United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 42

SEQ ID NO: 635 - DNA, 696403 bp, Homo sapiens
ctgagtggttaacgtttttatttcaaaaaacaggatattgtatatatcatttctgagaaaataattaaggtactataattaagttccatgtttttaaacacaataaggttatacagaatctctcaaatgtgagtttactcaaactttatttaaatatagcagaatttaattgggagttttaagtggtgatttctgcctctcacaaaataaaagctcttttacagggttttatttatttattttcttaaagtttacagctttaatatatgttacaagggtttaatcttttaatagagatattattcagttatttgaaaaataacggagaacatgattcaatattattcaattattatttaattgttcagtattgaataatcctttgggggttatacgtgccatgaaaagtacattttcctttttttttttgagacagagtctggctctgtcacccaggctggagtgcagtggtgtgatcttggctcactgcaaccgcagcctcccgagttcaagcaattcttctgcctcagcctcccgagtagctgggattacaggcatgtgccaccatgcctggctaatttttgtatttttagtagagacgaggtttcaccatattggccaggctggtcttgaactcctgaccttgtgatctgcctgcctctgtctcccaaagtgctgggattacaggcgtaagccattgcgcctggccacattttcctttttataaccaatgaacaacaaactaacgttgacacaaaaaggaaaagaatgatctcaaaatcttgtctcattcaagaatacagtgtgagattcaaggagaatacagtgtgagattcaaaacatattcttccctgaaaaattgcaactacttcccatatgcctaaaaaacgaaaacaaaataaaatgtggaaacacgtatgtgattcattagccctcactggatttaaatttctgtctgcagtagactaggctaaacatctgagccttttgttttattctggctatgatcacatgaacctgttttaaataaaataaaaactgttttaaaatgttaatttttaaacttcctgcaagatatctccttccaccacaataaattgatcagcattttcacatgaaatacatggtgtacacaaggaagtggaaaaaataaatttacgtcttttaaactttctggttctatgtagatacctcccttcctatctcttagaagcgtggatatcaaggtttactctgaaatgtctctctggaatctcatcaactcagtgcctagcaatgtttagcagagtgcatgtctcttttccctctttgtttctgactgctgttaagtccagcattaatttacatttaagagtttcagccacttaaaactttatgtctcctatattaaaagagggcgactcaatagctgaaaatttatctgcacacatagaagagaagtttccatcttgtaaagctaacaacattcatcattcaatattttaatatactatagaattttccttaaactatatatttttcatatgaagctgtcataaaactgatgagaatatcttctctgatttcaaacccatcaagttacgtttttaaaaactactttccaaaccccaggggcagtatacttgaaggggcaagtacatcagtgtatttagaaaatgagttgagaaaagtcaaattggattcctatttgaacatttattatgggtaccaaagaatccatctgactgaaaatgtaaccactattagcactaattgtagttatacagctacactgaagtgaagctgcatcccattatttcaatcattgaaatcttataagcaggttgtttaatttgtctcatcccactgtctatccaacagctttctactgtacagattgttaagaatgattcacaaactgttgctgccttcaaactatatactataaaaggtagccaagacataattgtatgttgtagcgaacataaaataatttgtggcttcaaaatatgtttttgacacaaagcctgcctgcccattgtagaaaattttgtcaattcatgtgaaaatatttattacctgcaaccatagatacaaaaaatcaatgtgtgtgttacgtaacattatgtcagtaatgtacttgttactgttttgagatttctttctttcttttggtctggattactcttctgccaaacaacttttttattttataccagcgcaagtgattgctgtactaaatttgcaattgtaatcataattttcctgggaatgctaaattatgtcttaattttattcaaaagcttttatttttaaagtaattaagcttattgttgattgatatttaccgtccaatgttccaggaacactaaaagaatacactttgtacgtaatcttccattatagcacattgcttgagagcagctatttgatataacagcattcagttgagttttcaaaccaaagaactaaaattatagcaatttcacttgaaatccataaatccatgcacaggattgtgttcaacagaatcactaaatgctatttgttattcaaagaaagatgaatgaatcaataacaaaatagaaccgataaatcattagcactttaatgcagagtggagagaaactaataaatcatgcagttcaggcactcgttttccttatggcatgtttgaaaacataaaacatgcaatgatgagatgcaggtcaatatgaatgaacaatattacaagactgctcagaagcatttcattttacatcataggcttaatgaaacactaaaagaaaagtactgttctgtgatttctttaaacagtcagagactccaactatgccatgaacaccttcaacagtgatctaggctgttgtttccaaataaacatttgaaatgtcataaagatgggagtggagtaggtgaggaggagggagctaattgcatgcatgattcgcttccaagagctcagtattattacaggtacccatttatactagaaataaactgatacaatcatttacttccttcaagtgtacttaactgatccatgaaaaattacacctatatttataaatgactgaaaaaagcaagaaatcatctattgagctttgattgtgttgtctggcttattgtctgtctgtgaaaggtgagaattttaatcataattaatgggcaactcactcgctttccagcattttagtcatcacaaaattaatcacaggaaccctaaatttgctccacaatgcttaattaattatgcattaacccatttctctcaagcattgttttctgaatctttggtgggaaacacattgattaggcacatagtttaaaacttctatttcgttattggtgtggttatgaattctctcctagattctcatgcagaaaggaacaaggcttgccatattaccacacttgactgtcaagtaacatgttttcacttatttctggaattaaaaagaaaactaagcaaaataaaaaccgcgttctatttttcagcatgagaaaaccttatgcctgatatttttatttccactcagaagagttaagatgttgaagaaaaactatgtatatatagcaaggtattgtagtcaactatttaataaaatcttcgaattaaaagtttctcctcaagtcataggtcactgatacactgattctaaaagggaaacgtatagcaatctgcaattatgatcattgtagcgttactgattagtgcttcgtaataattggaatcacactgagaatcacgtttcccatggtatttcctttttcatgtttcacgggtttttctcacaggttagtaaaaggaaattggggaagagttgggtgggagatgtaaaaatctatgggaatgcatgcaccaaaaatatgcagtatcacttcaggtaaacttctgctttcttcatgcaaagatgcctataaaaactgagacaataaattttctaatagctgaattttacattagcttagtaacaaaaactgttaaaccacttccatgattttgcatgagcaggagacttgaaatggttcaaagatttccagcatatgtgttccatggcccaattatgctaattcaatttctaagagtgaaacaacacaggattattccttgcttcggtttcttgtccttttgacgagggagcagaataaaccggtttttggaggcgggcccatcagcattggggcttggttcttgtgtgtaatttttatctagaaaaaaagagagagagagagagagaaagaatagagtaatctccagatagatacaataccaatttgtgagactctctgttaaggttaataatatttcatgagtgactgaaacaccgcaagtgtaaaatgtaatttcagagtttctattatttcaaaaatatttttaagggagatagggatatgtacttaaataatatcccagtgctcaggataataattttaaaaattatctgaagttgcattttaaatagtatgttacctctaacctcacttgtagcaatattccagaactgcttgcttaggttacatgattatccagtattatttcttgaccattagttacgtatcatttattgaagtcaggaaagaaggcaccattatagtttccagagtcctagttacagcccaatatcaagatgtacttggtatcaaggcaagccttatttatcttgctaatcagattgtttctctctttcaacatgaactgcaaggcttaatttccaaacagtcattagaaatgaaagttaaaagttaacatgcataaaaggtcagaaatgatgaactagctttctaatttgttaattaattggtaatataatagaatcaaatattgaaaagcctgcttaaaacactttgagagactgttctaaagctactcgttttgatttctttgatataaaactacgaatcaccttaaatgagacaaccttaaagtagattacgtctgcaattttctctaattcgactctaaattagagaagacattttatgaatatatgctatgctcaaagctaattgaaagcaattatcaaagtggcattttgtctgtgactttaagatacattgtaagataataaatgattctcattatgtaataaaaaggtcacatcttgcctttgggctagtgacgctaagagtttttcaaaagcaatctgagacattttctttagcgaactgcgactaatacaagaaccatcgcttattaaatatcagttgtcacctgcacagcattcgcatcagagatgagtatttctttcaaaaagaagcaccacctcattaaaagctgcaaaaaatatatctcttaaagtgcatacctgacattttcaagttaaaatgaatatccttcacttgtcattcactaatagcaatgaaacaaaaaaatgtacatcacgtggacaggatcattaaaatctgcagtggggcttttgggaaatggaaatttacttcacagtctagaaagacagaagtatgtgaaaaaccttgaaagaatgaacaactttatttaagtctgctggaatcaggttattctggaaggattcagtgttctctttcctgcaaaaataaattgcacctgtaaaaggccactaaggctaacccagcctcaaactctatggatatctgacttcatcttatttttgttatcttatgaactagggaattgatagttggatagttaagacaccagaatgcacttaactatgtagattgaaaatgatctatatcagattttctctcaataagtcagcattagagtatactgtaccttatgtcattgagatttaaactcctctgaaattctagctgtagacagggtctaatactgcatcattcatcatttattcatttcacaaaatttgttcagcccctactatgcttcagatactgtatcaggaactttgaataaatagacaatatacaagctctgcccccaagaaattataatctagcaggaaagataaattgaacaagcacattgaatggtgttacagatgctgaaatgggaggctaagcagaaaggcactatttttgaacattgaaaatgaaaatgaatcattttacgcacaaatgtcatttttaaatgagtactgggaaagcagttatcacatattacttacatgataaccttagattcaaacagaacattaagagctaaagtaagaaggttgagatttcgggttcataatttctggactaaatgctttacacggtataatagcattagggcattttgggaaattagatcattatttccaaatagttgttaagactatgaaagaaatatatcttcctagccatttatatatatatgttagtatcaatttatgacaaagcataaccaaaatgtcacataattattatctataagacttagcttcttctctgtgtttttttttggcgggggcatataaattttgtttatgactattcttatattaaaaactttttaaaaaaaaaaattacatgattttatgcctttgaaaaaatagcacagtatctcattcagtgctcttgacacaatgggacctttaatctatgtgactaagtaaaacacaagttctagtttgcagtcactaatcagaataatggccagtactattttaaaaattatatgtaacctgtcttcttgcttgtttaatcatttctacagtcaaagtacacaactgtttctttactctaactttatttctgcaaaaaatgaaatccacatcctttttgtctgttgtttatggaaacgagaaccaattggttgtattttcttctttgttaggggagaccacatggaggaaactagcattcagtaaatgcctattatgaatgctgtctcttcacatgccttatttcattggatatttacatgtcttggtatatttgggcagaagcaaaatcctacgagagtaattccaagccacatggattgtcggtgtcacagttacagaaattccaggtgtaggctctaggaagctgcagagactcaagtgaaccctcagactcaggttgctcatgtgggaaaatcctggttacggggggttaacagggcctgtaattatgactctgatgcctgttttgtatacattgaacattcttgctttttttattactcttaattttctatccactagagaaataacaatgagtaaaaattttatccccaaagaatttagaatatattaagtttcagcaatctgaggacatgaaccaaatggcctttgagtgcctccttctattaagcgtcaggtaattacttctcagttattccttgatacatcaaatattttgggggcactggctgtgaacaaggcattttgcaacatgattttggttgtttagtttctaagagactctgacattattatttgaaagaggatactgggcactcataaacagtggtgacggggctcctagaaactgcaatggttccatgacggtagaagagcattgcttacaacatgcaaggtaaattctatcagatacagaatggtgtcctcctataaaactcttccttctccttatcatgtacccttctagaaaagcaacagtggcagagaaaggttcttccactgcccatgactatttctacttctgtcttcctgtttcaaattaagactggccacttcaaaaactataaatacgaaaaatgtgggttcagtttcacttttataattattcaatatgaaataaggatgcacatatagaaaccagtaacagaatcaaagattacaaagcatagtcttcatcttcttatttctattacatttttaaggttgcatagtttgatagttgtgatagttccacctcatagttgtaatgttaagaataacagccagaataaaaaataacgttgatctggctcttactgtgtgctgagcattttgctaagtgttttacacacgttattcaggtgccccctatttcatccacctctttgagctgccctcaaagtccactcccataaaacatattatcagagaagagtgcaaaactgaagtagaatttcataaaagggatagaagagggtatttgtatctcacagcacatagcaaataatgtttattccccagatatttgtgttctcttcaaagactttgttcagcccaactaaaatcagagggaagagagatgggtcttccctgattagttttccagacagtatttggttcagctcgttggtgatttctttcttgcttccctgtcttccagcatcaaatatttccaaaccctttattatgaaaagtagcatttccctttcttttgttatctgaacaaccgctcgacatcctttccataagcatttattgaagcattctgttaagtttagaacagaggtggatctattttctttcaggaattcttgtacctgctattgaaattattttaaaaataattttacttttataatgtctaattttggcctcctaacaactctgggaggtagctgtcaacacccttattttacactgaaggacaaagagacttaaaagggttctgctacctgcataacatcagtcaagtgggtaaatgcaagagctgggtttgatagttgactctcaaatctcctgggccctccttgctaattcctacctctgcacctttgtgctagttattgccctagagagcattccctctcttttttgccaatcaaatttctatccctgtcctgcctagcttaaatcacacattattgtaaaatttcaaagtgaagggataaaaagaagattctaaatgtcctcagagagaaaaaaaaataggtcacttacagaaaaataaaaatcagcatggcatcaggcttttcaaaaacattagcgctagaagacaatgaagaaacaccttcaaaccccagaggaaaagttaattttatctgagaactctatacttagtcaatgtattgattaacttcaagggtagaatgaagacattttcagtcacaaaagtatctagagaatttgcctcttatgtaccctttaaaacgtatttggggtgttttctagcaaagtaaatgagtgagctaaggagacgagtcaaaaaaacaaaggattcaactcagatccaggatgacagatttgcaagagagctagacagaaacctaaagagaagggcttctggcatataaacaaaaggagtgtggataatagataaattgatatggtagagttttgtcttttttttttttttttttttaagaaaaatgagatctattgtaaggatcactttgcagagagaagaaagaaattctgaagctttacaggaaagaaaatgtgatcgtgggttagtacttggttctgcagttgacaatatttttatagtctgaatgattatatattttttattgatttaaacaaaattattatatacttctcagaagcagaacagcttaatggctgcctaggcccaccatttcctatctagggactttgagcaagttactacgattcatttccctcatcaatactgtagagcttttcatatagtgtctcactggtttcttgtaaggactaaatgaatcaatgtgcacgaaatgcttagactgttacctggtacaaaaaaagcactcagtaaatgttaactattagtaatagagtaatagaggtaaatacagtaatgtaagagtgttagaaaccacctttctatagcactaagtaagtagagtatacctaaaactaatccataaaaaaaaaacaaacaaacaacaaagcgtatttccagatatggagtaaataatcagaagaaatagtccaagaatcaaagtggtagcatctaatgagaagatctgttgacacagaaaaaaggacacaggatggctatttttcttgcaagtctatacattctgctttttttttttttcgttacacgtgcatatactattttggtaccaacttctaaatactttttaaaaatccctctgcaggtgattctcctgcactctagtgttttagttctccaaatgtgatccacaggctaggaacactgacatcattgttagaaatgcagactccccggtcccaccccagatcttctgattcagattctgctttcgaacaagaacgccagatgattcctctgtgcttttaaatttgagaagccctagcctatttgtcattttacttctcttcctaagtggcaagaccaataagaatctgttgactgactgaccaactgaataaatgaatgaatgaaagtccctttttctaggcccccaaaacacatgaaaacaaatatcctaacttactcaactttaattacctttattgttaatgtactaggtaccagcctaccttattttagtgtggaggattgcaagttgaatagatacatatgtatttttaaacctaactgaggtgcttgtagtataatgatgatagaagatatgtgatggtaggttgtaatatgctttgagctagggatattttcagggtacaataagattgaaaaaatatgccatttagatcatggtggagggacagtggcagaattaaaactgagttttagttacatcatctctctgacagcagagattaggggctggtgccataccagaggcatggagatcaaatggaaggttaatttgatccagaagagaagtgaaatagactttagtcagggcagtgccaatgggaacagagtggaggcagatttaagagagattgaggaggcagaagtacaggatacgatgggtgagtggatgtgtggggcactggaaaaagaggaagattttactgcaatttccatgcttgtggtcttcgtaatgtgtgtagtgatgctttttatagaaagagaagcgtttttggtaggggtgaaaaccaggaagttggtgaacctactgttgagggtgacgttctgaaggagatgctcagtatcttttgggtctgtgcatgtggtgttcggaagggagaacaggtcttgagatagatttgggtttgatcatcttataacaatgtcagcaattgagacgaaattactgaagaccagtggggcatatatgaatagcagatgttagactttgtaactggggaatgctgccatttaagagtgcagcaggagaatacaaacagtcagagaggtaggagaaaaactgaaagaagtgctatcatataaacatttccaatcagtcctcagagtgcctattaattaggcagtcttccattaattagggtgaaaccttcaaactacatgaaataaggtgaggcatgcctcggtttggtacaatggtctgtatgtccgtgatataaactgttaaattatttaacttaattctaaatatagaattattatattagagagtgatctactgaatgatatttaagtagtcattcatattgcttcaggggttggcaaacatgttctgtaaaggattagataataaatgatttcggctttgtggtctctgaactactcaacactgcccttatacagcaaaggcagttttgggctatatgtaaataaattaatgttgccatgttccaataaactctatgtctaaaaactgtaattttaattccatataattttcacattaggaaatattattcctctctggattttttcagccatttaaaaatatgaaaactcttcttaactctttggctacacaaaaacaggcagctggtcagatttggctcacaggccataatttgctgacccttgatataattaagtcaaacactgaaaattaaattcagaattatgaggcataaggtggtagaaataattttaatttaaaatcatgatttattgggtcaatggctaaaagatggataaaagtggaaataattttctttggcgtatctttattatactaagtgccaccattcagaaatcattctgtggaaattctgaattagaatgtatactaacattcctcaattttgataatgtaccaactgatcaaatttggcttaaatgcattctctttttaattaattctcattgctttgcaccagagtgggcttaataatattatggttcttcaaacatacctcagcaggtagcattttttcctattaaatattcaccctgtatctagccaaaaattttctccctgcttcatctctttaagagtttattatcactgaatttattcagctaccttaaaaatgaatggggttttcagagcaaaataaataccataaaatatctgtgagtagagcttaatttagcaattatctggaacactaaaagttacttagcttgattctggaataagattgtctccttctaataatggaaaccattttgaattcatgtgtgtagctgagccatatgacagcgggaataaagtacatgctaaatttttcaggtccataactgccaaaaaagcaaagcaatgaaacataacaattttctaaaatccttttgccagtttttttttttttttatgattctagccattattttctggaatgataatttccaagtttaatgttaaagtcttcgatctaacatcaaattcagagaaatcattgtgaagacttaaaataaaatccttaaaaaatggagttgggaggtttacttgccaattaaattcacaggaagtttaaatatgtatggaaaagagaacacttattcctgaaagtgatggactatttggccacattgcatgggaaatattcatacctggatttgaaatctcttttaacatataaattgtgttcttcattccaaaatatttttgtggctctaagttagttgtcagggaaggtcaaagacattttaaaagcatttttattatttccatgtctctacagagaaatgatcctcacaattttaaaccagtaactgttcatcttttcttagagtatctccaaatctgtggtcacatggaaaatagaagtcaaaaacataacaaaacaatacaaaaacacttcttttcttaactagagaatatttacaacttgtgacttgacttttcttactgagtaatatttcaactaaaattttctatatggcctttttcacgtagtaatggtgttaaggacatagacccaggacatgaggcaaggatttgtttcccagattagtcactggcagctataaaaccctgaccaaagaatctcagttttgaccttcggtctctgtttgctaaagtaatataacaatagcacctactttgaaagaccactacaaataccaaataaggctatgcatgtcatatacatgcttaataaatgttattatttttagtgttactatatttagtcccgtggaaacacattttgctaacccctcttctatctgagacaacacagctttctgtgttccttgggtggcattgggaaatggcatattatggccatctgccttctccctgtggcacctggcagcattcccgccacatgccagacaccaattttacccaaaagaaaggttagaaaaaaattaatgtggggcatttactaaccatcagagagcataattatttctgtttgtttgtttgtttaatcaagggagtccaataagctcacactgtcttattagaagaagaaacttctttaatggcccaatttctagactcagccataaccttggctatttggagcatcatagcactgatctgaaagactttctcctcaacgttaaactacatcatggtaatacaattggatacagatgttcaattttgataacttatccacaaaaaaattgccattgcttggtgttatgataattgatatttctaacaatgtgcttaaggcattgaatagggagaataattcagttgaaatagtactggattagagaggaaactgattgttttttcaggtcctcctgtttcaaggtattgtttcatcatttattcagttgttcaaaatgatccagaaacccagatcatccttgacaccttcttttccttacctcttataaccaataatctattattgactctaatcattttcatcccccaaatattttttgtatatcttgaaatttttttcctttttactaccatgttctaaggcctgaacaattatagaattcttctaaatggtcattacctctcccgccaattaattccccacctagaatgatcttgtcaccgtgcacatctactcacatcactttcctgttgaaacctctctttacttccatgttacccttaaattaaagctaaacatttctcatgagggctcccaggtcctgctgttctgctcccactggaccgtatgcctcaccccacgctgcctctcttctttcatgtcttccttctgaaccctgtacacaccaggttccttcccacactgtactgttttctctgcataagacactcttccctctctttggggcctagttatatccttctcctcttttagttttcaggtcaattttgagtttctttgaaagccttcctggaccttctacaacaagatcaaacacctctattataccctgtcacagtataatagtaccacagtaccgtagtatcacagttcaaaggatcatgaactttccttcacagaccttatatcattattgaaattttatatttgtgggactatttgagttatgtgtacctgcactgagttcagagatcatatctttttttggttcactttgtattgttttctctccattcattgtaacactaggacaaaatgtcagcagcttcatagagatggaattcaataaatgtttgctgaaagaatgaataaatgaatcactgatattctttttttgagatggagtcttgctcttgccacccaggatggagtgcagtggcgccatcttggctcattgcaaccacccccgtctcctgggttcaagtgattcttctgccttagcttcctgagtagctggaattataggcgtccaccaccacgcccagctaatttttgtatttttagtagagatggggtttcacatgttggccaggccattctcaaactcctgatcttgggtgatctgcctgccctcggcctcttagagtgctggaattacacgcaggagccactgtgcctggccaatcattgatattcttgacttggcttggataaaagagttgtaaattatatttatggatttaaaaatcatgtttaataatagctattttgttcacctcacagatttgtcatgagaatgatatgatataatctatcaaaagtctttgagtttttcaaaataataatagctatttatgacaaacccacagccaatatcatactgaatgggcaaaagctggaagcattccctttgaaaactggcacaagtcaaagatatcctctctcaccacttttattcaacatagtattggaagttctagccaggagaatcaggcaagagaaagaaataaaaggtattcaaataggaagagaggaagtcaaattgtctctgtttgcagatgacatgattgtatatttagaaaaccccattgtctcagccccaaaactccttaagctgataaacaacttcagcaaagtctcagcatacaaaatcaatgtgcaagaatcacaagcattcctatacaccaataacagacaaacagagagccaactcctattggcaattgctacaaagagaataaaatacctaggaatacgacttacttacaagggatgtgaagggcctcttcaaggagaactacaaaccactgctcaactgctcaaggaaataagagaggatacaaatggaaaaacattccatgctcatggataggaagaattaatatgaaaatggccatactgcctaaagtaatttatagattcaatgctagtcccatcaagctaccatggactttcttcacagaattagaaaaaactactttaaatttcatatggaaccaaaaaagagcccgtatagccaagacaatcctaagcaaaaagaacaaagctggaggcatcacgctacctgacttcaaacaatactacaaggctacagtaaccaaaacaaacagcatggtactggtaccaaaacagatatatagaccaatggaacaaggaacttaaacaaatctacaagaaaaaaacaaacaaccccatcaaaaagtgggcaaaggatatgaacagacacttctcaaaagaagacatttatgcagccaacacacatatgagaaaaagctcatcatcactggtcattagagaaatgcaaatcaaaaaccacagtgagataacatctcacgccagttagaatggcgatcattaaaaagtcaggaaacaacagatgctggagaggatatggagaaataggaacacttttacactgctggtgggagtgtaaattagttcaaccattgtggaagacagtgtggcgatttctcaaggatctagaaccagaaataccatttggcccagcagtcccattactgggtatatacccaaaggattataaatcattctactataaagacagatgcacctgtatgtttactgcagcactattcataatagcaaagacttggaaccaacacacatgcccgtcaatgatagactggataaagaaaatgtggcacatatacaccatggaatactatgcagccataaaaaaggatgaatgagttcatgtctttgcagggacatggatgaagctggaaactatcattatcagcaaactaacacaggaacagaaaatcaaacagcacatgttctcactcataattcagaattgaacaatgagaatacatagacacagggagtggaatatcacacaccagggcctgttggggggtggggggcaaggggagggatagcattaggagaaatacctaaggtagatgacgggttgatgggtgtagcaaaccaccatgacacatgtatacctatgtaacaaacctgcacattctgcacatggatcctggaacttaaagtataattaaaagaaaaaaaaagtctttgagttttttaagtctcctccaaagaaatatatgcaactgtcttctgaatattcgaggaaataaaaataataaactatgatattctagtcagttcatttttattaagcactttaagttcaaatttttatttaaaattagtattctatcccaggaagatccctgtgaaacagtggactagttctgtattagtgataagcaggctcactctttaaaattttcaacaatacagattattgccttttaatgaagagcttagaatgtggtagccttgttttctaattttaatacacaaaatcggagatcacagaaaattaatagttagaaaaggcaaggtcagaaggcaaatgtgagaggatagtcaggcccagaccttgtgagtctatagtctgtatccaccagcagaaagatttctaactgctaaaagcaatcaaacctgtgcattattattctgatgataaccatcaactgggagattatttccaattttgcacattccagaggaagatattcagtttcgaactggatgtgaatattggtcctcttgcaaactaatgacaaaattctgataagtacatacagttttatcatttttatcatatttacaggcttgggtcacatcaatataaatacataaggtattacatatctggcatatttctcatttaatttttaacctttcatgtttttagatattgtgtccaacatagatttggagttcctacatgagaatatgattatgagagatattactatctgctagccaaaatgaaattaattttttgaattggaaactaatgactagattaattcaggtttcaaaataaagaataaaagaaaaacttaaattcattgaacaatatttaaattgaatgcattaaagtgaagagtgacaaaaatgtaagtttaattgtaaacataacatttgggatggaaaacatttaaaatatgctatgacaagaaaaaaatctttaaaatatttttatacaaaaagcaatcatatctaatcagcttggcattaattaagctctaataatgtacttcagtatctttccaaagtagtatgatccatttcccctttatccaggtcgatttgtgcacattatggtgtcatcataattttaaaacatactgagaaaatgacagagctgcaaaattaaaataaatgattaatggtatttttttttcatgttttgtactaataggtattactgagcctttaaattaatagagctgtcaagctcacgggtgttacagatccagcaatgaaccaaaatggaaattatatattccagagacacctaaagatgacaccttggaatattttaaattttaattagtaggtgcaatggttttgttcccctgtaactactgcaaattaattggaaattagtcacaatcaatcctttttttttaaccaatctgaaatgaaaagcttggtgctttacatcttaacattgttgcttgagggccagaaagcatacaagcagtaaattgtgttgtcaattacaaaaaacaacaattgttatgaaattaggaaaaattatgcacaggtaaaccaaactaattaatgcataagtaacaggggaacacacaaaataatgtccaactaaacactgatgtgccagtctttggaaaaataaatgtttaaaattgtaaatttatgcaaaagcatttactaatgaagatttaggtaaaaaggtgcttttagtttatgttttatttaattgcttttggagtctcactaccactcacaccttaaaacatatactcacaagaacagcagtctgctcatgccagtatgtttcaagggggcagaagactattaattttctctcttcaaattatcaacatttaggcttattaaataacaaactggccaggcacagtgactcacccctgtaatcccagcactttgtgggaggccgaggcaggcagatcacctgaggtcaggaattcgagaccagcctgaccaatatggtgaagccctgtctctactaaaaatacaaagattagctgggtgcggcggcaggtgcctgtaatctcagctacccgggaggctgaggcaggagaatcgcttgaacctgggaggcagaggttgcagtgagccgagatcatgccattgcacacctgcctgggcaacagcagagaaactccatctcaaaaacaaaaaacaaacaaaaaaaaaaacaaaataaaaaacctcaccaccacaacaacaacaaaaaatactgtagtatttatttctttaacagatatctatagtatttaaatattaggcaaaatgcaatttctaggcacatcaggaaaatactaattatctacacctacctgttaaagcattttcttactgtttacatatgggttagtctttttctttcatcactaaaaatacacgttcttctgttgattttttctcccactctggtaaaataagccattagagcaacttaagattctttaaaaacggtgtgtctaccaagtcagcaagtgttgctacaatcgctgtgcaacttttaactagaaaataatattattttcacattttcaaaacaaggctactatccagataatgaaactggtacattaagaattatttaatgatatttaaagttaaagaatttaatgcaacggtcttgggagattcaagagttatgtaactatgcggataaacttcatcgcactatttcagagcactgttttcagtgcatctattctagatgagttttaacataattttctttttatgtaattatgaaagttaaacattatgataaaacaatgtccttctttaatatcagtttaactgtaaatgataatgaggaaacaataatgatgttgctacattttctgtaacactttggccgaatttcaaagatgtcaaatactgtcccactgtagaataacatgggtttaactttttgggggggtataattggggattacagggaatttagtctaaattatgaaaaagaagaaaattcagatgtattattaaatataacaatacttaatatataccagaaattaattaatgctttcttaatatcactaaatgtgatatatggtaattttcaacaaccattcaatatttctttgtgactcgtaggtagcaggttttaggactaggaaaataattccaagaaaaatattaaataactctccaaagtccagaagtcactaaaaaagcaaagacaagaccgtggattccagccctcatttctattttctgcccctttggatagtaatcttcctaagcagtttttcccctccttccttacagatatcccagaaaacattattttcaaggagtgaaaaatatttttaacctcagactacattgaatttctgttaaagtgctaggaaagttgactatttcagttgcagatgccaactttctcaaaataacttttaaaatagtagaacctagaataggttttaaataaaaatctggtaaacagaagttttaataaaatggctgagattctgtaataaaagagtggtaaggttgtacaacttactaatttgtttccagtcctctgttctgtgattagttaatttacataggaggtaaaaggagatccacctatcacaaaaaaatgcgaattctagctattttttaatttctcaaatttgccctattcctgctataaatcctttctcatgtactgtttatatttaggctttagtagcttctagtcaagaaacatagttctatccccaagttaaattaaaaaatacctattgtttcttgaactaaaaattaagatataagcacatagactatgggaaaaaagtgatcaacggattccattatattttccaatatatattatgtgaagtgctcatttaaatggtatttgaaatagaaaggattttcatgatattcaacttcgaatgggcctttgaaaggaccattaaaacaatctcttcttacaatggtttatgttgcttcttcacgtagatgccctaggctgtgtttgctaagtgtggaactgctaaagaaagccaaaatataaaggagtctcattggactactgtctgttttacacctgtgctcctttattcatcactgcacatttcagaaagcctcagaagcatggtatttcttcctttctgaaccttttatccttaggcaaacaagcttaacgaactgctgacaatttcagcaataataaaaggtaggaacagtcccggttctataactctttgtttcatgaccttggacattcacctaacctcatccgtatagtctaaaagtgtcttatactaacagataacttacttggaatagtcctaaaatgtgttcgcctacaatgtaatttaaaaaagaaaatctcatgtggtcatccacatcattactcgcctatagaaatacctaaaaccttaatcttataagtgggtaaaaacaactaaacttttttggtcaattattttctctcaatgtggtaaatgctgtctcaaactgcttaaatctggggcacaagagtagaaaaaatatcagtgatgttttctcaaattgggtatgttttaagattcaaggtttagggcatttattagacttatttagtatttttggaaggaatatgaaaatggggaataatctatgaaatctccaagtcagcacgcaggtagttctagctaataatatgccaatctgatggagagaatttagccagatctcaaaatagtcataaacaagaaaatctaatggtgtgggggtgtgggttccaatttcagttaagaaggaataagcactcttcactctatctctcccactgaatgcactataaaccctgggcagaacacatgaagcagatatctgaagttgctgaaaagaaaataataaaaggcaaattggggaagaagaccagaacatgaagtgccatcaaaccagtgatgagtttttagtttttagtttttttctctactcttgcacctcctggcctggacttaaaagcagaacaaaaactggaattgtataccaggtacagatagaaagtgccaagaaaaaccctgtcctactggtacaaaaataggaaagaagggccctacagatcagagtgaatgggaaaaatattcgttaatcaggccagacacagtgggtggctcatgcaggtaatcctaccactttgggaggccaaggcaggcggattgcctgagctcagaagtctaagaccatcctggctaatagggtgaaaacccatctgtactaaaaatacaaaaaattacctgagcgtagtagtgtgtgcctgtagtcccagctactagggaggctgaggcatgagaattgcttgaacccgggaggcggaggttgcagtgagccaacttcatgccactgcactccagcctgggtaacagaatgagactccatctcaaaaaaaaaaaaaaaaaaaattctgttaatcatttccatcccagtcctctggcaattccatggcagtggaaggtaattaaaactccaatggaggagacatcttttctctgactagagaaagtatgttcccaaagcatggggggagtcctactccttttttctctctctattcctttatcacagaaccctggaggcagatgctacttcgagaaatatatgacaaagtgaggaaacaaaagccttggattattggtcagagaaacaatatgagagccctgggagtaaaaaaaaaatatcagagagatcatggagaggaggtggcttgagaaagctatcctatgaagttgcatttgatcacctgagtttatcccttagctgtgtatgcatagatttgaccttaacaaacatactgatgactttgagagctgcatttgggggtatatcatcaccaagttttcagacaggcatatggatcttttacaagtaagatacatctgaataacattgcaaacactttgaaaaccaaacaaacatactggaaccacaactcacagaagatagagcagcttttgtaacctgaacctaacagagtcaactacctgctaaaatagtaacagcaacaacaataaattaacatttcctgtgagaattgaaaatacctagagtcttataacacaatattaaaactgttcagaatataataaaaagtttctcaagatatgaatcacagaaaaatctcaaaaacacacaaggggaaatatagccaatgatgcaaaccctgagatgatacaattgttggaattaacaaagacttaagaggtattataaccatgctctaagaagtaatggcagatactcttgaaatgaaatgaaagacagagagcctgaactgagaaatagaagatagttaaaaaatgaatcactggaaattttaaaactgaaaaatacaatgaacaacataaaaaataactgaaaggactcaacaacagaatggagataaaagagaaaaatgtcagtgaattcaaacacaggtgaatagatatccaatgtaaacaatagaaaatatagaaggaaataaaaagtgaacagactcaaagatctatgagacaatacataaagtgcttaacacacgtcatcagagttttagaaggagaggagagagtgtgtggcgtagaagtcaatatttgaagaaataatagctggagatgtgccgatgtggcaaaacatacagctacagattcgtgaagctcagtgaaactaaaacaagataggctcaaagaaacccatgcccagactcatcaaagtccaactgctgaaaactaaagacaaagaaaaaaatcttgaaagcagcctaagaaaaatgacgtattacatattgcaaagcaatgattcaaacgactatgaatttcttatcagaaattgcactatgtaagaagacatttgcaaagtatgaaggggaattaaagatgaaatttaaaaatgcttacaattaagtcagaagagctggatgcaggcatgcgtagccgaaatacaagtctgtgaattggaatgctgttaagaagatatcaacagagtcacaggagtacaaaggatcaggcaaatatttctgacagatgggaagttaaaaaggcttcatgaggaaattgcttctaagcttggcattgaaggaagagattttattttatttttagtatgtatgtatttatatctcattgccttccagaaagattttgaagtaacttataaaaatacatatatcccaataggacagaataattaattcaggcaatctgactaaaaggggaaaattatgtgtatgaaattaataaaccataggtaagactagatgaaagaaatgcaaaccatgggccgggtgcagtggctcacgcctgtaatcccagcactttgggaggccgaggcttgtggatcacaaggtcaggagatcaagaccaccctggctaacacggtgaaacccagtctctactaaaaattaaaaaaaaaaaaattagccaggtgtggtggcgggcgcctgtagtcccagctactcgggaggctgaggcaggagaatggcgtgaacccgggaggtggagattgcagtgagccgagatggcaccattgcactccagcctgggcaacagagcgagactccgtctcaaaaaaaaaaaaaaaaaaagaaatgcaaaccatgagtcctagataactactggaagaagccacagatttggaggtagcctgcctggagaccagaagaatgaatctatttctaaagcacaaaatagagggtaaggatttgaggcaaaaaacgaagtactatgcatggtaatcctctgggaagtggttcctatgaggcatagcagtctggtcccggccttgggagaataatttaatgtcatgacaaagattctgaacttttttctgtgtaaaatgaggaggcattgaactttgagatcaagggagtaagatcatcatagctgtgttggtcagtagtaattctggcaacaatatgatggatagctttggctgcagtgggaagcaaaatatgtattacataaaaataaataatataaataagatgaaaagggattttctgttttaaatgatagagttgtaattaattattagtattagaaatacattaaggcagccaggtgccatggctcacacctgtaatcccagcactttgggcagccaaggtgggtggatcacctgaggttgggagttcaagaccagcctgaccaacatggagaaaccccatctctactaaaaatacaaaattagccaggtgtggtggcacatgcctgtaatcccagctacttgggaggctgaggcaggagaatcgcttgaacccaggaggtggatgttgcggtgagccgagatcacaccattgcactccagcctgggcaacaagagagaaactccatctcaaaaaaaaaaaaaagaaagaaagaaagaaagaaagaaagaaagaaagaaagaaagaaagaaagaaagaaatacattaagcctctgaagagtgactgagtgaggcagcaaagcatcataattaagagattaaaacccaatggcctatttctgccttttgctgtgtggccttgggcaagttacttgacttctctggcttcaggttttttcttaaatttataatatggggattataataactttactgacatcttagggttgctgtggaaattaaataagtaataaacatgtacacatacaacagaaactggtacatggtaagcaaggtaaattttatatctaggtattgtcaccagggtttcctccaaatatctccaggctgttcttatgtcttgaaaaatccagcaacctttgtctagttgatattaacttgctgggtcttgaaaaacttaaatttatacaaccttttcctttatatcttaatggcctgagattattgtgtatttagcaagcgattaaagagtaactaacactttaatgttatgatcattttaatgatttgaaaaaacaaacacataaacaaaaaatgtaataagctccagaatactgtttttctttttgaatagtctgtattttaaagttatggtgggatgtgtgaaaagaagtgtcaaaatgaactctagataactgcagtagctagagcaacagagaaaagaccaagtcttcctagtagaggacacaaacaaaggcaaagcaagcagtcagtgtccaagtcaaggaggtgctagtgtcagggaggggaactggcagtcaagtcagaaaatagcatctcatggaatgggtcacacagtagaagtctgggcagtaggagacaggtgctcatagggtacccaggatttgaaaggatcatacctaagacagcaagactagcaggcttggtggggattggtcccgcaccaggtcagggctcaattgcacaatgaaggtagttgtaagctaagactgggcaaacaggtttaagatcttaagaggtattatgccagggaaggtacagaaaaaaggcaaagaggggttaaaacatacataaatgttttctagaagttgccgtggcctcagctatcactttgtagagtcttcttagtctacctgtgatcatttcactatttaatgtataatctgttcatgatttcctttccgttctctaccacatggaaggaagtttcaggagtttttttctgtcttcatcataaacaaaatacccagagtaattttgcattaaaatcttgttggcactacttttcataaatgtgtcatgagtaataatacatgcctattaatatttcaaataattaacagaatgcagctttttgaatgtgcaaaagcaatgtataattgataatccagagggaagtggcccaaagaagtttaatcataccatacaggaaatagaaggattaaatcttttgagattgagaaagaatttcttctctgatacattcaaattctttgctttgagaatataatgaataaagataactcaaaataacttttacatgtatttatatataaaaatatgtgaatgaattgctagccaacctacattatgttcagtgaaagaagatttagtagaaaaacactttttaaaaatgttatactaccctaagaagtatttcagaaatttgcaaattcaaagtgcatttggtattggcaatctaattatgtgtgaggtacagtgctacgctctggggctaccaagatgatccaaatcatggtccatgacctcagtaagcctgtgtctaaaaggagctggacatataactgagaattccaacgtaatgttgttattgttttgataaaactgaaacactgaggctgagcttttaggctatttggagaaaaaggagtggagaagtggaaggaggggttgtgctcagggaagcatttatggaggagggacagcaaggaatgagcctcaaaagatgtgttgtgttaccaaactaaagaagaggaaaaatttgtttggacaagagggaagcgcatgaaaagactttttaaaaagtaagagattatgttggtaaaacaggaagcctcactcaaaccacattttatcagacagagagtaactaaacaatattttaagtagaagagtgccatggtgagattcatattttatagtgactattctgatagaaatgtgaagcatggacttaattggaacaaaaattgagatggggaaatattgatgtggttttgccaggaatgagagagaaatgaattgggccaaatctaaaacagtggttaatagggagagaaagaaaggaaaagattccagaaataggtcatatcattatatggacacgtaaattggatttgagggtatatagagaagtacaggatgactttcagatttctagcttaggaaacaccaggtgtttcaatggtttcactatctcagtatgatagagggaagaatcgcagatctaggatgtgagaagacctcatctggggaaggagagatatggggaggcaaatgatgagtccattttagttgtaataaatttgaggttcctgaggctttgaatagtcacttctcacttaaactttactggtcatgtgtcacttaaaataaatgggtagtaaaggggtgctggttgtacagatacaaaataaaatcttacctagtctatgtcctctcctatcctaccactctattccctctaccctccaccccaagctgctctttcttcttcccattataagaacatattgactacagaatcatatgttctacatgctcaggaggaaggatgggggaggaagaagaaagaataaaatagactctggagtctggcctaaagacagctcttctaagacaattttcaatatatactctcttctagaattaatattgtctttagtttgatatgcttattatcacaagcaatagttatatggctaaaataattgtgttaactcagtgactattacaaaacaatgaatacaggagcacttaaaaatttatgttgatggctttacagtgacagaatctagatggtcctaaaaataattaccaagtgcatatttgaagaatgagtactaagctctttggttttttcttttcctgatctttgaactcaatattggtgaaatttataaatgtatcttacattaatttttctattagtgacttttttattgtggtaaaatatacataacataaaattcaccacgttaacttacatttttaagtgtgcagttcaatggcaccaagtgcaatcacattgttgtgtcaccatcactacccaccaactccaaaacttgtattatcttgatatttaagcattaattgatatttctgttttatatattctactaatagaaaaaacagaacttctgctctcctctaaaattatgtctagagcaattctttcataaattgaatatcagcttacagatatttaaattcagcagagaatttaaacattgtagcattcttattttctgtaagaaaaatattgggttattcaactgaagcaaaaaacgctccatagttaaccataccaatgctatgaatactaaatattctcttcaattacagtgaaatttaaagttcagaaccccatgcggctgtgggaaaagtagagtatgccagaatgtaaaatcacaataatgagccatagtctactatgattcttggcctactgtaagctgcaataaatgttttaaatgaataagtgagtttacaagggaagaaaattaatataagttacataaaatttttattaatttaacaattgtaagtcatgatagttaacaggtgaaatgaatgtcttattacttattgaaataaaaattaacaaaagtagttaaaagtgcttgtgttaaacaagcttaaattattctaacacattaattaaatttcaataggcagacattttcaagctggagaagcttgaaaggtagtcagggagaaaggtagtccgtcatttaccaaaggtcacacactctggagggagatttccagcatgcaccggggccattttgtgttgagcttcacagtaaggagcagagatgaagcgtgcagatgctggagtcagactacctgggtttccatttctactttgctatttattagctgtgtagaattagatgaactatttaacctttgtcttcctcagttatttccttcataaaataaggctaaccatataatttttgtgagaattaaatgcatcaacatgggtcaagtgtctccaactggatgtacaggacattctaagaactttttttaggatattaccatagctgtgaccgcttctcgactcaaaacatggaataagggctaaatgcctcttctcctgagaagagtccaaaataatacaaagagtattcatggacgctagttggttttatttctttgatttacttattcttttgttaccaaggctgatgaaaagtgacttttcattaaaaacaccgctaccaaccactactgtcttgcatcacaaccaccaccattgcaactaccatcaccaccattaccacgagttttaccactatttccaccatcacggtagcagctattacccccaccaccatcataaccatcaccacctctgcaatagcatcaccaccatcactatcaccattatcatcactatcaccatcaccatcattaaaaacaacatttttaacatccatgtgaatagaataatgtgaatttagaagtgtcatttggagagtgaaggatcacagaaaagatgtatgtgtacacatactggtgaagggaggaaaaagatttagtgttcaggcagctaaaggaatacaccagaaacaaagatgaagtaatgtttatgtgttatacacaacgtttgagccagtagtttcagagtaaaaccattacaaaggtaaaatgaaaaattccttcttacatgctaatctgtgctgtttgaaatctgtaactaaggttgtttacagtagtggttgagagaatgggctttaattaaagagtcttggattttagttccatatctacttcatacctgcccttgagtatgctatttaacctcccagaacttgtattttctccatctaaaaaatggtggttccattatttagaatttgtgtgaatatttaatacatactcacatataacataagcattcagcacaatgcttgtgcaagattaagaccttcccctgttgccctctaatcagtttctctccaaattttaactactcagtaaatcacactatcattcttaggtaagagttgacttcaattcagccctttctctcctccacctcctgcacccccaggaactcattaataaatttttcctgttctacctctggaatatagcttacattcatccactttgattttacttccctgctgccatctttgcccaagcccagagtactaggatagaccaatctctcagttgctgctcaatacaatcaatcctccacagagcagccaatgtgaacttaaaaaaatgtaaatcagatgatgcttaaagttttcagtagtttcctattgtacttagaatcaaaatttagctctttaccgtcaattttttttctacatgatttgttctctgtctaccttttctacttaaactcttaccattctcccctaattctagaagctttggtcacaccaccctccttagtgtcttttttttgggggggatggaatttcactctgtcacccgggctgaagtgcggtggcacaatctcagctcactgcaacctccgcctcccgggttcaagtgattctcctgcctcagcctcctgagtagctgggactacaggtgcgtgtcaccaagcccagctaagttttttttttattttttttaattttatactaagcttttggctatgtcctttcaaagaggtctcccttatctcaagtagtatttattctccacacctaatccagcttcttatcatcatttcaccttattttttaataactctcacagtctgaagttatatttatcatgtagttgtttatttattcggtcctctattataggaatgtaagtaacttgaaggaaattacactgttggtcttgttcatgtgtctactcccagtgccaaaagcagttcctagcatgtttttgaaatgcaataaaatattcactatgcaaatgaaaactgatttttttttgagaggggcagtgtctgccttaaataatacctcattctggaaaacacaattaattatggtagaaactggagagaaatttttttcttatggagaagaaagccctcaaatccccaaatggaggcatagaaaagctgagaaataagttcacatataagcttaggtctgcatttcttgcaaataatattctaataatgtgctctgaaataaacaaaaaagtttcagataaacttttattaatattttgtttagctccatagtttataattgatctatggtttataattgatctatttaaaagatctatttatacttaggctaacacaaacattcaagagctaaatcattgccaagggtatataatgtctacaacctaaatgtagtggctctgacacacacataacaacaacaacaaaaagactatttgctgataggttgaaaagaaataaagaaaaaaatcagttattgtggttatttagtcaaagaggaaagcaaaactgagattgacatagcatatcaactactctgtactcactgtgcatggggtctgcatccatggctccccatcaatttgcattggcagagacttgctcgtcctgggggaaaatatttcattgtaagtattgcaaggaaatactttatattacagactatatgtgagatataagatgatgagaccagggaaggcaatatggtaatagttgggctctaaatttatctccaatgaaaggagcttcaactctccactattaataaataccctgaaaagtaccttagtcacaggaatattatgagcttcctggtaagtgtagtgacatttaaaaaaattctggatgccaaaagaaaaatttcagggtttatgtttaatgacacgatcagaatttctacagccaaaagagattccttgtttttataaccctacattgcaaactgggagaaaggtgtttctcccagttcttctagcaccaacacttccagataaataacatcaattattcctgtgctacaatccgtggcttcacctgggcagatcacgaggtcagtagtttgaaaccagcctgaccaacatggtgaaaccccatctgtactaaaaatacaaaaattagccaggatgtgttggcgggtgcctgtaatcccagatactcgggaggatgaggcagaagaatccttgaaactggaaggtggggttgcagtgagccaagatcgtgccactgcactccagcctgggcaacaagagtgaaactccgtctcaaaaaaaaaaaaaaaaaaaaaaaaaattggggggaaattttgggcaaaaaaaatgcttgaaaaagttaaaatttaaaacatatataaaatcttactgtggcactttagtccatgaaatgatttaagtcaatggtgtctcatcattgttttcatagataatttgcccagtaaatactttggtgcttcagtagactaatatgagtataaatcataaaatttgtatgtttgaattcgtgcatcaatatgtccatggtagtcaacaagagagaatcagattccaacaaaccatatcagtaatagctaaccaatattttagacaatctgccaatgtccattattttgaaatatattagtattaataactgattatttggagcccaaagaagacaatgttactatcagagttctgcatacttttaattagtttgaggctatgccatatcaaacgcctttgtcagttacagaaagggaactacctgatgaccacgcaggagcactgagccagccgccggccagcacttttcaggcctgtgtatatttgccccatctccatggctccttccaagccgaccacctccagcagctggtcactgagatctgaaagaaagtagatgccttttaagttgcaatgtgtatacatatgtccacaatttaatgccatttgatattatggagattaaaaaaaataacagccacttcacaaagaaagcttgtcttagaaacttaaagtaataaaaagatggcctacttttataactctcagtttaactaaaccttgaggttctgtggaaaatgatttgctgtcagcttattctaaaacaaaatgggaagcacagattctgagccaaataataccaaaaaaaaaaaaaaaaaacccagtagtttttaacatcaacaaacttaatgttattccacatgtatataaggaccatttatacatcccacatcagacatttggcagcaaatacacatttcaacactataaataaaatatgaggatatgctgtcaaacatgattttgttaaattacttgaacaagagaccttggagatcatggagttggagcttctcattttatacattagaagatgggagtccctaaatctttgagtaacttgtctgtagtaataggtaactgtacagaagttcaagaaacaatagtaattttgtgaaatgtttttccgatgttaaggaatattctacaaaatactgtttggtagtatactagataattagtcccatgcaatcattattattaaatttttttttagcagaagacattaaaaaggggctaatagttaagagttgtcgcttgttgagtatttactaggactaattactttatattatctcatttgctcctgctccagaccaatttaagataaatgtgattctcctcatttacagatagagaagctaaacattggagatgttaataattattcatattcacatacctagaaagtgacagagccaaaaagtgaacctaattgctttgatgcactatgctacatttgataaatcaatcatatgaaaaggacagaatttacaacgttttagaaatcatcttaacataaaggtggaggttggactgcgtgagcttcaaggttcctttccaatctgaatatttgcattcagccagaaagcagaagttgaactcacatcaatagaatcccacacagtcctgtcccaagactcagtgacagcccatctgctcacctatttaactcagagtgctgagacccttgatttggaggccaaagtctaggtgcatatatatggttcttttccattgtaatattcttatgtgtttttgtgtattttcaaatataaatacacaattgtacattgtttagtagcagaaaaactagaggagtggaatacggtgggaggcatgattattatacaagaaagccatgtaatagttggtcatatttgaggtcggactcatagaaaaacaagcaaatgtgttttgtagggaatccactttgtacagaaagtgctcactcctcactaatgactccattttagcatagagtttagagatgctaatgatttattttcagtgtagttcaactgtgtggcagcaaatagtgctttgcaatctccaagttcgttaagcccaggatcgtaggtaaatttaataaaagcactttaaaaagaatatgcaaccaagccaccaaacttttaagtgaataataaaaatctattatttttaactttaagctgtagctgtagcaccggattactccaagtaaaaacaatattttagctacaaaatcaaatgttaacttagagcttccaccttgctgttctaaaccccatttagacttatttctcatgaaacttattctgtgtttctagtttaaattcatgttgccaagaacagatggacaaggaatggaaacatattctttcagctgtagccggcactaaaatgtgcttggctctatagcctgggtgttaatatacgcatttcttagatatatgtcaaccagaaaacgacattgtggcaagcactgaagccccagatgtgtgcctgctgatatttataaaacaacaactaccaccacgatgatcaccaccaccacaggactggagttcgcatttagtattgtagattttgcacggcctgattcctaaataggtagaattctgtgttaatttctgcaatgatctgaaactggttgatgggaaccattctataagaaatgaaacactttctcaagacagagttaatctgtgagccctaactttttcatgaatcacagggatctgtctacacccacaccatattgctactgtctaccaccctccttctgatttttttctttcttttaatttgtctttgtttttctgcatgcaaaaatgccttgaaaatcaattctgctgttaataatcagtaatgaagatatttctcatagacttagaacacccaggcttttaaactttcatgttcttgctaacacaaataattttataggaatagtgccatctttactaactctagcaaaggcaaataaataccatactccttttaattaggcattcagggagagaaaacaaaaacaaaatgaaactctaaatttgtgttgcacgaatttgcccccataacacttccacattttttgatacagcacaatctgcaatctgtctgtatacaattgatgccccctacctgttaatctttgagatcagggtcctgattgatttcagacagagagagtttctatctatgcaattttgaattctgtttctatatgtggtatcctttggaacatcagacttcctcacctcacattctagctaagagttattttaagaacagttctccttgggatggcctaaccagctagatcaacctatttaattggtttgctacctggctgctggcttcatatttaagagtgtgagcagcaaaagatggcctatggaccaaatctggcccctagccctttttgtatggctcacaacaattaagaatggttttatatatttaaaaatataaaaaaataaagtactataacatctgaaaattatataaaattcaaatttcagtgcccatcaattagtcttcattggaacacagccacattcactggtttaggtcttgtctatgtctctttttgtactacagaggcacagtagagaccatatggtcgacaaagctgaaaatatttactatgtggacctttagataagtttgcccacctatgctttagagaaacatgaacactttcaggtcactaaggttgtcactttagtactgcagctataaatgctaaatggcaatttattttttagtgcctgaaagacataatgttccagcattaattccacagtgtatgtaaccatgcatagaacagctgttctccaccagggagtctcaccacacttgtgtactatgagcattgccacaatccattggttatttatcacggaacaccaaaagtttccaaataattttattacaaaagaaagtagaacagtttaacattcattagtgtgctcaatcattgcctctggttggcttccttgagtgtgagaaaaagaagaatcatagataggaaggcagaagttgcaaccagacctggagattcaggtgggaaacagctctaccttcaaaagttaagtgtcaagaactgtgaaatcctgacaccatgatactgaaatccatttgtgtctatctagaggaagacgttgcttttgttcagtttaatgttataaagtatacttttgaaggaaaacaaagtacgtttctgaaagcatttatatgtctttttaaatacctccatgggagtaaacagagacaagctttcatattaggtattttcacatttaaaacagaacatctataaaaggtatttcagagggaagaaacttaataaaatcatcaaaattgggtcatattggatcaagattcttaacacatggtctgtgaatctgaataggaaaaatgcaactttattttcactaacatgtaattgaaattaagcatttctttcaaatataaatgtagtcaggaatacctgtgactttgtcactgataaatatcacgttatagttgttacaatatttcctactttaagaaaagataatacgttttaattatccacaataccaaaatatctacaagtctctataaaataaaataacacattaaattttattttttttatttttatcttatgtaatttttcaaaatgttatttatattcattatgtcaaattttaataattattgaacttctagattttaatttgttaataagaaagcatatatatctctaaatcaaaatttctaacagcattttaatctaatttttcatagaaaagcatatatatctctaaatcaaaattttaacagtattttaatataactgactcccttttttagcctacgtattttatcttataaattttaaaacattatgtctgagaagagtcagtagatttcaccagacaggcaaaaagactatagcacaaaaatggtaaggaaccctactttagaatggaatttgtcattttaaagtttataaatctttataaactttataaatctgtgaaaataattagtgctgcattcatctgttacacaggtaatcagggatatgaatgtaaatttgaaagtcaggggcacatatagattagaggacacacgagcagctcagctaataagtgggtaatatttattcatagcttagtcttcatttttgacagttatgccctgataatatgtctcattatgtaattgtttcagactgccatatgtgaagaaacagaagagaatgcattacaaacacagaatgaatgtgggttgtagcatttcgcagaatatagtgggtactgaagaaagggggagaaaggctggagcagagtagtataaacccctttgtgcagagtgtccagcaacattctgcaccactgtcagaggccatgtggaggtactcattgactcagcaggagcattttgaaatcaacataaattgctaattataatgacacttattgagccattatttggccatagtaagaccaggctagctatggagttgtaccttttgagtgtttgtagattgtatgccttccagtgatgtttcatttatctagcaacattatgaaacatgtctgaggaccaagaataaacttttaaaaggccaaggaacatatgaaatccattcactagagtgaataattcaatgattcgtcttcaaaatgtccatctacttctaattgattcttaatttagatatacttctcacaagcataaatgcctgtttttcctgacctacataacccagaagacataaattttaaaagggggtgggtaggaagagttttagcaaaaatttattaatataaactgtgtttcagagtacaagtatgtaaaacataaaggcaggctttttgcacctgaaggaacatacaatccaattgtaggtctattaataaaggagaaactgtatggggaaggctaatatatctactatatgcctgctatgagcaggctccctgctaagggatttataggcatttttccatttaagactctcaacagtcctttgagataggtattattctcctcattttattgacagggaaactatgtcacttgttcaagtctttacatagaattgaaaatctggttttctaaataggtatgcttgactctaaattccatgttactgtgacaacagtaagaactaaccaattaaatgttaacagttctcttggatcatcatggcggacaggaggcaggactagattgcagctccagacagagcagctcgcattgtaaattttagctcaatagattgcaagaacaaaccagcaatctcgagaggacacacagacgctctgacggaagtggactgctcctgcggagcctgggagaccccccaaatactgagtgcccaactgaggaagtggaaaagggagaccctcctctccccatcacatgcccccactagagaagctgacagtccatttgcaggagaagtttccggctttacttggagctgagtcaatttggaaagctaagccaagtacaggggtagaggaagcagcagaaaggccctgggagctcctggagtcccctaactggccgttcctgcctggcaccataccacagggatccaacgggagggtgaccagaggagcagggggtaaaactccacagggagaaggaaatctctagctaaactttgtaacaatttgaacggggtgggaagccacctggctagaactcaggagagggcgcaaatctggtgtgcaaactccacaggcaggggaagaaccaagaccttttctttcgcagttgggaggtgagttttcaggccggtctcaccttctgcctggaaactaactcgggtctgttcgtgggggcacggtgagagttagaacgggccttcagtttgcatgggagctgtgtgaggcctgtgactgtgggctttcccccacttccctgacaacctgcatgactcagcagaggcagccataatcctcctaggtatacaagtccagggacctgcaaatctcatccccatcccccatgctgcagctgcagcaagacccacccaaggagagtctgagctcagaaatgcctaaccctgccctcctcctgattgtctttccctactcaccctggtagtggaagacaaagggcatataatcttgggagttctagggcctcgcccactgccagttcctctctggaaagcaccacctcctggcaggaggtgcaaaaaaagcattggattaaatccagcgtctctttatgattaaagctctcagcaaaatcggtatgcaagggacataccttaatgtaataaaagccatctattacaaactcacagccaacataatactgaatggggagaagttgaaagcattccctctgagaactggaacaagacaaggatgcccactctcaccactactcttcaacatagtactggaagtcctagttagaacaatcagactagagaaagaagtaaagggcatccaaatcggtaaagaggaagtaaaactgtcactgtttgctgatgatataatcttttactttgaaaaccctaaggactcctccagaaagctcctagaattgataaaagaattcagtttccagatgcaggattaatgtacacaaatcagtagctcttgtacacaataatggcgaccaagtggagaatcaaataaagaactcaaccacttttacaatagctgcaaaacaaacatcttaggaatatacctaaccaaggagtcgaaagacctctacaaggaaaactgcaaaacgctattgaaaaaaatcatagatgacatgaacaaatggaaacacattccatgctcatggatgggtagaatcaatattgtgaaaatgaccatactgccaaaagcaatctacaattcaatgcaattcccatcaaaataccacaccatcattcttcacagaattagaaaaaaaaattctaaaaatcatatagaaccaaaaaagagcccacatagacaaagcaagactaagcaaaaagaacaaatctggaagcatcacattacctgattttaaactatactgtaaggccatagtcaccaaaacagaatggtactggtacaaaaacaggcacatagaccaatggaacagaatagagaacccagaaataaacccaaatactacagccaactgatctttgacaaaacaaacaaaaacataaagtgggggaaaggacaccctttttaacaaatggtgctgggataattggctagccacatctagaagaataaaactggatccttatctctcaccttatacaaaaatcaattcaagatggattaaggacttaaacctaagacctgaaactataaaaattctagaagataacattggaaaaactctcctagacattggcttaggcaaggatttcatgaccaagaacccaaaagcaaatgcaataaaaacaaagataagtagctgggacctaattaaactaaagagcttttgcatggcaaaaggaacagtcagcagagtaaacagacaacccacaaagtgggagataatcttcacaatccatacatctgacaaaggactaataaccagaatctacaagaaactcaaacaaattggtaagaaaaaatcaatcccatcaaaaagtgggctaaggacatgaatagacaatcctcaaaagaagatatacaaatggccaacaaacatatgaaaaatgctcatcattactaatgatcaggaaatgcaaatcaaaactacactgctataccaccttattcctgcaagaatgaccataatcaaaaaaataatcaaaaaacagtagatgttggtgtgtatgtggtgaatagagaacaattctacactgtgggtgggaatgtaaactagcacagccactataaaaaaacagtgtggagattccttaaagaactaaaagtagaactaccatttgatctagcagtccctctactgggtgtctacacaaaggaaaagaagtcattattcagaaaagatacttgcacatgcatgtttatagcagcacaattcacaattgcaaaattgtggaaccaacccaaatgcccatcaatcaaagagtggataaagaaactgtggtatatatattcaatgtaatactacacagacataaaaaagaatgaattaacagcatttgcagtgccctggatgagactggagactattattctaagtgaaataactcaggaatggaaaaccaaacgtcgtatgttctcatggatatgtgggagataagctatgaggaagcaaaggcataaggatgatacagtagactttggggacttggggggaagagttggagaggggcgagggataaaagactacaaatatagtgagtgtatactgctcaggtgatgggtgcaccaaaatgtcacaaataaccactaaaaaacttactcatgtaaccaaatatcacctgtatcccaataacttatggaaaaataaataaataaataaataaatgttatcagtgatggaagagaaaaaagtgctacaaaggaatacatacataacaccttaaaatagtccagcaaacagtcctaccaataaatcatttcaaatgtaatcacaaaattaaaatgaagtacaaagctcccatttataataccatgtggggtaatgtatgaagaatactctggagaagctcagtaagaaagctaagagcctggccctgctgtactcacatgcacctctgcctggcccaacatctggttcagcagcagacaaacctccctggacagatagccacaggcctgcttggcatcaccacacctgcacacacctgagcccagcctgacagccagtctgggtggtcccatttccctgcaaataccattgcaggaatgcctggcaccattgctctcatgcttggtccaacagctggtccagtgataattctgctttcctagacagattgccacagagtccaacaaccagcctagcgctcctgtcctcagcaaaactacactgctgccatcacaaacgcctgcagcctagagcactgaggcaatatatatcactgatgaggattacagctgaagaaactgcatgaagactacagtactgagtcgacctagagctaaagccaatgcaccacatttaacactaggacttgtttacaggaaaacatttatccctacaaaagctactccataatgttggaaaaaattgactacacaattagattcacagatataaatgtagggacacaagaaacataaaaaagcaaattaacatggcacccacaaaatgtctccagtaacagactcccaaaaaggacattcatataatatctgaaaaataaattcaaaattatgattttaaggaaactgagcaagatataagagaacacagagaaacaattcaataaaatcaggaaaacaattcatgatccgaatgagaaattcaacaaagatgtatataaaataaaaaaagaaccaagcggaattggagcagaaatattcaatgaatgaaatgaaaaaaatacataactgacagcttcaacaacagacaagatgaaggagaagaaagaatttatgaacttgaagacagatcttttgaaatagcccagccagaggaggggaaaagaaagtagaaataagaaaaatagagaatgaagaaagcctacaggacttatgggacaccatcaagtgaataaattttctcataataggagtgtcagagggaaagagacggagaaaagcacagaaaatttatttaacgaaataatagctgaaaaattcccaagtattggtagagttatgaacatccagattgaggaagttaaaagatccccaattggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagcctagatcccgccactgcactccagcctgggcgacaaagcgagactccgtctcaaaaaaaaaaaaaaaaaaaaaaaaaagatccccaattacattcaatccaaaaaattctctctgaggcatattataatcaaaccgtcaaaagtcaaagacaatgaaataattctaaaatctacaaaagaaaagtatcaagtctcttataagggaatctgcatcacactattagcagatttctcagcagaaaccttaaagctggtagagaatgggatgatatattcaaagtgctgaaagaaaaaaaagctgtcagttgagaatattatataaagcaaagatatttttccagaaatgaagaagaaataaaaatttttgcagataagaaaaagctaagggaattcattaccataaagttggtgttacaagaaacacttgagagtgctacaaatggaaacaaaaggaccataattactaacaggaaaacaagtgaaagtataaaactcaccgtagagtaagttaattaatcaaattcctaatatttccagtgatatgatacgtctttcaatcctctagtatgaacgtttaatgtcaaatggtcaaaaccaagaattacaattaatggcaaaggaacacaccacagataaagaagtaaattaagtgaacaaaagtataaattttagggggaaggaaaactgtctagagtaattttatgcaaccaaagttaagttgccatcatcttaaaatagtcaattctaactacaagactctttatgttagcctgtggtaatcacaaacaaataatgtactgcagacaatcaaatgagaatgagaaaataaagcttagcaccacagaaaaccaccaaaccacagaggtaaatagcaagagaagaagaaagaaataaggaatctacaagataaggaaaaaataatgaacaaaatggcagaagtacttatctaacaataataaccttgaatgtaaatggattaaattttcccattaagagacagaatggctgaataggcaaaataaaataaaataagacccaactatatactacctaaaaaagattcacctcaaaaaaggcaggctgaaagcaaagggatagaaaaagatattccgtgcaaacaaaaacaaaaattgaacagaataagccatattgatatcagataaaagatattttaagtcaaaaactgttaaaagaggcagagaatgttattatatataatgagaaagggatcaattcaacaagaggatataacaattgtaaatatatatgcaaccaacacaaaagcactcaaatatatagagcaaccgttattagatctaaagggagagatagaacacaatacaaaatagtaggggattacacccactttcaacaagggtaagctaatgacaaaaaatcaacaaagaaacattggacttacactgcaccatagaccaaatggacctaacagacatttacagaacatttcatccaacagctttagaatacatattcttttcggttgcacatggaacgttctccaggatgaatcacatattaggccacaaaataaatctcaacaaatgtaagaagagatgatcagctatcttttcgggccattatggtctaaactagaaattaacaaaataaaattttggaaatgttacaaatagatggaagttaaacaacatccttttagataaccaatgggtcagtgagtaagttaaaagaaaattaaaattttcttgagacaaatgagaatgggacacatcttaccaaaacccatgggacacaataaaaccagtactaaaagggaaatttatagtaataattgtctacatcacaaaagaagatttctatgaaacaatccaacaatgcatctcaaaggcctaggatttgttattaatttaataataaactaaagccaaaattagcagaaggaaggaaataataaaactcagagcagaaataaacaaaattgatgctaagaacaaaaattcaaaagatcaacaaaatgaagaatttgtttttttgaaatgataaaggaaaatcaataaaccacaagctaggctaactaaaaaaaagaaagaagactcaaaaaaataaaatcaaggatgaagtaggagatattaaagctgataccaacttttttttgcaatacgtttgcagctagaacaccagtgtcatgaaaaccatccctaaagtcaaatgggaaagaaaagaaaaagactcccatcaacattgtcaaaattggacacattgattcaggcaagtccaccactactggccatttgatctacagatgtggtgggattgaccaaagaaccatcgaaaattttgaggaagaggctgttgagataagaaagagttacttcaagtatgcctgggtcttagataaactgaaagccgaacctgaacatggtatcaccattgataccctgtggaaatttgagaccagcagttactacttgattattattgatagtctgggacacagatgctttgcgaaaaacgtgaatacagccacatttcaggctgactgtgatgtcctgattgttgctgctggtgctggtgaatttgaactggtgtctccaggaatgaacagacgtatgagcatgcatttctggtttacacactgggtgtgaaacagttattgttaacaaaatggattccacttagccactctatagccagaaaaggtacaaagaatcattgagaaagctgaaacttaagaaaattggctacaatgccaacacagtaacatctgtgccaatttctggttggaattgtgacaatatgctagagccatgtgctaacatgcattggttcaagggatggaaaatcacctgtaaagatggcaatgccagtggaactatgttgcttgaaactctgcaatgcatcctatcaccaactcatccaactgacaagcccttatttgtggtctgcctctccaggatttctacagaattggtgattttgatactgttactgtgttctgagtggtgactgggttacctttgctccagtcaatgttacaactgaagaaaagtctgttgaaatgcaccatgaggctttgagcgaaactcttctgggggacaaagggggcttcaatgtcaaggatgtgcacgtcaaagatgttcactgtgccaacattgctgatgacagcaaaaatgacccaccaatggaaacaaatggctttcctactcaggtgactattctgcaccaaacaggctaaatcagtgacggctatgtccctgtactggattgtcacacagttcacattgcttgccagtttgctgagctgaaggaaaagattgattgccagtctggtaaaaagctggaagatggccctaaatacttgaagtctggtgatgctaccattgtcgatatggttcctggcaagctcctgtgttgagagcttttctgactatcctctgagtcattttgctatttgttctatgagacagatagtcgctgtgggtgtcatcaaagcagtggacaggaaggctgctgatggtggaaaggtcaccagagttggtgaggaagaaataaaaggcatccaaactgggaagaaggtagtcaaattgtccctatttgtagatgttataatattttacataaagaaaactctaaagactccaccaaaaactagtcaaactgaaaaacaaattcactaaaattgcaggatacaaaatcaacatacacaaatcagtagcatgtccataggataatagtgaactcgctgaaaaagaatttttaaaactttcttttaccatagctacaaaaaaactagatacctaggaatatatttaaccaaggaggtgaaagatctctacaataaaactgtaaaactttgatgaaaaataaatggaagaggacacaaataaatggaaagacatattatattcatgaattggaagaattttttttaaatggtcatagtacccaaagtgatctgcagatttaatgcaattcctgtcaaaataactataatattcttcagagcagcggtcctcaatgtttttggcaccagggactggttcatggatgacagtttttccacagaccagccacagggttgggaggtggttttgagatgatccaagtgcattacatttattgtgcactttatattattagcactttatttatattattacattgtaatatatagttatatattatttcattatgtattacaatgtaataatacaactcactataatgttgagtcagtgggacccctaagcttgttttcctgcaactagatgataccatctaggggtgatgggaaacactgacagatcatcaggtgttagattcacatacagagtgctcaacctaggtcccttgcatgcgcagttcacaatagggtttgcactcctatgagaatctaatgcagatgctgatttgacaggagtctgagctcaggcggtaatgcgagtgatggggagcagctataaaatacagatgaagcttcactctcacctgctgctcacctcctgctacgcgacccagttcctaataggccacagacccatacgcctgtttgtggcctgggggttagggacccctgcttcagagaaatagaaaaaaaaaaaaacaactataaaattctgtagaactacaaaataccctaaatagccaaagacatactgagcaaaaagaacaaagtggaagggatcacaccacctgacttcaaaatacactattatacaaagatatagtaaccaaaacaacatggcgctggcacagaaacagacacatagactaatagaatagaatggagagaccagaaatacattcaacacctacagccaactgatttttgacaaagatgccaaaaacacacattggggaaaaagtagtctcttcaataaatggtgctaggaaaattcaataatcacatgcaaaagaatgagactagaccctgactcatgttatgtacaaaaatcaactcaaaatgaattaaagatttaaatgtaaagtttgaaactatgaaacaactagaagaaatcacagagaaaatgctttatgacgttagggtgggcaaggactttttaaataagatctcaaaagcacagacaacgaaagcaaaaagagacaaatggagtttcattgaactaaaaagcttttgaagaggaaactattcacagagtaaagagataacctagcaaatgggagaaaatatatgtagactatacttctaacaaggagttaatatatagaatatataaaggaacacaaacaactcaatgggaaaaaaacccccaaatacctcattttaaaaatgggcaaaagactttaatagacattctcaaaagaagacatacaaatggccattagttatatgaaaaaaatgctcaataccactaatcataaaggaaatgtaaatgaaaaccacaacgagatgttacttcattccaattagactggtggttatcagaaagacaaaagaaatcaagtgctggtaaggttgtggagaaatgggaacacttatatgctgttggtagcaatatatactagtacaaccattatggaaaacagtatggaggttccccaaaaatagtcaaaatagaattaacatgtgatctagcaattccactactggatgtatagccaaaggaaatggaatcagcacgtcaaaagagatatctgtactctcaacttctgtagcactatttataatagctaatatattgaatcgacctaagtgtccaacagtggatgaatggataaaaaatgtggcaaatatacaccgtagaatattattcagccataaaaagaataaaatcctgtcatttgtgacaacatggatgaacctggaggacaccgtgttaaccgaaataagccagacacagaatgataaataccacattatctcactcatttttagatgtggaatagtaaaaataatttttaaatataacaagaagataagaatctggtacataaatggattaacaagagtcatttaaaaaatctagcagtgtgaaatgttgcattccctgttgaaatctaaaaatgaggggttaatatatgttatattatgttatatatgtatgcagaaatacatatattctgttatatatgtacacagaaatacatatatattcatagtggaagcctgactttaaaaagaacttttcaagaatggatttgatcatctcttttaaagccatctagtttttgaaaacaaccagccggagctgactataactttgtttttatgctaaaattctgaactcctttaaacgagtctaaaataaggaaagaccagaaatcacagtacagcatattgtcaacaacctctctatagcgaccaaaggagttcagggcctgcaagtcactgtgttatagtgtacttgaaaagtcatctacaccacaggaacgcaaccaaataaataagtatttcaccgacaaaacccatagagaaagagtttaaagacttcccacagcaatccattgctgccactagccatgtgtattatcagtaaatgtaaatggtgtaaactagtggtgaatatgaacactgctgcttctgggttcttgaagcagtttgttctcgttaagctttgtgaagggactgaaggctttcacttgttttctgtgtgaatgagccgttagtgtgtgtgggaatgttttcacagcaccatgcctcttctgcccttttctataaactgagctacttcacgtgtctcctcatattagtgccatcactaaacaaagcaagcgctcatgaatgaaggctgatgtcagcaaattctgaatagcttctggaggggcatcctgcaccctaacactgatgccagctaaggggatgaagtcaccagggagatcacccactcttattctcctaagaactgagcagttccagcaatgaaaagcaatacaaagcaaacaaacaaatattcagattaaaatgcaatgtaatacagggcagtgccaacattactttacatatgactacacggtctttacactaaatatccagaagtactgtgaaaatcagttattttcttgagatatattataaactataatgagatgtttctatggtccctttattttagtttcagtgaaacatgaaaaacacataaaaataaaattttagaaacatggtagtacatttgaactcacttataaacttaataatgctgaacattaaaataaggacagaacatgatgatgaggaaaagtgatttacagtaaacatttccttgtaaaacagaactgtttctggtatccaatttaccctggttgcatgtaagtcttacgtgcttagcaagagattgaaagactttataatatttgaggttattgtgcataaaaccattgctggtcagaagtaaatcttactgtcttggcagtttgtcttcagagaataggcgacatgtctaaatagaattaaatctcagcaaccttcatgtagaactgtttgttgccgaaaaatataggattatatcatgacgtctggtgacttgccagagaacccttgaaaccctgctgagttcaaggctctgcacaacaggaatgtcatagtttctgcttagaacagtgtgtgtatttaaggagttttgctgttaatgcaggactaaggacccctcactcatgaactgagacagggactgttattgtcgaaagcactaaacacactttcctcattgcctcaccatttaaagatgagcagtttttgactcatgcctcaaagaaagaattattctagtcataaaagcctgctaaagttttcttttttaaagcttataaacagactgcgggcagattgaccatcatatctaataagctaactgttaacaagttagtacagtttagtatacacctgaatacttctattttctatatttttctcctccccccacactccctttcttttgaagtaattttatttcatgaccttatgtctacagaaaaagaattatattactgtcttggattactaaattgaattaatgttgacataaatagttttatttggatggaattttaaaattaattccatttgtaaataaccataagaaatacaatctcctttgtcatttcgatcacaaagtagcagagaaatctattccacacataaaatcacttagaagagagaacttgcaacttactacagtataagagattttcagtatctagtcaccttatgactcatattaatcatgtactgacaagtttccaaagagcttgaattaaaaaaaaaataagcccttgtatatagacatgttgaaggacttagataagtacaaaaaatctctgtgaaaaagttttcattgatgttttaaaaagcgtgttattttatctttacaaaggaactgcactaacactaatctagcttttggaaaatacagcaacattcatgactaatcgtagtgtgaaaagtagaaatggacatgaaaagtatcatcacctctagcaacacttgaaaccctaagagaggttcaaatgcaaactttcagattttcaacactgaaaaaccaaggactttatcttccctttcaaggagttgctttgtggggcgggggaaaccaaaacctcttttgtagtacaaactttgccaatatatctgattctttttctacctcctcttagaagagatataccccctttttaatagtttaaaaatactattgcagtgaaactcttggtacaaaggaaaattattctatttagtcgtattcttttaaaagttatttgtttaaaagggcttcactgtattggtcttgcagcccttcatacaacagaacaaaagcagttctatgaaagaagactaaacttgaacaaaccgtaaaaaaaaaaagcaaagttcctctctgtttttatcaaatttgattgctgcagctgttcccagtttctgtattttaaaaatagccttattcagtgccttgttggctaaaggccagagtgccattagaacatgctgtacggaaaacctctattcagttacagatacagaaatatatttaagatcagtgggggtcatctgcagcaaacacttgtaaaggaaaatcgaattttaatgtgtttggactgattgccacttttaccagatagtttaaagcttccatatagaaccatcctattattttttcttttaggtaaaaatgcaaaatgcgtatgaacttcattggacaaatattattagaaaggtctgtttctcaaataacaattgtacagctgagatacacatttcaaagaatacctactagtggtttctgtttgacaagctcacaggcattcatcgagtgaaaaggtaggtaatattgagcaaatgctacaaatggaatcataacttctttctgacacagtcctcctaagtaaggtcacgaggtgtgaaatagattgatctgcccaagggaaatgagtctggggactcattttggacttaaagtgtgtggggaaagggtgaaagaattgagttattcagtgatgtttcagagttgaccttcacatctcttcagttctttcctttgcctcagcaaaggattgaaattagcatttgggactaaacagattcctgtaggagtcctaatttgagttgtaagtaaaaaggatctgcttcgcataaatcatcaataaaaaggaattttgattccaggtattgaaaatagtaagaaaaaattagaaagcagaggtctagggaaaactaaggtgagaagaaaaaatttcattagggaaatatacagcagttgtcaaggtatgggaacatctaagatttcacctttcttgaaagctaacatgttagcctgccacagctttgttgaggctggcagaagacatgagttccctgcatcagagacccaagacgttactatccacagcaacagcagtcaccagtcttaacatctaaatcagtcccccaaaccccaacttccatagggtgaaacaaagaggtctgggagatacctgcacacataatgggctgcattatagaagagaaacccatggcttacaataccttgatctttcataatagaaaataagcctgcctgatctcttcccagctgccaaactggctaaaaaatgaagctcttattgacatttttatggttatatgtgaattgctaccatgatggtattaaaatagaagagatatcaaaatatttcacaatcagcaagagtactggccacagtgtatcctagatattgtaagaaaatagggtcccagaggtctctaaggtacctggcattgatactttaaatgttggatttggaaaagtctgggaggtcatgaggagggatagggggaacctggaaggacagggcgaactgtgcagaaatatttaaataatttaacatttggtacagctatgctgaaggtcccagtggaaggtactaaactgaaatatgtctcagaagttctgattcctagtcctaaattttgatttagctaaagggcaacttcaggtaagtcatttaatgtttctgggacccagttaccctatctctaaaagagaaatggtactgaccttagattgtgattaaatatattgttccaatcagttacatagtaatttttttgctcattctctttctcccctacactaaataaactttatgtataagtaataaaattataaattctgtggctattccacttttgatagacaaaaatttccacgagaatagcttgaaaaatattggaagtgaagtaattgagcgtgatgggtctcagatgaaagacatttggctacaaatattaaagtggtggggggaatacagaatgaataggaaaaaggaatagaaaaacaaaagaacagcaaataaaaatgtctgatctaagaaagcatttggatcagatgaatgggaaatgtaattaggctggacacctccggaaagggcaaaaatatgagcatttccaccatgaaatcaaagtaagatagagtaactaggtcagcactctgcaggcggcctgggacaggactgggctcactgtgaacttagaagcagaaataaaatccacatggtcacatttccacaaggaatggaacaaatagatgatgcccaggtgttctaggcataaggcattgtagagcaaaaagttcagtgggattcaattagtaagtagaacaaagcttcactataactgggcaagtggcagtgcactataatgaagctcttaattaggctaataatttaatataagtatgttactatgttattgctttaagatttctgaaataaaaggagtagtgacaacgaagtatacaatttcttagctttctggataacaatattgcaaagcaagatatttgttatttagcaaatacttactacaatgtcagaaattatgaaaacaaggatcaaaacaaacaaacaaacaaaaacaaaatctagctcctgagtatatagtggtgtacagggcacaaaaagagacctttactacaataattgacaaggagatgttcagatttcactccaggttcagagctggcctttaagtctagaacttctggaggccaacatgccactgcatagaggtcattctggttaataaattgagcacaaggattcacccattcctgaatctagttctttaaagttgtttagtaacaattctcctttaatactttctcttatgttgccagtcctctgctaaatgttataaaaacacaatatgtttatgactcttttgtactcaacctatactatgaggcagcaatgagagaatcaaaaaattacatggtgtggcccccagagtgcaagacctagcagttaaaaaatgatacctatcactgtgcactttggctacctcattacctagtgagacaactcctcattgttgagcataatcactaggaatattttagtgcaactcatgtattccccacattacccacaaaagccgtcctcatttttacacaggtgttatgaatttctaattgtctctttttgtttcttcttgattaggaatttggcaagaatttttattttcctggcttacattttatctcaatgtttattttcttatacatattgtttcataatactacatatgatttctttgcccatttatccatttacctcatccaacaaagttacattgagcaccaacagatgcttagtagatcaatgtatgccaggtactctggaatgtgactgagatagatgtaaaaagctattagtctccttaagagcactaacatgtaaaaaaaacgtaatgtagcattgtcaaaaagggagagtgtttaactctatggaggatggttggtggtggggagagagttgggattgtagaagcttaggaaaagcctaaaaagttgtgagaaattaggtaatgaagattcagtcatgaagggcctgagagcttgggttttccttacatttgactagggtgtagttaaaaattctaagctaagtagagaggcagttagatcacattttataaaggacatttagggagttgtggaagatggtttcttcattcatttaggctgctacacaaaaataccataaactggatcgcatataaacaacaatgtatttctcacagttctggaggctggaaatccaacatcaaggcactagcagcgtctggtgagggcctgtttcctagatagctgtcttttcactgtaaccttacaggatggaaggcttgagggatccttgtgtggtccctttttatacaggcattaatcccaattatgatggcaccaccctcataacttaatcaactcccaaaggtctcactcctagtaacatcacctaggggttagaatttcaatatatgaattttgggcagacacaaacattcagaccattgcagatggattcaaaggcaatgaggtaagaaacagcagggtgatcaattagagaagcattgaaataatgctgatgagagatgatagggagttaaagtaagctgtgaccaggtgcatgagagtgaaagttgcttaggaggtagaactgacagcattatgaatagccacctggggagtgtcggaaggcattgcagtggccaccggggttcagggttggtagacaagctgatgatgatgtcaccaactaagatgcaaaatcctgggggaaaagcaagtaggaaagtaggaaacatggtaagtttgattttgcatgtgctggtattgtggactctgtgggacatccacatggagctctctatagagaggacggcctggtgaatatatatctgtagatgtgaacattatttccaaattaattacaaattaaaaaaataagaatcatatatcatgttgctttggagtttgttgttttgtttttagatgtccaaatgcataacctggcacagagcagacaatcaataagcatacgttgaattagtaataatgtattatattaagtacacttgaagctttcctgatagtcttctataagaggctccaataaagggtagactcacctttaaatttggcttacaatgagtactagctaggaacaaaataattgctcatgatttcagagaacacttcttgaagtgacaaatatatttcttttgataaaggtaaccattaatggattatctataatgtgataattgcttcttatatttatctagctctgtttagtttcccattcttttttatgatttaatgtactcatagtatttatatgcttaaaccattgttaactggattttttttctggtaaccaatagcatttcttactgatacaattttacagatggaggaaagaagtcagagaagatgaatggtttgctcacagtaattcagcagtgtctagagttcttcccatgatatcataattcctctcaacatcatgaggctactgatggaaagtgcctttaggtatctgtcattaattactaataacaaggtatttttcaggggcaaaagctgttgttacttagccacactgttgaaaactcctttgccgtgactaactcttgtcaatcctgacagtgattcaagaaaactgttaatttcattatttttatactgactttgctaaagattgaaatcaatttgctacatttttggtatcttttaaatagtataaataaattagaaccaaatctgtaacaatataaaaaaatattatatagaactgcctattaaatgttttgtgttttcaaatatttctaaaaatgattacaatttgatactattattaaaatttaaaattccgtctttgaaacagaagttgtcaggtactgatctgttactgtaagatgccaatcatattatcacatttctagttgctgaagtattttatgaattttgaattctattaaatggtgatttatttttttccagataagtcaccatgcaagaggcacttattacacatgtttttcagcatatgttgcaagtttattttaatgctgaagaggcacattatgatcaaagcagaattctgcccaatttaaactgttccaagctattttcatacattcactcatgtaatactgtaagatttacattaaaatgaatgctcgtctacaattaagcgattcagtcaacattttaaaaaaaggtgcaaatgtgtgcaacgtgaaaaaaaatcaacagatgtgcgaataatctctacttcggggccagtatcaaaaagagcagtagccaaaaaaaaaaaaaaaagttaaaagtttcagcacttatttttcgtctatcctctaaggttttctatacctaagttaaaggacacacacataaaacagtcataagacatttccttatgatgataattggattagtcaataataaattgggttgaggaacaaacaataaactacagtattcacagtagaacttaaagatggatatatattttgttttcttctgattcttatactcttctattctgatgatgaatatattccaaagcagcaatgattcacctctgttcagagaagagtacacatgtaaaaccagaatatttagcactaatgtatttttaaaagatagccagctaggatataataacaaaagcagaaagagcttctgatcctagaggtgaataaatctgcaagccagtgcatgcatgcagttttgcaggttgtataatgcataactgaaggggtcaccattcacattgtggtctaaatgaatggcatcttcttgaattttatagagcacatcctgcacaattataatgtactggggccatggaaaacatcatgagtatgatggaaatgtaaagagtttgttcagataggataactgagatcaaagtgcttcttaaaacctcatctctgttccatgagatatattttggtgaccattggaaggatgtccagttttcacctacttcagtagcagatgtggggcaaagaaaaccttgatgccaattgacagtctgtaatatttagacaatctaaagcttctggtctgataacatggataaaaactactcaaatctcatccctattctctcctcccccagcgaattaattgcaggatatttcttcctttattattttaactgagcttcccagtgacatctatttgagaaaataagaagtggaaatggcactcactgacaagcacattcttagacagggagaaaatgaattggtataattttacttaaaaatattctccattaatgtttttcaacatgattaacatttatgaaaacattgatctatattatagtaaattacatactgtactttaaaatgaggactgtgcttttgtttacaaatttcaacatgctttgctatcctagatgaaatctgaatacatgaaaacttgaggggccttatatatgtacccatgtttaatcctgatgtggcccaaggcttcaactgttctaatttattgcagctcttctacacagttctacaagtagcttggtgagctgacacatttctgtgtctatgtgggttaatctgagcaagaaaatgattagcctgaagtctctggctaaatcactaaccatactttaatccattagatgagaccacctctctacttacattttaaattgggaaacatacaacggctgagaaaacatagggcttatgctttttgatgagctaatatagcctaaattgtcttggtaaactcttcattggccctttgcccatgagaactaaaaggttcaagtgcctagtcaactggctaaaaggaagtttagcatgtttctggaaattacaaaatagccaagacctgtgttgtcacaacagggcagcaaatattctccacattgaaaaagggatgttaaaaacagggccacgagtatgggaagagaacgtacgttcatgtagatcaattctaggggaaaaagaaatgtattactataaattgttggtagttattttctagcaattctttgatatcagggaatgtatttttatttggaaacactttaagcacttgtataagctttcattgtgtgtgtatgtgtccacaactgtagctattcaagaaatatcctatgtttttatcctcttaatcaacttcattcttccttcatgttcccattgctccaacctatcagtaaatctactctcagatatcttacaggcttatttcctctctaaagattgtataacagctaggaaaatgtgaaaatagcctctcatcttagtgtgtcatactgtcactgtgtattcatgtgacacaagcttgcattctgatgccatgtccatgtggggctgaggaaacttgtggagattcatcctgatatctgcctccccggatgcattcacatctctttcaactgataatgtctttccacctcctcaaaactcttccagggagcagctatggttctacattgttcttgagacccacccacagtaaccatcttctctgcttggaccatcagaatctttcctatctcttttcttatgttttaaagcttctctttcttggggacacctcatatcatctcttctgggagcagaagttatacattgttggccagagggttgaatctggttcacagaattgtttggctcataacatattatgttctaaatttttcaacatttgttaaaggttttaaaaaataagtggattctacataaacatgtgattctgagactatcttcaaagattggaggatcagacaacattgggccaacttatcctccttataaaccttttcacctttagacaggacatgctctttccaatcacccaagtccctgcccagtgtgcttcatttctggccccacaaggcatttgtgatttgtcttctgatctctcattctcaactgcttctatgttgtactctgcaaaaaatcacacggccagaatgagggaatgaaccttactacgtatgggaagtagaatcttactatagcttactaaaatagggtggcaaaatacaggcagataggccaaataatatgatatatatatgtatgttatagaagatagatcaattgattgacaggtagatagaagcaagaaaaactatagactttgggtaagatcatttctggtatacaataccaactagttgataattaatttaataatgcacatattcaaaataaaaacttgcatattaactacaaaatgtaaattctcttaaaacttggctttactgaaatgagctatacagacataatatgtgtccttatagagactacagtctatactaagaaagactgtaaagagatgtggaatccacataggaaaatgtgtaattaaaacaccagttgaaaaacatgataggggttatgacagggctaagtccaaggtgatagatagtttgtaggaagaaaaattaaccaaccttaagggaagatttgcctgaggaattcatgtgtaagcaacaactggaagcatgtgagactcatatccaggtgaacaaggaggtgatggtggtttcaggaggagaaacagcaagtgcaaaagtacagcaaaaggtgagatgaaatctagtgcttaaatctacctagaaaccgttcagtatggttgcagcacagaatttcagggcatgtgggagaaaaggcatattaggcttaataaggcaagcaatacctgggcatatgaccttataaatcatgttaaagagtttgaacttacataagggactgtgggtccccactgagatattttttacagtaaacaacataatcagatttttgatgttgagaaatcacatgaacctgctgaaatgtagtttctatacccataaaataggaatagtgtcgtatatcctggttgcctcattggattgctgcaaagatcaaatcaaataatatatgctaaaattcagcaaattctaatatgcaagtaatattataatgcataaagtttatttattgttgcaactattttttgtagaaagtgtgtgagccaatctctgataggctaatagattgtactacatgacaatgagtagtaaagcacaactcatatcagttattagcaaacattctattaagaaatgtgaagaaaacctaagtattagggtaaaaatgtatgagatggaatttataaatgttggcaataacttttaattaatcttttattatactgtttctcttactgggagttgaagaggttgatcatgttttcttgctgcccaacactttttaagcaacttctatgtttcaggaataggaaccctgcctttagagggctacagaagctctctccctctgcctcctttgaggtcaacatgtgatccatcagtatgtgatccatcaacatatgatccgatagcacctgatccctcagactgtaatctatcagagtgtgagtcatcgtgtgtgggatctttcaaagtgtaatctgccaacatatgacctaagctttgccagtcgggtgcattggtgtgagatgtttggaatgcagtggcttgaagagggagataacaggcagaaacagttctggccaggatggcatggagacattctgttctctgagggcatggagtccgaagtcctaggggtagcatcctgtgcccagcttctctgtggtgaggtgttggactcatgcacagaagcagagacattaaggttacctgtgggaatgccaggcaatgtacttggtgagtggttcctggctgtatggcttttaagcctaattatctgtcctttggagagattttgggggtaactaatatcagtaaacatgttccttttctcctcccacaaatgagagtggattctgtggtttacaagtaaaaatcctgactgataaatgtgtcaaaataaaactgttttttcatcttaaggtggcaacctttttttactcctttattgtacttgggaaccagggcacacaaaccatgaggatgagtatataaatgtggaacaaaagaggggaaggaaatggattccaatactctatcttcaaagtgaactaaaaaaatgtaaaatgaataatccccaaaattatatatgacttgtcagcacaatttctcatttgaaccttgaaccagcatctacagaactttgtagatgaacttctatagaagtttgtttgtaaagctctactctatgatattctcagtaaagttttacagtgattaaatatgcaagcttttatatgagttctgggtccagattgttgctccttaagttattaattgtgtgactttgaaaaaagtatttaatctgtataagcacctgtctctccagtaaaataaaacaaaatatccagtgagagagtatattcaacacatttagtgctatgcttggcccaagacagacctttaatagttgctagtactgctaacaattaaaataaaacatttacttgagcttgaaaaaatatttcagggatggaacaggaatagtggggactagtattcgggtttttaaactgctggtggaagtgcagtattagaaggccttaaaaacttgaagaaaacaaagaccagtctaggataaagaagtatattctacttaatcttcatgtttgaagtaggaggcaggaaggattaatgggggttcaacttctacttcaaacagtttccctcccttttgctgggttgcaagggattgtaaacagcctcaatttctccctctttatacatcttcttccctctttcttctgtgttatgcattgatatttctttatgtttgtgtgtacacatatactagtatttctgtattgagtaaaataattcaaaacgagaatagttgcattaattttacgacagttaaaggaaccggctttattggttccattcttcatttttctgcattctagccttctcgctttggttttgaaatatagaagtactaggtagcctctgtatctagcttgattctttattcactgaaaacacagctagtgttttttcagtcctatatgagtgctccaagagttgttagaaataaacaaaagaatattcatagcctcctggaaatagctagtttttttttttttcatttatcctttttactttcttccttttggattctcctcttctttccactccatctcttaattggcttgcttcttggtagcctatatattctatacaatgacttactaaattactggagtaatatcgacatacttgcatacatcgtttctcttttttcctgtagggcacatgtctcaaacagaatataattatagctagatgctgagtgggaaacaagcagtccttatatattgaggacatgagtataagcctgagtaactattactactgatagaaaaaaaaaaaacgccaaatttaaaaaaccatcaccattcatcaatttttaaattgtatctcatgtttaaacatttatttgcttcaaatgaataattaaagtcagtcccatctccccctaaaccaaaattaagtagcattgaaattccttttcatagagagatatatacgacaagattgggtatttggaaagatacagacactgcttgcaactataaaaacaagatcaaaacatttggatgccctttctccacttcagtaggacagcaactacacaaggctattctctggagtaatgatcttgtctccttccaaaggtttttttatcctatattcaggaggtcatatgcagtcttcagctgcacagagctccactcctattaatttaaaatgggggctccagaggttcacattcagcaaaatctgccccttaagaggtaagctttaccaatctcccatttgaagaaaaaaagaagcgtttatctttggaaaaaataacctacttaaatagtctatcttccctaacaagaaataaagaaaaacttcagacataagttaataaaatatccttttgattaaacagagttcactttattttcatgttttggcaacactgttttagtggatttgcatgggggggctctggtattgttattttatcattatattatcattttgttaagctatctggcaaattgaaaaggttattcaccctatggctgtctttttttttttaatgttgagcattcattgaaaagaatgaaagaaatctggttgaatatgcaggtgcactaataaatgggtggtctttggattacagtatttatgtgtactgtggcaaagctgaacagaaacctaaatgttatacatacaaagtggtacaacaagaacatctgtgttggggggattgaactggcatggctaacacctccagtgccaggtgcaaaggaaatttcaatacagcttgagtaatcttgactgctagcatctgcctgcatcagattatctcctatgttcctagtccaccactatccattagagtatttatatgatacatctggtggtgcaatggccaagcaagaagcagcaatgcctccgttactgggggcaaatgcctgactctttaactcaatacaaaggcaaacaggaattcatttcaggcccacaggcagccagccaactcttcaagactaattagaagatagcactccagtgtgatggctgctttgtcctttcagtttagttacttacatatccatgtgcacaatctgcagacatttaacttttcattttaaaatcctatttctaaatatcatttccaggaaaataacagggttttaatatgttgccagaatcacaacagagctttaatgtgacttggctcaatccaaagtctcaacatgcacctgattttcagaatgaatcaatgtggtcgggtgagaatggtggagatcatcagtccattagtctccgcaacatcaaatctcacatgtccaacaacacaaagattatgtccctctcttcaagtcttcaaatctttctcacctcaagagatgactgtgtcacctaatgcagagaaaatcagtgggattgctttagcagtctgccatctaagaatctacataaaccagcacctacctttcctctctgcttcctgttaccatagatgtgtgacacctctgtctttgactttataaagcaaacccatctcttcctgctttatacacccacatttccctgatttttgcatgcactccccctctccactgtatccttgccatctgaatatattgatccacttgcaatcctcttcaaagaaaacctctgtagatgttatgttcccctacagctatcaccttccccagggtgaaggtgttctttcacaatcaaacatctttataggtttcttcactgtgttctcctactcacctctcaaactgttcaaatctggctcctttcctcaacatttcatgagactgtatcatataaattgtataggtcccatatcttcacgctgctaaaatcaaagggcttcatcatcctaatagctattcctgcagtatttgaaacgtgtgaccattacttcctcatgaagtctctttccttagcctctactatgtgatatttactctcatgttttgtgatatttactctcatgttttgtgattttactctcatgttttgtgatatttactctcgtgttttgtgattttactctcatgttttgtgatatttactctcatgttttgtgattttactctcgtgttttgtgatatttactctcatgttttgtgattttactctcatgttttgtgatatttactctcatgttttgtgattttactctcatgttttgtgattttactctcatgttttgtgatatttactctcatgttttgtgatatttactctcatgttttgtgattttactctcatgttttgtgattttactctcatgttttgtgatatttactctcatgttttgtgatatttactctcatgttttgtgattttactctcatgttttgtgattttactctcatgttttgtgatatttactctcatgttttgtgatatttactctcatgttttgtgattttactctcatgttttgtgatatttactctcatgttttgtgattttactctcatgttttgtgattttactctcatgttttgtgattttactctcatgttttgtgattttactctcgtgttttgtgattttactctcatgttttgtgatatttactctcatgttttgtgattttactctcgtgttttgtgattttactctcatgttttgtgatatttactctcatgttttgtgatatttactctcatgttttgtgatatttactctcatgttttgtgatatttactctcatgttttgtgattttactctcatgttttgtgattttactctcatgttttgtgattttactctcatgttttgtgattttactctcgtgttttgtgattttactctcatgttttgtgatatttactctcatgttttgtgattttactctcgtgttttgtgattttactctcatgttttgtgattttactctcatgttttgtgattttactctcatgttttgtgattttactctcatgttttgtgattttactctcatgttttgtgattttactctcatgttttgtgatatttactctcatgttttgtgattttactctcgtgttttgtgatatttactctcatgttttgtgattttactctcgtgttttgtgatatttactctcatgttttgtgttcctctacatctctggacacttattcctagccttctttggcctccctttccaccatattcaacaattcaaggatggaattatgcagggatttgtcctgagtcatctcttcactatactttttccttagaaattctcattcaccaatacggcttcaattgccatcatcttgcagatgagctacacattttaatccccagcttagagtaaatcagtttcctaaacttcaagccctagcatcaaatcattcattcaacatctgaatctaatacttctgaatctaactcatcgttctctttgccaccaaaatacttttttttctaaagtacctagtccttccaaatttcaccaccatccatctaactgattaagctagataattcaccatttttgacatctctgtcttgttccttttccaaatcgatcaattagtaagtattgccaattaacttttaaaaacgtaaacattatacatgactatgtactttataaaaaatggcaataattgtcctttcatcatcactcctaatccttgggcatctttctttacacagaggtaatactaattatgaaatatattcattcaaatttttgtctattcttatactcatatatgtaccagttcaatttgaaatatatcagttttgtatatcaatttttataaaaaaatggtaacacattctaaaatttgatttattcagacaaaaacatgtcctggaaagctattttcgtatatatatcaatttgattcattttaattaatgcccaaaataccacagtatatatatccctctgttagagtttcttctatttaaagttgcgctttctcattttttctgttaacaatgctgcaatgaatatattcaagcatggctccttatatgaatgattctcaagatagagaaatagagattgaaaagatattgacatattacattcccaagtggtactgggagaaaattctccatggatttgtcacttttctgtatgtctgggaagcaaagcatcgtctgtcatttattccataatatcttttaaaaagatgtagagtgaacagccttggaaaacaacatgtctccctctggagcaaggggaaggtatgctaactcttcagtataatagcatttcccctaagcttggagttcttctcctatgatgcaaaccattgcagaagcaggtgttacctggcccccttagtgtcatcctgtgggaactgggacttcaggaactagtgcaaaaatgctgattattctggttgctgttattgctctgagtaataaactaaatttatctctggcccaggattctcatgccttccaccagctttcacagaactgtggtgacggtgatacagtttaccctctcatcatacaagtctgaacaatatcagcttcttcacattacagccaataagtgatagtaataaatgtttctttttttccaaataaaataaaagaaaaaaggtatcttatttcagtttgcatttccctagttattagtatagtgaggttttacatgttgcgttctctctctttccttcttcctctttttctctcttgccatttatctcttcccaagtactccttatactttcacttttgttcatctctgatgccaccatcctagttcaaagtagctgcaattatttcctaactggtctccccaagtctactcagcctccctcaaacacagatctgatcacatggcttccttccttaaaaacacttggtctttccaattgtctttaggataaaacttgaaacccttgacagggcctacatgctcgggataatcttgtctctagctctatttgttgacactcttgtcttcattttcaacttacatttagcttttaactttcttggatatggcacgctctttcttcttttggggatttcattcatttagaaaaaaaattccatgtgctatttcaaattaatgttttttaacaaagaaaaatttaatgtttaggaaataaggagaaaaaatctgctttggttgtaaactgcaatgaaaagaaaagaaaaagtttaggcagaaaatatatgtaaatattatatggtacttatttctggataaggggataaatgcattttcttattttagttattttaattttctctattctttctttctccaacaaacatattttgctctattaattagaaaaaataatcttaaaaaactgcttttttggcctctatcctgctctctcctattacataattacaacaaagcaagtaatgaagtttcaaaaggaaaagtttaggaagaaaatatataatttcacccacaaaatgtagcacaatttcaaaaataccaaatgaaaactaaatgcccaaacagcttctttgtcatcacctaagctaatttcaaatgaataagactaagggaatacagtactgaattgagaaggccaatgcctgcctcaccagttttagagtcagagtcacacagtactgtcctgacttccattcgctcctccctccttctcccactccattgcttctcctcccactcaacatttagtaagcactgtctatgtgcagtgaagtgaaagtccaagaagttcatgctgaaatagaggagctgatctgtaagtacctacactcatcctgatggcaaatgaacagacaaaagcatgaacgcaatgattatgaccggaggcagcagttgagtggtcttgagaaaagcatggactcttgcctggtggctgagagatgtagtgagatttctcatacagaataaacaggaagaatatggcaatctagggcaaatataaacaatcccataagaaaggaacctgtagtataggcatgcatgtgagtcaaggtgattaatgatgaacctgggagaaaattaaggttttcgagccacattagtctcaagggtaaaaaagaggcaatgtatttataaagtgccccacaaaatgcagggccccatagtaagcataaatattattcattcttcctctcccatctcttgcacgtacactccctttcaaatttcataaaagtctatgtcatgtagatgtattccaaataataataaagatggtaataatagtaaaaataaccactaatctataataagtacaattagcatacaaatgttttacacgttttatctcattcaatcttcaattactctcataaggtggctactggtattaccttcattttgccgatgaggaaaccgagacacagagttaagtaactggcctaattaaattaattcatggttgaggtaggatttgccatcagccattctgatttaggattggagctccaagataataacagtaactagaagtgtaattagtaaccagtgttatttctctgtgcaatgaaattatatgcaaatggaaaaagacaagatttgaaaggtatgcattttattcacaaaagtcaaacattaaaaaaatttatttatacaatgttaagcatgtttctctctgtatgtttgccactttgtatatatggcctggatattatttctttaagcagattaattttcagattcattcacaaacagttacaaacctcttactatataccaagttttatgttagaactttaaagagttgaaaacaagcagataacattcttgccttcctggagtttatggcctaatgagtataacaaatttaaaacaaaaatgaagatatacgattgtaaaatataacaaatgccattaaggaaataatatgaacacgttatgaaatagaacaagaagaagaaataatttaaattttttctactttaactttttaatctggacagaagtggagataaggaatgtggttagagaagaaataaaatgacactggtaaatatcagtaactattactcaactctcagccatgtctaagtttttttggactttcaaggtcacactagtgtactgttatatgtcatgagtaataaatttggtttaaatattattatgaacccaaattatagaataaaaaggtgactatgaaaatgcatatagcaggccgggcacagtggctcacgcctgtaatcccagcactttgggaggccgaggtgggtggatcacctgaggtcaggagttcgaaaccagcctggccaacatggtgaaaccccatctccaacaaaaatacaaaaattagccaggcatagtggtgggtgcctgtaatcccagctacccgggaggctgaagcaggagaatcacttgaacccgggaggtggaggttgcagtgaaccgagattgaaacattacactccaacctgggtgacagagcaagactccgtctcaaaaaaaaaaaaaaaaaaaaaaagaaccatatagcaagttccctcttttgtcaacgtgtatgtgtatgtgtgggtggggagggaggtgtgtgtgttcttaaaataacttaaaggtcttttaaaggacttacaccaatgtgttggtaatcactgtcttcagtagatagaattatgaatgattttttgtttctttccaacaatttattttctatacagtttatcagtttttatgtagtacactgaacaagaaaaatgtacaaatatatagttttaaaagtttttctgaacctctaagctaggatcttgtttcatctcacacactgaatgaaactttatgaattgagaaagccacttcattccctggccttcacatcaaatgacaagagaaagggccagacagtctagtctctaaggaactcctagagatccagagtgtatctaaagcagatgcctaagtattctaaagtcctatttatttattaaaattttaaagtgagaataattcagttttatctataagtaatattttttcagtaatactttttataattgtgaacaattgttcactactttcctctacctttatttgaatttaatgtttggatttttgtttgcttccttgggacgtgggtttttttcctagacttcaaatctctgaagccagtaccttattccagttgcaatctgtataatttcactttttccatttttagtaacattaaagaaaaaaatcatcacaaatcattcttggttgtttatctggacaagtgttctcaactattccaaagctctaagaccactgtaaacttttgaaatgagtaattataccaggtttatataaaagtcatatgctgaccagttacacgggaaattaaaaaaaaaactagaacgtacatgagaaggagaagaacaggcctcaaaacaagctaaaagtgagatgcaagtgaaaaaaaaaatcatacgtccacatatagacctgtatgaatattttccacatggagctcaaactatctagtcccttacgctttccctgtgaggtcaccatgggcttaatgaatgtaccggtgcttgatagaaagttaggctctcctcaagacaggtgactctccatctttctcactttttatcttttctttctttgtccattgaagtctagatggtgtccctctattgcgtctgaatccatggtcctgtccatacttttgtaataataaatacctttgtaaataaacccttctgaggacatcctaacttgtttgtttcctagtaggttcattactaatatgcaaatattagctttcatttggctttaaaataaaataagctttatttggaagggtagattcatatgaaaacaagacacatgtcccagatgaaacttcgtgttcataacacttaagccttcaaagtgttcagattatgtaaaatttgagagaaaagaataatcagtttcaatacgaggtattccagtattcatgtgttcaaaatagagaagaggaaaagaaatggagaaggaatttgaaatattttccaaacagatcatacacttgacctctagcttaacttagctatgatacttgaagtcatatttacaaggtcatagttttaaaaggagatacatcttgatcaagattactctatttgtctctacactgaaaccatcttgcaaaagcattcaatagttaaataaaaatatctttctaatgaaaaactagtgaaaaccacaatgatatttgcttaacctcataggtgaatttgttggtggtctaagatgtctgccaacaaaagctctttttgtgctttgaattgaccaaaggccaaatgctaatggaaatgaatacctgatctgctttgaaagtgaatcctgcctacaatgaataagagatggcttgaaggaagataaggggaagctgatcatacttttgtccatttatggactttctaaactaaaatattacattatatcctttgagaaagaagctgaaccaccattcccgggacagagtttttttttatagctttattgaaatgtaatccacatatcattcacccatttaaagtgtgaaattcagttttttttagtatattcaaagttatgtgcaaccatcatcacagtaaattttagaacattttcatcacttcaggaagaaaccctgtatcttttagatattgctgctgtattctccaatcccccacctctcaccctcagtccactattctcccagcaactaatgatctactttctgcctctgtagattttcctattctgaatatttcatacaaatggaatcatagaatatgtagtattttgtgatttccttctttcacttagcatgtttttaaggttactccatgttctagtttgcatcagtactcaattcatttttataagtgaataacatttatttgtatgaatataccatattttctttatccattcatcccctgattggcattttgattgttttgacctttggctattatgaataatgttgctttaaacattaatgtacaggctttctgtagacataagctttcagttttcatggactctgacctaagattggaattgctgagtcaatgttctaaatctatgtttagccatttgataaacttgaaagaatgttctctaaattggcagcactattttacaatgtgaccaacagggtataagggttatgatttctccacattcttggcaacacttagtgttatctgacatttttattctaatgggtgggcagtggtatttctttagggttttgatttgcattttcctaatgactaaggatgttgagcacctttgcatgtgctgattagtatctcttctatacgtatatataccatttctatgtgttctttggataaatgtctattaaggacatctgccatgctgtaattgggctatttattttttgttattgagttgtatcattacatattatagaaataagtctctatgagatatatgattccaattattttctctcacttgtgttgtcttttcactttcttgatagagtcctttgaaatgcaagttttaaattttgatgaagtccaatttacatattttttcttttgttgttcatgctgttggcatcatatatgagaatccattgctgaatcaagtttatgaagatttacccttgttttcgtctaaaagttttatagttttagatcttacacttacatccttgattattttttagttaatttttctatacagtcatgtgtcacttaatgagtggactactttctgagaaatgcatcattaggtgattttgtcattatgagaacattatagagtgcacttacacaaatatagatgatatagtctactacacgtctaggctaaatgggatagtctattgctccccggctacaaaactgtacagcatgtttactgtactgaatactgtagacaactaactgtaacacaattgtaggtatctctgtatgtaagcatgtcaaaacatagaagaggtacagtaaaattaagttattattatcttatgggaccaccattatatatgcagtccatcattgactaaagcattgttaatgtggggaacgactgtatagcacgaaataagagtccaactgcattctttgtatgtagatatccagttgtctcagcattttttgttgaagactattgtctccattaaatggtcttggcactcttatctaaaattagttgaccacagatacatgcatttatttatggactcccaattctatgctatatatatatatatgtctatccttatgttactaccacactgtcttgattactcatggtttgtactcctttttcgaaatcagaaaatgtggatactccaactttgttaatctttttgaaatattattttggcctgaatctcttgcaattccaaatgaattttagaatcaccttgttgatttctgtaaagaagccagctaggattctgatagtgattgcattgaatctgtagatcaagttggtgagcattgccatgttaacaatattaagtctcccaatccatgaacacaagatgtttatctgtttatttacatcttctttaatctcttttgacaatgttttgcaattttcaaatgttttctttcttttaattttttaaaatttttaaaaatttctttcaatgatgttttgcagttttgaatttcatttgctaaatttatttttagcattttattcttttctgaggctataataaaatttttttttaatttcattttttgttgtgttgcaagggtctagaaatacaattgattcctacctattgatcttgtgacttataagcatgccaaactcattgattagttctaatattattttggtgaattccttaagatctcctatatataagaacatgttatgtgcaaatagaaatagttttaattcttccttttcaatctgatgccttttatttatttttttgccttttatttatttttcttgcctaattgccctagctggaacttccagcacaatgttgaataaaagtgatgtaaatggatatccatgacttatttctgaataaagcatctagtatttcaccattaagtatgatattagttgtgggttttacatagaagccctttatcaggttgagtactctctatttctagtttgttgaatgttttttattataaaaattgttaagttttgttgagtactttatctgtgtgtactgagttgatcatgtgatttttggtttttattctattgctatagtgcattacattgattgatttccaggtgttaaaccaactctcattcctgggataaatatcatttgttcatgttgtataattcattttatatgttgtgaattcagtttgttagtattttgctaagaatttttgcatctatattcataaaaatattggtctgttatattcttttcttgttatatctttatgtgatttcagtgtcatgataatactggcctcatagaattagggagtatttctcctcattttttggaagggtttgtgaatagtggatattaattttttgtcttacacatttggtagaatttgccagtgaagccatctgggtctttgcttttctttgtgggtagattttgattactactctgaattctacacttatcaattcagattgagtccatttcttcttgagtcagtttcagtagtttgtgtctttctaagagtatgttcattttatgtaagttatctgatgtagtggcattaaattttttatagtattgttatagtcttttcttttttaaaggctgatagtaatactttctctttcatttctgattctactagtttgaatcttctctttttcttggtcaatctagctaaaggtttgttaatttcgttgatcttttaaaaaaacttgtttttggcttcactgactttttatatttttttcactttcctatttcactaatttctgccttaatctttgttttttccttccttctgcttgcttcaggcttagtgtgctcttctttttttgttttgcagtgtctgaagattgaagtataggctatttatttaagctgtttttttcttaatgcttacatttagtgcttcaaatttctctctaaacactgcatccccaaaatttggtatgttacgtcttcattcatcttaaggtgctttctaatttcctttttgatttcttcattgattcattggttattttagagtatgtttttgaattttcaatgttagtaaatttcccatatttcttttgttattgatttctaattttattccattgttgccaaacatgttttgtattatttttcatctttgagctttactttatgggctagcattcggtctatcctggagaatgtttgatgtacacttgaaaagaaaagcatagtctacagttgttggctggagttttatataaatgttatatagatatttattatattggtgtttgtacagatgctgatacacatacagtggttcacagagttccaatgttctatttccttgttatttctacctaattattctaccactttgaaagtgggatatagaagtctccagttattactgaattgtctatttctccttccacttctgtcattttttgctttattttgattttctgttgttagggtatatatgtttacaattcttatatcctactgaaggattgacgatcattattaaatgtccttctttatctctggtatcattctttgttttaaactctatcagtataaccactccaactttcttgtgattgctgtttgcatgatctgtctttcccagtcatttactttcaatctattttttatcttgtaatctaaagtgtgtcccctgaagagagcatataaatagatcttgtttttcctccccattctgacaatctctgcctttgattaggttatttaatccattcacacttactaccattgttgatatggctggattcatgtctgccatcttaatttttgttttctataagtctgatgtctttgttgtaaatctattgctttcttttgcatttagtattttcaaatgcagaatttatcttactttaatgatctttttactatctcttcttaagcaaccttagtggtggctctagggcttaccatctacatcttatcagaatcagcttcatatttatactaacataattccagtgagatatagaactgctactcctacataatgcaacttcctttctgaatttttatatttttatacctattacatctataaatgttacaaacacgttactttcctacattattacattatataattttgtatcttttactgaagctcaaagaataatatatataaaaaagggcaatgaatatgtatttatactatcttttataattcaataactatatcagtgccttttgtattataatgtggattcaagttattataatatctggggtcagttgctttcaacctgcacacttgcctttattactcaacgtgagtgagttagcaacaaattttctcagttttggtttatttgggattatgtttattttgctttcatttatgagagacttttgatcaatacagaattcatggttgatttttttttctttcagccctttaaatacagcatctcattgcatactgacctccattgttttaggtgggaagccatctgttagttttctttaaattcacttggaatttatggagtgggggttacttcttgctgtttctaaatttttttccaggtctttttccaggtccttttttccaggacatttttttccaatgtctccaacatttttactatgtgtgtatgtgtggatttcttcacgtttatcctatttggagtttgttagccttactagatatgtatattaatatttttcaataaagctgggtagtttttagcctttttaaaaaatatttctcctgcttcctcctatctttatttcccttctagtactccatcttgcaatatgttaatatttctctgagtagcatttttcttcattgttaaaaattgtttggattatataatctttactgatcaattttcaagtcattaattatttctttgccacttcaatccagggaaattttcacttcagttatttttcaacccttgaatttaaatgtttcctttgaaatagtttctatttttatgtataatgtattgatagcatttatttgctgtgttattgttatcattctcttctttactttaatcatgatttcttacttctgtgtacttataatggctaatttgaaggctttgtctgtttaactcaatatctgcttgcaatcacaggtagtttctgttgcctgttttttctcccttgtgtatgggtcagattttcctttctcttcaggtaccatacttttgtattagaaacttgacactttaggtaaagcattttagctattctgggtactcacattgggacttgtttgcttgtttgttttgtgactgtctggcttatctttgtgaattctagtccaccaccaccaccaaatgccccatttttccctcttgtggtgtgaagtttctaataatgctcctaagggaatacaaccttggctatatgccctgcaatgatagtgactttttcaggacactctttgactatctctttctttgaccatattcaatttcactaattaccagcctcttatgctcttgtttttaacaatgccctggtgcatagattgcttgaccaacagatccaatcaaattcaggattatttgaagagatagttcctgaggtcggtgtttgagatatgttttgaagttaggaggacacttcctagttgcctctattcgtggttcactccagcaaagtagccagcctacagtgcagcctgcatttccaaagaatccaccaatctccccccaattgcctttcatcattaccttcactgtttttgaaagcacccttaggtttgaacttattcacactctatgacaaattaagtcagttcctgtgggaagagatatggagctttctgttttgcagtctgtttcttcccttcgcaaaacctctgacagccttcaaactggcatggggacaatagtacagtctttctgcctgacactctaactttagttgctgagtatgggagactcaagagttttaatagattttcttgactacatatttatttatttattcattacatgatccatgtgtgcctttttaaggaacatttccagagatttgttgcccctaagaccataagaccatgtagagagacttaaacactttcttaaagcggtttttatcagtttcaccaaggagtgggtccacagagctccttatgttgaaagagaaacttttactttttaaaaaatctagctacttgtattaatgaaatgtttgtcctttttttatagcttgaatgtggctaaggccacataagcaaataattcttatatatagatattaacaagagtgatcggaatattgtgatgggttattttgatcaggttaatgatatagacaatcacaggatatatttttaaaaagtgatagagatttaaaaaaaataacaattagtggattaattaagagtatcattttctactttgtctaccacacaaaggcctaaatttagtctttaaatatagtcagtcaaatttatgataataaaatgtgctattattatataaagggaattatttatttactacttaaaaatttagaccatttaattttataattaatttctctaaaatgaatttaaaaatattactgtcctctatgcttggtagaatttctatttatttttgcctccccataagtcaccaatctcctagtttccaaactagttagtaagtttccatttgaaatatctgaaggtcaaattattatttagctatagatatccaaggattgagaaaatgtccaatcacataataaataacctgtcagaatcccaagaaggtataatagaaatgaaataagtaaaaataaatccacacacagagacagaagcctatcagaaattattataaatggttgaatttcagggaaaaatgctattacaaacatataatccctagttactcattttttttcttgattcttagatttaaagccagattccttcattatttctgacctgatatgaaacaccatctggcatgtgcgtgctaagaggattatatgtaagcaaaatagatatgttttttctccttctgactctaagactttttaaaggcgtgtagattatttaggtttgaaatgtgaaaattaaactggtaaagagaaaagacagtttctagtaatatattctttaaaattaaagcaattatacattgctttaacaatgaagtattttaattggcattctgcaatatctcttttaaattttaacatcatgactattttccttgaggattataaattaagattccctagaggaaatgataaagattttcataattatcttatgattcatacacatatcaaactgtatctcatagctcactaaatctatgttggccaaatttttcagataattatcaaatatttatcaatatccagtttcatttaacttataatacatgaaatgaatcaattatataacacatataagattgcaattcatgtttgtggttacttttcaaaatgaagaatttctgctgtttttaacatttactttaaattacataattttaaagctagtagtttacaagtcatgtggttaaaaaagaatctcatttatctatttaatgggggtctcactgtgttgcccaggctgcactcaaacttctgggctcaagcgatcttctcacctccaccttctaagtaactgggactacaggtgcccgcaccgcaccaggcaagaatctcatttttttgtctgtttgttttaagagaaagctgccatccagaaaggatatgtgacttatctcaaggcccacagctatttgatgagaagtccagggttagaatacaggtggtccaagccttggttcattctaccttggacactactgtgtttccttcacaatcctgatgaacttttgttcaaaaaatttcactttggagggtctgagaatatatatagttgcccaaacttcatgcacaccacactgtaaattgaactagattcacactttggaaagtaatcttttcctacattcttactcaaatgactatagtggctaatgtttgaattgcaaaacatttcctaaatatgcaaactaccagataaatctatgagaaacagccaaacaaactagccaatgcaaatgaaaagaatagatcataatgaaagtatccaaaaaggatctgctaaagtcaatctaccaggcatacaagtgatctaaatttctattttatatatggtataactaaaacttatatggctttatcttgacaaaattacacagaaaatagaagaaggaaggagggaggcagaaaggagaaggaggcagcaatcttgtttattggcctagtcctttgtgctggagtatattaaaaatgcaaatactaaaagcatggaacaagggcacataatggcatatatatttcacacatacctatgtgataacatttacccataatttcattaaaacaaaaagcagcaggcaaaatgagagggcacttaagatgtggaattttattaaaattttatctattctcttttatctcttgcatataagatcatatctatgttcagaattctgaatgactatgtatgccacaagaaaatataaaataaaatagtttagcaagatttttgttattgttgtcagctgtgtctgacaagaatatcaattaagatggcatttgttaagcccttgtctatgctgaactagctacagtatagagtagtttaacccatcttatcctataggctcagagaactcaattccagaatcatggagaatttctggctttgacgatgagggttattatatcatcagcttctgtgtctcactaattccagtgatgacaagatttttcatcatttatttttattttatttttacaactggtgcgtgttaggtttgtagaacacagggtagaaacagctggagttagtgttattatttttcactttgaaggaaataagaggctgacaacagtgaaggacaaagacaaagttgttgctggacatgctctggcacataggccacctcccactgcaaccagttctaaattaattatttattgttattttagttgctgtaactttctgaagtgtcctatctattgtgaatgggagtttcaactcattattgttttgtaaaacctaagactctaacttgaagagacactaaatttaatatgagtaatctgaaaacaattttagagctgtttatagtacacacacactcgcacccgcacacacactcacacacacagtacagcgctacactggctgcttcataatgccactcagacaggactacccacaaagcacactggctttgcccaaaactaatggatgtgagcaaaagtgaagctggtagatgattttgaattttgtagcgatcagtaaaatcaatcatgagagaaattaacactaagattttcagggccaaataaatactcaacctctaccattgctctggacatattaaaacactttcaaaaaatgtattcttttctgtctcaaaactcattagttctgtcatcaccaaagaagagtaaagcttcaactacctagcatcagttttttttctgtgtgtgtgtgtgtgtgtgtgttcaaaaataatttgctgtgaatggtgataatgaattaagaatagcatttagaagtactcacagtaaatttgaacatataaatttcattaagaaaatgagcaggctgtgctgaaattatacacaaaaccaatgtatatgtatgagaaaatctattctacaaaagaagggcagaacaaattttgcattagcccaaattaatttacttatatataaaatccagcagatctgattatttctttgttagagaagttttccaattttaaacattctatattgtgtttataatatgtggtcagtattactcatacatacatacactcatatacagtaatgcattgctcaacaacagggatacattctgataagtgtgttgtgagatgattttgtcattgtgagagcatcaaagagtgtacttacacaaatatagatggtatagtttactacaaacctgtatagcatgttactttactgaatactgtaggcaatggtaacttaatggtaattatttgtgtatctaaacataactaaacatagaaaaagtacagtaagaatacggtattataatcatatgggtctagagttgtatatgcagttgtcattgactgaaatgtcattatgcactgcatacgtgaatagatatggatatatatgaacacgtgtatctatatttatgtctgtagcattatttatttgtttctatgaaatttataccactatagaaatgccagaaaattaagctatctggggagaaaattactggggttaatctttagggatattgttttttcaacaattacaaaatacacttatgatcaatgaccatccttcattcccaagaaatctgtctctaagcataaagttgttaaataaaatattttgttaagtgtaacaggataaattatgatatattccgtccatgccaagataaccaaatagttttaactgatagaaaaacatgtaaaaataaatattagacaaattttatatgtattaataacaataatgcaaaagtcaatgtagtttgtacataaatgcaatgtaatgaaattttcctatctttgccaaaaggtaaaactgctttatagtgaaagatttgtggtggaggaggtgcgaaaaagagttggtctttggaaaagtcttgttgcatcctttttttctactgttgttacttcctatgggctcatacttaccttgtactaaacctgaacttaacatttttagggcaaaacaaatatttaacaaaagagtgcctcaaaacaacaaaagtagagttcatgtgcaataaactgaagtactttgtcttcattcttttacttggcaaatacacacaattcaaatttattccatatgatttctctttctagaaaatgtgacttcacataaattgatgaatgctttttttgcctgaaaccatgatgtcaaaataatacttagcatggcctagtcacttagtgtatttttggggtaaatgccattatactgaaggaaaaatttctcttacctgaaaaatggtgtatgttttcaaaagctgttatggtaaaatttcattaattaaagagttattatgtgaggtaaactgtaaagtcaaaaatactccacaaattaaaaaacaggagtagaaatcaatgccatcaaataagatagagcaataactaaactctttcaagtgaaaaacgcatataataagagaattattgtaacattgccacattttattatgactctatagattcaaacatactttaaaaccttagtttaaactttagaataagcttctgagatcaaccgatctttcttactagtcttatctcttttcattctccttgtttactttgctcatttcactttctataaagaaccattctctattcagagtaatctttatacacattactacctctgtctggaaagctaccctctccatatttactactaagtcaaagtacctcagggaagtctttcttcctctcctaccggatgagatgtgttcttaacatgtaagactattataaatattttcacaacaattaaataattactatgttataatttgtgtcttgactactattatgctgtgatcttccaggaggacaagggctaagtccctaagtctctgttgttcattgttggctgacgaattgtattaagcaaggttaaaaattctttcttctttccctttctttctttctttctttctttctttctttctttctttctttctttctttctttctttctttttctttctttctcttggtaaggtctcactgtgttgctcagactggagtaaaatcatagctcactacagccttgaacttctgggcttaagcaatcttctcacctgtgcccctagagtagctgggactataggcctgcatcaccaccatgctcagccaatttttaaaatcttttgtagagacaaggtcttactatgttgcccaggctggtctggaacttgtggcctcaagccatccacctgccttggcctcccccaaaatatgctttttaatgactgtccagttcacgttatattttctgataacattctacaaaaaactatttaataaaaataatttattagcatttgaaagagatatatcagaaaatcatgaaaagatttctgcaggaaaataatttccatattataaaattatgcatattttatgtgtgtatatgtttattattatgcatatgtatgagtgtaattgcacatatgtgtgtgtgaatgtgtgtgtgtacatatatttatatatagtcttttggtatgaaatggatggtaattttctgctatacagaaaaaaaaataaaactcatactgtgttctattccctaatagtgtctgaaggttcactttaatgtgattctgattaaagatggtcatctttattgattttcgaggaaaagtaagttgaattgatgtgaagttttgacatttctaaggaaaaaataccttgtgattgaagtatgtcagtaacagtattcaaatatcccaaagtaatcaagtcttctatgtaatgtttaacttagctaaagcctcattcggtgggtttgagagaagttgatgtgtttattggattttcctcttagtctttctgagaattcttaggaatgctttcaagacccaaagatggttggcccatcccggtttgctaaggaccacttccggttgcttttatcctctcatatccttttgcctccctcttttcctctcctatatgggataaaatgaagtgaagatctaagagtaatataagaggattaaatgaagaattgtaaaaggctaaaggagattagacattcacgctccctagaatccatctgtcttatcttctcagagacccctacatactggcccattttgtactcaatccttcaatattttggtgttttagaatccatatgtctttttaggcaaaaggctgccctgctcgaaattccttgcccacaaaatctagagtaagttagtgaaaaaaaaaaaaaagaatttaatctcttcaggggttaaaggttggcttattattattattattactattattattattatttgttttgaacttaggatgattggccatatgaccatgcatttgctttagggaagaatctcatggcactatatccagaccctggagacaaaagcaagagaatcataagagtgaaccaaatgcatctcaaaatttgtgtgattccatcttaaactacctagcgtatagcatgcactcaggactaactcaaatccctaattcagaaagcaaaaaaactaactttttaaagggcacagtctgattagaaacaccccaaatgtgttactaattagaaaacaatatttagtgtaaagtgttttatcattttactagcttagggtttcattgctctcaaaataatgaagaggtacttgtaagacaaaaaagtgctcactaaagtagcaactcccagaatgatgaatctgtctgttttagtgacaaattctaggctctattctacaagcaaaacttctttacaagctctaatgtgtcaatttccaatctccaacaattttaagttcttgactacatccagagcatcaggaagaatctgctggtcactctgaaatagcattttgtttttgctacacaaagactattcaagcttattattcatgcttgttattttgcctgaatggttgcaaaaagagagtaatttcttgaggtgtcttggcttgagttggaagacagaggggaacacactgaagatccctcaagacaatgcaagcctatgtataagaagggacttgccttaagctatgcacaggcaaagaaagaaaaaagggacatagaaaggaagtggtggggaaacaattttcagacaattccccaccctagtctggtgatccaatgacaaatgggactgtctgaagcaactctgactgaagagcaatgtcaaagtctctctgtctctctttttctttgccaggggaggatgttcgtatttgctactttgtaaagcaatatttcatgccagtgtcctttgttcttgcctataaattgagtcccagaatttcctttttgctatcttgcaagcgtaaagtgggtgtgattggggataatgtcccccactggcagtccacgctccacactaatgactcttcccttagtcagacgtgctgtgaagtgaatcattgaaggaaggttgataaagcaggaatgttttcaaatgatttttctacacacttctataaattgcctaaagatgatcattatcatctgagaatatgaagtatagctgcgtggaggaggggagaaagggcggacaggtagtccaagagggaaattatctgcatcattgagaaccaactgtcaaagcagagaaaccagagtccagggagtgtgtggggggtgcaaccacaggtcgaagaagagaagagccacacacttctcaacccccctcccactccacacctactccccagagagtgagagaaagccggaaataaagcttctgtttgtcactcctcacatcacaattccacttaactaaacaaaggcctggcaaaggcagttttaaccctaaagctcagagtgagaagtgcacctgttttagattcaacaaaatagtcccaaatgcctggaaggcatggtatctttgtggtcccccttgcctggcaagtacaggcccttctgagctacaaacctctggctatgagttctttcttctttgcctccttgggatgaaactgtcagctatggagaaaaagtaaggaaccttgtgatggactttgaaattcaacataatacctaagtagtaaagataaaagaatcctctcctccgtctcacaaacacagttgcatgaacccttgtccgtgctaattgaccaaggaatgaagtataagatagtaactacagatttaaaagaaaaaaaaattcatacactcttctccaaaagtaagtgtaagatttctgaaaattacaaacacatatactacgtgtatatttatggttcttaaactacttgaatgtatcttagcagtaaaatatcccccaataaaatattcctctccttcttgaaaacatgaaccacgcaatgctaagtgaaatatttgttacaaatatttttccagtggtttaaacactccaaatgccaaataaattgcaaggaatgaataatatttttgaaaatagttttatgtgaatgaattgtttatgcaaacatagatttaataatctgaatccaaataacaaaaaatcattccaaaatattttatcaccctatccagtttttactaacctttatgccctcagaaagttactttatttcgatgcttttctattggcagcagtaaaatctcatggaacttagaaaaggtgatgtagggggagtattctccatcttatatcattgcagtattcactttaaagcaatgtagtccttttctgtttctaccccaacatttcataattatatcattttacaagaattgtgtaatttacataaccacctaaattgtcataattgctagaaagtgctgaaaaagcatacggtaggcatttcagattcatttctgctctctgtttgaaactcattttaaatgccttttgcataaaaattcttttggtcaacaaaaaagtaacttggatttaattttgcaggaaccttctcttcttctccctctcagactgacttctcttctttcaggaagcctttctcaggtattagacctgagtactaacagggtcacctggtaaacaaacccctcctcttgatcttacagaagaagctgagaccacagaggttagctgacttgatctgagtaccacaggtcacatctgcggagccaagactagaaatcacttttatttaacttgcatgttttgttcattgtcccgcactgttctacactgcatttagaaagaggaaaaggaaaaatacaagaatggaatggtctctctacagttttctcagcatgccatttctattataattatcttaaccatctgttttgcttggaacaggcaaaagaatttgatattaagaaacaaaattcattctgtacaacagagaagggcttcagaaatgagactttatttcagaatacaagagtggatatcaattttatcagaggtttcatctgtgaagtagaatgccagtatttgaccattactgttttgaaaatcagtggctcatgtagttttgtaaataaaaatgtgcaactcaaagttattgcagcatattgtttataatatttgcttagagtgtaatgtggaaacctgaagtaaagcaccactaaacagttaagggcattggaaaatggcaacttttcccaatacccttaattgtttttctttcttgaattctgcttcaacttctctcctaaaaagctaatctatccttgcatacttaaaagacaatgtattgatgtttagctccttgaaactaatttagctgttatgtgaagctataaaacttagtggcaacatatgtgataggcataaataatggaccacctttctggtatgcttacctagtgcacgtgtgcacatatatggacgcacacactgcaaaaaacacacacatggatgcacaagacatacacgcagatacacaaaaacaatttatgctactaataattcagagttttgaaataaataagaaataagctggttcacttattttcctttctgtcaaaaattactgtaaaatatgtattttattgcaaattaagaaaaaaattgagagtgatgtacctgtcttgcagttacaggcttttcaaattacagatagtatttgaaagaaccaataatacctcaaaatcattattttaaaaaattataattattacaaattaaccaagcttcagaagaggtaaactcccaacatgaaagacagcttatcacttttgaaataagcatggaaggcagaacaattttcatagaaaaatggagagtattcattccaattaataaaaaaaaagctattatttctgccaaaaaaaaggaaaattaatagcaaaggtaggatgaaccagagaccctttcaatattgtcttctagaacataaagttattataataacactaaagaagaaaaaaaacttgaaacaacatatacattgagaaaagaacaatttttctgttcaacgagaatcaaattttttacagctgatcgatgtaatatagttctgtaattttcgtgaaataattttagaactgctgggaaatctcagctgaaggaaacaaagaaaagttcataaaattttctaaaaatcaaagtcgtgaaattttttccccctatgaattatatattagaaacaagtaattcaattccaactttctctttcctgtgatagtgaaaaagcttataaaccaacaacttaacacatgaaagccattttaattctcacaccagcacacatctcacaagaattgaaaataaatagaaaaatatgtggtgaaaacagtcgtgtagacccctaaacattttcagaatttaacattaagcacttttttttttctcgtggtgacttttctttttccctttcctaagttgtaatgtgatgtttatcctccacttaatttcttggcaatgtggtagtggatcaataaatcaatctggcatattaaccctagcaatcattttggaatgtggataaacttctttctgttattgcttaaatttgtgctcttcctgtaaatgaggttcattttataaaccacaggtaaagttccatagtccagcgttacacttgcctagcacatttctacatgaatcatttgtgatatgctactactttgtttaaaatatatacacccacaaatgtaagtatttatatgcatatatattatttatgtataaatgtgaaggtgaaattgactccactgaaacaagcaacatgggctataaatggtatgctcaatgtattcatgtttcattcttcccttcctccattcctccctttctccctctttccttccttctattacttttgacttccttctggtttgtgtattgtcctttattccttcaagagacaggctgtgaaagcgctaatatatgaggaatttattctttaatgtagtgtgttcaatccactaacgtccttgcctaggccaccaaataggcattaatgtgagagcacagtcttgagtaagtatagataatatatattttattataatattttacagttactcaaggtaattttaaaaatgccatttgaattttcattcatatataattcatgcttttattttgaatatgaatcagaaacaggcctgagagcaacaaaatagtttatgtagtagaatcaataatatgattacctaagatatgcaacaagatgctaaaatgcattgttatcttggcaccgaaaaatagatcatcttttttaatttgcctgtttaagataacataaaaaacaagacgtttgttttttatttttcttgataatctttgcagtgtttaaggaatgttaatcattcattcattcaatattaatgtaaacacaaaaagtaatcaataatcttgtccctagtagaggtgataattattaaaggccatttatattactacatatgtcactaaaacttcacaatattatttttgtattaacacattttgaatatgtctattagattggtgtttcctatatatacacccatatgacaaatatctctcgggttggtgaaaggaaaatttctctgaaactcataacccttttatcagaaataagaattaatgaaaactgtttgatatggtttggctctgtgtccccacccaaatttcatgttgaattgtaattcccatgtattgagggagggacctggtggaaggtgattggatcacggggaggatttcccccatgctttctcatgatagtgagttttcataagatctgacggtttaatagtgcttggcagtttcccccttcattctctctctttcttgctctgacatgtgaagactgtgccttgcttcttcttctgccctaactataagtttcctgaggcctccccagccatgtggaatggtgagttaattaactttcttttctttataaattatccagtctcgggtagttctttatagccgtgcaaaaacagactaatacttttgatttttttacttagtttccaggaatttccaggctacattttgggcttaacaagaataacttttcttagagtacattttctgatttaataaaaataaaacagcaatgatcgtagcaaatcattctgaaaatggtacaggacagagggttaaagttgttgtcttctgtagagagaagagaggtggacgtgaagttgaatctaggcagggtagttacaggcaatcctctctatgtgggatgtctgggtggttgaattgctgaatggttacaaatggtggaatttcatattatatctatgagtacctagtaattaatttttagatgcttattgaaatatcatgaatacaaactaaggatgttagcatgctttatatggggtcttacatttttaaaaaataatttttttatttgttgtttttactaggtcaaaaaaggatagaaacatctaaaacaatgattatgttacagtgaagaaggactttgttttgtcagcaatggagcattttccaagggagatagatgaatgcccactcccactgcctaactttgtaactgcttttgctgtttgtttcctctcattcattttgcattcgtgttaggcttgcatctgtttatgttacttgtctattattcatctacaggataactgctcagcagtcgttacttcctttcatatcttttctgcatcttttgtttccatgggttgttttggcaataaaaccaagaaaagggtacaaagcttataaaaaagtgcagttggaacatcatgtttttacagctctaagaacattattgctgatttcaaaaagtttttttaaatgttaaaatgtattcagcaaagtttaaagctcataggtatgataaatttgaaaatttgagaaaatgaaatttaaaaagtgtttccaaaacagctcgctactgtttgatcttcacatggcagtctgccttgtgcaattctctgtttactgtacattttaatacctaagtttcaagcaatgaagtcatagtaattccttacatttgtatagcacttcataattttattgtgtgattactcattcattatgtcctctaatctttctaggtagataattagcatcttcattttaggataggaaaaaagagagtaataactttgttaaatgacatgctaagatcaaaagatcaatggatctctgagcctggaatctacactaacttgatacctggtgtgggtcaggagaatcctcacaatataaagttgctccagacttcctgcaagcctaagtggtaaaataaggtttggggattttagattatgttagcatagttttatgtgtgattttaaatcattattgtgtctccaaacttattaagactctatctatctattatcaagggattgaagtttagctgggaaaggggactaatacgtatctattttaccatattacctttataaatccttaaaggaatatactttaggtcttatttttgacatgaagaaaaaattaaaaataatttgatcctgctaccttaccagccactgcgtatacgttttgtttagaaaataatggaaagaaacatgtgacaaagtggagaagataacaccatagaggcacatatatgttctgtatcttcccttatcaattacatattaccaatatatatatgcccaataagcagaaaacttttctgccaaagagatttcacttttatgtctctgttaaataatttctacattctacgtcccactgttgtaaaagaacaacccagtaatccctcaaagcctaggttccatgtaaaataaattttgtacgatcattatgtagtacttgtgaaaagtcatagaattttaaaaagcatttgatttgcacccaaaacaaccaagaagtgtcaatgtttcaataattgcataattatttttaaagttatcatctttggagtgctaaagctatcattaagtgataaataacaacataattttattttggcctgtgccatcctggactcacctaagaaaccttagttcatacttccagatcattatcagagctgtccctgtgaccatggtgtaagatgactcctaaggaaaaatgaactatgtctctctatctcctcaaccaaaaacatcagaaagtgctcccttaccttttcttccctccccaagagaaagatctttggtgaaaaaacttagtttctgccatgtgggtctccttatttacttatagtggtgagaagctacctttctactctgacatcttgctctctgttgctgtctttcagttgttgagtaatcaactcttaataagctgagtgacagtaaatggttacagtttaggaggattaataaaagttgctattaaaatatatatatttaataagcacagaggtatctgaaaatgtttatatattctccttattgaatttgtagaatctgtttaggtaatcactaagcctttagacagaatctctccaggtttccttcaatagatatgactttaatatcaagtcagctctgtccttttgttgactctcagtcataaatgccagctagaggttggaaactcaagcatcattaagaaatggtctgaaagtgacttaaattgtgttctggcctagattaagcctttcagagcaactataaatgtacggcgctttcatctaacctagccccatgggcatttaatgaaagtaagtgctcattattgttattgttatgaattataatatatactgtatataagacaaaatcacaatagaaaaaacaaccagcagcctaatttacattgagtagtccaaacatacaatttctcccacctaaaatttttaccttggaattttctttcatggctatctgtaattctataaaggtcagcaaaatactgagctgttttgaccaggcaaagaagggttaaacataaatcctaatatactataattaaatatataaatgttatgttcctaaacccaagttatacagcttaatataaaaaacgacatataagtaataacctatagcatacatacgtcaggaaattgtccttaagaaatcagctgactttaagtagcttataaatactaaataaaaatatattgcaaatgaaaagcttttttaagttgaattggaaattttttttgtaactggtttgattttacctgaaagtaggaaagcaaagtaaaatgaacaagtaaaatttatttccctaaaccccagggagtttataaatacatcatgagaacatttatgtagacacaataacagaaaaggagaacattagagatacaatatgcaaattatgggagaaaatattaagaaaaacagttttactaacattataacatgactgaaaattaatgattaaataagaaaatatctcacaataaattatttttagaagcagagacaattaattgggataacaagacaaattgcatcaagatatatacacacacacacatatagatatatacacacacacatatacacacacacacacacacacacacacacacatatatatatacacaaaagtgacctaatttatacatttcaacacatttatattgaaaggtcaatatggagcaaatcaactttatttaatttatatttattaggcagatgatgcctgaagaatgcagaaaccttagccattttgatttgattctttcagtccctgacctgcctacaggctgacataattttccttcacagagaccagtctccagtggttaccaatcttgatcttccagtgtagactgagttctctttgaattactggagcagggtgtatgcgaggttggataaatcagccaaaccgaaaggccctgcagggcaaagaagcagtagggcacctgtccttacattgtcctgaaagtgacctcctgtgtgactttctgtgaggtaagaggtcattctgcctctactttggcttagcttatgtcactcacagtaaaggtcacaaatcctgacagctttcggtgcttgagactcagattactgcgtgtctgagaaggagcggagagctgtgagacctgcttctcttaggaatctaggtcagaattcattcagtaatgccacccaggcccttcaaagcaatatcttacattgtagaaatgctttgagcaaatcctgacggttgttcataaattatattacaacctgaagggagaaaaagttattctgtcccttttttgactccagcttcttataagataagtcataaaatttaattggtgtcctcagagcaaggtcatagttcttaaattcacctatacccttcataacctccaagtcaataataataactgaagataatgttagtgccactaaatttgatgaaagtgtcggcagcagttaatgtacaagaaacccatccaaatatatgaaggctgttttttttttttttaaagtatgtgacgctttctgagtgtctctgaaatactgtaaatgtttggaatttggactttatataaataggaagcatatgcacatttgttaacagaggtgacagtatgaagattggagattggaaaagggtaagatagagggagagaataatcttttaagaaagcaagttcagacattaaatgtaaataaatggaaaagtctatgaggaaatgctgtaagcctatttttaggtaatttacctttcctatacaaaaagagaggtaggaaaagaaaaaaaaatagaaaaggggagactgaagtgaacacttgcttattgctttgaggttgtataaatgttgccaaaactatgcccaatgcctacttaagtgtgggaaacagagttgacacttaaagaattgtgcagtggtgactctggagtctagaagcctgttgctagtgtgaatggaactgaactcatttcctttaagggaaaggccaaagacagtgagtaagtgataaaaacttgtggtgagaatcaagcaatgcggagacattaaaaaattcctagaaccatatagatgctaacatattagattttgataatgaataactaattcaaatatcctgattctttttaaaaatcaaagtaatgtgttgcatccacctaagacactattagaaatataggagctatacttttataccttggcatggcatttcactttccaaagcaaatatgtgagactgtctctttttaaatgtttcattcagggataaaatatgatgtttggattatctccttaacccactgcatccaataaataaaaatctctcctcttaatattacctctattctctcagtaagactgatgataattcaatcttctttgactgtaatctctctttccaattcatctacaatattgtcagatcttgcttcaaaatgaccccagctttgttttttctatttctacagccattgtcgtaacttgaaactaaattgggatccatgataactgatttattgtaccatctttgctatttgatgttggtcaaatcacctaacttgagtaaaatgaaggagtggaagacctctaaatctaaatctaaatttctcttattgatattttccttctatgaaatacagtgttatgagagattctgagagagagagacagagagagagagagagggagagagagagagatcaatttaccttccaggtgcttattatcacataaggggaataaggcggcttctgacagagtgattagggaagacataaaaaggagatcgaaagtggactaggccttgaataaagtgcagaatattaacaagtcagaggaaagggcagtaagattaaaccaccgttgctcttgtcaaatgttttctcaaaatttattctttcataagagcctttagctcaatgacactgttatagactgaatgcttgcgttcttcccaaattcatctgttaaacctgatcctcaacgtgatattagaagagggtgctggccgggcgcggtggctcacgcctgtaatcccagcactttgggaggctgaggtgggcggatcacaaggtcaggagatcaagatcatcctggctaacacggtgaaaccccgtctctactaaaagtacaaaaagaaaaaaaaagaaaaacagcagggcgtggtggcatgtgcctgtaatctcagctactggggaggctgaggcaggggaatcgcttgaatctgggaggcgcgggttgcagtgagctgagatcacgccactgcaatccagcctgggtgacagagtgagactctgtctcaaaaaaaaaaaaaaaaaaaaaaaaggggtgcctttgggagttgattaggtcatgagggtagagccctcatgagggtgactggtccctttccagagagtttccttggccctctcacatgtgagggcacagagaaaagacagctctcttctctatgaaaagtggtccctcactagacaccaaatatattggactttctagcctccagaactgtgagaagtaaatttctgttatctgtaagccacccagtctatactatttttgttataacagcccaaatagactaagacagtaatgaagttcaggcaactcttcttaccccatggctctcattacttctgttcttcatatcacatatgcgggagagtcatgtatgcagtactttttgaatggaaggaaaattgagattcatgaagatgtcatgagtaaatctccccaaatctgaaactaatttagcctccagatttactgtatattagggaaatgtgcatatgtacacatacacacacacacacacacgcacaaaacacacactgtgctaaactttaagaataataagagaaaagactactggctaaaaataaatgtcctactgaaaagtgtactaaaatcccatatttaattatgattatttaacagtgatatcaggtaaggatgatgtacatttgaatgtaattgattaaacaaaaatacagaaagcatttttaattaaatataccctattgggaaaagtactcaaaaactaaaagaatggagctgaataagccaggtaagcatcggaaaagggatatcacagaggtagattctagccaagaggtatggagcctgtctccaagcagcctccaacattcaaatattgtgggttccttggcaagactaatggtataatgggtaagagtgcttcaggctattttaattaaaggacaagtttaccaagaaaaattataataattttttttcctccatttaacatgatttctgccaggcgagacggctgacgcctgtaatcctagcactttgggaggccgaggtgagtggatcacctgaggtgaggagtgcgagatcagcctggccaacatggtgaaaccccgtctctactaaaaatacaaaaattagctgggcatggtggtgtgcgcctgtagtcccagctactcgagaggttgaggcaggagaattgcttgaacccatgaggtggaggttgcagtgagccaagatcatgccactacacgccagcctgggcaaaaagtgagatcctgtctcaaaaaacaaaaacaaaaacaaaagaacagaaaacatgctttcatgacgagaatgtgctggctagattggactgaaaatagaattatttgacagttatttcaagttgcacataggaattggcattctggttacaaattagctttctatatggaaaggagccttaataggggacatttctgtactggtttgtctgcaatgttcatgaaagcttcatttagcctaggtttctctatatattactgcttgaatgggttttctttatcagtatattatataaaataaaatctacatatattggctaataacttttgagtggtgattgtttgacagatgttgcttgacatgcttcacatctaatctgtaacaggactttatgttatctgttttaaaatgaatgtaattttatagccaaagggactgaggaatagaaatgttaagtactttgcctaatatcacacagctggtaagtgaaggagcccaaattcaaaagaagataatctagcttctgaacccacattcttaacccctgtggcaaacggcttgtcagattgggctgacaatacttaaatccatcttccgtgctgagaataccatatatgatttgctataaactaagtaacaaattataaagaatatactctgtaagtttggaaatcatactcaattttgttgttgttgttggctaagaaactttgggtaactttagcaaatgtggctcagagattagtcccctgatttatttatcacccctccagctttattgaggtataaatattgtatatattggaggtgtacaacatgatgttttgatgtacatgcaaattgtgaaatgattaccacaatctaattaacatatcatctcacattgttaccttttgtgtgtgtgtgtgttgcaagatctattctcagcaaatttgaagtttacaaaacactattattaactatactgctgtatattattaatgacactgcaatacatactttatattagatcttcagaatatattcatcctgcaaaactaaagctttgtaccctttttaaaacataatatcctaatttccccaactgctagtcactggcaatgatctttctatttcctatttctagaagtctgctgttgttgttttttaagattgcacatataagtgagatcatgcagtatttgtctttctgtgtctagcttattaacttagcacaatgtcctctaggtacatgtgtattgtcacaaatgacaaaatttccttctttttaaggctgaaaaatattccactgtgtgtgtatatgtgtgttaatgtgtgcatgtagcacatttctttatctatccatgaacacaaatactaaggttggtttcatattttggctattctgaataatgcggcaatgaacatgagagtacagatatttcttcaacacattgagctcattttcttatatgtacccagcatttagattgctggatcataggcagttctgtttttaattttgtgagaaacttccatacatttttccataatggctgtgccaatttacattcccaggagcagggtacaagtgttcccctttctccatatcttctccaacatttatctttagtctttttgatcatagccattctaaaaggtgtgaggtgatatctcattgtgattttgatttgcattttcctgataataagtgatgttgagcatttcttcgcatatcttttggccatttgtatgtctccttttgcaaaatgtctattcaggtctttgcaaattttttaatctggttattttttttcttgctacttagttgttaggttccttatatatttttactattaactctttatcagacgcataatttacaaatattttcttccattttgtaggttgtctctttatgcctttgattatttcttttgctgtgcagagatttttagtttgatgcaatatcacttgtctatttttgtttttgtcgcccgtacttttgggattatagccaaaaaacaaatcattgcatagactaatgacgagtagcttttcctgatgttttcttctagcagtttctagttaaaggttttatgtttaaaattttaatccattttaggttgattttttttatatgttgtgaaataggagttcgattctattcttcaggatgtggatgtccaggtttcccaacaccatttgttgaggagactatgatttcctgattatgtgttcttggcacctatgtgaaagatcaattgaccacaaatgagtggatttatttctgggctattttgtttcattggttgacatgtctgtttttatgccagtactatactgttttgattactatacctttgtagtatattttgaaatcaagtagtgtgatacatcaatgcctcaatattctacttgtacaagattgctttggctatttggggtcttttgttgttccatataagttttaggattgtgttttctatttctgtgaaaaatgccattggaattttggtaggaattacattgaatctgtagatagctttgtatgtagtatggacattttaacaatattaattcttacgattcaagaacatggatatttttccatttattcatgtcttcttgaatttcttttatcactgctttgtagttttcagtgtataaatattttaccacttttgactttgttcctaaatattttattttttgatgctattttaaatggaattgttttttaaaattctttttctgtagttccttttcagtttatagaagtgcaactaacttttgtgtgttcattatgtatactgcaatactattcaattcatttttaattctaacagtttttggtatagtctggagttttctgtatataagattatgtcgtctgcaaagataccattttacttctttcttttcaatgtgaatgacttttattttgttcttagctaattgctctgattaggagttcctatatgtaccatattgaaaacaagtgttgagagagagcagtcttgactcattcctgattttaggagaaaagctttcaacttttcactgttgagtgtgttggctttgggtctctcttgtatggcgtttattacgttaatgaatgtacattccttctatacctaatttggtgagcgtctttattacaaaaatatgttaattctttttcacatgttttttcagcatctatttaggggatcacatggtttttgtacatcattctggaaatgtggtatatcacacttattgatttgtgtatgatgaagcatccttacatccttggaataaatcccacttaatcatagtgtatgacccttttaatgtgctgctgaatttggtttgctagtatattgtggagtttttgcatctatgttcatcaggaatatgggcctctaattttcttttcttgtagtgtttttatctggctttgttgtcagtgtaatcctggccttgcaaaattagtcgggaggtattccttcttcttcttccattttttgaagagtttaggaagcactggcattctttttaaatgtttagtagaattcaccagtgaagccatcagttcctagacttttctttgttgggaggttttgattactgattcaatctccttactcattattggtctgttcgaattttctattactttatcatttagttttggtagagtgtgtgttcctagaaatttaaccattttttcaaggttatctaatttgtcaacatataattgttcattatagcctcttatgatcctttgaatttctgtggtaacagttgtactgtctttgctttcatttctggttttaattggatcttctcttttttatcctagtctaattaaaggtttgtaattttttttatctttccaaaacaccaactcataatttcatcactttttaaaatcattttctcatgtttatttcatttatttttgctctgacatttattatttccctccttctgctaattttgggtttaatttgctcctcattttttagcttcttgaagtagaacatcaggttgtttattcaaaatctttttcctttcttttctttttctattttattttgttgagagagtcttgttacattacccaggctggagtgcagtcgtgcaatcatgggtcactacagcctcaacctcctgcattcaatggatcctcctgcctcagcctcccaagtagctgggactacaggtgtgggctaccacacttggctatatatatatatattttttttttttttttggtagaaatgcggtttcaccatgttgcctaggctggtcttgaattcctgggctcaagcaatctgcctgccttagcctcccaaagtgctgggattacagacatgagccaccatgcctggtttcttttcttaatgtaaggatttattaaatttccatcttagaactgcttttgccgtatcacatgggtttcagtaggttttgtttccatttttatttgtctcaatatattctttaatttacattttaattttggcttttatccaatggttgttcaggagtatgttgtttagtttcctcatatttttaattttccaatattcttcctgttattgacttctagtttcatgccatttcggtcagaaaatatatctaatattatgtcaatcttcttaaatgtgttaaaatgtgtgaactaacatatatattctggagaatattctgtgtgcccttgaacagaatgtgcattctgctgtgttggatggaatgttctttatatgtttcttgtgttcatttggtcagtagtgttgtagaagcccactgtttccttattgattttctgtctgtgtgaagataatggggtattgaagtcccctaccgttattgcattgtggtttatttctcctttcagttcagtaaatatttgctttatatatttaggtgtgccaatatttggtgcgtatatgcatacagtttttatatcctcttgatgaattgactccattatcataatgtaataaccttctttgtctattgtgacaggtttggacttaaaatctatttcatcttatgtaagcagagccaccctgctcttttttattattatttgcaggaaatatctcttgatttctgtaaactttcaatctatgtgtgtccttcaagctaaagtgagtctcttttaggaggtgtatagctggatactgtatttttatccattcagcccctctaggtcttttgactggaaactttaatctactcaaatttaatgtaattgttactaggacaggacttcccactgttattttgttgttttctgactgctttgcatttctttctttctttttttcctctgactgtattacttctgaattgatggctttttgtgctgctatactgtgattcatttctcttttgtgtatctactacagattttctttttggttatctggggatgatttaaaatatcttataattagaatagtcttttttaaagctgataactttgactatagataataattctacacttttacttctcccacattttatgttattgatgtcactatttacattttttatattatgtatccattcacaaattactgtagctatgggtttttaaagttttgtttgtctattaacttttagaccagattaaaaataatttatatactatcactacagtattagagtctgctgaatttgatgatatttttacctttatagggagttttattttttactttcgtatgcttttatgttaattagccttcttttgtttcaacttaagaactctagcttttcttttaagttaggtctgatagtgatcaatttcctagctttcgtttgtctggggaagtatttttcctttattactgaagaacagccttgttaggtattatacttctagttggtctgctttcttttatcttttgtttttatctcatttgatatgtcacatctcctttcctggcctgcaaggtttctgttgaaaaatgcactgaatgtcttacagagatttcctttgtgtaacaattcactcttctcttgtcactttcacaattaattgtctttgacttttgaaaacttgattataatgtatctccatgaagatctttatgtttaatctatttggattatttgggcttcatggattgggatgttcattttcctctccaggttgggaagttttctgtcattatttctttaaataagctttttgccctttctcttgctctactcattctgaatcttgtataatgcatatttggctttcttgatggtgtcccataagtcctgtaggcttctttcaggttttttattcttcttacccagatcaagtctgctgttgaaattttacccagatcaagtctgctgttgaacccttgtggctcattgagtttctttaagatgaatatttaaaattcttttgtcaggcagcttgtagttaccaatttccttagggttggttactggtgctttactttgatactttgatactatcatgttttcctgattattcgtgattttatggctttgcttgatgtctgcttatttaaagaaatggcagctctttcagtcctcatagactactcaggaagggaaaactcttcacaagtcagcctatccagagattctggatgaggttcaggggcaggctggatgttagaatactccaacaggctggcttggtgcctgggtcagtgggtaaacattgctggcacctgggcccacagggctcaaccaggcgccaggctccacagaaacaggccttgtccctaggccttgtctcaaggcctgaagccttggaccgtggggcaggtatgcctctggaatgggcttagaacttaggtccatggggtttaactggagcttgggtacacaggagcaagtctggggccagagtccactggcattggcatggttctgtggttgacagaaagtggagtactcgtttcactcttctttcccatgtggaggatatctctctccatgttgtgctatatgggcttggacaaactagtgttgcgtgtaaggggaaaatgttctttctgccctctttaatgtatgtttgttctcttatttctgtgttccactcaggtgctataatctgtcatccagattccttagctcttgtgaagatatctttgcatgtaaatgattgtttaaattcatttttttttttttagagggggagtctcgctgtgtcacccaggctggagtgcagtggtgcaatcttggctcactgcaacctccgcctcccgggttcaagcgattctcctgtctcagcctcccaagtagctgcgactacaagtgtgtgccaccatgctgcactgatttttgtatttttagtagagacggggtttcaccatattggccaggctggtctcgaactcctgacctcgtgatccgcccgcctcagcctcctaaatgctgggattataggcatgagccaccaaactcggccacttaaattgatttgtatgtgagggcaagagtgctgccaactcctattctgccgtcttgctgtcacttgaggagtcccctgatttccctatatgtgatctcctctacatctccagctgtctggcccaggctattagcactatattgtctaacaattcgttaagggccctattgcctaatcttaataattgaatattaacatctgaaataactacagcttcctatccctctatccttattgctattatgtctgaaatctctctggcattaagtttatcttaccctcagggggattagatttttgaatactgcgatgtaaatgaaattttaaaatacattcaattaaaatattgttatacttgaagttgaaaactaaaatgacctctttactttttattatcctctcagaaatatgcatctcctctgtgttagacttctgtcagactgcatctatggggcttctcttgtatgtgtccatttgtctcccaaatatacagtatgtgcctttggtttaggtactacttgccagtatcagttatgactaggttaataagatcatattaaaatgaatgatagtttatgctcagaaaacaaagtatgcctaggttataaaggttatgtgttatttataactgtccaatgcaactaataaacatttccctgacattaagctgtttagactcaatattatgtgggtctcacttttgctgatacaaacttgtgaagacgaagagaaagaaggagtgagaggtacaaaagaagaagtaggaggggactatattctatagatgaaaattttcgatctagaggaacaagtagcttttctgaggctacagaaccaagagaaaggaccaagatttgagttgaaagcattgtacctgccttatactctcttgctacatccggaagagatttcagattatttttatcatgctttcttcacatcctcaatccaacctcaatgaaagtattcagccatttgttgagggtgcaggaagatatacacagctagtgaattactggacaaaatgaatctatttctctgatcttgatatcacatgatagaacatagaatttatcctcattaatgaggaagggtgctatttaaaatggaccacagaatatagaatcagatgattgcatttgagtttcaactcagatatacactagataaaatgttagttacatcacccagcaaccctgaatcttactcagtttaaccatatgcatgttaattagcattgatctattttaaactgttgtaatatatattggaaagtacttctctatatattttatcaaccctacatatacatacatagagtactttatatatttcaattattatttctagccacttctagttacctaaaaatctttctttctgtgcaaaattgtgtctctgtttgttttcctccatagcaaatgcagcagtgtgtgatcaagtatattctaaaagtaaaataagaaataaaaaatagaacccatctgagatttttcctctttaccccatcttcagcccttccataataccttgtaaggaattttcttaccatgagtattcacaaattcggattcattccctagagttaacaatgtccctagcactgggtagtgtaaacaactgggtttttcttttaaacgtggcaaggcaccagtagaagttggaggaagtcccacattcaattcattatagtaacgatataaaaaattcacaaaattttaaagtaaataataagttatgaaaaaaagacaaatgggcacgacaatgtgaagaagtctgaatctgttgtcagaacaaagcaactttcttaaaactgttctccattgcctgggtaagaagtatttgtaatcaaccagcttgaaaactcctcttgaaagaagatgtaaacttgaaacaaaaatgaaaacattcccatttaagccttggaaaaaataaaataatttagttagaggtgttttagtgattaaatattttaatattaatcaccctcctattgctactacacataatgcaatcagcagagtcaatatgtgtatactcttatgatgataaagatcaagacatagaattcaattaaagacatttcactctacttgcagcatctcccttggcccctaattaagtgggaagaaagaaaaaaagaataagaattcttgaaatcttttcagagcactgtgaaacacgaagcacatccagagattacttggtcacctgtatgttgttgcaaaagtaagaataaataacaaggttaaaataatgcccttgctaaagactttcacgtgtaaaaaataatataatgcatacctactcctagatcctgaacttaatgttaattctctctattgattcattcaccagagtttgtaaaaaagcccttcatctttattacactgtcttctcatctcttttttttttttctcctcttctccgtgcagctaagcttttagtatggttatttgcacttttttcttcactttctcaccttccatttcactgttctgtaaactgcaatcaggctttgagcatgtgctccaaccccaacaaacctgtcgcagcaaagatcactgaggtcctattaagtgtgagacacagtgcacatatttctgtcctatattcttgacctttctgaagctcatgaaataattctatgtgccagaaacccttatttctagctttttaaggtagtgttctcttatgattctcctcattctttattaatcattctgtctaaatactggccaagttttgtctatttcattagactttgaaagaactagcttgtttgttttatttgcttatctattgaatctttgctttttactgaatcagtttttacttttatctctcatattatcttcctcttccacatactctgcattactgccattttcctaaatttctgagttgatctcttagctcatttatttttatgctttcttctttcctgggacttctttcttagtactttcttcttttctagtacttgtattatagtcatattgatttctcagctcattaatttttaatcttttttgtagtacttttataattttccctttaaataccacttgaaagcctctcttaaagttaatctacagtattttatttttatttccattctaaaataaatattttatttatttatttcattttgatagtttagaatttccaaatgtatgaatacttgaagtgctattttttgtattttataaaaaatattttaagtgggaaaatgaaatgatctgttttacatgttttaaaagattactcaggttgttatgatagttaatggaatatagccagagtggatattttgaaaataaattggaggttattgcatagtttgagagattaggatactcagtaaaggcagaagagatgtagacagattcaaatatgcattgaaggtataatggacaaaataaatagtagcatcaagaataacattaaagagaaaagtgaggaaagggtgagcaagggccagggccaataagcttctccttggtttttctatatgtatctcttctaattaaattatgagaataactcagctgggcacggtggtttacatctgtaatcctggtactttgggaggttgaggtgggagaattgctggagcccagaagtttgagaccagcatgggcatcatagtgagatcctatctctaaaaacaaacaaaatcaccaggaatggtggcatactcttgaagttctagctattggggtggctgaggtgggaggattaattgaacacaggaattcaaggttacagtgagctatgatcttgccaatggactctagcctgggtgacagattttttattctgtcatttattagaataaaataaaaaaatttattctgttactagaatagaattttattctaatttttttaaaaaattagaataactcatattagttctaggctttctgttacctgaacacgaaatgcatttacgatttctaccctcaacaaaacacagacatttttattagcttggaaaacagactgtaagtggtgtcaatacaaaagaatgccattctttatttggaagagtctctgagtagcataaccaaataaaccaacggactatgatgtgtgatatggtttggctgtgtccccactcaaatctcatcttgaattgtagttcccataatccccatgtatcctgggaggcacatggtgggaggtaattgaatcatagaggctgttacccccatgctgttctcgtgatagtgagttctcatgagatctgatggcttcatactgggctttttcccctttgcttggcagttctctttcctgcacccctgtgaagaggtgtcttccatcatgattataattttcctgaggcctccacagccacgtggaactatgagtctattaaaccttttatttacttatttttttgagatggagtttggctcttgttgcccaggctggagtgcaatggcacgatttcagctgactgcaacctccgcctcccgggttcaagcaattctcctgtctcagcctcccaagtagctgggattacaggtgcccaccaccatgctcggctaatttttgtattttttaacagagatggggtttcaccatgttggctaggctggtcctgaactcctgacctcaggtaatccacttgcctcggcctcccaaagtgctgggattgcaggcgtgagccaatcaatgtgtctggcctaaaccctttttctttataagttacccagtctcaggtatttcttcatagcagtgtgagaatggactaataaaatgagtaaaagttgacatatttaacagaaaaatttcttctaactgtgaaagggattaatataagttttattcaacattcacatttttgtagaacagtacgactttgtgataccatgtattcaagtatggttgaatttaatttttaaaggattaccagaataagaagactgtgtgttaagaatagaggtaatcatgcttggagaaggtattttggatgagaagaatatagattagttttgtttgtacattataactttttaaagttaagagccagtaaatagtctggattaaacactttttagatttgttgactaggagaataattaaagacatgttttcaaagactacagatgaaatttataaacagctgaaattagggggaaatgcaacaggatattctctgccactttgtcctatagcttccttgcataatccaagaacatttaatcagttcaaatttgcctgaatggaagagaacaagaattgctagagggtgaaaggaatgggagggaacaaccccagagacagcaaatgcagctgcagctctccaatggcaacaagtgttatggaaatacgcataagcacaatcaagtctatgtacagcaggaacttggtctttggtgcaaaaaggaacagacttttcacagttgatttaatttgtctatgttataaatggaatagtaatcatataaaggaataaaaaagaatccatagccctagggtacgtgtgttgcttcaactgtgcctatccctcaaaaacatgtaattcttcctaggaaaatctgcagcttttgaattattattggggggcactttttttcaaaacaggaaaattttgactcttaaagcctgatttaagtcctgctctaatttgtaatgtagatttcagatggctttgtctatgaaatttgttcaatagattcaaagcaaccattctatacagtgtaactttccttgttgaacatggtttaaaaaaaagccttgaacactcatctctgtctctcctagtatagagaacagattcacaaatgggcattgactgtctctgtcctacttaatgagtttcttcatagaaaggcaaaaggtgaatacaacacaaagacgatagtgcaattatgtgtagaaattgttgacataaaaaagcctattttatatatttatgagcaaaaattatgtaaaaatgcaatactggcaaattaacaaggtctattaagttaacctcaattaaatctttcgtgttcattcaaaatatagtaaattctcatctagtaaagtttctctctctctctctctctctctctctctatatatatatatatatatatggttttgttttgttataagacggagtcttgctctgtcacgcaggctggagtgcggtggcgtgatctcggctcactgcaacttctgcatcccggcttcaagtcattctcctgcctcagcctcccatgtagctgggattataggcgtgagccaccacatccggctaatttttgtatttttagtagagacgggttttgccatgttggccaggatggtcttgaactcctggcctcaggtgatccacccacctcagcctcccaaggtgctgagattacaggcgtgagccaccgtgcccagccaaagtcaatgtatttcaaatgttcattgtcattgcgtttgccttgtaactatagatcacgggtggtgcccagtgggtagctatggggttctcttttctggttcgtaataggaatgtctgacattgtcattgaaacattaaaattataggaatgttttattgtttgctaccatttctctttttacctctgatccaatattaaatggtgttcctcaatttcacaagcatgttatgtaaaataaatacatttcaaattgttgagcacttttatcttctgggtttgaaattattcatgtcctgactttgaaactttattgcagattaaaaacaaattaaaacacatatacatccctacatatgtgtacacacacacacacacacatgaacacacacacacacacacacacacacacagttgaatttgcttaggaaagaaatccatcaaaataaataattcatgttgggatggactgaaatctagtcttttaggaggtgccaacagatggtttacatttatagaatgcacacttgctgacttccaaacagaaatgaaaattcataaagtatatcattaggactccttataagcagcattatgattatggtatgaatttggattttcccaggtgaagagttttccatcataattttactaagaaaaagtgaaacaaattactttccagttactatcttgtgttagcatgtttgaaatcaaaccctgctgctgatcatccagcagcacatgccaataaactcagacctcaataaggctgttgttctcatgatgatcatcattttataagaagtcttgggcatttttaatcctttaaataataggcattattgcaactaataaaataaggcagtttctttagctttcacttcctattacatcagttaggttaggaactttctatcggtataattaggggtgagacctcagcttattaaagttcaggcaacaaggcacttttagttaattttagcaacccttttggtttaagtagagctacttaataccgtgggataatagtaacattttatttttagtaaatgttgctgctcaccaaaatgttaacatttatatcaggtaaggttataattaaaacttgttttacatctacaaaaagctaattcattgctcatgaagattttgtctacacagtacaaagtaaagtggattatgattggttatacatttaacgaaatcaaagagtcatgaaaatcacttaaaaccaaaacacgcctgagattttattcactaagtgtgtctagtagctcacttgatcaaattagctgaataaatgacaaaccctatccagaatggtagtatttacaatatggagaatataagaaaacataaaaaaattaattgggcaattgctagattttcttaatgatattttaaccggtctaaattatgcaggcaattgttttcagtctctttttcaacatgttgggttgcccactaccaaaataatttagacaaatattacggtgggaaaaatctgtcatttcagtgaaaaaaaaaaagccaaactataaatgttttgtatcatagaaataaaataactagtgttttaggctgaatttgttgtttttaaatcaatgattttaataatgtataggtggcctcttcatatttttatgcagaaatacctaagtgttggcatagatcattccaagcaaatacaatattctccgtctgtaaactttagatatcatatactgtacagtgaaggatgagtgaggaacagaacttttagacacatttattcaacaaaaacacctaaagttgatatttttgcctttccagtgattgacttgatatcctcaattaggggaaaaactagatattatatttggattcaattaatccataatccattcaatatatagtctatacatgactaaatataaaataagattgagcagcactttcttgcttaaaatggatataggaaagaaacaaaaacatagtttatatagatataatttgtgacgttttaacagaggtaaaataatctggtgatatttttgaattttatatggtagaattcaatattttaatctgtcagcctgattcttttacgactagacacaatattccaaaagcttacattccatatttttcttggaaagcaattggcattaaatgtcattaagaacacaaagcagaaataaattcttccatgtacaactcctcaattaaataccttaacagcaagtcatgataatacgattatgcatagtgaaatgtgctatacgcactgcagaagactttgaatgaatcctgggttgtgtggtgaataatcaagaagatgtatttatcctatcttgtcttaggttaggagaaagtataagtaaggcagaggggtcctctggaatataggagcttccaagataatgacgtatcagttgaatttgcagcctaaaaaaggaaacccagtagtccaatggtcttgggtagaaagagtttagcataattgagcccacgtagaatttacgttgtagaatggatggtactgtggtttgaatgtttatgtcccctcaaaattcatatgttaaatgtgatagcattaagaggtggtgcctttaggaggtaattaggtcatgagggtaggacttccataaaagagattaatttttttataagagacacccaggggaccttgcttgccccttctactttgtgaggacacaatgaaaagaagctgtgtctgagtgagagtgagagcacaggtcctcttcagacattgaatctgcctgggccttgttctcagactttccagcctccagaactgtgagaaataaattatgctgtttaaaagccacccagtatgtgatattttgttacagcagcctaaacaaactgacacagatgggacccaaatgtagttactgttcctagaagaatagcttggaagatttctgagctcagagccaggcatctttctcagggctattgcaaaggccagtccaagaggatgaaggggcaagatagggagtgcatgtggaatgataaactcagaattagggccaaaccagctccaactaatcagaccactttaaagtagaatcagactgcagcttagaacactaactgggccagcagcagtaaactgaacaagggtcattgcccagggaaccaagaaaatcagaagacgttttattaaacaaatcattcccaccaagaggtagcttgggccacaattctcccattacacatcaaggaagattccttccttccttggaaggaatctgaggactaagatgggtagttaacatcctgaagggctgcacattctatcttagaaatactatgcattatgtaaagggattcattaagaattggaataaacatgttttaaagtaggtaggactatatcttgtttttcttccccactactcagcaaatggaggtaaattcaactagattaattattgataacataaaccgttttctatgtgcccgagtaaactgtgagtttgcaaccctacaacagcaggtagtattactacgattgtcatcacctttttcattgtattgtcttacagtttcctttcaggctagtatttctaatacactatagctatagctctctttaaaatattttggtggatacataatgatgagatgaacctttgctttttaaaacctatttatctccctaagctcatctattgcaattttgccccaacccacaactcattttccagccaacttttagattgctattcctgaagtatgccattttctcttttgcctctgggtttctgtacatgacatgctctccttacatgctatgcatggctaaatcctgcatatctgttaggaatcagttcagatattaccttttccaaaaatctccctaatttatggtggccaccttcagaagagcaacattctttcttgctcttgaggactcctcagaaccaaggttgagaaatgatcatttttgagaacattgtagattcataaagttaaaggcaagatcttcctaatctgagaactccactgtcctaagaattgctacttgaggtttctttatcccttaggcaaatcattttttattgtatttgtctctttggctaaaggaatcctttatgttatatgccacttcacacactggaggtttacactgaaacatgagagttaagtctccaagtaatgctgattatttattcttaatgtatagcaaggcttctgtatgagcagagtcctggcatttagaaaaaaatcttttgcggaaatatcaagatttttgtaatagggagagcctctgtggtttgaagtttgtagagggagtgcagttctatttttgaaatgtatccaggacttccaacaggtagagtcacagagctccatgtgatcaaatcagattcatcatgaattgccagtagtaagatgagggacttaatggtatgaaatagacattggtagatgacagtggattgactgttatatgttctgttctttattgtatgatgacatatccaggtgaagcagagaaacaggaaaagataattcacagctcttcttaggattaatgcatttttatcagaaatttatctgaaatagccaaaccacacgctttcaggttggccctgatttctatattaaataggccctaaagacaaatgaaaacaaccgcttctggggacctcagtagcctgattgtgacacacataggcatgcctctgttgctttgtttttttaggcagaggtcctaagagaatattgttaagtcctgaccataattaaatatctcacccacagtagaggctccactcatgagtactagagattattaatgaacagggcctaaaccttaagaaagtcaagcaacttctatttttgcaatttttagatctatgagttgccatataagaagtctggctgttctacacagtgccttttagagaagtcatgtggagaatgatagtccctgagacaacacagaaagaaagagaggtcaaggtgtgcaagcatcccagtataggtggcagctatgtagatgagacatcttggatatttcagcccatttgtgcacccagataaccacagccacagccaacatcactagaagcagaaaagctgccaaatttggcccaataaatgcacaaaatcatgagaaaaatgggggttgttgttttaaactactaaaatgtgtgaagggttgtcatacagtaataaataactgaaacaaagactttaccagaagtagggctttgctgtaacataaataaaaaatatatggcatttgctttgtgatggacactggcagaatctgtaaggactttaagtagactgtcagtaaaagctggagggacttcttttttcaggtttctgtccccgccccacccaaatttatgcaacagcatcttaatcttcctgtctccaatccggagatcatttttttttttttcacctaaaaacaagtctaaaacattcagagacactcactaaacactaaacaatatttttcagtttcatacagagggcttcagggtttggctcgggcttacttctctgatcctactggttagcatacactttctcaatttggactgctgtcttttctcttgcattcttttttttttttttttttttgcttagtagtctcattcagatattacccatcttaacattaactagccatgcttttctgctactctcccgtactgtgctaattgctccagctagcacatttccccctaatcctgtgacagtttcatattatcttctttctattgtgtcttctacatcccttccttggccaggctaattcccacatgcccttctggtacttcttttggaaaacctttacccacttctctaagaccgagttagatgacttcttcatatattccatagtatctcatccttgctctaataattacatttttttaagctatggtataactacctgttcatatctgcctttcccttagattctcagaatattgaaggcaagaactgtgtctgtttttcaatataccctcatggttgacaacagtatctggcacataggaggttctttatcaatatattttaaatgaatgaattaaaaatgaatagatgattgggccaagtacttgtgtacttttttccaaataccatgcttattctggcaaagtaaacatatataaaacaatttccaaattggggtgtttatgtgaattttagtttgtttcttatctttactgcaagggggttatatagtaagaacagtggcgaaagagggtagcctattttgtttttgaagcatcctcttgcccctgccccagactaagtcggtaaatgctactgagtgcatgttagtgctacataaaaggcaaccttttctgtggcggcctgttccctgtgctcgttcaattgttatttttataaggcaaatagctatcagtgtgtagagaagccatcaagctcttatagctggttttaaaatactgtttttagtttgtatgccttcaaattgcgcctaaataacacagttatttttgactgattgattctaagaattttgctattacagccaaactatgacattttgcatcatatatttttagcatttttaaagaatgaaatgcatttctattttttaaaatgattttttcattttgagtttgagccaaatatctcaaaaatccacagctcctagaactcaacagaaaatttgcaaggccaaataaaatatatgtggcttactgctgcagctgtatgttttaaagaaagctaatatattgactaattcttagaagagcatccataaattgctgtctctgaaaaatgtttatagttataaaggctagagatgatgtcatttttgctgttacaggtaaagaggcatctgtgtttttgaccttttaagtatttctattgagattctaaataccaacgtaccaaaatacacctaccattatttatccaacaacactcaaaataaaatgacaacattttgtcattccactctatcaatttatgtctctttaaccctttgattgctttaatggttcagttgcttttaatacacaaaggaatatacaattgtttaactaaatagacaatactgtttattttaatataaccttataaggtgatcattctgtaaccaatttctttgatattaatgatcatcactatgttaaaatacgttaatacttaagcagactgatgtacataactgtaacaggttttttgttttaatttctttgtcatctaaacattaccttatattttaaagccaatttgttttgtaatatagataatgaacaagttggtttccccctagagatgtctatgatacgtgaaagatgtttgtgaatgaatacatgtctttgtgtgtattctatggtgtgacagattaaaaatgccacaagttttttgatgttttttctatcaagtcttagaagattctatgactgctttgaccaaaagaaaaaaacagaagacaaatgccaatttctgggccagatcttaggagagtggcggcctccacctcctatctcaacacttggtcttggagccctgagaaactgtgtaagaaattcaactagctattcagctacaaaaatcatgtgaagaggccctgaatctacatgaagaagaaggtggacctaggtgaactcagcctttcagacctgtgctaagatgccaagtgatcttgtcatgccacgtagagcagaaagatgactagcccaattgctggcccagaaaaccatgagttgtaataagtgcttattttttttttctttttttttttattatttattttttttgagacggagtctggctctgttgcccaggctggagtgcagtggtgccatctcggctcactgcaagctccacctcctgggttcatgacattctcctgcctcagcctcccgagtagctgggactacaggcatgtgccaccatgcccagctaattttttgtattttttagcagagacggggttttaccgtgttagccaggatggtctcgatctcctgacctcgtgatccacccacctcggcctcccaaagtgctgggattacaggcgtgagccaccgttcccggcctattgttttaagtcactaaatttcaagggatttgttatataaatatagataactagaacatagggtaaatggcatgaatatctgaggtgacaccccattttatgattctttttcatcaaactattttagaacaattctactaactaggttacaacaagataaatatccaaataccataaaattactcacaagggtacaaagaaatattgaaactattaagtctataattccatggttaatgaaaaaatcaggattttgccagccaagtattatccagtttctatattcgttttggagatgagtcaagtctgctagcttactatctagctcactgatctaaccactatatagaactacatgacctctagatttaaaaacctttatcttaaacattaaaatcacacacacccatagtcactgtaccacacacacacacacacaccacacacacacactgcctctcttcaaatatttctctcacatcaccagattataagacattttataaggatgctgtgagattcacccaccacccacaggcagctgctctgaagaggaattaatctacaacagcaataaataaataaataaaacatggaatgaaaaacaacatacgtattttagtatccagatatacctatataaatacatggagatacttcaagcatatgcaaggttattgatttagaattcagcaggaagaggtacccaaagagttctcagaataacaatgtaaaagcacatgagaaattcttctttcatttgtttttttctaagatttaaaaatgagattagtgcaatttaagaaatgaataaaagaaatatgttagaagatgtagattctttggggattcctagcattcagtttcggggaaattttgcctttcctttaaggaagcaggtatatcttatgttggcttagcaatttaatctatttaactcctacaaagcataacttatttagaacatatactggacattttatgtatcacttctgattaagagttattaaaaataatgtgaatagcaaaacattaattttggctttgatagtgtctctgtaatatgtaagagcagtgtattggttatctattgtgaataataagttacctttttgtttagcagctcaaaacaacacacatttattagctcacagtttctgtgggtcaaggattcagggccaggtgactctgactgagtctgtcatgatgattcaggtaagccatcaccaagaagctgaaggtttaacttgggctgatctgattccatgatggctcatttgcgtggctgttggctggaggcctcagtccctcagaggctatcggcagaaagccttagctccttgccatgctgacttttctgtggagctgcttgatctccttatgacatggcagctggctttacccagagtgcacagttaggaagaaaggaggaagctgcagtgatttttacgacctagtttctgcaatcacacactaacacttgtgctttattctgttcattagcagtgagccactgcgtccaccccacactccaggagagggaaattaagctccaccacttaatggaagcagcatcaaagaatctctggacaaattttagaaccaccacaagtaggtttaaagacttgccaagaatcaacttaaatggtctgtttggttctgaattagaggtgacagtgtaactagtgaacattttgctgctatgagccacggttagtatatattttgaaggctatattcttacatttatctgaattcactatttccctgactccacctctgagtcttacaagaatcaaatatatcttctcagaatgcaaccttatattctggcagagcgggaccattataggtcaagacgatagctagatcaggagaaatagtgcaaggctgaaaacaaccagaatggaattgcagttcatggatttagaaacttcctatttcaattcaatctgtatatcttctttattttatttgttagggaaattttattttcactcctgaggaatattgtaatatgattttagtccaaaataaatcttaaaatcaactacacagagaagactttataacacagtttctttaaatatgtggcaaatattcaattatctgtattaaaagcctgtaacacttcataaaattaagacaaggaattaataagtaggtaccttggcaagattaaaatgtactgacctttctcaattgagggtcattgattcctgtgccattcactaagtttattataaggctttttttgcaaaaaaaaaaaaaaaaaaaaaaaaaaagagagagattcctgaatgcacttcacgataagggagttttatatataatgtgcatgtaagatggtagtagaaacagaaaagtaaaattgtcaaaagtgatgcagttctagccttaggttactcagtttctctctcataggctatgctctccgtttctcgaggcatctccatttttagtgcacatatgctgcgttctcttctttctcctaaccaatttcctctgcttactcatagtttctgctctgtcacaatgttagctggcatatgaaccttcttagcctctcttgcctctctttataccttgttgttagcttctaagtcactggtcagcctatggtctgtagtgtgtaatgtgggtcagggtccctcttatcctatcaaccaatcagctctagatggggtagacaggggcacggggtttacaaagcacttccttttcaggaagggctgtggtcacattcattcctttcaaatgtcagttattggtagtacaggcaatctgagtctttgtccatgtggtgcaatgataaataaataggtgcataagttaaaaactatattttggttctcttttctaattgatgatcttaagaaaacatatacataagaaatattttctcatctgtcaaacagaaactcatttgctcatttactaaatagatgtcctgaaggcctattgcctgtgaagccctgtgctggaatttgcgggtcttgaaagttgcttaaggagatttcctgccttcgaaagctttctgtaggggggtggggtagaagggttaggtattcaagcaaacaagtaaaatatgatgtagaaagtgatttttcaagaagagagaaaacttaaacatatggttactggagtccagattaaaactaagtaaatcacagataataatatcttctttcccatcttacagaactactaacgtgttaactgttacaatacaggtacaagcctagaaggatgattttggggagaacagagttctacagaaatacaagctgtcttatgagtaaataataacagaaatcgtttacagggcaatttttttaaactgacttgaatcacatatttttataagactcatatctttttcaataaaatgtggccaaatttaagttcactttcccttgtattttaacagaaatctgaacttccattcaaagagagataacatgagaagcagaatatatagtggtccaaactgtgttgctcactatttttatgatcatgtacgtgtctttgaacatccaaggcctcagtcttccttaaaaatatgagatgattagaccaaagcatcttaaaggtccctgtggccctgtgattctattgagcctgagccaattagtcaaacagttacctgtcattacacaggctgtggtgtacacatacattttagcaccaaacacaatttaataacagggcacagaggccgcaaagcctcctgattctgttccattactaatttatcaggggctgaaagcaaccaaacttaggatcccaggcagacaatggagcctttgaggggcaagggaagcatcatttaaaaggaaagcattaccattctaaaataatggcaaagcacatgaactgagtgctctgaaagagagcactacaaaaaaggtattctcagcttaaatgccccaaacacaaaagcttttagttgggacttagacgggaaaaagaaaatagctcccaataaattggttttaccagtatccttttgtgtgtgctggtgccaagggggcgagggtacaggcaaagcgtgattttccaaaacctagctgaattatgtttcttctttagaacaaaacccaacattttgctaatgaggataaagacagtaaaactgatattcctgtgctattactaacttgggtattgaaagatcattcacacaataattgtaccatgttagcactatatttgcatatcttctattgtctcctttccttgatattttgatttaaaaccagtagataaccatacagtaccatatatgcatatacaacttaataatctgatgtgcaaggcaaaatgagattaaaaactgaacacttcatgctaaccaactgttatttatatgctatttttcataaacaatgcaagatgacagtgtatttatttgaagaactaggtaagttaatggtgtgtcaatttaagacaatataaaacatgtaaaatcttttagcatccccagtcaggtaggcaaggtgtttgttcatagattcttggtactaacactctttttgaaaaattctacacaaatgccaggcatcattattagcaatacatatacgtaaaattataggtttgaagaaaaatctcatatgataaaaaagaaatgcattttataaatctttataggtggcataaactataaaaaattgaagatttagttcagaaaaacctattttccaaccatttttctattgagatttatatctttgaagaagctatgcacataatgacttcaagattcattgcacagtagttatctttatctgccatactgttagcacctccttaactgtatctatggtcactctactttttttgcttaaagcagatgtcctacatgactgaaaacattttctcatagacccattagtgtctatgagacatacataaaaaagtgaatcccgtaagaactaggagatgatcttaatgcatattgttggtttttaactatttagcaatttcacttatcttgcagaaatggctgttgccctaccatccttaagtgaaagataagtttcaattgcaaattctttctgaataatgagtttgaaaggaaaaaaaagatataaaatgtgtaggtttgcatgttgagactagagaatctatttgggggaatacatggaatagttgagtgaaaggatgcacctaataatatctgatatacccggaccaggaaatgaagacaatgtgaccaaatgtgtttgttacactattagttctgaattcattagaaagatcacagtggggtctagcatggtgactcatgcctgtaattccagcactttgggaggtggaggcaggtggatggcttgagttcaggagtttgaaaccagcgtgggcaatatggtgaaaccccaactctacaaaaaatacaaaaaattagctgggcatggtggggcaatcccgtagtcccagctactcaggaggctgaggtgggaggattgcttaagcccaggaggtggaggttgtagtgagccatgatcgtaccactgcactgcagcttgggtgacagagctagaccctatcttataaaaaataaaaaatacataaaaagaaagaaagaaaagaaaggtctgaaacaggatacatgataatatgtttggcaatctcatttcagatgtaacagtaaagatatgaaatgatgtacatatgtagtttatggattcagggtcattgttctatagtcagagccaagatatttatatcaagtactgtgggctttctgatttattacattgttgtattgacacaaggcagaagtgctagttttgagaataatttgggatattagttgaatggtaaattttcacgtgataaggttcagaaaatagattttaactgaatgacaactctacatacaaatactggctgtatctccactggctaagctcatttttcttttgaaaaggtgtcttctaaaactatacagacatgataccactcagttgttactagtaagtagctttaagttcattctttgtgtaatttacttttttaaaatttagttcatattgaggtgagtatgtatatatgtgtgcaaaaaagatgtctgaatatcagtaatttctcattgtactaacagataatcaagatgacaatacctaagtttatttacaaactttacttcaggaattactcttttgaggattttaaattattagaaacatatttgtatttcattgttttgtgggagattattctagacctcatgacaaatgtccctttttgatacacttgaggggctttggctaataggagttcataagttgctttgctcaactgcaagacggttccaggatttacagtagcaggtgattgccagtttggtcaatgaatggctgttagctcctgaatagctcctcaaaagaatgtgacagccccatgatccacatgttcctctgctcttggcactgtactcaggagattccttgaaggtgatacgcagtgatagtttcagtgtttggaaacagcctccaaattttattttattttttctctcggcaacgactaatcctaccttaatccacctggctggagttttcttactaaaatgcagacctcctcaagtcactttctactaaactcttcaatgaatcctagttaccccaaactcaaaattgttggcatggcataaaaggccctccctgcttgcttttatattatctttatcacttgatacctttccgcattaacatcagacttatagtttctcactctgtattgtttctaactttatgtgtgtcttagtttgtgctgctattaaaaaatgtcatagactgaatgacataacaataaaatattcatctcttacagtttagaaggctgggaagtccaagatcaaggtgacagtgaatttggtatctggtatttggtatctggtgagggctctcttgttggtttgcgtacactttcttcttgttgtgttctcaaatggcagaaagagggagagggctctggtctgctttttttttcttataaaggcactaatcccgtcatagaggctccaccttcattacctcatctacacttcattacctctaaaaggcctcacctctaaatcctatcacattgaggattagaaggtcaaatatgcattttttggggggtgcacttcagtccatagcagtgtgtgtgtgtgtgtgtgtgtgtgtgtgtgtttgtgtgtgcgtgttataaatgtgatttcttctgtttgaaatggccttctctgttgtcctagatgaaagtattttccttctttaaaatacagattaaacatcactttctctgaagcatctctctgtcacctctgggcagaaataattcacagtttttatgttaccattgccttgaatatacttaagttctatgtttattctcatgacattatagatttgttttgctttgtattgttttgtttttaaatgtgcatatcttctcatcttaaggcagttaccatatttcatacatctttatagtcccaactcctaatacaggccctggtatagggttgacacacaataaaaagtttttgtatgaatatttcttgaaataatattggattatgagcattcttttcaccaagaatgaaacacaaagtccttggtcacaatttgacatgagcctacttcttcaactaatccaggcttacatttaaatctttccacattttttttccttctaatagcttttcatgcagacagaggaaagcaacatttaacaagcacttaattgcaacatgtgggaatgagtcaaatagtggtcatgtgtggaacttttaatagcgccaattcacatagggtctctgctcgctagaaaggccatgcttcctctgcctcagatatttgacagaagacaagcaacagctgaaacaaatactgtctttaaacaaatcaactagcaattcttaatagtggtaggtttaacaattacataatgtcagtgatgtcccaccagtaacagattagaagaattccaagtttggaaacatctctaaaactaattcataattgccatgatatgatgatgaggccaaattttggcacaatgcaaattttaaataacagaataagctgtcatttagtcctgactttgtacagtaggtgagcgtttaattaattcttatctaattcatagagtaaagaaattactctttactaacataaagacagatttctgaaatcctcttcttgcttttagttgctagcctcacatactatagtgatagacctattcgtatacagggaatatttgggggcttttaatattcaaaaattagatggtacaaagttcatatcactatgaggcaaatcactgaagctttattctcaacttagcacagttccatgtaatctgctctgctaagaattcagcctcagtatttggtaacagaaaaatttccaatgataccacacagctctccattccctaaaaaaaggcaagtaaatctatgcatcattctcattgcagaactatatattttcttacattgtatcgacaccacgcaagccaacatcttttaatagtttaatatttcttgctattgtacttctttcaaaaagtattttctcaaccaataaagacatgataaaatatgaattaaatcaattacagtatgtctacatgatagaatactgtaatgccattgccatcatatttttaaaaacatttccgacataaaggaaatacccagagtacataagagaaaatttttgttctgcaatattatatatacatcactattctacatttttgtagactatacatcatatgcatgttagaaaaattactggaatatatatagtaaattattagagcaatcatgcctaaattgcattactatgaatggtttctaattttttggtgcttttaagtattataaaaatagtagttattgatatttagcaaatatgtgagctactttgctaagatattttatatggattatctcacttaacacaataaccacatgatgtagatactatcatgacctttaatttacagataaaggaagaaaacatttatatttttaaaattattattattgctttataattttacatcttttaatattctttttaaagaaaaattataattgtatacgtatatatgggtacaatgtgatgatttgacatatgtctacaatgtggaatgattaaatcaagctagttaacatatcttttttgtggtgagatgtttgaaatttgcttattttaaaatataagatatattattattgactatagtcactctactgtgcaatagatctcaaaattcatttctaaaaaatatctaattgaaattttataccctttgaccaacaactcgttattcctttcctatacttccatgagttcaacttttaaattttcttagtttattttattttttttgagacagagtctcactctgttgcctgggctagagtgcagtgatgtgatctcggctcactgcaacctccacctcccaggttcaagcgattcttgcacctcagcctcccaagtagctggaattacaggtgcatgccaccatgcccaggtaatttttttttctttttttgtagagacagtctttgccatattggccaggctggtctcgaacgcctggccacaagccatccacccaccttggcctcccaaagtgctgggattacaggcgtgaatcactgtgcctggcaagagttcaacttttttagattccacatacatgtgaaataatgcagtatttgtctttctttgtctggcttatttcacttatcataatgtcttccagcttcattcatgttgttactaatgtcagcgtttccctctttaaggctgaatagtattttattgtatacatttacaacattttctttatccattcatctgttgaacatttaggctgattccatatcttaaccactgtgtatagtgctacaatgaacatgaggatgcagatatccttttgacatattgatttcagttttcaatttctttggatatatacccgaggtaggattgctggatcatatagtagttctatttttatttttttgaggaatctctataccatttttccataaaggctgcactaattttcatttcccaccaacagtatacatgggttccgttttctccacatccacactaacctttgttatctttcatcttttttataaacaccattttaacagacatgaggtatctcacagtggtcttaatttgcatttccctaatgataggtaatgctgagaatgttctttgtgaatttgttggtcatttgtatgtcttcttttcagaaatgtctacagattcagtgcaattcctatgaaaatcccaatgccattttggaaacagaaaaaacactctttaaattctcatggacccacaaaagaccctgaataaccacatcaatcttgagtaaaaagaacaaaactggggcatcacatgccctgagttaaaaaatattatgaagcaattgctatcaaaaatagcatagcactggcataaaaacaggcatacagaccaatggaatgggatagaaaaactagaaataaacccatatatttatggtcaattgattttaggcaaagatgccaaaaacacacaatggggaaaggacagtatctttaatacatggtattgggaaacccggatatccacgtgcagaggaatgaaacttgatccctatctcataccatgttcaaaaaccaactcaaatggactaaacacttaaacacaagacctaaaactatacgactactagaataaaacatggggaaaatgttcatgacattggtctggcaatgatttttggggatatgacccccaaagcacagtcaacaaaaagtagacaaatgggattgcatcaaactaaaaatgttctgcatgggaaatgaaataacagagggaaaggacagcctacacaatggaagaaaatacctgcaaattatacatctgatagggagttaataagcaaaataataataatgagaataataatataaggaacacaaacaactcaataggaagaaaataaataacccaattaacagtgggtaaaatgtttattattttaagaaatgaattggaaaggaggagccaagacggccgaataggaacagctcaggtctacagctcccagcctgagcaacgcagaagacgggggatttctgcatttccatctgagatacggggttcatctcactagggagtgccagacagtgggcgcaggtcagtgggtgcacgcaccgtgagcgagccgaagcagggcgaggcattgcctcactcaggaagcgcaaggggtcagggagttccctttcctaatcaaagaaaggggtgatggacggcacctggaaaatcgggtcactcccacccgaatactgcgcttttccgatgggcttaaaaaatggcgcaccacgagattatatcccgcacgtggctcggagggtcctacccccacggagtctcgctgattgctagcacagcagtctgagatcaaactgcaaggcggcagccaggcggggggaggggcgcccaccattgcccaggcttgattaggtaaacaaagcaactgggaagctccaactgggtggagcccaccacagctcaaggaggcctgcctgcctctgtaggctccacctctgggggcagggcacagacaaacaaaaagacagcagtaacctctgcagacttaaatgtccctgtctgacagctttggagagagcggtggttctcccagtacgcagctggagatgaaattctgggttgaaaattcttttctttaagaatgttgaatattggcccccactctcttctggcttgtagggtttctgctgagagatccgctgttagtctgatgggcttccctttgagggtaacccgacctcaaaggcagactgcctcctcaagtgggtccctcacccctgacccccgagcagcctaactgggaggcaccctccagcaggggcacactgacacctcacactgcagggtactccaacagacctgcagctgagggtactgtctgtcagaaggaaaactaacaaacagaaaggacatccacaacaaaaacccatctgtacatcaccatcatcaaacaccaaaagtagataaaaccacaaagatggggaaaaaaacagaacagaaaaactggaaactctaaaaatcagagcgactctcctcctccaaaggaacgcagctcctcaccagtaacggaacaaagctggacggagaatgactttgacaagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaggaatgcagaagcctcaggagctgatgcgatcaactggaagaaagggtatcagcaatggaagatgaaatgaatgaaatgaagcgagaaggaaagtttagagagaaaagaataaaaagaaacgagcaaagcctccaagaaatatgggactatgtgaaaagaccaaatctacgtctgattggtgtacctgaaagtgatggggagaatggaaccgagttggaaaacactctgcaggatgttatccaggagaatttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttcccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagggctaaacatggaaaggaacaaccagtaccagccactgcaaaatcatgccaaaatagaaagaccatcgagactaggaagaaactgcatcaactaacgagcaaaatcaccagctaacatcataatgacagcatcaaattcacacataacactattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggagaacaaaaacaggcaggggttgcaatcctagtctctgataaaacagactttaaaccaacaaagatcaaaagagacaaaaaagaccattacataatggtaaagggatcaattcaacaagaagagctaactatcctaaatatatatgcacccaatacaggagcacccagattcataaagcgagtcctgagtgacctacaaagagacttagactcccacacattaataatgggagactttaacaccccactgtcaacattagacagatcaatgagacagaaagtcaacaaggatacccaggaattgaactcagctctgcaccaagcggacctaatagacatctacagaagtctccaccccaaatcaacagaatatacatttttttcagcaccacaccacacctattccaaaattgaccacatacttggaagtaaagctctcctcagctaatgtaaaagaacagaaattataacaaactatctctcagaccacagtgcaatcaaactagaactcaggattaagaatctcactcaaaaccgctcaactacatggaaactaaacaacctgctcctgaatgactgttgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacagcctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctcactcatttgatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggcaggttcaatatacgcaaatcaataaatgtaatccagcatataaacagagccaaagacaaaaaccacatgattatctcaatagatgcagaaaaggcctttgacaaaattcaacaacctttcatgctaaaaacgctcaataaattaggtattgatgggacatatttcaaaataataagagctatctatgacagacccacagccaatatcatactgaatgggcaaaaactggaagcattccctttgaaaactggcacaagacagggatgccctctctcaccactcctattcaacatagtgttggaagttctggccagggcaattagtcaggagaaggaaataaggggtattcaattaggaaaagaggaagttaaattgtccctgtttgcagatgacatgattatatatctagaaaaacccactgtctcagcccaaaatctccttaagctgataagcaacttcagcaaagtctcagcatacaaaatcaatgtgcaaaaatcacaagcattcctatacaccaaccacagacaaacagagagccaaatcatgagtgaactcccattcacaattgctttaaagagaataaaatacctaggaatccaacttacaagggatgtgaaggacctcttcaaggagaactacaaaccactgctcaaggaactaaaagaggatacacacaaatggaagaacattccatgctcatgggtaggaagaatcaatattgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctggcttcaaactatactacaaggctacagtaaccaaaacagcatggtactggtaccaaaacagagatatagatcaatggaaaagaacagagccctgagaaataacgctgcatatctacaactatctgatgtttgacaaacctgacaaaaacaagcaatggggaaaggattccctatttaataaatggtgctgggaaaactggctagccatatgcagaaagctgaaactggatcccttccttacaccttatacaaaaatcaattcaagatggattaaagacttaaacgttagacctaaaaccataaaaaccatagaagaaaacctaggcattaccattcaggacataggcatgggcaaggacttcatgtctaaaacaccaaaagcaatggcaacaaaagacaaaattgacaaatggggtctaattaaattaaagagcttctgcacagcaaaagaaactaccatcagagtgaacaggcaacctacaaaatgggagaaaatttttgcaacctgctcatctgacaaagggctaatatccagaatctacaatgaactcaaacaaatttacaagaaaaaaacaacctcatcaaaaagtgggcgaaggacatgaacagacacttctcaaaagaagacacttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggtgattcctcagggatctagaactagaaataccatttgacccagccatcctattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacatcatggaatactatgcagccataaaaaatgatgagttcatgtcctttgtagggacatggatgaaattggaaaccatcattctcagtaaactatcacaagaacaaaaaaccaaacactgcataatctcactcataggtgggaattgaacaatgagattgcatggacacaggaaggggaacatcacactctggggactgttttggggtggggggaggggggagggatagcattgggagatatacctaatgctagatgacgagttagtgggtgaagcacaccagcatggcacatgtatatgtatgtaactaacctgcacaatgtgcacatgtaccctaaaacttaaagtataataataaaaaaataaaaaaataataaaaaaaagaaatgtattggaaaattatactgctaaaccttacttagtgagtgatattttctcactctgcatccttagagaccattatttctttacattgaatcaaaaataacatgatttactcctatttcctaatatatgcatctcattgatttgaccatataggtatactctgccctagcagggctcctaaaatatactgccattaggtgggtgctacaaagttgaaaaagacgtgcaacttactagcttgtgcagaggcaagtcactgattgagtctgccacaattactgctctaatagaggggctacaaattactattggagcaaagaggtgggaggatgtagtaagtaaatgtctcatacagaaatgcccttttcactggtgtttcagctgctcatcctgttcatctttctcaaggcattacaagtgcagaagtctgagtgaagacaaaaaagcctaaaattaaatatacactgatttagcaaaagccaataaaatattattttcagctgaaagtctcacagactacttcatggatgaagtatcagttgggctgggctcactgaaggttgtactaaactgcacctgataattcacattgtatattaattggacactaatatgtgccaaaggatagatatgaaatgctttttatatttgaaaacaattatgaaatatatttttggaaggtacatctatgtatgtaggaagatgttatataaatgatttagagaaacaaagaacacagttatgagacaaatccatatttagcatatttgagaaatccttggccttaaaatccctaatggcagtcagcatttttggagtaggttcaaatacttaaatatcacatcttctttgtgcttaaaaaaatacaaagaaaaccctgtgtttggatctaccttttctctattactagaaattgtatgcatcaatagatcagtataggtttttgttgtagttgttttctaactccctttagaaggtgacagaaattaaaggctggagatctccttgcctattgactcacaaagtttgcaatgtcagaaatcattatttataattaatgccagtgtacaaccaagcattctcctcaaccagcggctgtctgtaaccataaagaaattttagggaagccctacatgaaatctatcttatagatttcacacaacacctgtgagtcagccttgcccagggctatgtcatttcacttcctatccgtctgaaaaatgtgcctcactgagagggcataatactttggaagggcagagtatttataactgaagacacgccatatagcttcacatgttagcatggtgacgatatcaattttttggcatctaaactttgaatagtgaaagaatacagagaatgtattacttgggtactaaagtctgctctaaaggatgtaagataaatcaagatttggaattggatgttagaatctcttatggttaactatcgctattttaaaatgggaaatatgtctgaattaggaattgggtaaatagtcacataatggaaaagtttgcttgtgaacttatatctgactttgttacttatactcagtacttttctttgccctaaattctcatttttgcagtcctttaaatatgctataaaatacatgtttttcaagtctttctggataggaaactttcctaaatttatggaacattaaatgtctggataatttctgagattccagactgtgtttcaataactgtagttataaatacataagcatattataacttaacatattttggttattattagaattataaaatatgtgccaacaacctaagatggttttagaaaaatgtttcaatggacaaaaaggcatgaacaatatgacattttttcacctgcaaccaacacattcgccacttacattacctttcctattggtcacatcttcctatataaggtgatatatatacacatattaacttttacaacaaaacgtgttatttttggtgtatgtgggggtgggggaaaagcaggcccatgtgatctctaccatttctttcagcattaaaattctgtgactgtgatgtaaactacagtatttttgtccattagaaaagcagatttgtgaacttattattacagaattattaatcagaccctaaagactctagaattccaacataacagaataaaatttaggttttgagcatgttgaatatatctgattttaaaaattgaaactagagggtttaagattttattgatccctctaccatctgtccttttaaaacattttaatgggttctcgggttctacatttcagtgtatctcttctgttaagattagctttatctcaatgaaatcgggtttgtgatgctactttttcttatatctagaatttttaatagaaaatttctaggaatttctaagttgttctaaatgattttcatcatggttggcatttggtaaatgcacaatgaagatttgttgaattaatatgaacttattttcctatagttgtcttttacttatttctaccgcacggtctacatgactgataatgaaactgtgtcactataaatacaagagtagtatctgtggttaatgtgatattagaccctcaacaggaatacacagacaactgatagacttcaatcaaagctttaaagttaagcatgttcttaaactaggtgaggagtcatgaagatggaaaatagaaaagtatctctgaacacatgggtcctgaaatggagctttccagaagttggtgtccaattaccatttaatatttcatgaacatgtttagatctaagacattttaacaattttaattaatagaaggacagcctgccctcacagaagtcattgtgaagtttatctaaaaggtgagatttttaaacataattattcccttgatactgcctcatttccacattagtcctgttggaatacactggaccatataatggagaggaatgacagaaccagccaaggctatgatgcttcaggaatagtgcaaggtttctctgcaaatagcttcttgagatgcttatggttcttatattgttaaaattagaactagaagcaatggcaagtagtatcttattggagccagaaagaccatgttttcttgtatataagaaattatactttgaactacctgaactgatcaggcagaatttcagggtttctagaattcttgataatctgtttttttttttttaattttttttttttgttaaaagaaaaaaaaaaaaaaagaaacaaactaccctgagttttttttttttttttttactgatatagctctatactgctgcaacctgggagaaaaggatcacagtgtttatttttaaataaattttagtgtcatttctgtgttatatttcatatactgaattcaaattcctcaatttaaaaagaactcactcaggtattgattgcaaagatatatttctagtagttatgcctaattgacaattgctgtcatttacttctggccaacttaagagtcccaggaataaagtgcttctttcacttttaatcattcattactctctccttttcctcccttgcaaagtttttcctgattttctttgttttccccttggccatccaccttacaccccttattcctactctttgccttcatcattttgtccttgtagagtagctcaagtcagcctttgattgttagtcagactccatgggcaattccctcaatgttttcattgtttacatgaaagcatccaaatgtatagcaaatagaccagctggaaacctccccacagacagacgcatccaaacaggaggttccttgacgtgttgtggtgggtcagtctggttctgctatcagaaagaacagcccacacccatatgcactgttgctcttgagtggaaggcttgtgatagcatccacatggactgggcctcagccaaaacttagcctttagcacatacagcaatacagaatgatgtgacaacgacagagttttggaatactgtttgtagcatgctgttctttggcatactttttcagaatgtaagaacagatttctcctaattttcccaagacatattgtttattatagaatgaggctttaaaaatgactatagatttgaaggcaattgatcgacttaatattaaactcaatatttagtgtacatatcttggaaatttattttgaaatgttgcattggtgactcgtgcttgaaaaaaaccacctaattttaaatatttctccagggtgtgaaaagggcaacattagtaatgagacaaatagagtgatccttgactctaattagagaaatacagtgaaaatttatcaataaaagtaaaatgcttaaaacctaaagcaaatatatttaaagacatttcacaaatataatattggcagtttctgaacaataataacatatttgctgagtatacattcatgttatacactacactaaaatcttgtttaaaaaataagcataacatttacacattctatttagaagatgatgtatattgtctaataacacacattaaatcagtacatatttttgtcatcagtgatttgaaagaataatgtgttataaatttctacctaattcatagcactatgccataataaagaagaataatactattaaaaaataaccatcttggtttcattttttaaaagtccctttctttacttatcactattgttttaaaataaataaggcaaacataaatcagacatggaccaaaaaaaaaaaaaaaaaaacacaaaaccctaatgaaagcaattctatgggggtaaatgtggtttgagaaacatgtccttagcctattctaaacaaacaccttggtaaaggcaaacggaactttgcaaatcaaatatcatcattagtaagaggaaaaaacagtagcatatttctgcctttcatgcttgttacttcaggtggttaacctgaactacaaactcattacttgacactcaagatgtaggcaaaatcaaatgctatattccaacccaaaatatatgtagcaagtctacagatttgtcatacaacatgggcaacatgcaaccaccagtttaaagggttgcaaccaacttcttgtctatgttcacagacaaactgcaggaacctgacctcaaagcccaaccaggctctggaggaaaagctgtgtgcctcattccaagcaacttcagagtttcaatggatttaagacctagaaagagatctggaaaacaaaagagtaaaaataacatttcttatccctcttgatgaaagacatataattgaattccagagaatgactgattgaaatttttatttgttttttttccaatttgcttatctagtgtagacttcacttatagcctgaaagcctataaattatgagagagagagatacaataccactcacaaaaagctaggttatcctgcacacaaagaaccccaatgtgtttgtggtttacaaccatggagttttatttttcactgatgctcacgtccatcaaagctgagttgtcaattggcttcatctttccttccctcagactcaggctgcctcggtaccctctacctgattattgttggtggttgtgatgtggaaggaaatgacataccaaccacatgttagctcttaaagcttcttcccagaggagacactaactactcttcacatgctattaggtgaagagtctcatgccatgatgaatgtcaacaggtcatacaagcaaagataactgtctcctgtcaagaaaacatctctgtggacaataatatagtttaccacaggtagcaacaggcaccatatattctgagagttaggtagaggaatggcctgctattacggacttaagtagagaatgttggccaggcatggtggcacacgcctgtagtcccagcacttgggaggttgaggtgggtgtatcacctgagctcaggagttcgagacaagcctggccaacctggtgaaaccccatctctactaaaaatacaaaaattagccaggtgtggtggcacacgcctgtaatcccagctacttgggaggctgaggcaggagaatcacttgatcccaagaggcagaggttgcagtgagccgaggtcatgctactgcactccagcctatgcaacaaaagcaaaactccgtctcaaaaaaaaaaaaaaaaaaaaagagaatgttagactgatagatacttggatgagctatgacgtaagtaaggccaagtacaatggccatgaacagcagatccatggtgctaccattaaagtattagggaggaattggcaaagtatcatgctatctaaaaacaggcagatgctattcaaagttaagtatagggagatgaaatattaagcaacttcctttcttgcaaattcaagggatttcttcatttttgacccagatataggaaagaattttatttatgctttaagtagccatgagactgcactgcttgaagtaaaatgaggtctaaaatatcttctcagattttggctctttccttggtaatcccaaaattggtttcgttcagaaatcagtgaattctcctatctttattatagggaatctacagtttttgaggttctgaggacctgatctctaatagaagcttgaactctttctgacatttttgttttgatgggaaaatttttcaatgtaatcacttttacaggacccagacaaaagtcccaaatttaaaattttattctcagaaaatttttatagatttttacagtgaataccaggaatgcatccaacagaattattcaatgaaagcagaaaataccaccattatgagtgagatatcatgaaccctatgcggcaaagatcttgttgccctgaacattttgcttctttaatcatcagctctagttgtcattttagacaacaaggcaaacattggcatagagaagcaggaggtaatatcaggagtttcagatggggtaacttctggaagctgttagtagcttctactgtttacctccttttcaatttttttttcacaaaaaaggcacaatatctgaaggacacatgcttccttttaaagtgtgaatgttatttttagcactggtatggaaagcagcagaaaatacaacaatttatttgctctgttcatgaaaagtgattttatttttgggtttaaagaaataattgtgaatgtcttttgggaaaatacaaattttaaggtttaaattcaagtgtccctttctgtaagaacttttctcatttacgcgttttcatctatggtggatatgacatgattatttatgtcatcttttctccttcctacggggtcttctcttgcaaaatggcgctgcatggtcagcactgactcagaatgtggaacaaggtgaggctgcctttctcacagtattttatgtgtattcaagctgtgaaaagtgtcacagcaatactcccattctgtgtcagctgaactgtatctgctcatattcacatctcggattgactacaattcaaacctggttatttgtttctttatcaattgtcacaaaataaaaggcatattttagcagtgtttttgagcccccaaataggaaactaatttttatagaaatctataccattccgtctttgggagtatcaatccttaaaccagcaggtgagaccacattttattaaatggctcattctaattcagatcctggggtggtcttacttatggatgaattgtgctgctaccccaagaaaaccatttaacctatctgcacttacagagtgcctctgtgtacctgctgctgtctgatttgaagccatgaaatgagaggcttctgtttttgaaatcagtttttcagaggtgctggctttgacagtggctactctttattaaagaaagaacaagacaaataaacagaggtttgaccactacctgtttcatattggccatttctacatgatgcaaaatgccaggtcataaatgagtcattcagtattctgggcttctctggatggccaattcagagactgaggaaactaaaattactgcctgtaaatcattcttaggatgagagagagaaagagggaaaagaaagattcactggatacatattgacatatcctttgagtacatgtataaaaattatattctttatattttacttacagatattgctatttgttaaatatgaacatggtcagtttaatacatgcattatgttaacaaaatttcaattattgaataatttgggaataaagtttcttttataaattcactcacataaaagcaggaaagctctgcagaaatcatgtcaagaagaacagtttacctgaatttgcaggtgcatgataaaaatatcccagtgcccagcttctatttgtacctgcctagatgaaggtaaacaaatgcaactaagatcttccaatgacttctgttttctattgcattgctgggttattctttgtcttctttctttacaaaataggaactaacatacctgtgtctgatttattctccatatgttatgccatttattgttatttaaaaaaaaccacaatgtaaaatgtactcaataaagaaacttgtaagacagaaagaaataaataaaaaacacataaatcatctgtcatgtcatcaccaaaaataactaatggtaacatatggtttgcccttccggtaatttttctgtgtctgtgcctcatctcttccttggctgccttctcttttctatccgcattctttttctaggtgatatcctctaggcatgcctataatccatccttcacaggctagatggagtttacttttaaaaactctccagtttgaaaccctccaatggcttcctgctgcacttggaatacatttcaaagtccttatgttcttcttgctgagtcttttacaaccttcctctctgactttgtacagtctgattttcttgccctcctcatttttgtttgctttctattgctgaaataaattgctactaatttagtggcttaaagcaacacagatttcttatctttttgttctggagttcaaaagtcaacaagaggtctctctcggctaaaatcaaagtgttggcaagctccatttctttctggaggctcaatggaataatccattcctttgccttttccagcttctagtaaccatctgtattgcatggctcatggcccccttcaaaggcagcaatgtttggctcagtgtcaccctgtcatctgtctggtcctccttctgagtgtcttccacttataaagacccttaggattatattgggcccacccagatattccaggataatcttttggttagccaccttatccatctgcaacctcaattctcccttactatgtaacataatgtattcatagattctgaagattaggatgcagtcatctttggagaggggccatattctatcacattctgaagcattccttagagagtcaaagatgactatccactatccctaacttcaccaagcatggagaccctgcattggcccagtgatagccactatgatataaagattaccatacttggccaaatgaataaattgagaagtcagaactgttggaatattgcaaacagtataaggtgagagaaacattcggaggaagtgcaagtttattcagctaaagtttatagggctaataaaaatacttgtttcattgtcctgacatcagtttattgtaattaaccaaatatagactttagctttcttttctttttatagaacttcctcaaaaacagttaatacattttgttgcaacctattatctgaccactcaaagattattgaatatattatatgggatggccctggggatatagttttgaatgagactagaactgcctttcaagtgactcactagtttaatgagataatcagataagtgaccatttaaaatacagactacataggatttagcctgggttttggagagtcttgttggagttcaaaagaggctaagcagaaagagtgacctaatgcagtctaaattagaaaggttcccgaaatttttccaaatggagatgaaccaacaattgaggaagggcatccatcaacaggtatcaaacttcttcctttgttgtatttttccttcccctagaagcagctttatgaaaggctcttacttctctcacctcatcactgtttccccagcatgtagactggtttctggcacatagtaggttctctatcgatatctactgaatatgagaataatatatgtatacaaaatatgcaattttactttatagaaaggaaatcatacaaaatggcctatttggtaacatgtttgcttttagttagcaatatgtaaccatcattgtctgataaccattttgacagaaattcaatctcaaataaatgtttattcaatcagagctttctatgttagatttctttatttataattatggaagaataaacattgtttcctttagttcttaaaggagcttcgggggccaaaagtgtgtttgaattataattctccaaagcctaaaatctgcatttgtttaacaagagtctattcaaagtcctttgtactttaaatctttccttatatctgtttcctgcctgagcttggagctatggatcctggagactcacctattttttttttaatagataggttttctgtgatagtttattttcaatacaactatctcaaaattttgagcatactcttgctttccagtaaataaatatgccaaccttcaaacctccatccacctggttccaagactttttaaaaaattattattattatgttctaagttctcggatacatgtgcagaacatgcaggtttgctacataggtatacatgtgccatggtggtttgctgcacccattaacccatcatctacattaagtatttcttctgatgctatccctaccctagccccccaacccagacaggccccagtgtgtgtgatattcccctccctgtgaccatatgttcttattgttcaactcctacttatgagtgagaacatgcagtgtttggttttctattcctgtgttagtttactgagaatgatggtttccagcttcattcatgtccctgcaaaggtcatgaactcatttttttttttttttcagacaagaatctctgtcaccaggcttgagtgcagaggcacaatctcggcacactgcaacctccacctcccaggttcaagcaattatcctgcctcagactcctgagtagctgggactacaggtgtgtgccaccatgcccagctaatttttgtatttttaatagagacggggtttcaccatgttggccaggatggtctcaatctcctgaccttgtggcccacccacctcagcctcccaaagtgctggtattacaggcgtgagccaccatgcccagccaaactcattcttttttatggctgcatagtattccatggtatatttgtgccacattatctttatccaatctatcattgatgggcatttgggttggttccaaatctttgctattgtgaatagtgctgcaataaacatatgtgtgcatctgtctttatagtagaacgatttataatcctttgggtatatagccactaatgggattgctgggtcaaattgtatttctggctctagatccctgaggaattgccaaacatgagaaagcaggaaaaatctaaaatggacaccctaacttcacaattaaaagaactacagaagcaagagcaaacaaattcaaaagctagcagaagacaagaagtaactaagatcagagcagaactgaaggagatagagacacaaaaaacctttaaaaaaatcagtgaatccagggactgtttttttttttttttttttttttaaagattaacaagatagaccactagccaggctaataaagaagaaaagagagaagagtcaaatagacacaatagaaaatgataaaggggatatcattactgatcccacagaaatacaaactaccatcggaaaatactataaacacatctacgcaaataaactagaaaaactagaagaaatggataaattcctggacacatacaccctcccaagactaaaccaggaagaagtcgaatccctgaatagatcaataacaagttctgaaattgagacagtaattaataacctacaaaccaaaaaaagcccaggaccagacagattcacagctgaattctaccagaggtacaaagagatctggtaccattccttctgaagctattcctaacaatagcaaaagagggactcctccctagctcattttgtgaggccatcatcatcctgataccaaaacctggcagagacacaacaaaaaggaaaatttcaggccagtatctctgatgaatatggatgccaaaattctcagtaaaatactggcaaaccaaatccagcagcacttcaaaaagcgtattcaccacagtcaagtcagttgcatccctgggatgcaaggctggttcaacatacacaaatcaataaacgtaaaccatcacataaacagaaccaatgacaaaaaccacatgattatctcaatagatgcagaaaaggccttcaataaaattcaactccacttcatgctaaagacactcaataaagtagatattgatgaaacgtatctcaaaataataagagctgtttatgataaacccacagccaatatcatactgaatgggcaaaatctggaagcattctctttgaaaactggtgcaagacaaggatgccctctctcaccactcctagtcaacatagtattggaagctctggccagggcaatcaggcaagaggaagaaataaagggtattcagataggaagagaggaaatcaaattgtctctggctgcagacgacatgattgtttatttagaaaaccccatcatctcagccccaaatctccttaagctgaaaaacaacttcagcaaagtctcaggatacaaaatcaatgtgcaaaaatcacaagctttcctatacaccaataatagacaaacagagagccaaatcatgagttaactcccattcacaattgctacaaagggaataaaatacctaggaatacaacttacaagggatttgaaggaactcttcaaggagaactgcaaacaactgctcaaggaaagaagaaagaatacaaacaaatggaaaaacattccatgctcatggataggaagaatcaatattgtgaaaatggccatactgcccaaagtaatttatggattcagtgtgattcccaccaagctaccattgactttcttcacataattagaaaaaactacttcaaatttcatatagaaccaaaaaagagcctgtatagccaagacagtccttagcaaaaagaacaaagctggaggcatcacgctacctgacttcaaactatactacaaggctacattaaccaaaacagcatggtactggtaccaaaacagatatatagaccaatggaacagaacagaggcctcagaaataacaccacatatctataaccatctgatgtttgacaaacctgacaaaaacaagcaatggggaaaggatttcctatttaatatatgatgttgggaaaactggctaaccatacgcagaaaactgaaactggaccccttctttacacattatacaaaaactaactcaagatggattaaagcattatatgtaagacctaaagccataaaacccaggcaataccactcagggcataggcatgggcaaagactgcatgactaaaacaccaaaagcaatggcaacaaaagccaaaattaacaaatgggatctaattaaactaaagagcttctgcacagcaaaagaaactaccatcagagtaaacaggcaacctacagaatggcagaaaacttttgcaatctatccatctgacaaagggctaatatccagcatctacaaagaacttaaacaaatttacaagaaagaaacagacaactccatcaaaaagtgggtgaaggatatgaacagacaattctcaaaagaagacatttatgcaaccagcaaacatatgaaaaaaagctcatcatcactggtcattagagaaatgcaactcaaaaaccacaatgagataccatctcataccagttagaatggtgtcattaaaaagtcagaaaacaacagatgctgaagaggatgtcgagaaataggaatgcctttacactgttggtgggagtgtaaatttgttccaatactttaatgttattttatataatagtaaccaatcctcataactctattccaaatctatcaaattatagtgaggcatggcagtagaaggagagtattggaggaaaggtaagtagaagcagatagaaaaagaggcatttcataatcatttcaggttgtctataatgtatagttttcagaggaaaagtaaacataaaaatgcctagatagaaaagcctgtttaatatgtagaattacatttctgtaacaagaatcccttccccaatgtatcacaatcttctagaacagcttttgataaattttaaagactcaatatcaaatgaatggatagataaattacagaatatattagtgagaggttttgaagaaaaggcagttttgttgcaatacagaaagctaaattaacttaacactacaaagatgcttcatgcagaccaacaagaacaatagttaacagttgaaaacctgtttctgtgttttagccgcccctcacccacaatgtatacccatagtgataacattttcttaataaaaaactgaatcacatcatttgactgaatgaaaaggaaagggtatgaggggaagaggttttggaagaaagggaaagaagccacagtgcatcaactcatgaggaatgctttcacacctgccgcttccctcccactttgttacacatccctgtaaggcgtgcccttcactcctcatttctgagaagcactagccagtgagctatattaatcaaggtattatttctctgaaagttattcagcaaaaaaaaacctttaaagtaaagcaaaacacaaaaaaaatacaaaaaagcaaaaaccttgtatgtagcaccatataaaaatattttaaaatggcatgatcctctataacacgggatagatggccactatatttgtatagcaactacttccagacatacacggaagaatatgttatcatactttaatgatttctgaaagatatctaccaaaaaatagtataaaatactataaaagagctcccgtgtagtttccaaagtccaccaatattttcaaatcctacgttacataaagagtttctttaaaaattgactcgaggaatgtttcctattttagatgtcactatgattttaaatgttaacatacaatagcaaagtgcacctcatttttcctatttcatttttttccctcatcaatctgactttgtttttgtagggagtgctctaggtgaggcatgaacttacagccttggcatcataaataccgtgtactaatcaactgtgcaactggaacaaccagacttttcttaaatggttaatgatatgactcatacattgatacatacaatgatattgttaaaatcacccagtgtatcacttactctacatttaaaagccctgtgtgaaaatgactgcttatttttattagtaattaatcattataaagccatttaatggagttatgtattcttataaatctctgaatacctgcagtcaaatttaaatattctcttagttttatatttcctctctacattagatctttttgttggttttttaaagacatgccacttttgatcttaatattaagcatattgatttacttaaggacatgaagaatccagttttaacaagtgtatcgttcacaaaaatgtctcctatatggctgtactctttttccatttcctggttttgaatagtcttatttctgtcatcaacaatgaactttaaggtacctcatttcaactagagcaaatggctgttgaattcaatgactcactcagcatagaaattcattagacattggtttatcagtcaaagatgacatttgttttgagccagatgggttttcttgaggaaatcctctaactggatgcagattagattggattttagctttcctacactattaaacatcactgtttcatatggcacacacagcctgtaatatatttgtatatatttgacaggattttaatagccatggttttaataataaaagattacactttttctgaagtttatctgtttgcagtctttgatattttatgggttttaaaacatgcatcatcttataaatatatttccaaagcctaaaatcttgggatatatttttaaattaaaatgttaaacaataacaccaaagaagaaaatctcatttgactaggctacatagtaacagtgggatagaatagttgatccacagtgcaacttttcttgggcattggtgtctctatcttttctattttctatatcctacacaccctaacaattggcaagtcatgagatttctacttagaagaaaaaccattctattttcacaaataccatacccagtcaagacatcttcatgtactgcagagacaacagcaatactgatctaatttgcattccatcttcaaatcttactgtttaaattaatcctcataagagcagtcagtaatcttttaaaaagatagattagggaatgttacttattgtaataagaacttggtaatttgggccaatcctaccaatgtggacaacttgtgctgctgtatacatatacatctccagatgcatctttgtgtatatatacatgaataggtgtgtacacacacacacatacacacacatttgaaggcttagaagactaataagagagtaaaaaaatggtgttaccatctggctaaagatggagatctggagaggtgggctactcttgccttatgggttttcactcatttcaggagggttggttgatcaagtgtacagtgcttttgtcagactcatgggactgagtccagggtctaccaaagtatggggcttggcaaatgtccctggtcttgggttgggaccccaaatggcagtgctttagcaataaaagaaaatcagaatcaggcactctcacaaggaccacagctttgctttgattctctccatctctgtaatcctacagagcaaggacgatgaacaaaccaaagccaaagccaacaaaaagcaaattccacaaacatagcatggaataaatgtacctagacacaaaagaatagatactaagttattttatttatttcaacacacaatatataatgtttaggaatgtattcttaggtgttaaggtcatatgaaaaatcaagaaagtatttataataaaaggcaagataatggttcctctggtgtacagaggagagagaacataagaaaatcttctgtgttactgccaatcttcctctattttggagtgatgtgtacacatatgatcactttgtgataaatcagcaagtgtatattttattttgaaatttgtgtacctgtgtgctgtatttatactaagaatgttaaattgtaagttagatcatattactctgtattgaaaatattccagttacctgtgattgtctacctccctgttctcatctggaaacagcctgcccccggccccattgctcgttttactctaggtacatggaattccttgctcttgttcaaaaggacaaaaatcttgcccattttagtctttggacttgaactttcttctcttcctgcaatacacttttattgacttgatccataattgtttcccaatccttcagccccctattaattgtagccttcttagagacgtatttcttgaccagtcattctaaattgacaactgaaaacccaacaaatgctccatatcgccttgtttatttccttcatattggaaagcagatgatgacatttgatttgtaattaatatatcttttatccaaggtaaaatatttgctgtaatgtaagatctatgatgggaggtatacttttggtttttattctcagcactaaatgaatcataggccaacgaaaattattttgagaaaagactttgtgcaattcctaaaaattagtctattataccatgggtggtaggagaagcttaggatctcatcatataatttggttatcctagctatgctgctaagcaaaacaaatatttatttagcccagatatgtagaattatcttagacaaattttcatatgtgtccagtgccagttttcaaaatgacgtctttttatggcaacacctaagtgaagtatttctttcagggacattatacacaaaggaaagtaaatgttttagttcaggtggtaatgacaaagttttcgtaatgatacaagttatttgtaatgctaaagttattgcgtttcatttttacttgaggaattacatatgccattttagaaactttacttggatgtgtatgactgtatttcccgccgtagttagtttttaagaaagaatgtttcacctaaagccatattcacctttccagagtaaaaaatcaatatttagccttaaattaataaactatgtttttgttattattggtccttttgatactgtatctctttccatttcattaaaattaaataacttacctgccatatttattatctgaatactaatttattttcccatttaatttttttctttactctttggtgtttctttgctcagaccaaacctagtcttgatctagttgcactgtgctttctttgaagttcaaatgcatctaatgaatcatggcagtactctctatcaccttacaggcatcaaagtaaatcagccagaacagggatagaaattccaaaggtccctgccacctgtgctgcaacattcactccaagtaaacacttagtcatctctttagttgtgaacagtgatgtggcccaggagcctttcaccgaaggtggcccagcacttgctgctgagttttcatgcactttgcttgcatttatcgccaccatgaaaattacccaaggattgaaaagtctatcaagtatagaggagagaaagctaacaggttcacagatgcagataatttagtgttttaatgaaaccctggattagataatgcacttctctcttttatttaattttttaatgttacctgtctgctattatacaccatttgttcttatagaacacacacacacacacacacacacacacacacacacacacactctctctctctcacccctacctcaagcaaaggaggttgcaacactttttctcaaaaataacaaatcaacctgtaattcttcacactaacggtaaggtttatgtgtttgcttcaagttaaaattactacctttcagatggattatctttttatttttattttttattttttttgagatccacctaggctgtcagagttccacatttggcatcattacacccagttaatgtaagacagcttatttttatattgcggtgttttatagatttttttattgcaccattaagagcattttgttttctgcaatattcccagattttcttgtcataatacacaacatcccacagtcccactttgtgccaaatctcatagcattcacttacatctacttttctgcctcagaaggctaggtaatgagctgagcttcagaaaaagaaattgctggtttagtttttttgcattacagcccaaacagattgttttcttttcgataactagccaatgctcagttcacagatatttcccctggtaggtaagcattgccgatttagtgtccagtagcatgtttacagttcataaatgtcatctgattttcaatttttaacctgagaaatacaatgtttctttcaatattctgtaaattttaatggaaattttgtggaatttctcagttgttcagtgaagcaaaaatttgttcagcatgcctgttttaatcctaatgaaaactattaaggagtttatattcttgatattgactatttttgacaatatagtattacaaaaccatttcgacagaagcagttttagctttggagtttacacagattattactgtattatctatgactttcattcactcaaagtacatacatatctcataaagacaccatttgagattgccaccatttaaaaaattaataaataatagttgttcacatttatgaggtacatatgatattttcacatatgcatacaatgtgtaatgatccaatcagggtaattgggatatctgtcacctcaaacatttattgttcctttgtgtggggaacattaaaaatcttctctcctagtgattttgaaatatatgataaattattgttaactctagtcaccctactgtgctattgaacactagaacgtattccttctaactgtatttttgtacccattaaccaacctctttttgaccccttctctctgatatacttctcagcctttggtaaacaccatgctacttactacctccatgagatcaatttttttgcttctacatgtgagtgggaacatgtgatatacgtctttccgtgccttcttgcttcatttttgataatattaaataaaggtctaacacctagtggtcaagtttgaggttgacatggaggagaataagacagtcatatttaggctgaaatgattttaaagacaatgaactctctaatgtacatggatatacatttgggattcctattcagggctggaattcaaagcattctaaacatgttaacaacagcatttatttatagttctagtggcttgcgatccatcaaatggcacaattgctactggcctcagggttgacggtcttcctggcagtggtcccacagattgcaccagtgtaatttcaaggccttgatttgccaatgatcttatcattgtaatgatccctatattctctttagctttctcattttataagactgacattagaaagcaggttcatattaacatcatagcttgaccaggtcttaacagacaggatgactaaactaccagtctacttgaatttgttttttcagaggtctatatttaagcttttttccaaaagattaatgttggttagcatgagaatagaagacagtgaaagcagatgaactttcaaggaataaaaagaattcatgagacctaggttaattctagaactttgaagattagatttattcatctagttggtctgaaatctaagtgattttttttctttttttcctcagagataatattcccaaataagatttttaagttcattctaaagcagctaaaattcttgagtagctatctacttatttggactaatttaattttatcccagtgatattaaatatatacacagatacacatatacttaaatatatgaattaatattttcaataaagcaacattttagaagttaaatagactggaatcaatcagcttaataatgcataacaccgaaagaaagtaagaaaggaacaaaataaaaaaacattaggggaaaagcaggtaagttaggagagggatacatgattctacatttccttgttaaggaggagctaattgatttcacaagagccagctggggttttaaatgctcactctttttttctggtcaatattaataacaataaaatcaatgcctaatatgatattagccattaaatggttattccacgttcatatttgggctttcacaaagtcactgaagttttttttctttttttctgagaatctgtggatagtccagtcggtacagtagataattgaaataaagtgttccctgcatcctttggctctgcgcttcagaactgggccatgggttttcttttaagaggcgtaatgttgtgctggaaaccacatcagctttgacaattgagttcttattttcacttcactatacaccaactttatgagccctcatggtgcttaaagtttattaggaaagaaagaaacaaaagcttcaggggccaataattagctaatttcattgtgatttcatgctacgatgcttttggctcttcaaatgtgtcctcttgccccaccaggaacctggaataacatgagcattcctcttccccttagcttacctaatttgttcctgttcttcaggtctcagtttaatatcatgtattctcttacttccctaatcttttcaacagatttggtgcccttagtgtgcctttatcatcagtactttctcattatagcacttatcatactttattataattaccaacttaattttcttttccaccttatttctatttgaatctaccacatttcttggcatataatactagcacaataatattagtagacaatggataaataattgagggttacatttaattgtgtctggactatagtaagaatccaatgcctaataactgtgatcactatctcaaactatacctctttctaatttctaaaacaaaagaattttaatagtatagaaaatgctgatagtcatttaatattttccgacttcaattaattaaagtctttcatagaaaaggatgtggtgttataagctttcatccaagacatttaattcaagttttaacatatttctaatgtatgactaagcatattaattgaatagcgttaaataacagtaaaggttaaagattagaggatgttctaaatgaaagatgagcagttcgctgctgtatatgcatataggcaaagaacagctgggacttctcttaggataaagaaatatgctcaaaactgtacaaataaaatgcagatctttaccacatattgtattgaatgtcaatttacaaatggactaatctgtggagaaatataacatttgtagttaatatgaataaaagtaatgttagacaatttaaagcaggtaatttgtttcacttatacattgctaagtatatagtgtgattttccctgaacacagaattatatcacatagagtttttctttttcttttagaatcataatgtcttagtcaaaatctcatataagctctagctttttctgtcattcaaatattcccacattgactcccttaaattatgtggaagtttccttctccccagctcacatgtgtcaatgaatttatctaaagatcttactggcttaggacttcaagaacaaatatcagtaagaacctttttaaataaaaagttttgaaataacacattttcctgattttaaaagtaatgcaaactaatttcagaaaatctgagaaaattaaaataatgtaaaaattatattatcctgttttagagataattgcttttctttttatgtacttcaagaatgtatatattttaaaagaaaatcataaagataacccgtatagttttatagcaggatttcctcatgtaatttcatgtcataaacattttcaaatgatattaaaattatttaacctcagatttttaatggctatgccatgagtaatttaataatacccctaaatttggacattttcattatttatccttatgcaatgaagatatttgtatataatttgttttctgtacttagcaatttgtaataggtgttttctataatgattatgaaattaaaacacatacacctctaataggatatttctactatttagatactattaaatggtataaaaacatgtttaaaagaatattcaaattacaaatgaaatttttcttttatcagaaatatctttgccaaattttataatagagaaagtaatattgaggcataattatcttctttaatattatatgagtgaatggggatatgcaattagttacaagaccacaaacattaaacaacagaaagttatcagctaaacctaaaaacaagtgtgaatttgtcaatatgaaggtagataaaagggaaatgtgtgggctatattgaggacctgaaagagggactaggcactattaaacctgatgggaagcttaagtgaagaaagcccttagagattatgccaggatagaatgaggtctcctttgtaaaataagtgaaacaatgggacacatttttttcagttccacaagtaggtttctaacaatctcgatgttcttttgttacagcctttgagttaaatagtctgagtttcttcagcttcgaaaatgttaaaataggctgtgcatggtggctcacgcctgtaatcccagcactttggaaggctgaggaaggaggatcgcttgagcccaggagttccagaccagcctcggcaacatggtaaggcctcatcttacaaaaaatacaaaaaatttagccagtgtcatggtgcttgcctgtagtcccagctacttgagaggctgaggtgggagaattgcttgatcccaggaggtccaggttgcagtgagccattattgtgccactgcactccagtctgggtgacagagtgagaccctgtctcaaaagaaaaaaaaagtaaaatactgttttgtttgcaatcagagccctgtctgtctttgtcaccatgtatcagcagtggttagcacatagtagatctccaatacatttatgtgaatggttctatgtaaaagcaaacaccacactgattaatcactaattaaaagcaaaaagcaaaaagcaaaagccaaaagtcctcttatacaagattctgcagccaaagagcaaggacagcagaggaccaggctcagaatctaatcataaaagcagcagatttcaaagaattctggtttattccatgatcagaaccctgatagttgttataatgatacatgaatatctggagcaatgcaatttaaaagtttgaacttctagatttctagattttctctgggcctgcagaagttgttcacttcctcttttcacaagatagtatcttctacccacttgaagtcatacagaggctgacaaagggtagatttcttataggataattcttgttcttcagggattactctcatcactccctctgacaaccagacaaatactgaatgtcaaataccagcacaactgggacaaagatgctatgggatttctaagagagaagaagggctatcattgaagttactgaaggatctgcaggtgcaggaagagtacacagagtatgtagcctaaggggctctgacaaagggtgaaagaatatacatttggatacagtagctaatggatatggaagcactctactatgatattaagatttaaaatcctggcacataccctagatgatgttaacagctgctaggatggtacctggaaaatttatggctcacattgagtgaggtagaaattccagaactgccacggaagatgaaggaagaagggaacaaaggactcagtgtattgagcatgcctgagaaaatatatatggaaagctagaaatcccgcaagataaatataatccaaaggatggaccactggacactccatttaccaaaatataaagagtgtgttgtggagaaggacatcagtattgttgagaagctcagtggtaactgtcttctgaaggccagctggtaggagatcacattacagaacagggattcttgaataaaaatgggaacgatagaatctctaaataatagataccaagaggtgatatttcattgacagaagaaacatagatgtagatttcgcaatgagaaggaagacaggagtggcaaacatggagtctaaaatttagaaaacagtagaataataaatagagtatggagttcctataggcaagacagatggacagctaccaaggattttgattaatttatacaaccaaaaccaatcaagaatggataatcaggaggttaaggccaggcacccttcttcttcctccacaactctctatcttttgcccagtttctagacctgcattgattctcagacttttaattgaagatgactgataaagtagataacagatctttcagggaaagaacctaataataccaggaacatatgaagttgtaattttcccagtccttttccaacaggacctgagactctttactcaagtgactatgtactaggtaagaggaacatccagaacttctgaggtttgcttgattcagaatccaaactcaaattaggccaggtacggtggctgacgcctgtaatcccagcactttggggaaggtgggaggatgctttgagaccaagagtttgagactagcctggggaacacagtgagacctcgtctccacaaaaatacaaaaattagccagatgtggtggtgtgcgcctgcagttccagctacttaggaggttaaggtgggaggatcacttaagcccaggaggttgaggctacaatgagccaaggtcacgccactgcactccagcctggggaacagagcaagaccctatctccaaacagaatgaaacaaaacaaaaatactgaaattcatcctttgatatccaaactgattccatactcctaatagaatgaaggcatatgggagccagatagtaagtagagttttggctggcatttggctcacggtgtaatcactgggtccacagaccaaccagatggtgttttccaagatcttccaaggtattactggattatacatccttggtagttggcagatcccccacactggttttttgttctatatgtaacagccatcaactgtcgcttcacccacaactttattcatttttcatcatttttttttttagacaaggtttcactctgtctcccaggttggagtacaatgacatgttcatggcccactgcagcctccacctccctgggctcaggtgatcctcccacctcagtctcctgaatagctgggatgaccggtgcatgccaccatgcctggcgaacttcttttgtgttttttgtagagacagagttttgccacattgcccaggctggtttcaaactcccgggctcaagtgatgtgcccaccttggccttctaaagttgtagaattaaagtcatgagcctccatgcctggtcatttttttaatctttattgattttcctaacatttatattgtcagaaacaattttttacaatgtttccgtatttttggtgtaatatcaaaatacttctatagtaaatcatttgggttaagccattttcttcttaaagaaggcgggggaggtggtctctggaatattcctatttatgacactagtctagcaactataaaaatatggatagataatggtatatgacagtggataactgtaaacttatccagacagtaacaccaattgctgttgctgcaccagctatgttattttttttttctgaagcagattaacacagccttcagtgtgagatataaagccatcaaaatgaaaatgcatttatttccagccatttcaaaaagaaaaatcagaatcagtttagatccacatggaacaaaaagaatacacttatagagttttaacttgagttctgttaactctcttgacccctattataatgcagtatagagacctgaaacattgacacagtatgtggaacgccacactggtccattatatcagcagttctgcaaatgtggtctttgaatcttgaaggtccctgaaacactttcaagagattaatgaggtcaaaattatttttatacgcattgtgttaacatttgcactgatgaagcaaaacaatgttgtataaaattgctggatctttagcatgaaacaagtagcacctaactatacttgttattaatgccttgttcgttgctatgaattacagtttttaaacaaagctttaaaatgtccttgatgaagcagtaaaaattttattaaatatttactcttgagtacaattttttagtattgtttgtggtgaaatggggaatatgcataaagcaattgtgctgcataacaaactgtgatacttgtttaaagaaaaacacttgtgtgattgagaacaaaatcagccactttgttcatggaacaccttcaaaggtactgatggtaaaattatggttattcagacttgggtatcttggggtagttggcagatattttcttaaaaatggaaggagtttttcagtttgatggaaaacaactgacagtatttgttcccaatgataaaattcaatgttccaagtgaaaattaggaatttagaaactttttgtatttactagtcttagcttgaaatcaacaagtatgatttttgatattgtataataatctgtgtcaatatttgaaagcctgcataacagaactgatattattttcaaatgattaattcatggtattaaaaatcactcatagttaagaaatccattcaaagttcaagacatacctgtagattttaatgcaaaagagtacaaaaaattgattgatgtttctatatttcacattgcaagtaacctttaagaaactactacttgttgaattttgatataatgccaaagaataatatccaaaagtatttgaacagattattaacatatcactctttttcccaactacatatctgtgtgaggcttgattttcttcatagacttcaattaaaacaacatattgcggggaggagccaagatggccgaataggaacagctccggtctacagctcccagcctgagcgacgcagaagacgggtgatttctgcaattccatctgaggtaccgggttcatctcactagggagcgccagacagtgggcgcaggtcagtgggtgtgcgcacagtgcgcgagccgaagcagggcgaggcattgcctcactcgggaagcgcaaggggtcagggagttccctttcctaatcaaagaaaggggtgacggacggcacctggaaaatcgggaaaatcgggtcactcccacccgaatactgcgcttttccgacgggcttaaaaaacagcgcaccacgagattatatccgcacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagcctggaagctccaactgggtggagcccaccacagctcaaggaggcctgcctgcctctgtaggctccacctctgggggcagggcacagacaaacaaaaagacagcagtaacctctgcagacttaaatgcccctgtctgacagctttgaagagagcagtggttctcccagtgcgcagccagagatctgagaacgggcagactgcctcctcaagtgggtccctcacccctgacccccgagcagtttaactgcgaggcaccctccagcaggggcacactgacacctcacactgcagggtactccaacagacctgcagctgagggtcctgtctgttagaaggaaaactaacaaacagaaaggacatccacaccaaaaactcatctgtacatcaccatcatcaaagaccaaaagtagataaaaccacaaagatggggaaaaaacagaacagaaaaactggaaactctaaaaatcagagcgcctctcctcctccaaaggaacgcagctcctcaccagcaacggaacaaagctggacagagaatgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaaggctcaggagccgatgtgatcaactggaagaaagggtatcagcaatggaagatgaaatgaatgaaatgaagggagaaggaaagtttagagaaaaaagaataaaaagaaatgagcaaagcctccaagaactacgggactatgtgaaaagaccaaatctacgtctgactggtgtacctgaaagtgatggggagaatggaaccaagttggaaaacactctgcaggatattatccaggagaatttccccaatctagcaaggcaggccaacgttcagattcaggaaatacagagaacgccacaaagatactcctcgagaagagcaactccaagacacataattgtcagattcaccaaagatgaaatgaaggaaaaaatgttaagggcagccagagagaaaggtcgggttcccctcaaagggaagcccatcagactaacagcggatctctcggcagaaaccctacaagccagaagagagtgggggccaatattcaacattcttaaagaaaagaattttcaacccagaatttcatatgcagccaaactaagcttcaaaagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccgtcgagactaggaagaaactgcatcaactaacgagcaaaatcaccagctaacatcataatgacagcatcaaattcacacataacactattaactttaaatgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctaccaagcaaatggaaaacaaaaaaaggcaggggttgcaatcctagtctctgataaaacagacttgaaaccaacaaagatcaaaagacacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgggacagaaagtcaacaaggatacccaggaattgaactcagctctgcaccaagcggacctaatagacatctacagaagtctccaccccaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggattaagaatttcactcaaaaccgctcaactacatggaaactgaacaacctgctcctgaatgactgttgggtacataacgaaatgaaggcagaaataaagatgttctttgaaaccaacgagaacaaagacacaacataccagaatctctgggatgcattcaaagcagtgtgtagagggaaatttatagcactaaatacccacaagagaaagcaggaaagatccaaaactgacaccctaacatcacaattaaaagaactagaaaagcaagagcaaacacattccaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaattggtaccattccttctgaaactattccaatcaatagaaaaagagggaatcctccctaactcatttgatgaggccagcatcattctgatatcaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatggaaggcaggttcaatatatgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaggggtattcaattaggaaaagaggaagtcaaattgtccccgtttgcagacgacatgattgtatatctagaaaaccccactgtctcagcccaaaatctccttaagctgataagcaacttcagcaaagtctcaggatacaaaatcaatgtgcaaaaatcacaagcattcctatacaccaaccacagacaaacagagagccaaatcatgagtgaactcccattcacaattgcttcaaagagaataaaagacctaggaatccaacttacaagggatgtgaaggacctcttcaaggacaactacaaaccactgctcaaggaaataaaagaggatacacacaaatggaagaacattccatgctcatgggtaggaagaatcaatattgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaactctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctatagaatgggagaaaattttcgcaacctactcatctgacaaagggctaatatccagaatttacaatgaactcaaacaaatttacaagaaaaaaacaaacaaccccatcgaaaagtgggcgaaggacatcaacagacacttctcaaaagaagacatttatgcagccaaaagacacatgaaaaaatgctcaccatcactggccatcagagaaatgctaatcaaaaccacaatgagataccatctcacaccagttagaatggcaatcattaaaaagtcaggaaacaacaggtgctggagaggatgtggagaaataggaacacttttacactgttggtgggactgtaaactagttcacccattgtggaagtcagtgtggcgattcctcagggatctagaactagaaataccatttgacccagccatcccattactgggtatatacccaaaggactataaatcatgctgctaataaagcacatgcacacgtatgtttattgcggcattattcacaatagcaaagacttggaaccaacccaaatgtcccacaatgatagactggattaagaaaatgtggcacatatacaccatggaatactatgcagccataaaaaatgatgcgttcatgtcctttgtagggacttggatgaaattggaaaccatcattctcagtaaactgtcgcaagaacaaaaaaccaaacactgcatatgctcactcataggtgggaattgaacaatgagatcacatggacacaggaaggggaacatcacactctggggactgttgtggggtgaggggaggggggagggatagcattaggagatatacctaatgctagatgacgagttagtgggtgcagcacaccagcgtggcacatgtatacgtatgtaactaacctgcacaatgtgcacatgtaccctaaaacttaaagtataataataaaaaaaaatattgcaataaatggaatgtagaagcagatatgagaatccagctgtcttctattagaccagacattacagagatttataaaaagcaatacagtgccactcttcttactaaatttttgttttttaaatatagttatttaaaaatatatttatagtaacatgtaataggtttattaagacttttaaatgaatacatattttaataatttctcagccttaatgttttatatggtaacaatagatgtacctcacataagcaaaagttctttaggattttcaataatttttaagagtatgaagggatcctgagactaaaagtttgagaaccagtgtactctttggctaattgggctagatgagcaataaatgatatgtaggctgtagatcttataagataatgacttgccagggtgtgaaagataaatcctctaaagagtcaattcatctttgtattatgcatccagtggtctatagtatgtcaggacatgttctccaaaataaaagataaagtattgtattttatacttacagcactaagaaaaagtgcaatgttggtaccttgtccccattcctataagttcatccacaagcatcttctttggaacactttgttaagatctacaggtccatttgtattctcaccttgggctactctctatacaaaggataactgggcaggctcccagagctctgctcattgggaatttctcctttccactaccccaaaagcagcactgctggaatagcagcccttttttagaagcacactaacaaagcaagataaactattcaagaactctcattaaagcttttccttctctgacatttggtcctaagagtcataggtgggagctgagggggaggcgggggtccagcagtggtgggaacaacagacactcatgcagctttcctcgctctctggccctacatgtctgatccaggtgttctatctacttctatcttacaatgaattctgagcttatgacttggttggtctaacaaaactcagcatatggtgggccctgtgatttcattatggtcacttgctatggtcagatgatccatatttatagagtccaagtagcacgtccagagcttgttctcagttgacatatagttttctgctgccaatgccatagccttgctccacagccttagactacattgtgattctcttattgaagtgtgtcatcaactccacaaagcatcttttccacatatatatatgtaccgcatatgcggtacatatatgtactatatagtacatatatatatgtgtacatatatagtacatatatatagtacatatatgtggtacatatatatatatagtcctgtagggtctgtcctataacttaagttacagggctgcttgcatttcagattgacctataatagaatcattttatggtctgcatctgacacaaagctataagcctctgttattagataaagtagttagagccatactcacaagtgcaggtcatactgcctaccaactttgccctttctgtttgcataaccttattaaataaacctaatgatgacatgataggaaaaataattcatgaccattctcatgaacatagatgcaaaattttaaatgtaatattaataaataaaatccagtgttgtataacaagataatacaacattccaagttagatttatttaaggaatacacggttgctttaaaatttaaaaattcagcagccaggaaaggtggctcatgccagtaatcacagcactttgggaggatgaggcgggcggatgacttgagcccaggagtttgagaccattctggaaaacatggcaaatccctgtccctacaaaaaatacaaaacttagccagacatgatggcacatgccagtggtcccagccgcttgggaagctgaggtgggagaatctcttgagcccaggaggcagaggctgcagtaagccagtatcacatcactgcacttcagcctgggcaacagagtgataccctgtctcagaaaaaaaattaagcaatgtaattctccacattcacaggataaagaataaaaagtatgattctctcaatagatgaaaaacaataattttataaaaatcaacatgtatttataacaaaacatagtaaatttgaaataaagaagaaatctttaacctgaaaaggtgtatccataaaagtatacaaggaacattagagaaatggtgaactattgaaatctcccccacagcctccaatatcaagaacaagacaccaacgtccattttcaccccatgtattcagccttgcactggagactttaaacagagaaataagaaaaaaaaaaaaaaaagaaaaggattaagggtaaaaaaagaaggaatgaaccatcatcatttattgatggcatgatatttatttaaagtccaacagtctatagatacagtattagaattgataagtgattttagaaagctgtgtattttggtacaacaaaaacaattagagagtaaaagttagaaaatatattttttagaatagcactgttaaacaccaaatatctaggcataagacagctacatagaaagttataaaccattataagaaactaaaatgaaaaaaatggaaagctataccatgttcaccatttagaagactcagactgtaaaaatgccaattgtccctaaactgatcaatgtaattttattcaaaatccctgtggtatttatttatttatttattttagaggggagacattaacaaactgattaacaaaacattaattaggaaactgtagtactggcgtaaggactgatgaatcgacccatagggtagaacaggtgtcagcaaactgtggctttgtgccagatctggcctgctgcctgtttttgttggagcagagccatgcccatttatttaggtattgtttttggctgtttctgtggtacagtggcagggatgagtaggtatgacagagagtatatgacccaaagcttaaaatatctactatctgacactacagaaaaagccttctgacccctactgtggaatacagtgttcagaaataaataaactcataaacagaaacttgggattaagattatgttaccactgagtagtgggtgtaggagtcttttcaataaatactgctgggtcagttggataatgatatgaaaaaagaaattattcttgatctaaatttaaaccatgcacaaaaatcaattccatcttaatgttaaagttaagccaataaagcttctcaaaaataatatagcagatgttcaaaattatttttaaaaactacagataaaaagcaataagaaaaaagtaataaatggatacattggactttaataaaattaagacattctgatgtttaagactttgtaaactataggcaaggcacacagtgaaagaatatatttgcaacccatagagaacaaaagattctagttccttcaaatataaattatatataataccagttaaaaaataggcaaaagacttgggcagatatttcacaaaagaaaatgtccaaatgatctggtcacataaaatgatgtttcacatcattagtcatcattaaaatgcatatttacagaacaataaattaggatgcctaaattaaaaagactcatcattcaaagtgttggagaagatgtagagcagtgatagcccttgtgcactgctgatcatagcgcaaatcagtacaatcacttttagtagcgtctactatagctgaacatgcacataccttatgacccagcaatttttattactcaatttatacccagaaaaatatataatcttcaatgataatgttcatagaagtacaattagtaatagcttcccactggaaaaagctgcgtactcataaaattaatactataaaataatgaaaatatggaatttaaaaggccagatgcaaatcaatatatgccatataattctactataaaatataaaaaccagaaacatttattcatggtgaaaaaggtcagcatattgagtagggcaagtgaactaggggtttctgtggtgttggccgtgttctatttattgatcagagagagtggttacataggtgtattgactatcaaaattcattgacggtacatataagacatgtacacttttctgcacatatgttgtagtttatgacagcgttcagtttcattaaaaggataacacatagagagggagtagggaatcggaggagatggggtgatattttagacagggaatcagagaaagcttctcttaagagagcatattttaacaatgacctgttttcagtgacctgaaagaagcaagtgagaagccatgcgaagccatggaaagtcatattaagatctgagataagaatattccaggcagagagaatatcaatgcaaaggctttgagatgatgtcatgcttgatgtgtttgatgagtatccgaaagcctacttgggcttgagtagagtgagaagagttgtcataaattagattggctgacacatattaaactattgagtgaatgacttatatgaagattcacatttctggtcttggcatgattatttcttgttatctgtccattaaatatacatgaaacattgtaaaatggttttcaaaaaacctgtctattagccttagaaaacaacagatttaataccagggtaatcactttacttagttcaagaactgaattccatttcactaaattttcaaagtctagagaaaatgttttgtccatcctacacaattcctaatgaaggaaaaagacagaaaccagcagttaatcaagacattagttaagttgagggaaaaatatgttgataaaagcataatctcttcatttactgatcatttatgggaaaagagctatacgcaaattttatatatgcatatgaaagttttggcgggcacagtggctcatgcctgtaatcccagcactttgggaggtcaaggccgacagatcacttgaggtcaggagtttaagaccagtctggccaacatggtgaaattgtctctactaaaaatacaaaaattagctaggcatggtggcatgcgcctataatcctggctacttgggaggctgaggcaggagaattgcttgaccccaggaggcagagtttgtactgagccaagattgcaccaccgcactccagcctgggtgacagagtgagactctgtctcaaaaaaaaaaaaaaaagaaagaatgtcagatttaagacccgacaccagcagcaatggaaaccgaacaatagaaaatcattctttcaaggacttatttctcttaaagatataattacctaggattgtccatgaagaatgagcaatgtcatttgcggtgatggaagctcattaccaggtggcaaaaaaacaataattatactttctacattttataagaacctagacatactacattttaaccctgtgatgttttcctttttaatttaaaaatagcagcatcagcaatcaccaccaagaataaaacaataacacacgcgagaacaagatacatattcaaagtcctgagacctcacagtttccctgagagttgcaagtgtcctgcaatgagacaatggacgcttctgcctagaaagagttgctgcagaagcaggagacactaaactttaaacaaaatcatagaactctttcaacctttcttctcgtattgagtctacgttaaagtgccataaatcttgttgacagttactgccacatctattggcacacagtcagcatctgtttgaaaagagttttgcagcataggtagggcccattacctgttctctgtcttctcttagtatttattttcaccccagcaggcagcacctcacaatgtcattaatttcttagtcagcctgtactttcccttacagccacttagagagtgctcttataaacagctctgtgcatcaccagaaatgcattgcacctctagaaggaaatcagaaatttaagagcagcaggtacaacgtgaactggttgctgaggtgatgtggtctctgttgctagatcagtggggggtcatcatggtgatttggttatatggttccgagggaatcagtgctgttggccaacacaatcttaagaaagtgagcgatggtagatgtgcaactgaagggaaagcagcaagaaaatacgatattccacgattcaccatgaagaagaaagcaacaaatgagtagacaagacagcaagaaattacctgcataaagaaggcattctaatcatcccaatacctgaaaagagtgaactgtactctagtcaactttcgttgggataaatattctaataggaattgcccctttcttcagaaaggatgattaaaaaacatcatcaatcaaagctggaccagaaaagcaatcagaacctaattcttcattagaacaggtttaaagatgtccagtcatgaggactctactactttaatcataatatggtttttttacaaaaattaaaaatttccataaactaaaatatggatcacatttatttttattcttctgtggggccaggactcatttctagaagggctactggtccacggttagaaaatggccccttcacctctgtggtaaatgtgggctatatgtttggatgtgcttcaaatattctagatgggtagctttgtgcatattttaaattttatagaaaaataatacaatcttacatttctatttaatcattgtttaaaatgtattgagctgtaaaaatcacacaaggaggtagaaaagtcagaaatgtttatgtctacttatataggttatgagacagacctggcaaagataattaggtcacagatttcttttttttttttttttaaccatacaacttattgtattcatgtgcttatagtctaggaaactaaaaactaaaacctgtgtgtaagaaactcagtagccttcaatgtctatgtcaaaagtctcccctattagcagctgctaagtggaaaagaaagctgaaggaaagcagcctgggtaagttgagaattctaataaaccaattggtatgatactaatttgctctttttttttccttgcccatggaatatgataactcatttttatcatgcacctttgggaagattgaaaaccaaaaaaatgaaagaaaagtcagtacagtattagaactaatgtcttcccacccaagctactgtgttctggtgcatgagtcaggtggagcggtgctacaaggtcaaccaagagagtgggttgttcaactactgtggcaggaatcaccatagaatggacattctcacctggaggaggacttgtaatgaaatctgaagaaaacattattctcaagagataatatgtagtggaaggaaagaaaattaagacagagaagaaggaattcccttctcctgtctatacattttcaacctcctttcctttgcgggaatggcataatgatttgtttcttagagaaccttgttttgttgtttcctatcagcttcctctgcaaaacaaaaacacccctgaacccgccttcctcttgaagtaatactttggttccctgattttctgattagggctttcaaaataatttgtgttcaagtatgtttttattccaggcttcattttgatatctacatgtccattattagcctgtccccattaaccaattaagtacacatgcaaacacacacatgcacacacacatacactctctattacaacacatatacacaagacatatctgagtactcactagtaaatactcatgtgtactaaagtctaccacaggggtttcaaatgtcagttgtgttttttagtttaattcaacttttatacctatagtaattcatttatttcatttttgattattttaaatgttttggataacagaatggctcttgaattgcaacggaagttaaatttcagtatctaccataaacagcacattcatttcattcctcaagaatgaaaacacctgttatagttcctttttgattgctgacttttaaatgaacatttggatgaaaagtaatgtttacaaagataacatatataaaatattcagaagacaaacagcagaaatgagaaacaaaaaaaagcaaacagaaatttaaaatagtttgtcttaacaaaacaattacaataaagaatttattaaaaacctttggaagaaactgtttccagtaatttaaaaataaacagaaaatatattaacaaataattgaaaataatatctaactgcacaaatgtataaaatatctaactcaaaatagcactgttaatatgtcagtatattttagttaacatacttttaaaatgagacacacagattacttcattgcatatctctgagagctcctcaaatcctacacacattttaaattgttaaatttgatacaattactgtctttttaaaatcaaaagagcattttcctacttttagactgagtaaaagatgcattgactccttgcttcccactagactcactagacattctgatactgcactcgtggtgagctggccagagtgaggttgtgaaaaaaagacaacaataccgaggacatttgggcaaaaaagtatttatcaccaagtataaaaatttttgtaaagccatcactgattaatacattatttcatttttgctcaattacttactagagaaatgtataagtagcattttcagttccttgcaagagaccatggttagcttatttcatggcaaaaacatgttaaaatatgaaatgacttctcaaacctattttatatggaagtcacatttttgtgcacatgactttttaattttgaaaagacgttttatcacaaattccatgaaactttctttcagtaaatctaaaaatggaatgttctatgatactagttgactttccatctcttactattcttctaacaggatactctgaaaatttgaatatcatagacttagtaagaaaatatgttttatgtagctttttgggttaagaagcattagtaggaaaacaagtcagtgtgctaagggctttaattatccgaagagacatacatttatatattcggtaaaataaaattatttaatgttcttcgttattcaatatttttgaaaatattgttatgtttgtgttttattcacagaaattcagttttacaaatagcagctgattttttattaaaccagagccaaattactaatttcagtattaatagttagctttgacatgtttaaaaagggtagaaagtacgtaatagacctgtcttcaactctgaaatgaacagctgctcagggaaatggaattgttcaaagatacattttctttctgccaatctgtgaaatataatataattattctcttttaatgaatctctcaacgaggagcaatctttcagagcttgagcaggtaaaatataatgataatgggaacagctttgtaaataaaaggatgaaatgagattgttattttgtgccatattatgggataattaaaataacagtgcagcattcagcaggtatttgaactttctaaaaaatgctccccagggctcttttaaattagtcatgtttatccatgtagatttgtaatcttactgcaaatgtctgtcaccttataatattcagacctcaatacttaatctgattaatatctgatactgtacaacagctaacaaaccttgccgaaagcagacattaaaataataacctgagttgacaaactcgaatttattaaaagaagaacaatagaactattttcattaagccaggagaatgattactctcagtgtggtgggactcatgaactacatgagattctatgtatttccacaaaacagagtggccgcacacttccaaggagctactattcacatgataattagctctatataataaaagagtatattcatggaaactaaactcatggcaatggaactccaatggctagttgctttgtttaattcaaattcatacagctcaaatacaagtagatgatgagatctgatttttcaagaaacaagttcctttgcagttcactggaccctcctagcacccttcttagaaaaagtgtgcaagcagaatcaagtgctagagtgtggccattatatcacatccattaaagttattagaaaacaaaatataaataaagaaggtaaaataaaagtctgatatctcttctggtataactttaaattgctagtgagatatcatttcacgaaatggtacaattgaagttttattctcaattaggttgtagtttttctcagttattattctctatctggaggaacaaggaaaatggtttttaatatcaataaataagtaactgtgacttctgtttcatactttctgtagctgatttcatgtctttttaatagttctttcatgcttataattttttaaaatcctccccaactgattgtcagatatcctgatgatagaaagaaattattgtaatttcctggggagctatctaccaccttagcttcaaatcattaccctcaaagggcaagatcgctatcaggctttatatttaggaaatttgtatggatagcctcatatctggaaactttatgtgtctactattagaaggtatactctacatgtgttatttaatcacttgagcgttatattatcaggcaatatttatttagtttggaaatctgttttatatgtctaccactgggtacgttaaattgacttaaagttaagatgcagctttactctaggtaggtgatctgccactattttcaatagacagaggactggacaactgtgccacagaaacaaataagatgataattttaccactgatatcagatatcaaggtctacagaacatacccattaaagcatttgtattttctaatcttctctgcaattgcaaaaatcaatagctagaaatatagaagggttttagaatagcatgtagaattttgaaaataaacaatgtattcttcctcagaagtcatataagattaacaatctgagccttaattaaaaatcctgagtaaacacattcatttcctttttcccttgcaactattaaattgatcaataaaccatatatttttcaaaatgcgactggtactaaaaactcatttttcttgtttccctacattcattaggtgatagagagttgctcattattctgccatccctgtgtacctttttggattttgcccattttcctaatttcaatttcttttcaggaatgaacaaattgatgatcaatggtgatgatttcatttatatattagaaaataccacttttctgtttaaatgattacttacctgttatattcaatttaaaatggctttgcagtcttaccaattctaccataaaaagttatagcattatacttcttgtcagattttgtttttaaaattatactgcacaccagattttttaaattttactgttgaacaaggggaaaggtggcaataatgatggtcatgaaaaggtaatttgtataccttcagaagacatatgagaatattctaaatattgtcatctagtggctcagttcctccaaaatattattcatatttctagtttgtgctttttaaatttctaggagctaccagtgtctgcagtttctacagtactatgacaaatagaaatttcattaatgcttctcgataatgcatgtgcttttataggatagccaaacaaaggataagagtacctggtcttatatattgaaaatttttttatttttacattttagaaatatgccttatattctctaactttttattactttttacaaacttcaaaattataacttaaaaaaaatcttagtgccatcacattaagatacccaggtatatgatgtaatcttaaatttaacagcaattttgatatttagtcttattaagcatatgctattatttgcattaccattgctaaaaaatttcaaaggaggcagtttaaaaacatagttgggagacatctacttaaaggttactagatagcaaatgtttggatctatctattttcaaccaatgaaaatatcatggtattagtgtatgcatatatttttgtgaaatgcaacatctcaaacgccatactatttttcaacagttttaacaaccaggtgtaataatgctgcatgaaatccttttcttgtttccaaatttaattgatttaatcactgaaattaaatgcttggaaattcttctgcttgccggtgtttgaacgccaaatacatcatctacagttctaaaatgaatattgcatttatatttagacaacttaaaacactgctttctaaattaccctaaataacccatagaaatgtctagaaaaattcataatagtggatgacaaatgtccattgccatcaaccttcaaataagaataacttttacaaggtatacaaagtgtacaattatctgggaaatataatgtaaagcacacatagattaatcttacttcttccagcactcaccaccagtgagctcttccaaaactcatctttaaagatgaagacatgggagctagaaatcatatttatcttcagaggcaaaagaaatttaagttttgccaagctttcacagacgtcagctcatttattctctttgatcaatttggtttgtattgctttgttttgcttttcttcataatttctgggagttaaaaaattaatagtaataaagtcacttgagtagagatactccttgacagccaatcagatacacagtctctcccaacagtgcatagagagatcaaatagggtgagatgaggatatgtttggtgcaaagtatatggaaaagcttattctgggggaaataatacatagtaaattttatccaagatgatgaagaataaaaacaatgtttacagtaaagtatttccacatggggctacttatctgagtttgtttgtttgttttttgtttttttggcctgaatttttccatgaaagatagtagctagcattaactaggcatttgctacgtactggcccctattctaagcttctaatctgggcttttctcattctcacagtcaccatatgaggaaggcgccattctttgtgcccattttagagataaggagattaaagtacaaggacatgaagttacttgcccaaagttgtccagataagcagcagagttggggtttgagccagctggaatctggtgcctgcaccaagaaccacgaacactatgccgccttcgtggaatgtgtaggagtgattaagcttaagtatttccacatggggctatgcaaacactatcaaggtggtgaaaactgcagcagctgagtgtagttttctaaactttagtctttctggcttcaccttcacaattttggcaacatctaagtatcttctaaattatcacttaggtaggatgttttactctatttttacttgaattaatttttaaaagaaaattttgattaacattataaatgatagtaaaaaattcagcatttcttaccacaaagagaagacaactgtaatagtaaatataaaaccattaaacttttaaaacattcatccatgtacccactaacccatctcattttccatcagtggagtccttgctgggttttgggaaattctgcccgaagaaaagagtatcattgttaaatgtgaatgaaatcactgaaaactgtctggacaatataatatgttaattagtttttaaataaacttttgcatgatgggtacctggacagttgtatccatatgcagggtagacagtcacctattaatgaggtttcaagcagaaagtccagctgctcccttagcttctggcaaatgtttgaaactccataatttgaatataattactttcgctcagtggttatcaaactttttaaagcagtcaacaacttcattttaaacaaagcaacattttataaaccagtaagtaaaagagaaaattgaaattttatttgtgcaaatccattttagaagttctaattgctaacactctcaacacaatcaatcagtgagaggccgggggcagtggctcacacctgtaatctcagcactttgggaggccgaggatggtgaatgatgcggtcaggagatagagaccatcctggctaacacggtgaaatacccctctactaaaaatacaaaaacaaaattagccggacatggtggcgggtgcctgcagtcccagctactctggaggctgaggcaggagaatggcgtgaacccgggaggtggagcttgcagtgagccgagatcccaccactgcaatccagcctgggcaacagagtgagactccgtcttaaaaaaaaaaaaaaaaaaaaaatcaatctgtgagaataatggatctattttgaggaagacaattgcaatgcgatagtatcttatttttcatagatttctgcattttgttttggttttgtggtattggcaatatcctgatacagacatatatatataatcaaatagtatgaatgtgttgcttctcagccatgttgaaccattctgtctccactaccaaaaactggaatagacttggatcttcaaagctaaatcaattagagtaactaaaatggttcatattccttgagaggtcctcactcttggttaaaaaatacctttcaaaagtgtctttttaacagaatttttcactttcaacaaaacaaattcatgacataatgatacttgctgtatcattgaattgaattgaattgcaaagcttcaattagtcaaatatattttattctgtgtacatacctgaaaagctccaatttcattgctggctgcttacacgcagttgtgagcatgtttaaaatcttctctgataaaagtgtgcttgatatataagccagtacaaaattattattaatatttgggggagttaattaactgatacaatttctttatgaggaaaaatacatcttatggtggtctgcattttcatttaggtatcatcactttgttttcatgtccactgattgccatatgttgtttggtgcttgtgccatgcaaaagtacctgaatttgctggccttttaattgcatgtggttcccatgcactgtggtggtatttgcacaatattgtggcccatttgcacaatatttctcatgagatatgcaaagacatatttttaaatgtccattgcagatctatagactttccagtcaatgccacagttatttatttctttatatgtatatacatatgtgtgtgtgtgtgtgtgtgtgtgtgtgtgtgtgcgcgcgcgtgtatgtgggtatgtataactatctatatatgcatctacctatatagaaagaaaaaagaggaggaagagaaggaggagaagttgtttttgtctggtaacacaagttaatgatttgagaactgttaatatgacaaatatatttttattatagtttttttattgtccgcaaatctggcaatgaattttttttttttacatttattacagaactgcagaggaattgcagttataactcaatggaacacagtttgaaaaataacattttagctgaaggtctttatatcttttaaaatgcaaaaacctctactttcatctgcaatcagtcatttgtacattaatgtgaatgaatttattagacatctttctgagtttaattcagaagagggggaggaaaagatgaactcagctactgaaagacatgggaaaggtcgaatattaacgctaggagaactgaagactaatttggcctagtttacagttttgcttcaagactatgccatctatatataatacatttatttgtatttataaacacatatgcacacaaagaaaatgtctactgcattagttgagtgtgagtgtgattatgtttcagaattgcatccaactattttagaatattttgctggaataatgtaattacatgaattactcacaattttgtcaactctaaagtaagtcaacagtaaaatttccaaccaatgaacttattgaagatattctgattttattatgtgagtgtcttcaaagattgcaagcaaataaattatgcagaagtcccagattatgtacagcttaatataaataaggacttaatgctccaaacctgatctcatacctttggactatgatatttctttaaattaaaataaaagagtaaactttaaattaaaataaaagggtaaacttaaaacaaattaaatccttttattaaataaaataattacctttattacatgaatttagttacatgtgtcccccattttctccccctccaaaagaaactatctaaagtttatgaaagcaagtatctatttcaacagtgtaaaaatttagttgaaacttctgataattttttacagaggcatatgagaaacagtgttagttaatattttaagaaagaacaagaagaaaattacgttaagtttttcatttcatttcatgtattttctaacagtgaaagttattaatttgactgtaggttaaaaacgtgttggactagagccatattggccatattcattctaaagtcagtgcttataatgattttgtgtgaatttgaaatatatataaatttgaaatactcacatttaatactattgctgctttgttgtgtttttgttttgttttgttttgttttttttaagagacagagtccttgctccattgtccaggctgaggtgcagtggcgcaatcatagctcactgtagtcttgaactcctgaggtcaagggattgtccctcctcagccttctgagtagttgggactgtaggcctgtgccacccaccaggtgctattcccacttcctcctttcccagtatgttgcctaggctgggcttgaactccctgcttcaagtgatcctcctgccttggcctcccaaagtgtgaggattgcatgtgtgagccaccatgcctgccctattgctgtttttatgtcaagaaattgaaaacaaaatcaagtaatagaaatattactatttaggaaagggataaatgtaactatctcagtagtaaattttgtttttggctattaagtataacattgaagaattagcagaataaatatgaaatcaaaacttagaagcattttgagatacttttggtattctgttgcaaagtatctcaaagtgaaaacaatagtgaaatcatcactaaaaagaaaagactaatatataacaggtttttaaaaaatattcagctcaaaaggtcattcttggttctgagattatatttatcctgaaataatactaaatcaaaactataagctagtcagttaagtcagggaacagaattgagcctaacatacttctgtttttgctcatagaatgacctttgaaacctctctgagctctgctgttttttaactatttcccatctgtgtacagagaaaaatgtattactaagtcacaaggcctatatattcccacttcctcatttcccagaatttatgggaaattggttctaatagttccacagtagaaagcaagaagacagaaaggaaagagagcgcttttccaacagttacaggcactgacagcctatgacaatatttgagtctggtttgtttgtagtttcttccaaatgtgtgttcctgaaaaaaaatcatacgaaggagggtgagtgagcccaggtaaatgacatgtatgcagcagctccagagcgagtgtacagacatgtgtttgggtggagcacagtgctgtatctaagagatgttcaacaacccagtgggtgaatgtagttggcagctgagccattgagaatcaatttgtataagtatcgggaatgtgtagatgcaaaagacatatcaagtattgagatgtagtgaccaaacagaaaacttaacctggaaattattttgtatatattatttagtgaaaatatttttaaggaaggaagcaaggagtacatacgtagtacctaataatacaggctatacaattacaaaagggttttttaagcttggttttagtatggtccttaagctaattgcaatacttagaatttttcactaccctttttagaaatctactaattttacatttaaatgaatatttaaatacaaatataaattaatttcaataacttctagaaactaataattatatttattttcctcctctaattcatatagcacgaacctcattttttctatatatttctccttcaaaatattattttcctccatattttcatacagttatattttgagtatgtaattttttaattgatttgttataaacatgcttgtactaatacaattctccaagattacttacacattttaagggcatcaaaaccacctgtcattggcaggttgtgataagcatttctttcaagagaatacctaacactttctccatcaatcttttccactttcatggtaccaaattttatataaaagaagtcactgcttgttactgaaacttgaaccaggtactcaaagacaccaaaacataaagctattgcccaccaccataaagcccaccaaccatcttctcactttattctatttcattttttagtaatttatttatattagtccattaacactgaaatctcttcatattttgtccttgctacactgagctgagacaacatgttttgatttctcaatgtcatcagtagtattaggtaaattctagaaggtaaaaatgatattatagaattacatacataaactattgggacatgattagttatcagaatatcacattgatatctctagtttataaaatctctaagaattaggtatcatgtcccaatgagaactatattacaatagagttgaaaattctgacccatagttagtctagtctactttttttaggtctttgctttctgtttcccaggtctcctacttgttgttactaactttctggaaaaattcagcagacaaccaaaatttatcatgggatatttaaacattctgttatatatggtacttagaacaacagctctgtaaaatagcttcaatctcatagcctgaccaaagcagaaaaagaacaaaatctcttataacacaaccttagaaaagccttaactacgtccttattccagcaactcaaatgtcctatttaagacaatcacgtttcagaagagcttaatatacaatatcttctattttattatccatgaaataccccaaatgtattttattttctgtgggaagagctatatacgaagaagaataacgaaaaatgtagccaatttatacttgagttagaatctattgtgatataagttaatcacacatgggtatcccataatatgaaaaatacaactgtaaaaatatataaattattatagtgcaacggaagactctttacttttaaagaagcctttgaaaacaggttaacaagcaatttaacaactaattgttagaaaactgaccttgacttgcaaacttcaactctttggcatctgtgacggtggtccttttgtcagacccttttttctctattcgtcgatggcttcgtcttttcttagactctccccaaagattggatcctccatgcatgcttggtatattcaaaatagcaattccttccagagagatgtttattaaatctatctgtactccatcacactgatcggtaaaaagaaagaaacagaaacggaatattttatctttatttccctgatttcttgtttttcatttcctcatcttttaataagtgcgttgaaatccataatgttgtcatttccaaacaagcctttcaagaacacttaaacacttaccctgagtcaatataaaagataaagcagcccctaacattaaccagttatctctagaagtccttaaaaatgatcaaattaaatcaccagtatatctttgtttgtagaaaacctttgggagagactcgttagcatctgcatatatatttaaccagctgcaaatttccaatgtgttacaaaaaggttaattctggaaactatggtcaaattttaggaagaaattgtgatgattgcccctgtttagaacacactgcaaggtactattgggggaaagtacagaaagcagattgatgcctcatggtctcacacctttggggcagagaaagaagtagcttaaaagacttttgctaaaaaaaaaaaaagtaaaattcaaagcagagattctaagagatttcaatcacactgaatttaccaagggtggtttcttggactagatgaagtcctaaggagatgtcaaaggccatgagaggcacagttgtccaaatgaatatggagggccgggtagattgattgagggaaatagtagcagtcaaaagaccttcaatccagcatgactttatagctgctgcaaaaatggttaaaaaaaaaccaaggttaatcagcccaatttttcttattttcctggtgacaaaacaccctggtgattatgaaaaatataaaattcactaacaaacaatgttttgttatattcagagtggtcacttcttagttttttgaattttccattcatttccactactggacatatgtggacagtgacaagactattctgtatttttaaaattactatttatttattcatttgccttgacttctttaaaatgctagttattattatacattctagaaattattatcccattttcaattataagtgaatatgaaaagagatataagcgctttgtttttaaaagaactttgtgagggatatgcatttcctaaattgaaatatatttacagtggcgttgtttcatttgccatgtcttagtacagaaaaaattattgacactaacttcatcatttctcatggcagtcatgatttttgaactcagaagacacagtgttccatgaaaatgatgaaaaacaaacaaaacaaaacaaaaaaaagccctctctttttccacattcgcctcatcatactgaagctaggattgcatcttgttcactgaaaaataaaaactgtgaaataaagaaacacatcttgagactacttggcaggggtagaaacaaattctagagaaagtgccaagttttcatttaatttgtttcaatgagggcgaaaccaagatctggatgatgcttttttttttttttttttttttccagaaagcagtgcttttttcctccttttctggtactaaattaagatgatttctttttactaaagaattctggtcatgtgtatactcacttaccgctatatattctagataaacagatattaatttcataattaaaagtaatcttgtgtaaataccctgcaggcctcaatgaatcaaacacatactgtgtgtcaggcctcccactgtcttcaagtggaatgtactggctggataattagatagtacatattttttaaccttatttgcatgcatattatatcttttgcacactgacaagcagcagtaacaacaaaagtcagattaccacagggaattcccacaaagaagtcttcattccttataatttgcagcctaaattaaaataatttgatctttgacaaggatgaaatgtcaagcagaagggggtcctctacaagccacggcctgtggcttctgaaatctgcctaatttatgtcagtcacttcttaatacatatttaagtattacacgaaaaagatgataaatatgcaatctgacacctttggtatttccctgctgttaatttataaaggtctggcttcccccaaactgactaaaatcatttaaataacagaagaatcatgaaataagctggagtcagggcctggcttccattttcactcaatattgaacacagcaggtagtacactaagacaattatttgactaggccttagaaccccactgtgacaagttactttcagaattagtgaaggaggattcctttgttcatctgcagaaaaggagagcatgttgcaaagaggcttcttttttttttaaaaaaaagaattgaaccagctgagttacatgtgacaattgaaaaacatgagtgtatgctattattcatgttttcactcttcagagttttgtcatgtgtagttttagggaaacagagtaagtagctctctgagaagtgaaaaaaaattctcaaacagtcgcaaagaacaaggactgatgaagaacattgatgttcctttgagagcaggacaatgtacttaaataaattgctatttattaatgatttgtttccacttgttcttgaccctaggctaccttcctctgtttgctttaacgttatgttcattagtctggaaaatttcagtgctggttctgatggagaccagtaattgtagcacaccagttgagtgcatgaaagtaaaagctgaggtgaaggctatgaaatataaacaagttatagtactgtgtcagataatattttcattccctttgagatttatgacttttaaaaaggtagctacagaggaaaagaatataaaagcttaaaagctaacagcctcagttagtcaataaatcctgaatatttttattaggtagaaaaaaggtcgttaacatatagtactatgggagctatttatagagtgcaaggctgtgatgccattgtctgctcttttcagttttaaaatagaggatcttattccagagacaaatataattaaaagaaaagaagacggtttcaatttttctgccaatgtgttttaaccttcataaataaatgagtcctgggtcacaccgtacagaggtgttaaaaacaagctttatatgtgactttagtgtttcagatccacttaacatgtcagttgataggactattcaaaacatgtgaagaactttggagagctctaagtgtggatggtaaatgtgatgagatacaattaatgataaactgtaatttttttccatagtaggtctgattctatgtctatatcagataagaattatttctatttttactcaatgaaacgtaaaacattactttataggtaatttcagtattaggacacatggggcagagactatgcttgggaactctggctattgcctctaagaactctgttttccaggttactgagcaataagaatattgtcttttgaatcctgctaatttattttgtgtttttgatgctagtcatgccattcattaattcttgagatcatttaggtttctaggggtatttaatcattacaataaatcagtactttgggatggaaattcttggctttaaaatttaccatctttcccagtatccctgtcaaccaaaagactgaaatatctatagaataggctttcttattctctcattaactttgcctggtactctgagcaaactgaacattcatgaactctgtatcttcaattccaaatgctgacctgagtttcttaggcacacatttcacccctccaaatactttaatataaacattggttttaaaatattttcttgtaattttaaagaatttatttttatcttttgtaataaagttagaagataaatgaatatctttaaaaaattctacttcgtgtatcattaaatctttacatgtatgtgtaaatacatatatttttcaatcaatttgctcattagatttaaacattgtggcagcaacataattcttatttctcttaaattactgaagaaaatgtttatctctgcaatggagatataacagtatcataaggttttgataaagactaaatcaaataatatatgtgcattgtttagcatcacctgtgagacagttaataataggtaaatcttaactattattccatgatattcatatcaacccaaatatttgccctcttttgaaggtgctcactatgtgaaagagaaatattaaataaaaagacacacaaaagatagtttgattttgaaaaagctgccaataaaacatgtatctattgctggaggttctgtttttactgaagtagtttattctgttatatatttttcaaaccatagtaggtataattttaggacaaataggaagcaacaacaaacagaatcaaattttcgaatttctgtttttgttatatttaattataaaataaccttgagggtagaaaggcatattctgctaatatgatagacaggattcattaaaaagtgagcagagaagcagattttgcctagctatccacacacacacacacacacacacacacacacacacacacacaacaagatatgcaaaaatacaagggggcatgcacacagtgctggctgtgatttataaatattattttaatagctcccaaaataagccagggatgcagagctagaaggtcaggctgagagagtaagcagaaacagcactccaagaaacataacttagttctagtagcccagatttcttggagaacattctaaatagtttttctgtcagatctcaagctctgtggatcaaaaccacttaattttatcattatttagcatattacaaatcaccgttttcaaatatattttcattcaaaatcttttgctgtaaacacaacacttttcttaaagattttttttttgtactttgtgacacatagaatcttattttatagatcaacagcttttaaatctgtgctcaagggtaggataaagtaaagggaggtgcaggaggattcaggatctccacctacattcaaccaaagccatacttctaatttttctaaaacttttcagcttctgctgcaaattgtatttgagcataatttttgaggataagaaatattcaaaatctagtatataaagcagtttttttaaaaaaataatgattctaagagtaaaggggtatgtatatgttttattgaatatatatgcacataaatatgtatatgtatataacaatacatatgacacatatataaccatatatactatatatttaactatatatgtagttatatatgtcatatattattatatataatatatataactaaatatataactaaatgtagttacagatgtcatatattattatatacaataatatataactaaatatataactgtagtacatatacaattattatatagatatacatgcatatagttatatatgtgttatatatatcattttatatacagttatttgtgtgcatatatcatacatatacacagatatatcatcctaaatagtaataacagaaagtccacgttgaacccaaatccttcacctctgtaattatgttcctttcaaaggttatgatctgatcctgttatgaagggttttttcccattccatgaccatcaattctaatacttaattatatttaccaatcatgatgagataaaagtgctaaaaggttacactgagagtagtatcattttttggtattattaataacagcaaattagaaatttaggataatgaagaacttagccaggccattgtgtggtccataactacttctgtttaccaaacttattacctgaatataaggaactaatgatttaggtatcagtagcaaatttttgcatttatttttaaaatgaaaagtgttgaagccaatgtttcttaattcatatcaactagtcattaagtgttcatgtttcataattctgttcctctggttttgtctttatcatttgtcaaaatataacttttcttttttctttaacccctaaaaatctctcaatataacgaagtcattttcttttataatatttctccaaaattttgagtcctacagtgtcttttttttttacagacctatttgctccaagtctttttaaaatgtgtcttttcttgctatctttgctctctttcttggcatttccactttctataaatgtaatggggaaatggcaaccttgggaactgagaaaacctagttaatgaatgggaatggaatggaaaagtatactttttaacctttattcataaaagtaagtacaattttagcaaagtgtgttttaaaggttacaagatattgagacccgaaaataatattttttatgtattctgcaacttttttcttcccaactacttttatcttacctttctatctgcactatgcccagtaacaactgcatcaatttccaaagttgtgttccacttctcattcttttatactataataaaataacccatatctacacttaactttagtatgtcagatagtgctgtattccaaatgagtgaaaggaatgacaatttaaaatcttgagtaagtctctgtggattgctaatatatatttcattccatgggctccaatgcaaatatactaacaacaaagctcaagccatttcatcatattacaaaagagaattcatttttttcttacttctatttctacagattcatgtagcttcttgcaggtggctgagaaagtttcagatgtgccaaactcaaaataccaaaatttgttcttcattctgaaaaagaaaaggaagaagcaccttaggcaattatcaataacagagggatcttttaaaaaatggtctaactctgtcttgtgttataatagaaaaggtctgaggacatgtgacatctaaaatgtaatagatggtcatataattttcaaagcttaaatgtgggtgccaaactgtatgatggccttgagggaattataagaatgtgttgatctagcagactcaagtacacctttagttttttgtgggttcatcacattttaaaaaacggttttaatgctcatgattcttagcttgttcttaggcaaaaagtgaagaatgtacaatagtgggaaattatgatacagcataaagttttttagttctttcaagaattaactaataatatagaataaaataactaagaaagtaataacaatattatatcaataaaagttgcaaagaaatataattaaaataatttcagtatttaatcttaaagtaaaagactcaaaatttattttcttctatgacttgatatttttggctttttgtaccaggtaattaaatttattatcacttaatgtaactttacaaaggtcaaatagatttttatattatctagtattggatttgaaattttattcttgtgaaaaaaatgcagtatttgattatgcataattctaatagtgatcatgccctcaattagaagacaatacatgtaagtgacagacattttcacacatagaaatgaaacaaagaagtttttgttatggtattcgagtatgtctctcatatcaaattaaagtattctgtttgacttataaatattgatatctgcttcttacattagaatgtaaaacattttgacaattaaaaagacatttggcaaaggccttactacttaattcaagcctattattggtttggaaaatgacattaaacctaatagagtgcttattattatgctatgttaaatccaatagagtgcttattattatgcagagttctctgatataaaattataaaatacaaagcaatgttatattatctatctaaacatagtcaataatgtttaggctctcacaaggttttatttgcttaaaaaattcacaatcccttcatgaatcagtcatattcaggccagtaatctgaaggtcagtataagtttcataggattctagcaccatgaatctttattcttttccagagaatatttgacttagtttatggcctgatttcatatatgtgagcagatataaacagatgatagtgaagtaggttagaggtaaacatttaatgacaagatttgtgggcctgtatctacagatgtgtctatattaaattaatgtaaatgtctattttatagaatggttaggcttttataaatttacacactgaagtcatgtaaaattaaaatattttgctattgagatttatcattctgatgaaaaacatatcattctacagatggagagaaaaatattggtttatacaaagaggtctgaagacattcttaatgaatattttatgactattggaatagtctttctatattcagcaactttctaataacatttttgtgttattcttttctccagaccttccaggattgattcattcattcaacaaaagtttaatgagaacactctctctgttaagtactatagacacaaatataaatgcaattacctttgtccccaagaagctcagaatgttataaacttatgggcatatcagtttgttaagggaggcaggaaggtaatggagggagtatgcctggacatgtgaggcccactgggatcttggttattatggcccttatctgccaggactgagtctcttccctacactgtctcaaaaccacaattagatatcacctcctttttgttaggatggctattttcaaaatacctcagataacaagcactggcaagggtgtggacaaaagggaacatttgtatactgttagtgagaaaataaatttgtacagccgttatggaaaacagtactaagtttcctcaaaaaattaaaaaatagaacaaccatgtgatccagcaatctctcttctgtatatataccccaaagaaatgaaatcaatacctcaaagaggtattgttggaccttatgctaagtgaaggaagccagaacagaaagacaaatcttgcatgatctcacttatatgcagaatcaaaaaaagtcaaatacatagaagcaaagagtacaactgtggttatcaggggtcaagaattgggggaaataaggaaatgttggtcaaaggatgcaaacttacagttataagataagtaagttttggagacctaatgtacagtatggtggctatagttaataataatgtatggtagcaagggggaaaataatgtattatatatttgaaattaactagagtagtagattgtaagtttctatgtgaagtcatggatatgtaattagcttcattgtgataattatttcacaatatatgaaaacataatgttgcacatcttgaatatatgtataatttttaaaaatttgtaaattataccttaataaagctggggaataataaatagacattattttgcgataaatttagattcacatgcagttgtaaaaagtaacacagaggagtccaatgtgcccattacagtttcccccaatgaaaatatcttgcaaactgtagtacaacaggacaaccacaatgctgacattgatacagttaagatgcagaacagtcccgtcaccacaaggttccctcatgttgctcttttataaccacccccacttctacctgcccccactccctcctttccttcgacaaccactaatctgttctctagttctataattttgttatttcaagaatggatacaaatggactcatataataagcaaattttggcatttgaatttctcacttagattcatccaggttgtttcacatatcaacagtttcttccttttatcactgagtagtagtacatggtatgaatgcatcatagcaaaggactagtatttagaatatataaagaactctgatgattcggcagtaaaagcaacccaaacaatttaattagaaagcaagaaaagacataaacagacatttcaccaaaatagatatacagatggaaaaaaaaatgtaaagatgctcaacgacattagcgtttagagaaatacaagttaaaaccacaatgagatatcaccccacacttaacagaatgactaaaattaaaaaaagtaaaaaaaatcttgaatatatataattttcatgtgatttgtacctcaatgaagctgaacataaaaacactggtctattatgaaaaataataaattgagtttctaaatgaaatatgagccaagtattgtaggaacatacttcaatgattcagctaattttatctcaagagtcctgcaagctttagaataaaaggtagcatgtgaatggataagtagtagaaggcaagcagagaaggaagaagagacaagttctgtgcacctttgggagtgctgtatgattttagagtaggctaaataccgactaacaagtgtggtagggtctgtttcagaacatgtaaacaaagttaatggttttagacttgatcttatgattaagaagaagctgacagaagtttattagcagaggggtgacatcgtgaactttgttttatgggcaaacaaatctggcagaaacataaaaatgggctggagtgttgaaatgctggtgtcattaagagaactgtagttattgcaataattcatataaaatataattgaaggcctaaccaaatggcaacagaaatggaaaagaggggctcaattcaagagctataaatgaggtagaatcaataggaactggtgatatttgattttactgatttatgccatacctagattatctctgaatgcatagacgagaataccagagtctaaatccagcctaaaaagagatatgggtttatattttggcaggttctgtgatctaatgtacactgtatcatagtttgaaaatttaaaaaatatatatacgaggttttggcttgtatagaaatgattattccctgtatttccattatgtccatcaaagttcctcacagcgtaattagcattatgtgtgtttctatcagttatccaagatatgctcactttagcaaacatatcacaagaaacagaaattctgagaatttacattcagcccttattcaccatattagttagcattactgctcatgtgcaaaagctactttaaattctccattattacaaccattttatgtttcacttagataaatatatggaggtaataaaatgcacatggtatcagattccacatgacaaattgaaggctgttaaattttatttttttcaaccaaactggttttaggttgtagaaatgcaaaaaagcacatttaagcatttatgctatctacttttatgattcacattagaaaatgatccaaataattcaaactcaaatttgtcagtgaaaacatagctttggactttaagaatatggtaactcgacatttaacctattgtgaaatggtcacagcaaagtcaaatttatcgtattcctggacagattttgtgactccaaggaaagtaacaaaggttctgtaaacctcacaaaagttattcatgtaattattatttgaattaacgtagtaaaccctatgccaatgaatgtaattgtaaatctacaagtttctatttaatgctcaaagtgcttggctaccagatagccaggtaaagacgaagaaattggctcccatttacctggaattttcatacgaactgtaattttgcttcttttacgtatcctgagtaatgtgaactatcagagactttgttcaagcaaaatccttcttgttgctatgaaatttagttaatattcagttcttcaagtttttaactttcaaatgggtaatttaatttccagcaatatattttccttggaatttttcttcctgccttacatgtcttttattttggctttcatcggcttagtaacattaacgaagtaaacataaaacaaaacaaacaaacgaaacagtaaagtaccagtgcattttccgaaaagaataaaaagtaacctaattagacatgaaactcatttctaacaaagatgcaacatacagagggcgatgaaattatctcatttgtcttactgtggaagactcaaaagtcataagcaacaaaaaagttttgacttagtgaaactactctgagaggtcatatttttattttacaggtgcatttgttttattatttttcatgtatttagtggggatttaggtggcacaggaagataatttattatgtagaaaacagaaagacttctactagatactgaacccattttcaagcatcgttaactaagcgatttgacctatattgtatggataacatgctcaacagaggagaaaataaatctcttttgatctttgcttttcaaataaaaacaaaatcataatattttaagtagcttagttaaaatgaaattaaatatttaattactaaggatgtttcagaaatcctatcttttttattagttgttttcacttttgtcctgttattaaaatattttatgtgtcatttcaaatctggttttaaaataattttctcatggagaacatagtttttaactatgttattcagtaactttattttaatactaaaacagtctcataattctatggcatagccggaatttggacttgcttaactatgctggttaatgggaaaggttgacttatagtaatactgcagagtaagtgtttaaagtgggtacatttatgtcatagaatcaattcagttttattcactttttcattgccaagaaacattacactaaacatgggttatagggttactcatttattcctaaacgtagtgaggtattactttaaaaaatacaccacaagtcaaatggaagggccctggtgggacctgattcaccagtgaatgaggagcgtctgaaagctgcagttcagggagagaaaagcactcccagagtagctgcagcagacagaatgttggcagggcacagggagcctggtcggcaaacgagccctaggtcagtgcagagggaaagggaggatacatttgtagtttgtttttcatcacttcttgaagtcccctgggaaattaaatgtcatctgtatgaactatggccacaggtatttgttaggaactaagtcctggcccagttgaataaaatcagcaatttatttttttttgattggcaactataaattcaccaataaagagttatgaaaaaggttgctcaaagtatgtaatagtggcatgaatgggaacttttactcaaatttgtaaaaattatggtatcaaatttaagtgtataaaaagttaggtatttgcttgtagaaacttgaaactacaattttgtggcaattactattcagatgaacacattagtggtggaagtgacccgaaattctacacatgttatagaaagaactccattttatttaaaccgctaaactcaggcttttttgttcacagaaatgtgtacttttttttggagtaagagaataatgttgacaacattattttataaggaagaaacacagctataatcactgcagtggagacatttaatattcacaccgaagaaggcaaacatttttcatatttctagacaacaggtagagatataaatttattcaaatgacagataaaaatgcttgtatctaatgctcattcataagacgtgcttgttaagtcccagggagacaatgaaataagctacagaaacttcagacagaatcatatgctactccatcttagtttataaaagaaaagatggatattctaaaaccgtaatttttaacctgaattacttttacaggactaaagaaactttttttatatgtaagtgtaagaaaaggatgcacccaaagatcaaatattttagtttttaatcatttcaacaattccctatggaaaaaaaaagtggttatttaagtattttgatgtataagaattttctatcataatactaattatttcttacctaaatgttctctagttctctatttgtattgtacattagaactaattacagagcaaaaatggaaaaagtatataagcagtagtgatcccacattgcagagtcatacaaaaacgtacacaaagtaagtccctaagagcagtgataaattcataattatttgaaacgtaaaatgaaacatgtaaaatgtttaaacaataaccaatcatgttaagaattgaatacatttcaataataattaaatctttactattattggctcacaacctgtaatcccagcactttgggaggcagaggtaggcggatcacgaggtcaggagtttgagagcagcctgaccaacatggtgaaaccctgtctctactaaaaatacaaaaattagcccagcgtggtggcgcgtgcctataatcccagctactcgggaggctgaggcaggagaatcgtctgaacccgggaggcggaggctgcagtgagctgagatcgtgccattgcacttcagcctgggcaacaagagcgaaactctgtctcaaaaacaaacaaaaaaaaccaaacaaataaaaaaaataaatgtttcataataataaaagtgtccctaagaaatttattagaaagatttaatgaaatgtatgatagtaataattgctgttgttacggatcatagcactgtctcaaatgagcttagaagtgatgcttccaacatttcatgggaagtagcaaaatctaactcaagaaaccctagcttttttcccaaatgtctctcattatatacaataatgaatgcagcatcacttgaacctttttttcctgagccataaggaaaatgttataggccagaaaggtcatcattagatgacacctttgttcatatttctgtttaagtgcttttatttccctcttctgaaataagccaactaaagaagacaatgtaacctagagctgactaatggaacctgagggaagtataccgtgggcatctaggaaagatttttttctctgatcaagacacatacaaagtaaaagctttgcccctcttttcctatttttgcatgttctcaaggaaaaataactggagatgaagcagccttcttgcccctatgaaggaaaagacaagggaaacccagagatgacccagattctggacagagctgaactggctcatcagcaaccttgaaatagtctctgaatttttactcgtgagagatacataaatagaatcattatttattttgcatattctgtcacttgcagccaaagcacactcaaaacataactcactatgttttataaaagaattttcacatatattattgagatattagaaaacctaaatgaatatttttcatacaatactatttttctaaatgtgaaacttggtagtggctgaaataaaggaggtaaagtagagaatttctgttcaccataattgcttgtttttatcttgtgccaagatatgcagatatcactgaatatgctttcctcatctgacttgctgtccccctaaattttctaagagtcattttcacacttacatgcatgaaataatttttttaaaaaacatgaaacactgcttttttggagtgctcccaatttgcatcagatattttatcactgtcaatgaagtctgtatagaccagtgagtggtaagttgacacttttcttcttcccccatcccacatccaataacttaaaaatacagtcaccttgtggtgtttgaattaataaaatataccctgatgtctgagattatctgcaaaaatatttaagatatggtatttctctataatataaataggaacatgtacagcctagtgaaaattgatagcaaaatgtaataaggtatgtgttcttgtatacacaaaaagctgtagtttatttaattgaattatattcataaataaaaagtgtccaacaaacaaaaattgttttcaataagttttaaaaaataagagggcactacaaatgcagatattagcatgtttccactcctgactttgggtatcaggggaggttagcataaccctctttctggtagaatagaaattcatttattcaacaatctgagcatttactataggtccagtactgttataagaattggaattatgtttatacaagaaaagaagagatctctacataacacttactttgtattagaaaaaatacattaaattatttaatataaattgagatcaagtgctataaagaagatacacaagatggtatgtgtgtatacaataaaagcaaattgagagccttctttaaaaagaaattgaccaggccttccaaaggttcttttgctgaaattccatagttaccaagcaatctggaagttaatttggctttctatggattttgatataattaataggatgtcttaaattatggaattgtgtatctgaatccctggaaaggaattatcatcacctcccctatatattaagtggtatataaattttatagtagataaagttgagcaagtgaataagagcctgaccatttctgggtgtcatgattcaattatgtttccccatttgccaagatgagagtgagactctggactatggatgatcacataatcaaggtagtgcccactggaaaacccgaataaccttcctaggcagcagaaacaactagctggattatactagttgactatgttgagctagacagcaaatagcagaagaattgcttgttcccccatcctctttctgccattcaccagttgactttcttggctctctccctctctccccctccctccctctctctctttctccaccaaccccccatcctatttagtggtctttattgaatccattaagtcaatcaattgtttaagcacaggtgtgagaatataagaatataaagttcatttctttctcttgcctgattgccctggccagaacttccaacactatgttgaataggagtggtgagagaaggcatccctgtcttgtgctggttttcaaagggaatgcttccagtttttgctcattcagtatgatattggctgtggatgtgtcataaattgctcctactattttgagatatgttccatcaatacctagtttattgagagtttttagcatgaagggctgttgaattttgttaaaggccttttctgcatctactgagataatcatgtggtttttgtcgttggttctgtttatgtgatggattaatttattgatttgtgtatgttgaaccagccttgcatcccagggatgaagccaacttgatcatggtggataagctttttgatgtgctgctggatttggtttgccagtattttattgaggacttttgcatcgatcttcatcagggatattggtctaaaattctttttttttgttgtgtctctgccaggcttcggtatcaggatgatgctggcctcataaaatgagttagggaagactccctctttctctgttgattggaatagtttcagaaggaatggtaccagctcctcctcgtacctctggtagaattcggctgtgaatccagctggtcctggactttttttggttggtaggctattaattactgcctcaatttcagaacttgctatttgtctattcacggatttgacttattcctggtttagtcttgggagggtgcatgtgtccaggaatttatccatttcttctagattttctagtttatttgcatagaggtatttatagtattctctgatggtagtttgtatttctgtgggatcagtggtgatatcctctttatcattttttattgcatctatttgattctttcctcttttcttctttattagtctttctagcggtctatcaattttgttgatcttttcaaaatccagttcctggattcatttattttttgaggggttttttgactctctatctccttcagttctgccctgatcttagttgtttcttgccttctgttagctttccaatttgtttgctcttgcttctctagttctttttttttttttttttttttttttttgagacggagtctcgctctattgcccaggctggagtgcagtggcacgatctcggctcactgcaagctccgccttccgggtttatgccattctcttgcctcagcctcccgagtagctgggactacaggtgcctgcaaccacgcccagctaattttttgtatttttagtagagatgggtttcattgtgttagccaggatggtctcaatctcctgacctcgtgatcagcccacctcagcctcccaaagtgctgggattacaggcgtgagccaccacgcccgggcttgcttctctagttcttttaattatgatgttagggtgtggattttagatctttcctgctttctcttgtgggaatttagtgctataaatttccgtctacacactgctttaaatgtgtcccagagattctggtatgttgtgtctttgttctcattggtttcaaagaacatctttatttctgccttcattttattatttacccagtagccattcaggagcaggttgttcagtttccctgtagttgtgcagttttgagtgagtttcttaatcctgagttctaatttcattgcactgtggtctgaaagacagtttgttatttctgttcttttacatttgctgaggagtgctttacttccaactatgtggtcaattttggaataagtgcaatatggtgctgagaagaatgtatattctgttgatttggggtgcagagttctgtggatgtctattaggtctgcttggtgcagaactgagttcatgtcctggatatccttgttaaccttctgtctcactgatctgtctaatattgacagtggggtgttaatgtctcccattattattgtgtgggagtctaagtccctttgtgggtctctaaggacttgctttatgaatctgggtgctcctgtattgggtgcatatatatttaggatagttagctcttcttgttgaattgatccctttaccattacgtaatggccttctttgtctcttttgatctttgttggtttaaagtctgttttatcagagactaggattgcaacccctgctttactttgctttccatttgcttggtagatcttcctccatccctttattttgagcctatgtatatctttgcacgtgagatgggtctcctgaatacagcataccaatgggtcttgactctttatccgattttccagtctgtgtcttttaattggggcatttaaaccatttacatttaaggttaatattgttatgtgtgaatttgatcctgtcattatgatgttagctggttattttgcccgttagttgatgcagtttcttcatagcattgatggtctttataatttgacatgtttttgcagtggctgataccggttgttcctttccgtgtttagtgcttccttcaggaactcttgtaaggcaggcttggtggtggcaaaatctctcagcatttgcttgtgtgtaaaggattttatttctccttcacttatgaagcttagtttggctggatatgaaattctgggttgaaaattcttttccttaagaatattgaatattggcccctactctggcttgtagagtttctgcagagagatctgctgttagtctgatgggcttccctttgtgggtaacccgacctttctctctggctgccctttacattttttccttcatttcaaccttggtgaatctgacaattatgtgtcttggggttgctcttctcaaggagtatctttgtggtggtctctgtatttcctgaatttgaatgttggcctgccttgctagtttggggaacttctcctggataatatcctgaagaatgttttccaacttggtttcattctccccgtcactttcaggtacaccagtcaaatgtagatttggtcttttcacatagtcccatatttcttggaggctttgttcatttctttttactccttttttgtctaaacttcctgctttatttcagtaatttgatcttcaatcaccgataccctttcttccacttgatcgaatcggctattgaagcttgtgcatgcctcacgtagttctcgtgccatggttttcagctccatcaggtcatttaaagtcttctctgcattgcttattctagttagccatattcaataaggaaaataagaagtcaaattttccctgtttgcggatgacatgattgtatatttagaaaaccccatcgtctcagcccaaaatcttcttaagctgataagcaacttcagcaaagtctcatgatacaaaatcaatgcacaaaaatcacaagcattcctatacaccaataacagacaaacagagccaaatcatgagtgaactcccattaacaattgctacaaagagaataaaatgcctaggaatccaacttacaagggatgggaaggacctcttcaaggagaactacaaaccgctgttcaatgaaataaaagaggtcacaaacaaatggaagaacattccatgctcatggataagaagaatcgtgaaaatgaccacactgcccaaggtaatttatagattcaatgccatccccatcaagctaccaatgactttcttcacagaattggaaaaaaactaccttaaagttcatatgggaccaaaaaagagcctgccttgcaaagacaatccatcctaagcaaaaagaacaaagctggaagcatcaggctacctgacttcaaactatactacaaggccacagtaaccaaaacagcatggtactggtaccaaaacagatatatatatatatatgtatatagaacaacggaacagaacagaggcctgagaaataatgccacacatctacaaccaactgatctttgacaaacctgacaaaaacaagcaatggtgaaaggattccttatttaataaacggcgctgggaaaactggctagccatatggagaaagcggaaactggatcccttccttacaccttatacaaaaattaattcaagatggattaaagacttaaatgttagacctgaaaccataaaaaccctagaagaaaacctaggcaataccattctggacataggcatgggcaaggacttcatgactaaaccaccaaagcaatggcaacaaaagccaaaattgaaagtgggatctaattaaactaaagagcttctgcacagcaaaagaaactaccatcagagtgaacaggcaacctacagaatgggagaaaagttttgcaatctacccatctgacaaagggctaatattcagaatctacaaagaacttaaagaaattttcaagataaaaagcaaacaaccccatcaaaaagtgggcaaaggatatgaacagacacttctaaaaagaagacatttatacagccaacagacacatgaaaaaatgctcatcactggtcatcagagaaatgcaaatcaaaaccacaatgagataccatctcacactgttagaatagtgatcattaaaaagtcaggaaacaacagatgctggagaggacgtggagaaacaggaatgcttttacactggtggtgggagtgtaaattagttcaactcttgtggaagacagtgtggcaattcctcaaggatctagcactagaaataccgtttgatgcagcgatcccattactagatatatacccaaaggattataaatcatgctacgataaagacacatgcacaggtatgtttattgcggcactattcacaatacaaagacttggaaccaacccaaatgtccttcagtgatagactggattaagaaaatgtggcacatatacaccatggaatactatacagccataaaaaaggatgagttcatgtcctttgcagggtcatggatgaagctggaaaccatcattctcagtaaactatcacaaggacagaaaaccaaacaccacatgttctcactcacaggtgggaattgaacaatgagaacacttggacacagggagaggaatatcacacactggggcctgtcgtggggttgggggctgggggagagatagctttaggagaaataccgaatgtaagtgacgagttaatgggtgcagcaagctaacatggcacatgtatacctatgtaatacgttgtgcacatgtaccctagaacttaaagtatatatatatatatataaagaatataaagctcattagttttaatagagttcaacatatatttaaggagcacctactaagtttcagggaagttaatttaatgtaggtgttgcagtagacttcaaagacagctcagatttcccatcctgaatgatgggcaactttttacaactagaatagacattaattggtaactttgggcatctaacaaatatctgaagtggactcagattattaaactagataaccctgtttaataatatttgcttggcatattcaaatatgaatgacaccccaaatcactaggcaaagcaatctcaaaatgcaacatagggagttcaacatgtgagaaaaaaggagtatacatatattttggaaaaacacatttgctttcatcactgaaaggccagttaatacttttcaattatcttcagtggtatagaagaattttaaatcagtaattatgtaacattagaacatattacatatgtttttcctaaccaatttttagatgctatattttgtaaaacttgcaaaaatcgagaaaaaaattacacctctctagttccttcacacattatttcccttacctatattctgtgaagactaccacagcttcacaacttaaaaaaaatacttctaataaaacttgtttctattctctgaaaattagttaagtgttttttaccttttgtttttcttcacacatcagcagtctttttccaattctgtaacaagaagcataactttgcattttgaaaatgccaatcaccttaaaacttctctcatgctagaaacagaaaaaacagaacagttctcctttttctaatgctatggaagagtggttttacatacacattaattatcttgtataaaaatgataagaaataagaatcgggctacttgaattatattgaaaatattgatatttttaatcaaattgaataattctatagtttaacacataaatcagtaaatcaattattatttagattgcatttttgtcatggatttacatcttgagggactcagatgactccctgaaatatcatgatctgtttttgttgccagtcatgatgctataatttatataaaatattcaagctgacttgtacataaactaattgacagatgtaggaattgtcatttggggattaatcattttgccagtacattcaagtacatgttagataattctaagatgtacgtaaaggaaacatcccctctctttttctctccaatattatctactatttttaaaatgtgcctacctttataccattttctcctatttaaaattatgtccatataaacagataataaatggagacgaattccaattgggaatatttttacaagataaaacttgtttcaatttgcattaccatcaacaaatagccaaatcacccttttttcctatattaaaatactagcaacatgtagcattcatttaccagatttaaattttaaaaagacctgtatttttacatgagtcagaacaaagtgagactcttgtccagagaaatagtactgcagtctgaatctagatacagtattgaaatcaaattctgaatattattggatatttacggtcactcatttaggttagtgactcatttagatacgctttctatactgaacagattacagagattagggaaaatatattactgtcgttttgtaccaatcaataagaaagcaaaatctcctggaggctccgtttagtgggtgatcaaatgttcataaaataaatcataaagactgttcttacctataagttttagtgtccttacattatggcagttgattatcaagaattcattgaacaacatatgcgagcaggacctctatttcttatttagccatttctctaaaaatttggaatttaatcatttgagacagatgagaacaaatgacaacttcccaatgaacataaaagggaagaccacagaaaataatgcctattatttttgctcattaattcattcattcaacaagtatttaatgaatacctgttatgcatgaagcactattctagttgccagaaattcatcaataattgaaatatataaagtttctgccctcatattgcttataatttttatttatctaaatgtgagattagattgcttatataacttagaattaatataccactctctccacctcttctcattcttagagtgtatatacaataaaaacccaaaaaaaatgcaacaaaacatggaacagttaatctagtcaatttctggactaagttttataattaaatgacaattacattgatattattatattattttgtattgtattacatgcatattaatgtattacaatgtactgtttaatacagtggtagactgtttaacgggcacgagttcttcccattcctgtaagcttccttctatgcagtgagactgtgctgctgcttctcccttctagacatgaatctctttctaggccctcttgaatcaggaccaaccttgtgacttattttgactcatggaacattacagaagtgatgcataagctctggatcctaggcttcatggggttcataaatgccaccttccccctcttggagcattgtcatgagacctccatgttaataagcccaggatggaaaaccactaggagagggagacacagtatcctggctgggcttcgcctccagctcatccaccagattactgttgctaaaaaactgccagactaattgacagaaatatgagaaacagtaacttattgctgattaaagccactaagtgttagtctggtgtgctaagaacaaatagataaaagacacataaacgtatataccagacactgtgctaaataccacctatgcaaaattcagcaaaagctttcataatctttgcctatagtctctatcatattgtatagcagaaaagacacgaactgttcaagtattcacacaaatattgtgaaattgctatggtagcaaataaaagaaagaaaagtaaaaatattttatgagagattgtgattcctagagggaagcacatttctggtacaggtgactttaagtgcaaagtccctgtcggagaaagcagcagataccagaaaccaatagaaagaaggcatttgagcctgcgatagagggttagcttatgaagagataagattgtgctagtgggttacggttaggtatttagctgtgtagcatatttgatatatggaggatacagttagtagcagctcttatattaaaaaaagaaaaagaaaatttgggtttctttgtgtatgtgcattttatctttttgagcaattatttgctacaagagcattcaggaaatagaagcaaaacatgctccaaaatatcagcagaggcagtgcttaaatttcattactaaggcttctttcatatctacactcttagagtggaaactaagtaacctaaataaatctaataatgaaaatgaattagagagaaatgagctttggtaattgtgactgtctttcaattgaacaattagactttaacatagaagaaaagaaatatgataggtcaattaaacactgtatataaccaggcaaatcaacaagtttctatagtacaggtcagctcggtactgtgtggccaccgactttattgactcagtacaatacaaagaatatgcaaaattttgaaagtgacgaaatttttctgacactactattattctcataaatgtgccaagtgaaaaaataacaattatttccaataaaaaaaacaactaatgcatagttctgttaaaaacaagatttgctttcctctaagctccaaaaatacagacatagcaatgaacaaccctgaaattcccttcctttgcctgcaagactcacaataaaattattgcccagaagtgctggcaagtgaccaaaatgaggaggcatttttggggattactggcttaaacaataactccttcaaacagggaaagcaaaggaaaaaaaaagaaagaaggaagaaaggaaggaaggaaggaaggaacgaaggaagggagggaaaagaagagaaaatctgtattctttttgttacattcaatcgtcacaatagagtaattttctctcatcatccataaatctatcatcttgctaatacttaggtaaaatcattttcattgtagcacataatatatattaataagctactagactttttctaatattctactttcctttccactttagatttaacaatcatataataatcactgttctgcttgcaaatgaatcatatgcaatagtaaggaaatagctaagagggagatgccgcccatgagagatttaatcataggaaatggctgactttttatttccaataaccatctgcactcatggtaaatcaggtgctaatgaagctcaggcccagactgcacaggagcataaatctcaagaaccaaaagtcgtggagcaacagacctcagaaaaacagaattttctaaggaaatgcaccaaaattatcatatagaaggtcaccatctgcaaacgtgtcacataagtgaatatatttggtaggcctaataccacattatgacactggctgtaaacatcaaatctctacttttcttttgaaacttaccactttcaaatattatgatcacttatggttttttacgtcctcctagatagtcaacatcttgggggtaggggctcttcattccagtttaatttttatcgcctccacagtggtttgtccttataagtacttgatatttggagaatgaataatgagaataaatttattaattgtggaatcctacttttagggcagaaaagttttgcagaatttttttctccagtggaggaggaagccaagtcttaatgcagtagaatttgtaccagaatttgtcttctgagagtcaataaatgtacctatatcttctaagagtttttgtctctcagtaattataatccttaacttcacgtcttgctcactcattgttggagtgatatatgtaaaagaatcagaacagagttagaaggagaagggacagcccagaaccgacagtataaattcaaatcctgtcacaaaatgatgcaagtctaaggacttgacaaaataatttcctttttctatacgctagtataatacatagatcatatctatctcgtaattattaatcattatatttttagccactggcaaatcatatcaaagcaaagacctggtaaagaagaggtatgatatctctattaactcttgaaccaacctaagttctataccatgccacacttcacttagcctcattattctctacttgtttccatgaatgcagaaatcttagtcaagtgttaataagccttttattttcatttgttttctgtaaaaaaatataattagcacaaaaaagaaatctggttgctagagccaattagtctgtaaatagctttataaattgtattaggtaaatattaatacttagagcagcagtttttaattttctgtggatcacagatacttgaagaatttgatgacaggtgtgaaccgtctgccctgatataaacacatgatatatatgtgcagaaatatggctaaaatttcaggagttttacagtcttgaaatccattaatagtacccaggactgtgtaaatccaggtcagaatttctgactatagttgtatttgcaaactgagaaattaacaaagatcttaggtggaattcatcatacataacagactttagatgtagactgttttttatttcttatccaaaaagttaatcaataccagagtttatcatgctagattacaattttaaactgtgttttcatatatccacatgaaatccacataaaacaaaataatgaatcttttcatttaaaactgagaagacagacaaattttaccattcagtgtatatttctggacatgatatatagagttgtattcaggtaatgttatgcagtactaatcagaattcacaaaattagagttgcttacatctgatgagtgggttttaaccctcagaagctagttaatgcatactcctgccccaggcaaactgacattgctgtatcctgaatgtgttggcatttgacctatgggaagctaacatgctgttagtgagaggaacatgtgtatgcgcatcctacaacacattactttcacatttactgctttcttctctttcatttatcttaatacatgacaaaaaaattgacaaatctttgtttcgtaatgcaaattattgcacctgaagccaaatccaatcgattctcaattcaacacataagatgaactgagaagggattttatggcatctaatattataattaggcatgtttttaaagaaaaattaatattaaatatagatgctagtaaaagctaagtatcagatttgagcttcaattttcttcaaagattttctctgcaaaggaacatacgttcttaattatatactttattgtgtcaaaattgtagaaaattaattaataacaaaatacgaagaaacctataacttgcgttatagcctgtagtgtaaggacaatggtctccaatttacatggctcaacttgtgattttcatagtctacaatggtgtgaaagcagtgcacattcaacaaacactacacttcaggttttgaattttgatcctttcccaggctagagacatgcggtgcaatactctcttgcgatgccaggcagtagcagtgaacctcagctcccagccacgctatcttgagggtaaacaaatgatagtctatagtgtactgtgtttccagataatcttgcccaactgtaggctaatgtaagtgttctgagcatgtttaaggcaggctaggtgatatggtttggctgtgtcctcacccaaatctcatcttgaattgtagctcccgtaattcccatgtgtggtgagagggatccagtgacaggcaattgaatcatgagggcgggttttttcccatgctgttctcctgttaatgaataagtctcacgagatctgatggtttcataaaggggagatcccctgcacacactcttgcctgatgccatgtaagatgttcctttgctcttccttcactttccgccacggtcgtgaggcctccccagccacatggaactgtgagtccattaaacctctttcctttgtaaattacccagtctcaggtatgtctttattagcagtatgagaatggactaatacactaggctaagctacgatgcttatatgatgttaggtatattatattagtctgttttcacactgctcttaagaaatacccaagactgggtaatttataaaggaaagaggtttaatggactcacagttccacatggcttggaagaaacttataatcatggtggaaaggtgaaagggaagcaagcacctttgtcacagggtggcaggagagacagaacaggggaaactgccaaacactgttaaaacttcagatctcgtgaggactcactatcaccagaacagcatgggagaaaccaccagcatgatccattcaccgcccaccaggttcctacttgatacgtggggattatggggattacaatttgagatgagatttgggtggggacacagagcaaaaccatatcatatattaaatgcatttttgacatgatattttctttttttaattttaatttttaaatagaattcattttatttggagcagttctaggttcacagcaaaattgtgcagaacatatatagagttcccatatactccctacccccacatatgcacagtccccccaccatcaaaaccttataccagagtggtacgtttattataattgatggacctacactgacacataattatcaccccaaatccagagttttcattagagttcactcttggtgttatacattctgtgggttttgataactgtataatgacaggtattcacctttatagtatcacacagaataatttcactgctttaaaaatcctctgtgttccaccaactcatccagatttttttagggtgattttatgaatcaaatgagatataggtaaagtatttagcactaggcgtggcacacagaaagtgcccactaacaatagccaacattagcattaatcatcagcttgagttgactggtaagagctaaaagtaaatggttgcaacagaaatgaagaaacagatgcaaacggtattttctctgtgtgtgtgtgtgtgtgtgtgtgtatgaaaaaggtagtgtatgtaaatacacaaacagatataaagaaaaagaggtaacacagaaaacactacgacaaagttactgaatacatgtgggagagagagaaaaaaagctaagtgcaaagaatcaagccttgtatgttagtttttactcaatgagatgcaacccaaatgtgattagatacgcaagataatttattagggaaaacgcttgtgagggaaaagtaggtaggcacaggaagagcccgggagagccctcagaccatcatgcagatccgatttctgtgaaagagaaagagaaagaagttctggacagtggtgctgtgttttgttgttgtttttgtttttcaatttctgggatacatgtgcagaaggtgcaggtttgttacataggtatacatgtgccatggtggtttgctgcactcatcaaccccccatctacatttggtatttctcctaatgctatccctcccctagcaccccacccccgacagaccccagtgtgtgatgtttccctccctgtgtccatgtattctcattgtttaactcccaattatgagtgagaacatgcggtgtttgattttctgttcctgtgttagttttctgagaatgatgatttccagcttcatccatgtccctgcaaaggacataaactcatcctttttcgtggctgcatagtattccatggtgtatatgggccatattttctttatccagtctatcattgatgggcatttgggttggtttcaagtctttgctattgtgaacagtgctgcaataaacatatgtgtgcatgtgtgtttatagtagaatgatttataatcctttgagtatatacctagtagtgggattactgggtcaaatggtatttctggttctagatcgttgaggaattgccacattgtcttccacagtggttgaactaatttacactcccaccaatattgtaaaagtgttcctatttctccacatcctctccagcatctgttgcttcctgactatttaatgatcgccattctaactggcatgagatggtatcccattgtggttttgatttgcatttctgtaatgaccagtgatgattatctttttttatatgtttgttggccacataaatgtcctcttttgagaagtgtctgttcatatccttcatccactttttgatgtggttgtttgtttttttctagtaaattcgtttaagttccttgtagattctggatatcagccatttgtcagatggatagactgcagaaattttatcccattctgtaaaattatgtaaatgcacacatatctatctgaaaagaactatctgattatagtttcttttgctgtgcagaagctgtttcatttcattagatcccatttgtcaattttggcttctgttgccattgcttttggtgttttagtcgtgaaggctttgtccatgcctatgttctgaatggtattgcctaggttttcttctagggcttttatggttttaggtcttatgtttaagtctttaatccatcttgagttaatttttgtataaggtgtaaggaaggggtccagtttcagttttctgcatatgaccagccagctttcccaacaccatatattaaatagggaatcctttccccattccttgtttttgtcaggtttgtcaaagatcagatggttgtagatgtgtggcattatttccgaggcctctgttgtgttccattggtctatatatgctgttttggttactgtagccttgtagtatagtttgaagtcaggtagtgtgatgcctctagctttgttatttttgcttagaattgtctgggctataggggctctttttggttccatatgaaatttaaagtgtttttttctaattctgtgaagaaagtcagcggtagcttgatggagataacactgaatctataaattactttgggcagtatggccattttcatgatattgattcttcctatccgtgagcatggaatgtttttccatttgtttgtgtcttctcttattttcttgagcagtagtttgtaattatccttgaagaggtccttcacttcccttgtaagtgagttttaaaagataatttcaacttttattttagattcagggagggcacgtggatgtctgttacatgggtatattgcatgaagctgaagtttgagataaaaatgatcctgtcacccaggtagtgagcatagtactcaatagtttttcaactcttgtccctgatcttctctccatgttctagtagtctccaatgtctattgttgccatgtttgtccatgggtacccaatgtttagctcttacttataagtgagaacatgtggtatttggttttctgttcctcagttaatttagttaggacaatgacctccagctacatatatattgctgcaaatgacatgatttcattctttttatcactgcatagtattccttggcatatatatatataacacattttcttgatccaatccaccacagatgggcacctaggttgattccatgtcttggctagtgtgaatagtgctacaacgaacatatgagtgcaggtgtctttttggtagaatcatttattttcttttggatatatacccagtaatgagattgctgggttgaatggtattctgttttaagttctttgagaaatctccaagctgctttccacagtggatgaactaatttacattcccaccagcagtgtataagcaagcattcccttttctctgcagcctcaccagcatctgttgctttttgactttttaattatagccattctgattggtgtgaaatagtatctcactgtggttttgatttgcatttctctgatgattagtgatgttgagtaatttttcatgtttgttggcagcttatatggtttcttttgagaagtgtttgttcatgtcttttgcttgttaaatagttttgttttttacttgttaaattgttttgtttccttatgtgttcaaaatattagacctttgtcagatgcatagtttgtaaatattttctcccatcctgtatgttgtctatttactcccatcctgtaggttgatagtttcttttgctaggcagaagctctttagtttaattaggtcccacttgataatttttgcttttgttgccatcacctttgaggactgagtcataaattctttcccaaggccgatgtttcctagatttccttctaggattcttatagtttgaaattttacattgacattacttagcaatgagggagagcacaattccagcacctactgctgaggtattttccacagttctggctgtggaggctcctacttcactccagagcaggcatgccaatctctggcatgagactaaaatgcctccatggccatgctgctgggtctccaaagaatgactgactttgtatgcacctggattaaaaatggcctcctgctcttggtcccaagtctgggaaaatgtctgcagcttttccaagtgcctttctctttcagcgcctccaagcctctctccaaggcagttccagtgctcaggagaaacaaaatgctcttccttggtctaggttgctcagatcttcagtggaaatgtgagtcacagagggagactctctgtccctctcacctacccgggcttcaatcacgtttatcagccagatgctaccacgggagctgtctgccaacaaccccgggaactggggtgtccttcatggttctggttgattccttttttccttcttgaattaaagctcacatagttgatctttatgtactatcctgctacctccaagtggctgaggcaagctacctctaatctgccatcttgggagtgcgtagtggggggaactatatttttaatttatggtgggtttatggtgaacttaacctcatcataagttgaggagcacatgtacatcacttgtgacaacaagtagctgacaagtgaaagaaacacatggcaaagtaccaccttgataaatatctttacatcctttgacttggctgctacttgctttttgatatctttatcattatgagagatgtgtataacagaaagaattacagatgatgatttcttaaagtgattagttactaaatataaattatatttatatttattaatctatactcttatctactcaccttgttttaggggctcatatactttcctggaaaactatatataaatagtataaatggctattttttcaaacattttagctctagaaggatttattcaagtttatccattgaatctgcccatccatatctgttttacttctttagtcctactaattatccagtttattattaccttgattattgaatcaatgcaatctgacaaatatttccattttccccttctgggagcaaggtgggagtatatctcctggccattttatggaggggataaggccacaactctacgtttgatccataaggtgttaggaaacatgatgtgggtaatttcaagtctggaatagttaattgcccacatgagattcactggaattctctttccttcttgcacattgaatgacaaaattcgagttaacggccactgtgtcatcttggacccttgaataaatacagaaacagagctctgcaacccctgcaaataatttggaacatgacagagaataattctttgtggatttaagtcattgttattttggggctgtttgttaccttggtgtaacgcttcctaacatgtttaaaacattcactaatgtgtcttttcaaatacagttgttccacttccaaattattcttcagaaaggaaccacatttttgtttgtttctatttgtgaaacagtaactgttgtattgcataaaaatgacagaaagatgccatcataaagtaaataaaattttaaaatttgtcttacatttattccgtacagtgagttctttgccaaaaataaaatctgagttcagtaattaaaatgctagtctcatcaaagctctgaatctaatttaaagttgagattacttccctgccttagctattggctgatgcaagaataaagcccatgaaaaagaaagggaagggacaacttcttcactcatttctcacctaggacttcttttctcctgctctatcttggctatccatattctctgactcctccaattcagaacaagcagtagaagaggtaaggagagaagggatagttcttccttgagtggtaccatggtagatgactcccactagtattttctactttttccatattttaaaattcattttctgatgggcccgtgctttcattttttcatttttcattttttcatttttctgagatttctccctatcctttacacccaaccagtccgctgacatagtcaagtgcatgttttgagtttatccttatcccctaggcatctgccaatttaattctcatttcctctgctgaggtccccttgcccttcctgaaagatctaagacagtcacagagcagctcatgctctcctcttctcttctcctcttccaatctctctctctagcccacatgctgaatttcaccctggcaaactcagggtccacaacacttcccgaactgcaatcccctactctactatcaatagctccccaacctttacttgctcatatgtgactcatacttgatgacctacaaagcagtggatactaagacctccaagcgagacattaaacctcctcttttgactttggtttaggaggggttaccccactgggagcgatgaagtggacctgacagcatatctccctccagagacacctcttaaaaacctttcccctctccccatgggcgctcttccatatttttggtttgatagagtgctttaacagtcctcaaactggttctgcattagcatctctctttgcaatgtgcctcagctgaaacttccattagaatcatttgcaaacagaaatcaagtcttgccaactccacctgtctcctataccctcaccaccagcccccgcacacattctgataaaaagccttcagagacttcatttgaatttaggattaaaatctaattaaatcctacatgatctaaattctgcctgtcttaacaaccctttggtatgataataagagctagtcgcatgagtctcctgtttctcttatgaaagaactctcttgccgtacagcagggtttctcaatctcaatactatttacattgattgggcagatacctctttgttataaggcactgtcctgtgcattgtaggatgtttagcagtatccctggcctctatcaactatatgtgattactacccccaaccttgtcgtgacaatcaaaaatgcctccagatattgccgaatgtctcctgaggagggcacagattgtccgtctgttgccttagaaacttcatatgtgatattccctctgtctcaaagtctatcttgctcattctctacctaaaaatttcctactcatctttatccctgaatgagtttccaaaactaagtcagttcttctggtgataaagcatctcaacattacttttcctttgtagctacacaggtggtttacaacctccctctctccgcctcccacagagatacttttggagcattggtttatggcatatgccacatacccaggccactacaacaggatgaggcctttataatgcaactgaaggctgaggaaacacccagacctcgttggagaagcttccaggcagtgtaacagttttaattttctcttttctcttttagatatgtcattggctgaatcaaaagcctttgctgatgtttcttttgtgagtagaatggatgaaactgagtgagagataataataagagctaagaggtaatgaacatgtactatgtgctttacataaaataatacattcagtcctcacaatgaattagcactagctagcttcatctgacaaaagacaaaatcacaattcagagagaataaagtattcatttcagatcaggtattggcttcatagatctgccttgattcttcataactgctgttccctctgctgggaagtttcttccccctattaaccacatgcctttcctcctcaccttccaggtctctcttcgaatgtcaccttctcaggtaggatttcttgagtgctctatttaaaattataaatagatgcctcacgctggcatttcctgctttgctttcttcgatagcacttcctgccatctgaaatgctgctgttttactttgattgcctctctcctctgaaagactggaagttcttcgagggcagtgattttcttgcaaggctaaatcctcagtacctgaaacatgcttcacacttggtgagttcaccataaacatttgttgaataaaggatgagtaaatttcaatcctctacatgaaggtcttagtatttgaactaggcatacagtcttggggtgaaatgttggttcaaacttgtttcaagaatgctttcattttagttttctagaaacaagaatactgaccatgcaaattgtatacaggtaatccagggtacatacagataatccagggtaaaagagactagaagtgactctctcctgcctccatagttaatttctagagaggaaggccctgaggcagaaagcaggtagacaaccagcttgcacttgtgttggtggcctgtcagccagggttgagtttgacctggcccgaggcacccacagcagctgtggccaaaatcagactgggccaagagaatttttcatggttcaccaagatcacctgctgtgataatctaccctggtaacattttatatttctgaaaattcgccttaatttatataagtaacctaaatccatcatgctgtttttaaaatacattttctatccttcttgtctcagaaattatagaaacagatgtatactctcatcacaaaaataaccttacatcagatgaaaattttactaggtcatgcccccaaaattaacaaagttactaactatgcaatttttcattttatattaaatcatacgaataattttcctatctccctaaacccattaaaagtccagtactttatagcagagatgacattgaatgattcacaaattaatgaaaccattgttacagtgctttaaattttaggaactagaattataaaaaccttataaaaccatgactccccccagccccttcagtagcacatgtgttgcctgtttgaatactaaacgtgtgagaagccattttatgaacactttgcactaaataacttttctaggatgaataagggtgcctagatatttccacagaggcagattagtgacattcaaattgtaatcttgttcctcgaagcagaagtaagcttttctataaaggacccaacttgaaagggaaattttgctgacagtgagagtttgagtttcagtccctaaagccaggggcaagtttttcaagagacccatactgcaaggccacattgtggactatgtaacttcagctaatttcttggaaatgtgagtataattgtctctgcattttacatatttaagtgatatgatgtgacagcatctgggttataggatggggggttctgaaccatgagaacccctaaatttgagaccgttttgtgtcaggatattctgagctctgtctcaagggattttttcctctgacccacagtgcagaattgtttcctgattaggctgtttcaaagctaaaagggacaaaaatagggctgagcagccagccagccaaatgtaccttttataaatctatctctaaacttgtagagaactctaacaatggtttcattaatttaacaatcactcaatgtcatatctattataatgtactaagctcttaagagagaaagaaaaaagaaaattgttttattcccgtgatttaatttaaaatgaaaaattgcattgatggtagtcttgttaaactttttttgatttgctttatgatttaaagtatggactttcttttcttgagggccatgcttctgtcttctattttaaaacttctaaataatcattcttatcttctaggacaggtatgaaaacacttgataagtgattttaataaaaacatatactgtgtacttgtaacttggtaacaaacgcagccaaaaaggttgcatattgaaacagtgtatatccaaaccgtatacctagcttggcccccaagatgcctgtgggaacaatgaaataccctgactgatccccattgctcaccatgtagcttactttggctagatcactttcctgggtccctgggatcttcctgggattcttgccaaatccagtttccagttcccagggtaggttatactccttttgcacagttcttcacagccgtggtttgggattgtcccatcaaagactctttgtggacaatataatactctccctttctcagagagctcctttgataatgtcctaaaacttctgtctttctaatccacaaaggatttttcctaggttcagaattttctggatctgctagcctactaaaatccccctgtgattctggagtatagtagaaacatcagagttacttagtcagacattcttgaaatagattagactttaccaggggtgactgagccaaaattgttacatttcgtaaccatgaaaatgaaagacttccactgaaagcaggacatattggaagacaaatgcatttgattctaggctcatggggtcccttttttctgctactaattttgaagttgacctctttacgaacattgattctcttttgagatccagtcatttcaaggggaagagaagatgatattctaatccatttgcccacataaacagagtcaaaaagcacgataatattaatttcttggttttgaatattcatttttagtttgaaaagtgtatcatgattatgtaagatgctaactttagggaaaagtagataaaatggattcagtttatctatggaacatctttgtaaactttctgtaaatctaaagttattccaaaataaaaaatttatttaaaaaatttgtggatgatagaaggggacctcagtgattcaaaaagtcacttaaatcccagagaatgatacaatcaatatttgtagaggatagaaaatgatccaacacctctcctagctacattgataattaatttgcattagagactgacatcaaatgcctcagcctatatatgtttctgtgtaaaacactcagaattagaaggaggtctgcagcaggacatatactgaaaacttaaaattcaaaatgtgcagaaagtcccttattttaaatcaacagtgtacttaaaaatatttacctactcattttcttcaggcttcctttatactagatgattatgcaaatagaatttaaaagggaaaaaacaatctatgtttttgctcttgtccattataaatatttacgcattttggtgaagcaggaaagtggttgttagcaaaactgatttggatggataggaggaaattttgattaaaaataaagtaaagcataatgagattggggaaaatgtcatctgaggaaaaaaatctcattttttttttcagtttttaccaacatccttttttgagagtactgcagacaattatgtcacatacacatttttaagactttttcccattacactagacttcttcattttctaaatttgttatttgtaaatggaattcatttctctggcttcattttcttgtctcattatgctgaattcagcgagtgtttgttttgaaaccctctttaaataagagctcccatttcttttcatcatctgtaagttcttaaccatgtacaaaatcatttttgttgaaccaactttccagttcacgcaccactgctactagaaattctaggatgaaatccatcattaggcgactcaaagaaattatggagtttttttttttttttttttccactttctgtttcttgctagttattgagaaatttggtgattcagagaataaggaaagagagtggggagcgctctgactagtgtctagtaaccccttagtggatgacttcagctggctttaagcaattgctttttttattttattttttattgttttttgagatggagtcttactctgcggcccaggctggagtgcagtggcacgatctcggctcactgcaacctccgcctcccaggttcaagcaattctcctctctcagcctcctgagtagctgggattacaggcacgtgccaccacgccagctaattttttgtatttttagtagtgacggggtttcaccgtgttagcgaggatggtcttgatctcctgacctcgtgatctgcccgcctcggcctcccaaagtgttgggattacaggcgtgagcgagcgggcccggccttaagcagttgcttttaatacaataattcctctcccaaagtgttgggattacaggcgtgagcgagcgggcccggccttaagcagttgcttttaatacaataattcctcttctaaattcactgtgaggctgcagtcaggaattggttttggtaattgtaaagtccagctgaagtgctggtggaaactctatactaataagtgcttggcaattatagttatgtccccattgaagtgatccaatacatgttgcgtacttcgctatatccaaaactggcagaaatttgtcttcagtgattaaaacagttatcactgcccagccctaaaagatttataaacactgtatacatttagaaaccccttttcaatctaaaaataaatatataaataaataaataataaaaataaaaataaacaatggcagcatgtttttaattatgcctaattgaaaaaggaataaaatcatttggaagttaggtgaagaaaagaggatgaaaagtctgataatcagtggttattctaaagaaaataaaattcttctcaatgtaaatcatataaacataccagagtgctttaaaaatacagttaaataatcacattgttttactgttttggcaaaagttccatttagcatagaaaataaatatcactcatattgttttcattttgctttatgtgttcaaataggatatataccagctctacacatcatccaaatatataattatgtggttaattatcacaacatagtgttattcttattaactttaaatattttgtgattattagaaaacaaatttaataataaggagtattcattgctttcatcacacattgattaaatatgtttttctgagggtctgttgagtgcaaagaattgtgctgtaatagtatatattttttccaatttttctttctaactgttgatttcttatttccttagcaatcaaagcatatggactatattttaattctacagacattgcgttaggcagaacagctaccaacacccaatccctgaaatttgtgattatgttttgatacatggcaaaaggaactatgcagatgtaattaaggttaagaactttaaaataggaagattaaatccaaggagttcttcaaagtaaagaactactacatgcagaaggtatgtgctgcctggggcacctcgtagttggaaggaaggctcctcacagtgcatgatggagctgtgggcgggaaaacaagagagaaggccattggctgagagctcaggggctcgttctctctgtgctgccatctctaggtgagaaactccagtgttggaacctggccttcaatgttgtcatgccaaggtaatcaataaggtagagcctcttttatttaatgccaataagcaagtaggtcagggtgatttaaaactttttaaaatacataggaatgtgctatgtgggtctccatttgtacttttgctccaggtcctgacaatttcagtcataggcctgagataataatttgaataacggacttattgaaggcttagtgaatgtcctctgtgtgttggatatcatgcagactgcttggcatgtactatttttttaagttcagataacaattctttgaggtaggaataatgtgtgtacatattttagagatgagtaaatgacattacaggagtagagtgatctaactaatgaatcttaccaaagaaaagcattcctgtgaaatctgtgtgactaaagggagggtagaaatagttgtcttccccagtttcctcttgctttgtctattttctttagagatgcccaggctggagtgcagtggctatccacaggcgtgatcatattgaactgcagccttgcactcgtgggctcaagtgcatctacctgcctcagcttctccagtagctggaactacaggtgcaggccactgtgcccagcttcctcctgtctctagccacactgtaatcacaaatcacaaaagttttcttaaattatattggtcccagaggaatagtaatgatatttgctacagtttcagtttccatctgtacttaaggaggaatagcacccaaactcagcaagcaacccagagctctagttcttgattctgcaaagtttttgttatagtaaaatcttttgttttgtcagtatgacttctttttggagtctgagttatgcatttgacatgaattcaagttcagttatcattcatctcctttgtatttacacaaatcaattaagtctaaactgcaaatagtttttgtctcaggttcacctctgataggctggtagcagctgtctggatagtcccgccaagaaggatcgagtagctgcatgtagatgcagtaagaaagagcacaattagaagaggagactggggatatgcctaccatgaatttcttatccgtaatcagtagagcccagcccttgtgcacagatatacaaacagtggcaatttttttttttgtccaccaaaggattattcaacaaggcacatacaacctatagagaggaagatgcctctctattcactcaaatacatagtttttttttttttgcatttccaattatctattgctaataatcttttcagtgcttacatatgtgcatgcctgtacacacacacacacacagacacatacacacatatatcctaaagtttgtgaaactatagtttgccttatggaaggaaaacacttgatcctattcacaggggtaatttttagacatctctattcataggtataaccagcttagaaaatttactgctgtattaagggtcagaatagcaactcacaggaaattgaacatttggagaacccaataggtaacttttaagagagaagtatttatgatatgaaggaacataaaagttttgtttttactccctttggttttcttctgtaattctagattgggaagaaataacagagagtgcttgaagaatagatgtggctaggacaatatctctgaatctctgaatggcccatggtggtgacccccagccagagtgaactgtgcagcagcaatggtgcccagtgggcagcaacagtggaacagaaggtgaggaaggggccagaaggaatcctttaggaaattaagaaaaggataaaaatatgataaaaatgtggtgtccaggcgagaaacggaataacctcatccctgttctgactaacaatttggtaatattttgacagttttgaacaagaacttccttctccttttcttttggagtacaccatagtgaaagacctatggtaaaaaacaaggtacaactggaatactgctttttgtttttctattttcaatagtatctcctgtttataatggattgttttaatctcagggaagaacatctgaggagatcaccgggtctctaaataccagttcttgtctctgcacaccttttttaggggggactgatgcctggttatatctgcggtacaccagttcctaaagcaatacctaagaaagtcaatgtttcctagataaacttgactttcatcaaatgatatttagaatcagttttaaacttgtagagtattgcaatcaattatgatcatattttgcagcatatatcatgaagtccaaatcattttagcttaaagaaaacagacgtctattattttttcacttagagtaagtcaggaagtgtgtagtcttatgtgttggctttccagtgtcatcaggggcccagattcctgtctttctgctctgccatctccaatgtgtggtttctaacctcatgatccaaagtgggttcttttgctccagcccgcgtatcaatgtaccaggccagtagaatgaagaaactaaggagagcaaaaggaggctccttcctaactgagtcaactttctttaagcatttgtcctgaaggtctcacacaatatttttgcatacgtctcacaggtcaaaacttagttatgtgtccacacaaaatttcagaagaggctggaaggtgttgtcttttagctgaatgcattatcatcctggaattcaaatctgggttctaatagtaagcgagaaagagagcgtggttattaagtggtgtcatttggcacagcctgtcaacagaggacatgttaattggcattcatactgatgttttaataaagcatgtagtgtgcttatgaggaccaagattgaccatactttggtcatcatcaatcatggactgaaaggcttttaaacatgaggtatgtaccgcctagcattcagtaacaacccacttagtcattcctaccttaattttaggtgcatgataccaaaatgttaacatatttgagaaacagtccaagctaatttaatttacgtaagtacatttttagataagacaatgataaatttgaaaatcagtttggtttaatgattggttagttaaaaatatatcaaataaataactttttctaccttagcatttttaaaattctggacctaaaattattacattctatttagggcaaggattagcaaaatacagcttacaggccaagtttgtcttgacttccttttttgtaaataaagtttttttgaaacacagttactctcatatggttacatattgtcagtggctgctttcactctatatcggcagaaccgagtaattgtattagatacccccaccactaaacccaatgtgtttactatctggattcatacagacaatgtttgctgacccctggcataggcaaagcaaaatacatgacacaatgaatttccctcatacttagaagttagggcccacagaactcacctgaaaagttgcttaatagttacttaattatatagcagattaatcagtttttaacttgattctgacgttcctaaagaatggcaaattccttcctaacacaaactaaacctttacctccgtggttctcaactggggtcaattgtgtctgccagagacatctggtaatatgtagagacctttttagttgtcacaagttggggttgggaggtggctgccactggcatttgataggcagaggccaggggtgctgccaaacgtcctacaatgcacaggaccgccactcaacacaaggaactatctggcacaaaagtcactagtgctaagactgagaaactccatggtaagtgagaactccctaggaccgaataggtagttgtcaataacaaaaaggaggaattactttccttaaaggtaaaaataattgtggcattcggtaaaaataattgtggcattctttcttggtggtggaggttttgctgtactccttccttgtttttattctccgaatgaaaacaccatttttatctgaattagtagctcaaagttttccattaatcacctcaaacggactgacacagtgtttcacacacaatgtcacgcatgctgtatgctaactcctgagttttgttctgagggagaaaaatgaattccatggccaaaagtactagaggaagaacactcatcatatcatcatctgggaggttcactgtttacctccaggatattaatggcactcagaagactggtggtgaagaaacctaggaactgtagaaatgtaaaacctgatgaggctgctatttgtagactaggtccagggaagatgtactaggtcagaggagaagatatcatggcagaatcttctaaacagtttttcatggatgacttattcatacatggtcctcagacatggtcctcagagtgaaaaataaaagaattcctaagtaaatgaatttggagattactaccttttacagagtttaacaagttcaattatagcaaaggcttttaaccctctttttctgtgtgtgataaatcccattggcagtcgcagatctcttctcaaattaatgtgatcaaatgcataaagcaaaatgtatagggtatcaaataaattgcattgaagtgtaattaacaaaacaaaaataaactggtgatatatgaatgtaagcatctctttattatcacattaaataataagatctagcagtaggtctactaactaccatacttttaaagtagtagtgagtacaaataatatttcaagacagctgcaataacggtgatgtgatatgaaaacatctgtcatttttgttggggacaaagtcacaagtactgccaatattactacagcttgttgtcttcattcaaacggaagaaaatgctaaatttcagtgaagtgaaaactaaggtttaaaccatcgtagagcctttaaaatgttatgttacttgtgagtttccagaagtaatggttgtgggacttgtttgaacttatttgaacatagaaactttaatatattttgaaaagataatttcacatgccatgtgggaaatgttgccttgagctagtgctgtacgcctgaaagcttctaatgtaatgatgcagtattgcatttataatcattgttttaagctagcgttttcaaatccagttcagctccatgataacagctgttgttttctttaccgatgtatttcactttcagatatgattttttaaaaatttctttgaacttcatacttttcttagcaaatatctccatttaaattctcagaatgaaaataaaaatgagttgtctcacacctctacacttagaaaatctaggctgcctgtggccctttgccctaacacgtgactcctgtatcatgtatgtataactcccttctaattaagcaacctcattcatcaagaaagccctgcagcgataaggtaatttttgccacaggaatgtgacactaccatgtgccagttgctgaaatagttgcacagattttagtgaaatgcaagagataagtgagtaagaaagtgaaaattgtcagcccataaattactgctgccctcagtctacagtaattacagcaaagctgtagataactgtccctctgatgaactctagcaaaatggtcttttaagtttatcagcatattcaggtacaactctctcaggaggcttggcctcttctaaatgatcaaatattctgagggtgggtggcagaaggacaaaagatgaggaaaaaggaaagagaaacattatttacatcaattaaagtaatttttaagtttattcttttaaaattatctagtagaagccttctttctcacttatgattcctttaaatgacacttgctattttaatgactattaaaatagtcattaaaatattaagtactaaatggtacttgctatttttattaatggatgccgaaagcagtcagggagctaattattatattgtgaaagtaaaaatatatatgaggctcatgtaaaacagttttgtttgtttcttttgattatttatttatttatttatttatttatttaaagacagtgtcttggctgggcgcggtggctcacgcctgtaatcccagcactttgggaggccaagttgcgtggatcacgaggtcaggagatcgagacaagcctggccaacatggtgaaactccgtctctactaaaattagctgggcgaggtagcatgtgcctgtaatcccacctactcaggaggctgaggcaggagaattgcttgaatcagggagtcggaggctgcagtcagctgagacggcaccattgcactccagccttgtgacagagtgagactccatctcaaaaaaaaaaaaaaaaaaaaagacagggtctcattctgttgcccaggctggagtgcagtggcataatctgggttcactgaagcctcaatttcctgggctaaagcaatcctcccacctaagccttcagagtagctgggactataggtctgtgccaacatgctcagctaattgttttgtttgttttctgtagagacggggtctcactatgttgcccatcctggtcttgaactactgggcttaagtgatcttcctgactcagcctcctaaagtgctgagattacagttgtgagccaccatgcctagcctcatgtaagtttagagctataaacttaaatgatgggtcatcagtcatattactttttttccttttcaacatttttattatctcaataatcttataaggtgtggaatctactattattcccattttataggttagtacaggtatcatcagttgaagtgtccttttcttttttttttttttttttgacacagtttcactctgtcacccaggctagagtacagtggtgccatcttggttcactgcaacctccaccccccgggttaaagtgattctcctgcctcagcctcccaagtagctgggattacaggcgcctgccactgcgcccggctaatttttgtatttttagtagagacgggtttcaccttcttggccaggctggtcttgaactcctgaccttgtgatccactcgccttggcctcccaaagtgctaggattacagacgtgagatgtccttttcactctcactgctagaaaatggtggtgccataatttggaaaaaaaaaaaaatcttctgcagatttggtaaaatgatcctgaaataatgtgaagccaaaaaaaaaaagtggatatgcagttgttctatgtttaaaactattaagcaaatatatacatatattcatttaaatatatatacatattttaatatatacatatatttaagtgtatatacatacttaaatatatatgtatgtagatgtgtgtttgtatatgtgtatatatattatatataaaatatatatatctaagtaaaaaagacaaattaaaaatactaaaaagacaacagtgctgattctagtctgaggagataataagtcatcatttcaacacttaaaattttatgtattgtcgaaattttctgcagtaggtaactatacttttattggcaggaagagaaattcttatgaaaaatgattgatattatatcttttaaaattgtaagaataagtaaattagtaaattccaaagttcaaacattaacttctattgataatagagttttaaaaattctttcaggaagatggagaaaaaagaagactgacaactctcccaagcagcaccatttccaaaaacatttacaagatagtggatgtggtggtgacaactgaggaaagagcacagagacaaaatcagaagcttgttgaactccttctctctctcctaccaacctggaacagagggcttttatatagaatttcaagtgctgtcctttacccctttgttaactcattctaagcatgaagacaagcactcttggaatgatcatttaaaacagtcactgccctttcatgatagcctcctcagaccttgccagcttgaacaataaattacaaatcatttttttgctgctattgctgaggtatagctttcaatattatcactgatttaagagttgatgtattttgaaaagtcagactaatatggcagcatttcggatgaggcctcttttgtgtgtctgctttattcctttgttggagttccacattttctttgtgtgggaccgaggaatcatggaaaattgccacttgtgtgataaattactgttttcacccatcaaacatagaaaatgctccatgtgagccttgcacaccattatgttgtcccatctaggaccctttgaaagtcagcagggtgcatctggctgaaattcagtcaggcgattaaatttattcaagcttggtgaacttgagagctttcaaaagaagagtagctgaagggatgagattatagtcctgacagggctctggaaagggtgtctgacacctgacggctcacagcgagccatggtacctgttcccattgatttgcaacaaagtctttctcaataagtatttccacttaacatttcctctcagggaacctgtgccgttgaagatatttacaagttgctttcagcttaaaaataaatcacctctaattcctctaagcgaaatcaatcaaaaacctgtaaaaaatggactggttgtttggtcgattctggcagaaaagtaaacagcacttcagcttttctccgccattaaggcctaaatggcctagaaagtaaatcaatatttctagtcagccttctggctattgtttagccagtagatatggatttctctggcttactgaactcctttgggactagcctataatcctctgagaggaataataagttcgttatctagttcagctctctgttgtacatttaaatggactacatccatcagcagcccttgttaaagttaaagggtgagggcatcccattcaaccccctttagagtgagacacttccaacacagtgagggggaaattataattcaaagttctactggttggcaaatggcctaaaaaccctaagtaagggtgaggcagtaatttgagtatgaggaggcatatcatactgctgtttcaagctaggaaatgctacttgcccatttctgagtatactatgatacatacataagggtatttgctagagagtctctcattattcctactagtccttcttgaatgtttttatttaaatactcctgtgattctgaacagtaaaagctatcagaactttcctgatgtagcaaaccaacatgcttccacctctccttgtcagcaaatggagaatctcatacttctactaattttactttaataatttaaaaatgactgtactaacagcttggcaatgcagtttttgagggttttagaagataagaatcctggataaaagaccattccttgaagaaattaatttccccttgcctttcaacttgataaactaaaattctcctttaaattccatccatgtattctggcttcatatgaagaagtgataatgtaggaataatttattttgagctattttatacacttaatttttatattattttgttgatttcttaacaagagccacaaagacaaaaatgaattatgattacttgaaactttcaaatgtaggtatttatggtatccaagacatttctttaacaaaacaaaaacaatagtgtttccaaaggtcccaggtgtctcttattaagtcttggcatgtatttcatttagagattgttttcataattttttaaagtaaaattatcacaacagaattaataaagggaaatataattatttagataaaatagtcacaatagaatttagaaggtagaatatgtatgcaacatatactcatttaggaatgaaagttattatattaatgcctaatattgagctagcctatgaagctgacttgttctgtagagatttttactgctgccttcttcaaggactcacctcttcaattgccagaaagtttgttttagagagaatacttaattatttggaaatcttttatggggaaaaattaaattcagtaaaaatcaacctaaaagtttgtattcaatttgatacgtttgttaactacacttgctagaggtattttgtgattaaataataactttaccgattattaatgccacattaaattcacttttaagaattcagttaacaactatttttgcatggaaatgtagaattttatctattttggtttttgctgtattttgaagaagtctatgctgagaatctgactgtgacagattttgctcctcataagccaagtcaactttctcactatcacctttcatattctccaacttatttgatggctgatgttcttcccaggaggagataaaaaggtgacttgaatgataagggaggccagacatggtggcttatgcctgtaatcccagattttgagaggctgaggcaggtggatcgcttgagcccaggcaagaccagcctaagcaacatggccggtctacaaaagaaaaaaaaataaaaaaaaaaaaaggaaaaattagcccggtgtggtggcagatgcctatagtcccatagtcccagctactcaggaagctgaggtgagaggatcacttgagcctggcaggttgaggctgcagtaatcacaccactgaactctggcctgggcaacagaatgagaccctgtgtcaggaaaaataaaagaaagaatggtaaagacaaagggctcttctccgtcttttagatatattgacacttgattttcatacttttaattcttcagtagtgttcacatgcttaaagttaaaataaatgcaaaatgctcactgtattctcattctaaaattgcgttggaatgatataatattgagagactttactaatcatatgaaatgagaatcagatagaaatgatagaatttatttgcaaaattgagttgatttttcatgtttgattatacttcaacatccctattaaagttttacttaaatggtgtgaaaatttacataagaactataactcttagtacatttataatatacatttcatgtgttttccaaaacaatttggaaatcaggttatgtctgcataacctgacaataccaaaatgtatctatctcttacttgtcaggaaacatttcttaccaactgacttggaggtatgaatgcatgtaaattttctctgtattagcttcatttttattctgatgtttgagaaacactaacatatatagagaaatattattatatcaataaggtttaatttgccagtcaaaacctttcaagattataaggttatagcctttatctgggagttgtcagtactggatgaggttgccaacacaaaaaggtagtgagaatctagttgtttattttgttttgtattgcgttaacatgatataatcacttttctgagaaacataagttatttctgcatcctcataattatcagtgaatggaacgtactatttattcaacacatgattgttaaaagaacatataaataaatgaatatgtaaatgaatatatatgactataaattaagactactattttgtttctgcagcagaagcttagacaatttattaatgtgtgtccctggggtcttaccagggcatgcagtggcattgacagaatgaattaactgagtgaagctgttttggtgctgttgtctaaactcagaaagtggagagtagttgacaacaaaagagtttggtcaaatcctattggaaattccaaatcccattcgcaaaaagtggctataacaaacaattacaatgaataaaataagaatttgatcagtcacattcgactgactagaagacatttattctatataccaagatagctttggaataagaatttctctaacatcctttcacataggagataaaacttctacagaaatagctctgtgctacatcaaaagcatttcagggaagggctcagccaattataacctgagggccaaaacagacctgttttttgtttttgtttttttttttttgagacggagtctcgctatcgcccaggctggagtgcagtggcacgatctcggctcactgcaagctctgccccctggggttcacgccattctcctgcctcagcctcccgcgtagctgggactacaggcgcccgccaccttgccaggctaattttttgtatttttagtagagacggggtttcaccgtgtaagccaggatggtctcgatctcctgacctcgtgatccgcccgcctcggcctcccaaagtgctgggattacaggcgtgagccaccgcgcccggtcaacagacctgtttttatacagcttgtgtatgtgtaactgatttgatgacaacgaacaccaattttgaaccactattaagcaaaatgttacttccccaaaacaaataaccatctttctcattagtataccatatgatttaaaaaagcactcaatattatatttttaatgttattaatgcatactatgtagaaatttattctttcttttgatgtaataatctacataaatatctttaattttgcatcttggactgcaaagtatgagaattcattatctggcctttacaggaaaagtttgccaatcccagtgccagtgtatcacactgctctcgaaggatcatgaaatatttacattgctaatttagctgatacaacatctttaggcctttatcttctcttccttcatctcaccatctatttaactatcttattaatccaccttggttagagaaccctcaaggataatgtttttatagtgtctaacgatttctttgttctaaatctgaacgagaaactctgtgtctactatttggtctagaaaaaccataagcaacctctctgaactgatgttacatataacatgaagattgtgtatatcaccttagagccatgcaactaagaacaacatgagtctggtgacacagatccaatctgaggggagctagctggacatggctgtatggtgaatttttaaaaagaaaaaaaaaaagtaagcacttagttcagttcatttctttttatcttaaatagcacaaaattatccttttgtcatttaattcacagtggtatctagaaatcagtgatggaaaagatcaattaggtcatttagctcctttccaaggttccaattttctctttcagcatattaacttttgcctgtccaaatttaagtgactaaagagatgggtttccacaacttacttgggagatatttctaaatcaaatttatctgtaccaaagcatcgttaaagactttgctattagagttatactaaattgttctctgcttaattgcatctcatttttccttcattcctcttggctactcaaagcaaactttgtttttctttgaatagatttattttagaccagctcatcctcatatattattgacaaagaatatatcattaattgtttctgttcattacatgaattgttgcttaaatatttttgttcttttgctcagaaaccacagtggaaaggaggccactttgtattaaaaataacaatatttcataggaaattctcttaaattcatcaagggatccagtggctgtgcataaccttttctagcttcaacccatcgaacatgaatgccatgtaagttgttgttatatcttcacctttcttcctgctattcatttccccatcaatgaccattttttttttattttctgaaacttcaatcacattaagcttttcttttttctgccataaaacatggctcccatacccctcattgattaagtctaactcaagatattctaaggatgctaggttcaacagcatattgttctcttcttcctgcccaattgatggatatcctgtaacacaatcttgaatccaaaaatgagctgattaaagaagtattaagaaaatccatatatatgactaagtcaatccatcagtgttttgctcagtagggtcaacttttctgtatgtagaaaataccactgccaggagatagtaatgaactacgacctctgagagtgttgcaacaggaactaacaacaaggaaacttttgctattagagcaaatagactcctaatcaacatattatcgatccttcatttttgtcaaggttattttgtgctttaaaaaatgatcctacagcaaggctttaataggaaaagtagactaatttgatttaaagagtaaatgctattaattatgaaagacagtcaataaaaagcttgttcttccaaacataaaggcaaatcttatagtgcctttgatttatggtaatgaatacaatgatgaaatattttgactagtatctcttactctcaccctaccttttgctgtttttcttgctcacacattagaaatacttaaaataatctcttccaagccatttttggaacaaaataatttttataatttagtaaatatactttttaaatagataaacctgttacacaatattttgatattatttccagaagaaatgtaacaaaaaggaaaaatttcattttatgtttaaagatatgggtaaacatttatagttgcttattataagttgatgttcaaacaccatatagtgatgagatttaaacaagaattttagcattctaaaatccagataagtaaaaaatttcagagaactaccatgtttaaatgatatattactatatgtaaaaatatgtgcaaataccaaacatgtaatattctgtattctgacatattaaatctgttaaagccatttttaggttccattaatttattattcacattattttatctgaaagaaattaagatatacattatttcacaataataaaaaacagtgaatttaagaaaaaattcttgaacatctatatataacctattggattactagtttctctaagaaaaagggttaatgctttatttccctaaaatgatctaattatatgcattgcaagttattttatgtctcacttcaataaggtaaaatttattggttataaattatacatttgaaggactgctttcaatataactttcctcattatgagtcatcaatatatgaattgtttagtcttctagactgtaattatatgactatatcactggagaatggtagggcaggttaaccttacatgttggttaggatgagatttccttctgttatgaaagggtatatttataggttaggaattaatatattttaaatatattaactgtgaatagatgcaaagtctgttacctgaaaaatttcacatttttttctaaattttactgaagatttgtttatttgatacaacaattaatttcaaggtgaaataaagtagcatatcttgtaagaaacaagaggcacagtagcctagccttgcatagtgactaaattatcaaaacttacatggaacaaatagtttgggccattcatttaattactaacagattatattttctacaaaaagaaagctgtgttggcttaccatcagggactccattaattttagattcatatcagtctttgttagaccttacatactgagatttaatgcaaagatgatactcaagttcacctcaaagctgaaaactccacatctgtgtggccatggaccaaaaggctgttttgagcttggatttgttgatgggcttcttcaaaaagcatgatattcaacaaccttaatgacatgtaggttaaagcagatggcatatttaaacagaaccagtatttatttttaaaattgctataagcagtatgttttaaagtgctctggacacatttcacaccagggtgacaatatgcttcaatccacaccaagctctcttttagctaaagctgccatgctatgtgactatctactgagtttatagagtaataaaactctgaagactgaagccagatctctgaataaaagaggcagaatagttgctgtagtctctgtatcttactaattcagaggaagacgaatttctaactttgaataaggttgagaagatggctacgatttcatttccatggtttttattacaaaaattatgttatatggaaatattgaagagattaaattattccggtcaataagtttttcaagctttctgggagagagagagagagagaaatttacatacagaagaaattgcggggcatgaaaatctgctaagggttacatgttttctcgcaattttacataggtagacaggacatgatctaaatgttcttgaagatagaaaattagattattagtatgaataattgtgttgtactatatgaagagctaaagttacaaataccagtttcactagtacaagaccgggcaggggataagaattgtgagtgcgctgacctgtgggagtttgccgttctctgtttaagcgtagtggttggcctactgttaacatgtggactattttaggagaatagaagtactagtgcatatttgcacctttccctttttccatagtccagttgttagaaatattctgtaagtatattctcaggttctactgtggaaagtgagttcttttcttctttactccttttaagatagtaaagatcacctctctgagagtctagaactgctgtgtccttctagtcaaaaagttgctttgttcattgcgtttcttcattgctcattttctttagccttacagagtctctttaccacttctatcactatgtgtgacctgcatgttcaccaccagggtccagtggacacttctttgtcatatatttctccttttgattacttatttttcacttttgtttggttacgttttgtttcatgttgcttctcttgtacttcttagctttcatgcaaaaaaaagtggattgtgcttgttaggtaatttaagcatttttcattatgaatgctttcttatgtcaagtatagtatttgggttttctccttttagataaattaattgttcccgggtgctcaacaattcggctttattttcaaggaactgggagtcttctcttttgtttgttatttcaaaatgaatagtggtacaaaacagtggtgcaaaaaatagtgttgcaaaaaatctgatttcagatggccacaattttactgaaatatctgaacactcagcatcaatataaacattggaatcacttcaaaggatgttttacgcattggagaaatgcaagatagataaatgctcacctattgcaactatctaaatatctactttgatctcatcctcttgaatgatttcgatcaatggtaatgactgggtgaagagaataaagataggaaaaatgaagaaatgccaagttttacagtagccattgtgaaacattatgttaaaccacatttaccaataaataaatggtcttctatgtttccttgagctgaggccttgagactgtccttgtgaatacaaaatgaaaattagaaaaacagacactttataatgaacatcagtaggatctgtatatggtactaaaggcataattcattcaaaaggctgagcaactgacaatcaatgctttgagcacaaattcacattatgattttgacaaattcacactatcattttcaaaagaaatagcgaggcaaagctataaaattcttttataaaaaagaaaacttactgggatgtgtgaaggcaaaatcttggactctgtttttattatcattttgctcttccaaaatgagcaaatcatctacagaagtaaaagatttagtagtaactttattctgatgagctagaatgagagtagagccagaatagagattagaagctcatcaaggggatggaatcagagtgaacagttgttggcatttgttatctggagtcatctatgaagtaatatgagctcaggatgctaacacatggtctatgactaaaaaaaaaaagttgcagaaacaagagggaggcaagatattgacttgcagaaggttatgattttgaaattcattaaggttttcaggttggttgtgggcccagactaatgcttaggaaagatctaggggctgctcgaatgcaaccccaacaagttatgtgcctgtaaaatttgcagatctgaatatctcacatttacaacccgcagacgtgaagagaaagtatagtgaaattagtaagagatttggactcaagagatatgagttcaggagtttcctcggcgacttagaaaacatatgtatccgagttgaatttttaacttctccaacgctcattttctgattggcaaaatggcaataccactattaccaccatcattactactactagaataaaagtggtctaaagctattgagaatatatcaaaaatatatttgaaagcatttggtacagaaaacaaaatgttagtattcattattataaatatataataatggttaaatagccacaactttttgtatatggagctatttatgtgagaaaaataacttaccatatttgagttttcagttattttataatcaatagctccagttaatgccctaaaacctaaatattagtgagacagaagtatgtaacttgtttgatattagttaaatttagaaaaattatattttattaataacaatacttacaaagccattcatcctgaaacaatagtacctataatacaaataacccttaactaattttataactaagtgctaagattaaaggaaaaaaatgtgaattgattactatgtatagtgactgtcctatatatttacttgtataaaaaagcaagttttgattttagcctgagataaaagaaaacttagagttgatagtactttaattgagaaagactatgggatgacatccaaattatgtgtttctagaatggcaatgaaaatctacttcaacagggtgttctttgaaaaagtcattcctcttgaagttctcaaaaagagacagaatagggaacagactattctgaagcctttgaatctaacaaaatgacaaaatgaaagttttttttaaacagtcttcatagactgccagatttttctcttttgatagaagagatacacgaaggacaatattaacaagaaatttagaatattacaaaaaacaccataaattttgacgataagaatattttcaaattattttaaaagaagttctaaagtatttaacagactatccataaaaaagcatttgtatgctgaagtgcgtgtaaaaatagttactaaaaatccattttgaagcatcatataaatctcttcaattaaattgcaaatcaaagaggaaaacaccctttatggtctcctttagagtaaggaccatgatttcatttccttgtgactctcagtaatgccaaacataatgcatgttcagtaaatagtcagaataacccacagacttccttacattatgtttaataatttgtgactcctagagaagttaagcagtgattcctcagagaaatcactgagctaatccaataaaaattcgagtatttcaggtctcttctgctgtttctacactagccaagtacaagtatatactctggcatttggacatatacttgtgcctctacagaaagcaccatattctccagagatctggcaagtaacagacttcatcttgccagtgtagaaatagcattagagcaagactaattgctggaaagcctgttcagaaagatttgtcattcaggatggtaaaaataatcctgcttttcagcgtacattcaaacttttttttatttccagtatttaatggagatcaaaacattaccatttccacaagtgaatgcgttttatgtaatgcagctatttcctttgatttgagttcaagcagaaaggctaaaatgaaaaaaaaaattctgtctagacgtatcatgtttgtttcttgtgtgagatgaaatttattaatcctgaaatgtggcttaaggacatatttatatgtgttataagtatcttattgaaaaacagaaatgccaagagggagagacctcttagatatacccttgaaaacatagtcaagtttaagcaggtcacattcagtggggggtccagagatttatattcagggaatctaccgagctatccttgactgcctccccactcaatttgctgtcctgtactagatatgttgtcttgttgactacaaaatcaccaccaaatatgtctgcttatagtagcagcagccaacaccttgcatgactttattaacctgattctgccagtgacaacatctctaataaaatccaatgtctctgattattttaacttttggctcaaggtttccacttttaaaagaatattacctactagattttcaatcataatccaaaatgtcttccattgtgcatggccaaattgccatagtcttatctaaacagttcagatcaagccaatttcttaactctcaacctttaatagtaatgtgaacatagctgttggatttctagcaccttgttcccttatctaccatctcataagcctgagaaagcatatctgtgatttgtaacacaagagagccaacataaccacagtaaataaaagagaaacatgttatgatgttaagccagtgcactgcttggcatgcattaagttcactgtagctgaaaaaataactgtgaggctctatatcccattaacactgtgttaattattgtcattgtctcatcaatgttttgtttatgacagctctggctgacaggaatagtgggatgttctgtcaaggccatcacctgatgagattttattggcaaaagatctttcttccctttactatgttaggggtatcagtgcttcattaactctaaacataatcgcttgcaataggcccagtttttaaatgtttcaaataattgatataatagtccctttccagcattatagttaaccaattcaccctctaaaaatgagagacatccctcaatctctctcaactcaaaagaccactcaatggcagtcaaatatgaaaggaaaatactgtctcactggggaagactttttaatacggataggatgttttattcctttatgtatgatacctgtgaataaagaaagcctccatagaggaggaaatctatctcaagaaaaaaataaaacacaataatttgtacacacacacacacacacacacacccgctattcagctatgatgaatcattgccctctcccttttaaatcttgctcaatgagagggctgtggggtactacagattcttgggcaggggctaataattaccattctctttttaattatttatttctatatatagaaatagattatatgagatagatctatttcatttcatatatgacactcaatccttattttttaaaagaaagaaggaagattgcatcattcttaccattaaactgtcttatcacagcttagctatttctgtaagtgaaaatatttcaagctaaatgaaagttccctgcaatttcaaattcacagaataattctaatttaatgataaagatgatactcctacccatatcaatgcctaattttaattccaggaacatagtttcttactaacattgcttttgcttttttttccttattgactgctaatacaattctttatgacactgggtgtgcgctctagtctacaatttaggaattgcatattttaaaaatgactcagtttcctcacttatgtcattagagtcaaatttgctactctgtttaacctgcaatactgttatgacaatatgaaatttatgagtatgacagtatgtaaaaatagctatcaaaatgtgaaaagttattatctatagcactgacctgaaccataagtaggtactataagagtgatcattaattttatgtgtcaatttggtaagggtatgatacccagtttggccacataccagtctagatgttgctgtgaagatgttttatagatatgattaacatgtaaatcagtagattttgaataaagcagataatcctccctaacataggcgggccttcatctaatcaggtgaaagccttaagaaaagagatcaaaggctccagactgtaacctgaaaattctgtctgagttcctagcctttggactatgcactgcaacatcaattcttagaggaatttctagccagctgtcttgccctgcagttttcggacatttcagctccacaatagcatgatccaattccttaaaataaaccttgccttctttctctctctgtgtatcattctcaaccccatctatctgtatatgtatatacatacatagatacacacacattctattggttctgcttctctggagaatactaatacagtgtttgttagaagaaattacatatatatacatacccctcccataaattgaacacagactctctcttttaatttaaaaaaaaaagcctgatattctggaacaggatgttctctctgtatcagaatcagtttctgctcctagacagcagtcaagttctgccagtagataccagcccctccttcctctagcttatacaggcatgagagtaattaatcctcatgcttattggagtttagtttggctttggcacagtatgctttccctagcaaaccataattgattctgaataattgatcagcaacgaacattcaattttctttatcttctcttcctctcattctcctatgatatatgttttctttggggaaccattttccattttaaaaaaaaccccaaatgcaaggccttttagtgatcaaatcaattcatgctgctttctgccaattcgcatcaactccaatgcaactcctgttggagaactcttagggaaccctaattagtgtcccattgtatccattagttttcaataaggaagtaaacttcttatgtaaaaacctcggaaactatttacatgtgactgctttgccatttatcaaccaccacactagcttgcttttttcaaaaatcctttgatgaggactgttattgaaaccactaaaccctacatgagtcatggaatctggctagacaaagacacctaaaatcagaacctgtgatactcatctaagctttgttaattcacctaaggatgatgtccctcacttttctcttatgtaaaagtaagattataatgataccccacttaaataattattataattccttaggcaccagaataaaacctcttagcaaaacagaagtaaaaagttctttgaggaaagtagtcttcaaaaagtcaaggcattttatcacatcaaagagaagtgggtcactttcaggccaaaggcatgcttagtgtaaggtgcaaaattaagcttacttatttagtgaggttggatatctactttcttctaataatcaaacatagatggatactagatgaaaagtaacagaatgtgagaaactgttggatgctgatattttgagatgaatcatacatatgtctcggatatccccatttaacctcctattcaatttagatgcaatgcccttttatttctttcaacctctgaaacaagaaatgttatcatgaccttttttttattgaatattatgctgttacatacacacctttccaactctcgtgggagtcaaatgcttagaagaacaaatctacaagtggactttctctcattgtccattctacccaacagcaaattagatgcacactcaactgcctaccctgctatacactgttccttaaaacaaattataactcagcatcccatttaatccagttgcatgaaattaacatttaccgagtagccactctgtgccagaatctaagcctaattatggaaatagagctgcagcctcgttttgaaacaaaacttcccaaggccatggtctctagtcactttctgcatcacctcatcttgcttctcactcaatccctcccttcagtcccctcctctataccagaagtgttcttttctgctctgcttgtcttactgggccttcaccactgtgtcttcttgaattgctcctcctgctcatgtctgggaacctacactctctgcttttccttgtctttcgttggctgctcttcttctacttccttagtcactcccacttctcacctcagccattaaacactaatgaaacccaagcttcagaccagtgctgtgtccccatcctctccctggttaatctctgggtaatctcatatagtgctactgctgaaagcatcacatagaacttgatcatttccagatttatatctaaaatttcaaactccaataggatactagattccaccatttagagctcatatttaatatatctaaattgaaattcttgatttccacatttcaaattattctgcctcaagtttctcaagactagaaattgtgtacagtgttgcatatgtggataactgagacataatctagtcaacagaagaatgggtaatattcttctacataaccttgtcagtatcattctcatgattttttaaaaaaataaattacagtaaagagtatcagctggggaatcacaagaacctgctttttaaatacagaatctaccatgttattagctttttaataagttacttaatcttatgacttctgaaataattcatgacaagctacttaatctctataaatgtcagttccctcaactgttaaatttggataataatagccattatgaaatcagcttgtagtaagaattaaatgagataggcttcttaaaggatataatcagattttatgcattcattttttcttttactcatttaagaaatctgtataatgaatctaacatgtttcattctaggtgttgaggatgcagaaacaatcaagacagacaaggttctagccacccttgagctataaccaagttggagaaaaaagtcagcatgcaagtaaacaataatcattcaagctatataggttgtgcctcatgaaacaaaaggactttgtatgtgagagagtaatggaaaccaggcacagcttttaagagatgatgtctagaatgggacctaaagaagaaggagctctccatgcaaaaatataagaaaagcccattctaagcgagagacatcaggaaggacaaaggaaccgaggcaggaaagagtttggtgtcttttaggaatagatgagaatccaatcttgggctaatgaagcaacacaagattcgcaacagcagggagttgctactatctttagcttgaaggagaaaaaggaggaggttgtattaccagagcccaggggtggagtgacccagcataacatagaatcttagttggtatattcaagagaagttggatccaaagaagagatacagccattattagagatgctgccccagagggagaaggagagataccttgaaaatttcccttaatccctccattcgttatatcaccaatgacttccagtgactgaaccaaatcagatgccagatgacacaatagcctagcaaatgcagtctaagaattcaatctccaacacacccagtagaaagagcaaagggtaagaaattgacttgagagcaagttggctcagaacagtagacccttaaattcattaagggtcaactactttaatactttgggaaaataatcccactatgcagggaaagaggatgaattttaaaatgtcatattttaggtatataaagaaaaatcctgcctgaccctgatataaagaaatgaagatattagaaaaaagtgttggctctacatgtccaggtactactgatcacgacagcacttacaggctctaaatggttaacttcctgaaaagtggctgttatatggaaaaccataaaacaatcattggtgatccttgtttctatttaaaaaaacatgctcttaggttcaagtagactgacccactttaggactatctatccctagggatcttgtaaaatgcagagaatgagaaaaacctttagaagatgctaaactctccgcttttaagctaactagcatgttgaacaatttatttgtacaatatgagatatgaccatattgcatctcatcttatggaattactcaagttatatacaattttctcaagtgctattgctagtctggatgtaggagtgaagagaataaattgagggcttgatctatgtttggggttttcagagaagacatagaaatgaaagaagaacagattggttgagaatataatcaagtgattatgggttctgtattgagcagataatttagtccaagaagatgcttatagttatgaaagaaaattcaggatcaagtacatgaggtctatagaaggtcaaacagtagttaagaaggagtgaagaagtgtgagagctaaaggatgtaaagtagaagtcagaaagtgagggcaatgaggcattctagtgcatgaatgtgacagggagcagctgaagagaatggaagtgatagttctagttcaacggttccaggaactgccatgttagggagttagaaagttgcccacatggatttgaaatttgtccttaatttattcatcaaatgtagttagtgctattatgtctattgttcaacgttgctgagtaacaaacaacctcaaaaatcctatcggcttccaataacattgtgtctcgtgcttatcagactgtggtttgactattttcagttgatctaggctggaccatgttgctccacggtgtgagactggagaactttgctccaggatttcagtcttttctatgtgtgtttattttagagggcaggctgatggagaagaagctacctgggtatgctcttcttattgagagtgacagtacaggaggcaaaagcctaaccacacaagcaaattaaaacctcaactcacttcatagctgctaaaatttcgttggccaaaacaattcatgttttattaaaataaactgaaaactgaaattaataagaggtttttcttttctaatgagttgtattataaaatcatacggcaaaatctttggttaagacagagtaaatatttcaaatgaagatgcaataagaatgaagacaaatgctgtaaatcatgtgcttcagtggactttgagactcttggcaagtgaatggaagtcaacagagatcagcaacaagagagatagaatagacagaactagggactaatgttcaaaaaaaaccatgatcctctccatgcccctacacagaagaccttagaagaataacagtctggatagggcataaggcagtgaaaaacagaaactaccctcccccaatcctcacaaaccataaatagcaggttgtgggggcatactgataattactagtcattagaagctaactgtggaacacacactgtaagaagacaaaacatattttatcaaacacagttatgaagaaaaaacatggtggctcctgacaaagtaggcacatccctctttcacggtttaatgatcaattactcagttgaagttttggtctctgaggatatcagagtaagtgtgattgattgggattttatagaacttgtcattaataaaccctaggtgttggaggcaggaaaaacgcccatagcctggttaattatcatggaagtacttcggatttttgtcttggagggagtaagaacagaataaggacatttctgaaatcaataagcaattgtttatgtgaccggtatggttctagcaatatggggaatacagaaggcttgtaagacaaagcaatcattttcacagggtaaaattaaccacaatattaatgctacctgattgtaggctgaactggaaaagtctgaataatttatatattgaggtgcaggcaaaatgccattggaggatacatttaacaaccttccaaatacatagaacaattgccatttctaagttatgttataatcctattcttctagctcactgattcttctaaatttcaaatatagtattttaaatttcatatttttggttctttacttgataatgaatccaagctttaaaaacaagctaaaaaatgagtaaatacagttggcccttgaacaacatgaggttgaactgcatgggtctacttgtacgtggattttttttcaacaaatatattgtaaaacttattgaagatttgggacaatttgaaaaaactcacagatgagccctataacctagaaatatggaaaaacatgaagaaaaagttagatatgtcatgagcgcataaaagatatgtagatgctagtttagtttatcatttactaccataaagtatacatacatttattattaaaagtgaaaatgtattgaaacatacacacacgaacacttgcaaacaatacatggcaccatttgcagctgagagaaatgtaaacaaacataaagatccagtagcaaatcggacttgcataaaattaactgtagtacataaggtactactgaaataattttgtcactatctcttattgccattgtggtgggctcaagtgttgtgagtatctgcttaaaactccacgtgatgctaatcatcccgagggagcagttcctttctctagtaaattccgtagcacagtaaaaagccatcattctcagtccttgtgtacttttcatcgtgtttagcgcaataccataaaccttgaataatatcatgagacccacatgaaatgctactaaggatgcttgatgtgttcctgagaagcagaaaaatgtcacgacattaaagaaaaagttgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgctgtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaaaaaaaaaaaaaaaaaaagttgaattgtttgatatgtaccgtagattgaagtctgcagttgtgtttgtccccatttcagacaaaaacgattcatcttataaacagacaagtactgtaaatgtattttctcctccttatgattttcttaataacactatcttttctctagcttaccttgttgtaagaaaacagtgtagtagtacacacaacatacaaaatatgtgtaaatcaactgtttatgttatcagtaaggcttctacttaacaacaggctattaacagttaaatttgggagggattcaaaagttaaagatagatttttgactgtgtaggaagttggtatccctaactcttgcaatgttgaagggtcaactataagccaaaacactctgataccacaactaacaaaatctgtattcacactcaaatgtctcaggtattcttccatcaatttttctgaccttttaattacactaaatatatatatatacacatatatatacatatacatgcacacatgtatatatatactctttttataatcttccttcagataagcttaacacattttaaaattttaatatagttgtatatttttataaagtctggttctgtgtaactttctattcatttttctccaaattcatctcatgtgtatattcattctatttctaaaccttttgctattcctatctctaagacatttttattcagcaagacacatctaaaatagattttatctgcattcacttatataaccaaacgtatttatatttccaagcacatttctttcaagaattatttaacatttatccattgttaatatgttttcaaatgtcaaatcttgtatatgacaaaaggtatgactgaataaatctggctacataaaaacgttaaaatgactgtaacactaaaagtacacatatatgtgcacatacgtatcccacaaataaaattaaaagaaatttgacaaaatgagtaaatagttaccacatctgagctacataaatatctttaagataaaaagagctctgaggaatcaatgatattttaaaaattgtatcaaatcaaaatgataaaagataagactagataacccacagaaaaatgaaaatgtgttgaatttctattgaaatataaatatatacaattttattaaagtgaatgcctctacagatggtcccaacctatgctcgtttgacttaaaatgattgttttgactttacaatggtgtgaaggtgatacacattcaatagaaaccttacttgaagtcttgaattttgctcttctcccgggttagtgatatgcaatacccctgagatgctgcgcagtggcaggtttctgcagctcccagtcagccacaccatcgggagggtaaacaaccagtactgtagtctacagtgtatggtattcaatatattgcatgagatattcaacaccgttataaaataagctttgtgttcgatgattttcccaactgttaatgtaagtgttctgagtgcgtctaagttaggctagactaacctataatgtttggtcagttcgatgtattaagtgcactgtttatttatttgacattttgttgtagttttcaagttacaatggatttgtcaggacgtaaacccattgtaagtcaaggagcatttgtatcttctaatggccaaaatatttttctttaataagttggtaatggcccagatacgggagtaaagaactataaattaatataaaatctctggagaatgtctgacaacaaacatcaaaatatttaaagtgtattatttaacaagtcttatggtaatcagagttctgggttcaaattgttggtctaccacttggttgctatgtaatctcagtaatttattttactccatgagttttagcttaaattcctgcataataggatcataacaaccatctttcaaggtggctgtaagataaacagtataatacacacatcttaacacattttctgacaatgataactgttcttcagacaaaaacttctatcctaatagtttctcatctttctcccctacctctttcttttttttctggaaataattatagatacaaagaaagctctgtatacaaagatgttaaccaaagtatcatctctaacagtaaaatataggggcattggtttaatacattatgtcatattaatatagtagaataatatgtgaccatttaaaccatgttatagaaaaattaatgagattgtttagtaaaatgcttaagtgatattgatataccagaaaatcaagttgtataagtaataagtgttttattatcacaattttgtttacttgtgtggttatgcccttataaagggcaggtatttctgtgtatgggtcatgcatgagcatgatatgatgtatatgcatgtgtgattgtgtatgtgtatgcataggcacagagaaagaccagaagtctataaacattcacctattcagaaaaaatttgctgaattgctgctataaagcagataccatactaacttctggtgataaaaagtaagagaagacaaacacaaatttgtacagcaaacaatatattgggaagctagatgttgttagaataatctctaaaatagatttcaaattctgattgggataatgctacaaagggacaatgtgatgtggaagaatgtaacaggcacattgacttttgaaagcaggtcagaattccctgctcaagacccagttgaactgaaatctgcaaaaagtgcaagacatacatagcaaaaaggggaggaaagagagcccggggaaaggagcaaaggaatttggtgtggctttaatagatgagcctgaggctcagggagtctggaaaggcaggtgacagatcaaaccaggtttaaaatacactgttaaggagagttgaggaggtgatcgtataagaaaaatgatcagagatctgttaggaaaacatcactttaactatagactgagggagagcaaaagtcagcgaggaaggccaggcacggtggctcacgcctgtaatcccagaactttgagaagctgagggaagtggatcacctgaggtcaggagttcgagaccagcctggccaacacagcaaaaccccatctctactaaaagtacaaaaattagaaggcgtgatggtgcgtgcctgtaatcccagctactcaggaggctgagacaggagaatcgcttgaacccaggaggcagaggttgcagtgaactgagatcatgccattgcactgcagcccaggtgacagagcaagactccagctcaaaaaaaaaaaaaagtcagtgagatgaggagtaccgtgaagtcatttgagtaattcaagtgagagatgacagcagcctggactaggatggagtgaaatggaatgaagtgatggatttaggagctacttacagggcaaaactaaagtgatatagcaatggattggatatggagagtgcaacatggagaaaataataatatcaaccacacaaggacatgagaatgaaaaaaacaatacgccatttcagcatcccagatggggccaggcacagaaacagactgatgttgagtgagaagcagctgatgaagatgacatagaacttttacttgcataacaaaatggatagcattgccattcatggagatgggagatagggaacactattaattttgagggggacagtcataaattcagttttacatgtaaaaatttaaattattttcaaaatattcaagaggagatgccaatgtggtagttgggaaaatgagcctggatctcagaggagaggtctgggttgtatataaaagttacgaggttacatatgtggtcaataaagctaaaggtgaaagggcctagtaacaagtcttgaggtattccaggtaaaggagaagaagcctgaagcgggatagagtaggagatataatgtcacagaaaccaagggaaaaagggggtttcaggtatctaactgtaatacatcttgctaagaactcatttaagatgcagataacagaaatctccctgaagaaagagagatggaagtcattggcacccagggcaagagtgatgaatgtgtagacagtattggatcagacttgagctgtgaaaatagaaaatatgaaaaacatcttcagtattttggctataaagaggaggaacaacaaaggatattcaccagaaagacatgtgcaaggcaaattagtatagaatttgcttcttaatgggagagatttgagcacattaagagtagagatttgctcttggaagttaaaggctaaatccacactaagtccttttattcaatatttatgcggttttaacaaattgttgtacattttttaagtttacaagttgtgatattatacagataattcaagaaaagaaatattaaatagattacagcaaaagatgtaaagtttcaaaatatatcaataaaaatataaagtagatgaattagagggatctatataccctttacaaatgtctggagcttagaaggtgaacaatcagtgtgagagactgggatagaacaagttcgagataagtgagtataaagaatctagagggggtcaggaaaatttaccctccaaaagtaaaacagagcaggctctgggaagattttaaaacttgctcgagcaactaaaaatgagagttgaaaagactcctgtgatagtaagaaggttatttcaatattatatgacatacaaattgttttggagatggcatagtgtggtacagctgcagaacagcccttccctagaagccaggcaccgggtttggttttgtctgtgtcaataataaaaggcagtagcttggagaagtcatttaattaatcagagctttagtttcttaacctgtgtatttaaagagtttccctacattttctgtaagtttcttacaacattaaaattctttgtctctgtaactaacagaataggtatgctgtaagaaaaaaatatatacattgaggtaaacttaagtgtctctagagcataacattatcaaactttttttgtaggtcctgtgtaagtgagaataaaagctccacacagtccttgacttcattctaaataggttgacacgggtgtgaaatgacattctccagtcttagggatgtgtgaagggcacttaacatttctgacaagctgagtcatttgacattattccctgtgtaacttatccattaaaattttatctgttgtgaacataatttttaacaactacataaaatttaaatactctgaagaaagcacctagtcatttcaagactttctgatgtgatctatgttgaaacaaacaaacaaaaaataaaaaaaaaccctcctatagagtctcaccagagtacaggtttaaaagttaaaatatgtatttctaaaagtaaatacattatataagcatatgaaataatgaatatataatacatattatataaagtgattacatataaatatatttctattcctttttggaatttgactattttctggtgaatattaagattagcttagttttatgtatcaaattaatgattaacattgagtcaaatgacattcatatatatacatatttttaaattttagtattattatactttaaaagctttagtgtacatgtgcacaacgtgcaggtttgttacatatgtatacatgtgccatgttggtgtgctgcacccattaactcgtcatttagcattaggtatatctcctaatgctatccctccccactccccccaccccacaacaggccccagtgtgtgatgttccccttcctgtgtccatgtgttctcattgttcaattcccacctatgagtgagaacatgcggtgtttggttttttgttcttgcgatagtttgctgagaatgatggtttccagcttcatccatgtccctacaaaggacatgaactcatccttttttatggctgcatagtattccatggtgtatatgtgccacattttcttaatccagtctatcattattggacatttgggttggttccaagtctttgctatggtgaatggtgctgcaataaacctacatgtgcatgtgtctttatagcagcatgatttataatcctttgggtatatacccagtaatgggatggctgggtcaaatgatatttctagttctagatccctgaggaatcgccacactgacttccacaatggttgaactagtttacagtcccacctacagtgtaaaagtgttcctatttctccacatcctctccagcacctgttgtttcctgactttttaatgattgtcattctaactggtgtgagatggtatctcattgtggttttgatttgcatttctctgatggccagtgatgatgagcattttttcatgtgttttttggctgcataaatgtcttcttttgagaagtgtctgttcatatacttcgcccactttttgatggggttgtttgtttttttcttgtaaatttgtttgagttcattgtagattctggatattagccctttgtcagatgagtaggtggcaaacattttctcccattctgtaggttgcatatatttttatatagggtttagcttttgatgtcaatatatttaagaaaaatttctatgtttttttcagttatgtttcatagaatcaggataacttctgaaattttggaaggtaagaggatgtccctcccactcttactcattgctaagaactttgtaaaatgtatgctgtttaaaaacatatatacccttcaaattgatttatattatgggttatgaccaaaatcttacctttggcctcaagtcctggtacggtttggctgcatccccacccaaatctcatcttgaattgtagctcccataattcccacgtggtgtgggagggacccagtgggaggtaattgaatcatgggggtggtttcccccatactgttctcatggtagtaaataagtctcacgagatctgattgttttttaaggggaaacacctttcacttggctctcattctttcttgtgtgctgccacgtaaggccttcccagccccgtggaactgtgagtccattaaacctctttttctttataaattaccaagtctcgggtatgtctttatcagcagtgtgaaaacggactaatacaagtccctttttactgggtttaaattagttagtttctacatgcacaggtaattttactcaacgctccctttgtctggcaatccattcgaaaactttttcgaattgtaaccattgccttcaatgaacaagattgtcgtctgctccccaggcatcactgaccgggcaatttcttccttagtgtaagcaatccaacaatgaaatattctcacagttactgtacatgttcttgattataaagatacacatatttaatggaaagaactaggaccataggaacagatttggtattttattgtttctaataaattaacttgtgaccttcagaacgacacttaagttctctgcaccctgctggtttccataatgattaggtgttttccaagattacatttcctctaaagttttaggcttctacatttttaaatatattataattatgattaatttcacaatttcaaagatttagtgtaaacttgttctgagattgttatatgcagatgctgtattagaacaaaataaaaactgtgaaataactagcaactttaatgttcacatataagacttcaagaaatataacaaaaagtggagttatcctggctcagtgaactaagctataaaatttttgaatggtaagagctgttagaattatgaggtatccactaattcagaatattaaatttgagatatactttatgaataattttcttttttatctcaactgggaaaaattattcttgaacctcaacagagaagtttgataaatgacatttaaaatgattaaaaatcattcacccaatttaagaaactccctaaataataatctgcagctcaattttggttaagtttttgcatggacatgtgaaaattggaaagtaaaataaattgcttctggtgattttttacttttttttttaacttgtacagtatacatttatttaactatgactgctagtaaataattaaatataaacctctgtaaagctttctgctgtaatattttggatgagaaggatagtttaaacagcaaggtcttcaggatatttgagggtttataccttgcagtaaaaaaggagagaaaataaaacaaaaaacttttacctagtttggatggaaaccttctagaattcattatacactaatttgcttctttcaaaaaatgtcagagttataaacataagtaaacttgagtttgctgatgcctggtcatcatttgcttattaataaatgcagctttctgtatctcactggtgtttgtaggactctgtacatctctatattgctgcattacacagcctctgattataatgcttctagagttagagtttttaaaaatatatattttatatataaatttatatttttatattttatattttataaatataaatataaaaaattttatatttataaatgtatatattatatatgtacatatattttatatatgtgtgtatatattatatatgtatatatattttatatatgtgtgtatatatacatatatgtatgtatatatgtatgtatatatgtatatatatacacacacatatattcacatatatatgtgtgtgtgtatatatatatatatatatatacacacacacatatattcatgtgagtatacatatttcctttatggcagagtgtaaaatagcaattccttctaattataataatacagcatacaatacaaagtgaaccatagtgtctcctacaaagtaactatcctacaaatgttagctgtcattagtactattaaatagctattgaaaccctgatggtttgtatcagtccatttatttctttttaacaggctatcattctgatgcaaacataaataacaaacaatcttggactatgttgaaaaatgggttaggcttgcagtcaaaacatctaggtttaatcctggatatgttgcttcatagctaggttaatttcattagcattgttacccttaagcttgttgtcttagattttaaaagcaggacaataatggttatcttgcagattcgttatgagtagcagtttaaaaatagatgtgacaaaaaggtgagaaattcattatcacaaaactgtcacacagaaggcattcagtaagggttaactgaatctgaaatcaggaaataaggttgcttctaaaatataaacatttataaacattcacaatattccaggccataggttctgcatagcacattagggagacaagactcactattaagaaacctgtcattgaatatgattattgtgattgagagagcagagaaaggagaataatagaatccttactctgggacagcggaatgtttgtcctattaaaaaaattctttacacaattataatttattttattcaaaaaataaattcactgtaattacgtatgaagaaaataaacctctgcaaaattatctatactatgggaaaaagaaaaggagtgagaaagtaattgagtgaattcaactgttaatatgatatataacacatttttaaatttagagtagaaactataaataaagctatgctgtaatcaaaattgtactaggaaatacacatgtaaagatacttctgaatatttctttgtccaattctcagtcaactgtaaaactgctgagttttggagatataaactttgcaaaactcagatcattactccttttgggcttttagttacaattaaggaaattatgattatctatttgtttatatttgctgtgtggcaaaagacaatatgaaaaatgttacttagtgagggtttggtgatcgttaccagcttccacattatccttaaagttgtgttgaaatgattgaagataaatgcacttaatttgaaaaaaaaaaaaatgttggactggaactgatagtgttccaggaaagttgaaagaaatcatgagcaggaaacagtgaacaatcttacgagacatagagacatacaggctctcagttagctctgaatggcctttacaatcaagatataaactatgtgacaaatgagtgtaaaataccaaagcactggcttgtttcatgaagataagaacagtctcaaagtccttgtgttccatatggtccatggatttccaaagaggaatatgcttgaacagatcaaaaagcaaaatagacattgtgtctggctggtatttgggacatggaagagcgacatctaatttcttaaataatgtcaacttatactgctgtgcttttattggacagatatgtgtgaggctttgaatacatccaaactgaaacttcaagaacaaacatcaatattattgattattttaactttttttagaagttctaactaaaatgcagccctgggcatagaaaactggtgtttaaaagaaatagtcttattctaaacaatatatatacattgtttatattttatataaacaaaattttttgtttatatatgtattctgtttatattttgtattataatacatttactctgtattaaagatgaattcaagtggtaatattttcattgtgatatggctcaaaaatatgtttacattttgtgaagttctcttgtctcattgatccttaggctcctaaagctaatctgcaagagggttttcagatttcaattttaattcatttgccaatataactgctagaaaatcacatttagagtaagttttggtaaaatatctaccttattacaaactgagcagatttgggtggggagcagtatctatcctatttatattaataaatatatttcagaatctattttttctctgtacttctgaagtgaaaaataaatcatcagagtagacttaaaagtgaaagtggctgctattgtcctaaatctatcccatttgtgatatgaactcagaagcttcagtttctttggaaattattatagacacggactactgcatgaagtttcatttaccttaaacttctaattgaagtttcacctatatgtggctgagatgctgattcagttcaattcaaatattaactaactaaatccttatctggctgatgagaaagaaagagtagcccacatgaagcaggagaatagggtctggaggcagggaagctaaggtcaattcatgctgacgtcctagaactggatcaaaaggaaaaccccacctctccatgcccaagtgacaaaggatcaaatgctactccttccacaacccccacccccttccactgcgtcacagatggaaaatggaaagtacctctgattggacgtgggccaagcgtgggccaatccttcatttgcataaggtgccaatccatttcagcctctgattggccagagtcaaacctccacttccatcctttattacatagcgtataagcaatgggaaatctttaaagggtacttaaaccccagaatattttgtaaccagggctcctgagctgcttgcttgagcccgctccaattctgtagagggtattttcaccttaataaatctatgtttctgttgccttttgtgtcaataaatctatgcttttgttgcttgttcatgcatgctgttcaaatccttgttcaatacatcaagagcctagatgactcacgatcagaaccctttatctagtaacactttacaaacatatatgctcattttaatttttaaaataactttttgaataaaataatgtatgtttataaagtgcatagtaaactgtaaactaatatgtaataaatgagttattgttgtcatccttatctttttctaatcaaagtagataatatctattctaaaacaagttattcaaatgtcttttgccctttgtcttattcaaatgtcaattgcctctagaagttttgattttaagaaaaggaaatgttttgcctttcaatctttatcaatggaaaacatttcactcagtctcaaaatgcaatttccacagatattttattgggtagagtacttttaaaaagctctaaaataagaaagtgatgataatggaaagcaatatttagtatcaactttgaataggcacaaagagcactgatgtaattagagatacttagacatgtagctaaagaaaatatacctctgggagaaaatgtaactgctgttactattttcaaacaaatatggggctcagaagtatctatttaagtgccaatattaaatatctcaccatgtttccattataaacccttcttttaggagtttataactgggccataaaaattcacttcaggcactccttagtatccaaaaaagctattacagccttctgggaaaataataagcatatttatagaaggtatatataaaaatattgatatgtttacctatttttaaaaatgcacttgtgacaactaatctcctttatcaatttgctgaatcatattaccttcttcagttccattaacctaaaaggaaaaatacaattaaatttagtctcctttcaattgtttctaaatatgattaatctggtgtcaacaaagtatcgctgtacttcagaatttgcctgctggcctctaaaaagccaaggaaggggtaataacttttaatggagtaaatacttgtttatttttctgaagttaacttttttgttgttattgttgagatttttctgttgcaaacattgtgtacagtcaaaaactctgcgaataaagaaacagagacacttataaatacatgtgtactttttgattatttctttagaatcagaaagacttaaacccatgtacattttattttggcagaagatcatgtaatttttccacaattactcacataccgcagcagaggacacaaaatcattccaggctttattaatttcaaatacccaaaactgtcttgagaagaaaatacctttatattattttatttgatagtgaagtcttaaagttctatttctctcataggttttttgtttgttttagcagttagctaaaaagtttcccaattaaaacattttagtacttaatcctatggttgtcatgcatgagactggttcattaacaaggtggaaggtagaatagtgaatagatttttcacaatataatgagcatgataataataatagtagtagtaataagaaataacaacaatacaaagaatactaacagcaaacattctttttgagtactttccacctcactggtatgcggttaagttctttacatacattattccccaattaaatctacgagatcagcgcctgttttgctagggaaactaggctgtaaggaatgaaatcactaacgcaatattatatagctaactattggcagtgctgggactcaaattacattctgaagatgaagcctgtgtttaataatcaagttctaccactctttctactttagaagaaaatcagtatgatttggttaaattagatgctctaacaagaaggaaatagctgacccaaattatagatggaaaactatacggtaagatagctggattgctagacaatagtcagcataatatcactattattaaaaattcataaatatttttgccatcctaggaactagtctttaaacttactacataccttgctattcaattgcaaaatgtaagatttaaaaaatggctcttctttaaaataaatgtcaaaaagaatggtgttatttatctttgaagttagcaatattaattacttgaaaattagtaaaattgtctgacgtttaagaggttttaaacggtctcctaactattatacttttagattttacaaaatgagtgttcaaatatcatctggtttataattaatacataaaagccagtgaatctaagtgcacgtacatttttatttaactgtgtaattactgattagtagttcataaaattggttttgatatattttgagagcctttacaataactttgcaacttttaactcatgcaaaagtgattcagtataaagttggactaaaattcagaacagaacttcttttacgaagttaacagagataattgatatttcactcaatgatgactgcattaaaatcattgacacacatttaacattcataactgctctaacccttgaatttggtatatggcaatatattgaatctaaaactcttaattgctttctcatcaatctatttctcccctggtcttttcctctttgtaaatggtaactctattcttgtagttgctcaggcccaaatctttatcatttagttgtcttctacatgtcatttaaatcaaccagtaaaactcattaatgtcaacttcaaaatatatccagaatgcagccatatttcatcactttcaacaccatcaccttagttcaaccagtattactccctacctggtcttgggcaataggttcctaactggtttcaccatttaaatccttactctctacgtcttccatgcaaaaaccaggattggtcactgttcatctagccaaatcctaccattcagtaaaaccaaatcatcatcactatctctggggtcatgtgtggcctgaacctctgctctttttctgtcctcattctccctgcccagttttgtttgtttatttatttgtttcaatcactcagctcttgctacattggtctttccttgagtacacctaatgtggatctgtccttgatgcttcgtgactattttcctccctgttcaaaatattcttcctccagatttccacctgtcccattttcttcatcttttttttttaagtctgtgctcaaataccatttagcaaaaagccttctctgaccaccctatataaaagagttaggtctatcactctctggaagcttttttatattaataataaccatcccttatattctaggcattctgctaaatgtattatatctgctatttcataatcttcaagacactactgagaggtaggttttattatttctcttaaataactgaataaaatttaaataaaacactaaaggtatggttaagcttcaaaccgggtctccggattcctcagtccttgttctccatgaactgcataatcccatttatgcttcaaaactctcccaatttaacaaatagggaatgtgaggctcaagggtttgaaataattgcccagatcacacagcaagtaagtagtagaacaggaattcaaatgtaggttgatcaaatctgatgtttactcccctgcaccacactgccttcctgtggacaaggtcatatccttattgccaattgccagccaaagatagataagatgagttcactctccattcttctgggctttatttttgcttacttactcaagtctcacataaatacatattcatcttagatctataacttggttgatgtagaaatataagaaaagtgcacatatgatatagaacattaacaatattgacattatcccagaaattatataattaagaattgaaatttatatgattttcattgatttttttcttcttttatttgctaatattctatcctctcaacaacatactgctaaactttgctttgttcaatgtccatgcttgatcattgaattaaaatccctctaaaataataagtaggacatatctcaaatatatgtatccataatataaaacatattcatttagaatctttgcaatgtaccattatactaaggccataataaaaattctcacttgtctgtatacttggtgaaagaataagatcaactgaaccatatagttgctttatatagaaatcagcctgtacatatctaattgaatttactaattgtcacaggtgaaaaaaaatgccattttcatactgaaatcaaatataatcctgacataaaggtcataaatttaaaaatttatgcaaagatacctcaagctactactggaacacctatatccaacatacagaaagaatcaatacaagcattaatctgatagtcagtattagacataaagtgactgaaatagagcttgattacaagagcaatgtctcctgctttgagaataaacatttcagttttgtctcagcatttatgtaacagcaggagagagaagacaagttatcttgtgacaacatcctgcagtatgtcattgacattatcttataattagacttgcattaaagatgattaatagtatcttctttggtgcctaatcagtgcagtctcatagcatatacaaaaatgagtattttagatcactttaagtcagtattacagcagtaaaatcgttatgttccttttccctcaaagccatctcaaacaaaataacaatattttcattcaatttttgttggtaacagtttgaaagaaaatgccacaagtatttagagtgttgaaattcaaattttatctaattaacctgaaactcctgtattttttgaatccagatttaaaccactattgtggctaccgctaatagctatatatgaattaacagaaaatgaaagatttacttctaagagaaacataacacaagctagtttcatgtgtagtcaattcaaagttttatgaattattggactcagattacctacaggcctggaagacagtggctctgtctactattggagatgctggctcattgcactgaaaatttgctatttatgtataaaggataagattggacttagaaatctgtaaattaagctaagtgatttaaagccatgcagcgtacatgtgagacacaagaatcaaacccttaagctttatttgtgaggaagtagcattcatgtgtgcttagcctaccaagggggatcagcaaatgtttgctgaatggatgcatgaatggatggagtggcttcatagcacaataaagtcatgtaccacaatagttagggggtacagctggaaataacaagtctttataaagtgaccagactaaaacagctttaatgctgtcccactgctacctatttgcctactgggatctgagtgatttgttgagaatgaagtatcctaggcaaccatgctaaaattatgagttcagaaaaggcgaactatttaacaggctagacatactgatggaagctattgtggggccttcaatttaaaatttgttgaatttgtgtacttagttccactgactctgtattattaagaaattccactatgggccaagcgtggcagctcatgcctgtaatccaagcactttgggaggccaaggcaggtggatcacttgaggtcaggggtttgagaccagcctggccaacatgaggaaaccccatctctactaaaaaaaaaatacaaacattagccaggcacggtggagtgtgcctgtaatcccagctacttaagaggctgaggcatgaaaatcacctgaacccaggagacggaggttacagtgagccaagatagtgtcactgcactccagcctgggtgacagagtgaaacactctcaaaaaatacaagggggaacacacactggggcctgtcagggagtggggggtgggagagcatcaggataaatagctaatgcatatggggcttaatacctaggtaataggttgataggagcagcaaaccaccatggcacatgtttacgtatgtaacaaacctgtacgtcctgaacaggggcaaaatgccaccagtcattttgctaaaatgcaacaagagtcacctatgcttcacttcccaacaagttcttcatctccatcagcctcagcctcaatttcattgcccatatcactatcagcagtttggtcaaagccattcaacaagtctctagggagttccaaattgtctcacattttcctgtcttcttctgagccctccaaaccgttccaacctctgcccagttacccagttccaaagttgcttccacatttttgggtatcttttcagcagtgacccactctactggtactaatttactgtattagtccattttcacgctgctgatagagacatatctgagacagggtgatttacaaaagaaagagttttctttacagttccacatggctggggaggactcacaatcatggcagaaggtgaaaggcacatctcacatggtggcagacaagagaagagagcttgtgcggggaaattcccgtttttaaaaccatcagatcttgtgagacttattcactatcatgagaacagcacaggaaagaactgcccccatgattcagttacctcccaccaggtctctcccacaacatgtgggaattcaaggtgagatttgggtggggacacaaccataccacaatgttttagaatacatttggccctataaaactgtagattcaagtctacaataatttctcaaaagttttcttaaattatatctttctctatgttttaaattttcctgtttatacagtttgtttctaccagcacatcaattttctattgatggttcatttatttttcaatattttcaatattgaaaattttattgaatattcaataaaaaatattctgattctggcaatcagaaataataggcaattatttaatgcctattgtatgctagacagtgttctatactttgtttcataactttttctgtgatatatatatataattttctttacaatcatcttccaatattctttcattttgactcattttgcttactttatcagttctgttctctgagccccttattactctcatcagtgactttttactgcttctattttgactttcacttctgtaactgctttatatttacctttaacatcttccttagtctctcctggtttgggttttatctttgtgtcactatacattctgaggtattgaaatactgatttgttgttttgcatcgaggttgtttgggggtatgaggaagtgagaggttcataaaataaaacagtgtgatttccttctgctcataccaatatttttcttgttgcttttctcagcctgctccttcctccctttctttttctctttttgttttcccacattattgtatagagcctatacttgttcattttcttcattattgctcttaaatgaagtgagtacaacaaaaattgggactgttaagtgcagagtatcagaggtttcctctaattaatgggaagtttcttaggattaaaaataggtgcacatgtgattgtgtaagtgtgtatgtttttgcattacattgtatacccctctccctttaattttgccactcactgattcagctaatggcaagatctgagaacaaaaaaacccatgctcattcagatgctaggaaaacaggctgaaaagagcagagaacattccccaagcccctattttactaaggactctttgtaatataaaaaatataaattttttatctgaacaaatgaccattttatatttctatataaaagttggtggtttaataatacaggactagaataatgtagatttttaattttcatagaaattaaactctgtagccaaaggccctcagagattactaaacacagaaggcatattgaaaacagaagattctattttgacagaaggattagacatatttttgttactgagaaaatactatttattttcatagactgaatgtttgagtccccccaaaatgttaaaatcctaatctcccgtgtgatggtgttaggaaatgtggcctttaggagataattaggtcttgaggatggagccctcatgatgggattagtggtgccataagaagagaggagataacttgctctctctttctctttttttctaccttgtgaggatacaaggagaagatgtacatctgtgaattagaaaaagggtcctcaccagaaccaaatgtgcagacatcatgatcttggacttccaagcctccagaactgtgagtaataaatgtttgttgtttaagccactcaacctatggaaatttaatacagcactctgagctaagacattcatgatcacttttaggtgcctttagttctggtagtcacatggaagatatatctgaagagtctgatctcctcttcactctgcgccctttccactttatagtggatgcacatgaaaatgtattttgggggccaggcacggtggttcatgcctgtaatcccagcactttgagaggccaaggtgggcagatcacgaggtcaggagttcaagaccagcctggccaacatggcaaaaccctgtctctactaaaaatacaaaaattagctgggcatggtggtgtgtgcctgtaatcccagctactcggaagcctgaggcaggagaattgcttgaaccaggacccggaaggcggaggttgtagtgagctgagatcaggccactggactccagcctgggctacagagtgagactctgtccccccccccaaaaaaaaggcaaaatgtatttcggggaaattcctgcaagcatactagtcttagcaagtattggtgtggcttcacttgggaaatgattgctttttactgattgtttgctctttctagactttttagttacattctttcacaggaaatatgtttgacttgttgttattaaagtacatagtgtttctctgtggcccgttttgggtcctagcaagtggctgatggcttccttgcactttcacacactcgtggcaacattcaaaagaaaatgaagtcagacttggaccaagatatacgcctttagatgatgctatgagatggtcttttaaaaatatttcatcaaagttctttgtcttgaaagactaacaatgcttgttagattgttaatttttgagatccatgtgacttatatctatattttcatatcattaaaatatttcactggctgttgagatataagtcacaatctgccaatttgtcattcttttcaatgacatctggatccaaaatcatgattggttaacatgtgaagttggtccattaattttatccaggaaaaagttattggaagctacatacatagttttaagatttaaaatttcaaatttctatgactaataaactacagaatccctcatgccacatctctaacacattgattccgtaaatgtttcttaaattatgttcagtgctaagatgccaataaagtttcattttagatgaatacaatataaattgatttattagttgaatatttgttgtatatttgggccaactgtccaagtgaatttattcagatatccacattttatatataactactttcacatttctgagtaatttcattggcacatttttatgtgttacagaagtactttatgatttggtgaaaataatatttactttgattttcatatcgtaccatagctatctaagaatctacctttattatctaattataaccatcctgccaacaattctacctctagatttgttctattctgcatagacatatctacctagaagagcctacctcagagaggaatttccctctgaagtatcattttcctgtggcctgttttcttgccttcttgttttgatctttcaggcgatgtgactttcctggctatagttgctctcctgagtctctgacctcccaacataaaaaggcctcttctcccttgtgttgcctccgggttttctctttcattgttatgtgtgtaagccttccttctgcatgactgattgactttcttccctgatctcctgttttggaagctggatcatcatgaccacttacctgaccgctgaaccatcagccattctgcagtgtaacttttaacaccttttagggttccttaaacctcacatttttatctactgagactgtgatataactttaagcagtaatattaaaacttgtaatattcatttacaacagacattttttctgcttttttaagtgaaaagttgaatattagcaatttaattggatcaacctaatattaagtgtaaacataaactgtgctgctgaaaatgttcagaaattcaaactcctctacttcaaagctctgacaccatgtcacgaaccaaagaaacaatttagtagctcttacataatagactaagtatcatcaaacaacactgtttactttctaaaggcaatactctaggtgccttaatgaataaattttatctataaaaagtacttttaaaattatattttattgtggtaagtcattaaggagcaaattttctgacaatattttaactagttttgcacttaatccaataatcaaattaagttttatctatgttattatagaactgatacattcttgagaaagatgtatatattgattcatatgagatttttcataaaaaatatattaaagaaaaatagcccctcatatgcaataatgggaaagccacatggatttatattgtagctatggtataagagatcatgtccttattataatcttcacatctatgtttacatatgttatttataaatgtacattttgcaatgtcttgacatttgttagctgtgaaagactatgccaggtatgtttcaggggaaaatgaaagtgcttgcccagaaatataaaaacaatgttgtctcgtctcctaatatttacatttttatttctgttgataaaatagacttcagtgtaacagcatctatacagaataaattcctgatttacaaaatcttctgcaaacaattattggtttctcactgcaaagtatagaagttgctactgtcaaatcagaaatatttccctttgtaactgtctgtacttgctgttgccctatcatcgctataaagggattttttaccttgagtaagaattgagcaatttgcaaaacaggcaaaaatgaggagtagacataacccttctaagagctatgtactcaagccccatcatcactccctccgtgcaaaacaataggctgtaaacaccatccatgtctgtagcacttttccacatgtctttattctttcaggatatactcctaaattaattccagctcaaactacttttagctcttcactctgtttctcatttattatcctacttctacttcctcagatttagttctcccctctctaaatagtgactgtcagttagtcttcatggcctctggcttgaattgtatccacaaggttttctggcttgcaactactttttaaaatttatagacaggaattgatctctaagagtggatccatcaaccataatcccaaaaggagaacaatttgagatgtggtttccatgttggccttcatcctgtgccttagtttagatttctttagctttatttcagtttttattttatctcctctatttccctcatttcatgcttctctctctttcccttgtctttctttccgctatttaaatgctccagaacctttttattttaatgtcaagtaacacgctccaaaggtatcacctgggaggaatgaggaaatatgaaggcctagaaacctagggaagaaaatcaaatgcaatgaatggaaggaattgtaataaacacacatggtaagagcatggtggagtggatgctttggtgatattcccagatcccctcccttaaagactaaagtattcattcttcccagctgctgtaaatgctgacaacagacaacagctgggcaaggggagcctccttgtctgaggtcacacactctccctgggagcacgtcgtatctattgactggctagcaggaagataaaagacttggttcctttgcttcagggattactgtcaagagtcattccaattctagagctccccatgagattagctgatgcctttttttgagacttcattgcagttcaactcttctcaatccaatttcctccactgctttgcaggtattgatctcaacaaaattcttgcatgcaaatttccatatcagaatcttttatctaataaacttgaccagaaataataggctttgggggtcagagagatctgggtttgaattcaactgcacttttacttgctagctgtgttactttggggtttattttctctataggcaaaaatgggtaataagaaagcggaagtattctacggtggtgacatccttgaagttgtacaacataattccctgaaaaaaaccactacataagtgaaagattaaatcatatatttaaagcagttactgttttgcagagtagacacttaatacattttttgttccccccttttaactttggacagattgaggaaaacaagaaggaaaccaagcaaaatagtcaattaaggatctaattaagggtagagtattccttatctaaaacgtttgggactggaagtgttttggatttcacatttttttctgcctttgtaatatttgcatatatacaatgagatatcttggggatgggacccaagtctaaacatgaaatgaatttatgtcttatatacaccttacactcatagcccaaagataattttataaaatattttaatgattttgtgcatgcaacaaagtcttgactgtatttttactatgacttgtcacatgaggttaggtgtgaaaatttccacttgtggagttacatcagtgctcagaaaattttggattttggaacatttagcacttcagagtttaagattagtgatggtcaatctctttcatttttggagtataagatagttatcttagaatcaaagagatttttcagttactttaatgggatgaagacaaattaagatggacaagcaaactgtttgccactgctgagttatctttattttgacttgaacctattaaaccctttgtgttaggcagaaagtccttctctgtcccaactatgtccacgtctcaatctctacaacctataaatatgtttccctatatagtaaagtgggctttgaagatgcgattaaattttaggatttggggagggattattctgaattttccaggtgagccaaatgtaatcacaagggtcctcaaaaatgagaggcagaagagaattagagagagagatgactacaaaagaggttagagttatgcaatgtgagatgagttcagcctggcgttgctggctttgcagatagaagaaaaggagccatgctggaaaacatacaaaagtagctcctcccatagagccccagaaaggaaagcagctcattggacactttgattcttgttcagtgagacctgtgttgaatatctgacctatagaaccataagataatacatttaacaaatgtgtatgttgttttaagttactaaattttaattgatttattacagcagaaatataaaatgagtacacttttcataactcatggaaaagttatcaaccagtaggccgtgtctagcgaccaaagagcctcaaccacgtggaaagaaagggaacaagatgggaaaccagtaagagtatgacgttaatcattggaataaaatatatttggcatataccaatggttgatcgtatgtttacaatatgtttctttcacactaagcttgttttgccagtaccatctcttgaccttctaagatgcaccttctcttccccatttcctttcaattgcatccataaccagaaaagttatatttcccatcacattgagaaatagctgaaaactttctttccttatttttgcctactgctcaccttattttgcttaatattaacactctgttaattcaaactagctcttgatctggatttttatctctcaacctctacctaaattaacttttttcctactatttctccagaaataagcattgctctcacttgttttgttgtcatagtttatttgtatcacaaggaaagactataatcacaactaaacatccattgattcatcaaaatagaagaaagggaatccctgagtttttatgtgatttgaacaaaatacagagttcaggagaagaacgcagtatgtagaggactaattaaaatcacacaggctccagttcagttcctgctcctccaattggtcagtatctcatgtcaaggaaattatttaaatgtctaaatcacactttatcccctatgaaagatgggctatactgacccaacagagttatgtgagtatagtaaatgatcataaagtactctagcaagataacagataataaacttcaaataaatgttattatttttactacaagaaccattgacattaataaatattgtcctgaaaaagctcccaacattatattcaatgccatgttatctttgatggcttttgtgcccatgtccacatactcttctaatttatagtctgttcttcatgcaacaataatcaagaaaaaagtgaaattgaatagttggttttatcaacttgaaactttgtttttgaaaattatatttaaatttctattataaattatgttagaaagcaagtttattatttacaaaactatttttggaaatatgttctgagcttccaacaactgtctataacttgaattttggcacctattattgtaatattctttcctggatgtctatggcacgtagatattctaatagactatgacttagaataatatcaaagggaaattcaatagaaattatcagtctttttggcacaaaatatttcaaatggaatctaatgcctaatttttcccattgtatgtgttggcatattaacttagatactatagacttttacaattggcataaagtcttgattatgccagataaaaaaatttgagagatctgctgcataacattgtctctgtaattaaaaatactgtagtgtacatttaaaatgttgttaatacactggatctcatgttaagtgttatactacagtaaaagaaaataaatcagagaactttaaaaattaatttcccataccaaagattattgtctatttatttttaatagtattgaatgtttagctctttgaccaaatagcattattaaataaatacaggcaaatactaacttcatcaaagtcatatttaacaagactttgattgacttgccaacactatgggtgttgtttttcctctgggccatggctgagactgagaattcctgccctctctcttcgtaagcatttctgaccccctggacatttattttggtatgctgtccacttggggacaagttgctatagttgtgaccactctctggcctctttccctagaaaaagcagatcaacacccttctttccaaaatgcagcattttgtttttaacctaaattcagtaattagatatttaaatgctattagatgtaagtaaattgctttgattttttatttcactcttagtgattttccagtggttcatttgcaagaggtacacatgtttctaccacaaaactcattacagatagtctagccttagctcaaattttaagagtttgacctttgttttaattaatgaagtggcaatattaaattattaaaagtactggaaccaaaaaaagtgagaatcatcctcaaaaatattttaatgaaccccagagtaaaattagctaggtgaattattaaaaactatattatagttaaaatgctttcctagtatccattaattaacacaattaatttcacctttcttaatgaacataactccattggcatttggcattttttcctctttcttgggtttctttctgcttatttatgtgttttagcagtaaagaactgcaacctcagcaaactataaattttatttttggaacacaaaatattttcctgggagccacgacttaacgatttatggagaggtattttatttttaaatatatagaggatctgcaagaacaacaacaataagaaaaaactttatatcagtcccagaaaaagtggttctaattaaaaattaaggtagagtttattaatttagtaaccaagtccataagaatagagaacaactttttctttattcagtaatgcagaattaacattaaatctctttgataattctaaaactatccgtgcttttgtattttagttttctacacacttaccagctcattggtttctggattagaaaaataaagttaaacacaaattgaggagcagtactgactgtgcggaaaatatgctccactcttaaaagtatgctaaatatattttttaaagtttctaattaaaaattatttacttaccaaatgtgattgcacatgtcggctttatttaactgatttaatattttgattgcatacctcctaaatatgttttcaactaagataattgtgttaatttgcatcttgaaagggaatctttcaagacagagaattgtcttcaaggtaatctctggtgaattaaaaatatattttttcaacaatttatgatataatttttaaacattaattccctacttactctataacccccgaagttctccctagggttatctcgtaagcccttcttaggaaatgactataagattgtgccttagagaattctagagaaagctttttaaagacaggacttattggtctttacataactgaaaaacacgtcaaagaaatagaagctcagagttcaatattttttctttagcataggatagataaaattacaaaaattctttcattgctgcgttacagaatgacaagaataatgttatagtacataaatgacaaagccttattatctacactgctatactgaagtttgagaaattctgaagtttccaagcaagtctccccacaccacaacccccagaacaagtatctatctaaatcaaataaaaactcagggatactaggagaaattaattcaaacttgacagatttctgaccccagttgttagtgtaacactagaatagttaggattaagaaaatggggctcaagctctctgcctcgttatcaggttctatattgttactgcttcttagtgaggctgatggagtcgaattagtaggtcaagagagcaaagctagtcagttttttaacagtgctaccaagcacgtcacatttggaggactcagcacagaatccaccgaaaacattttgttaattttgtactcatgttctaaacattatttaaaaaggatcaaacacagactctctcattaaagagatattgtcaagcctgagtttgattatgtgttaactgagaacaatttactgcccaaagcccctatacagttaacacaataatttagatacaaacagaaagaaaagtgctatgaatcttgcttcctggagtgacagaggttggagcgtgggtgagatttcaatgaactacatttatgagtggccaggaactatagataacagcatagttagatgcaatattttatctcaaattagacccagacattgtgaagcaagatgtccttctagcaatcttagtaagtgttggcagcaagaataggtttcaatccaacaatacatttctaaaagaagcagataattaagtatcacctaattatcttccctatatcttttgaaaggttaacactttcatgttttaaaatcaaagtaataaggggaaaaaatgtagtgacctgaatatactccctaacctttaaatttctaagactttttttttttaacatttcaaatcctatatgtgggaaaattatattataatgggggaagcctccttttttttttcttttagttcaagttttttccaagtttcttgtatttcactggaaacaacatagccagatgaaatatctccaactaaagtgtctttacaaaacagacaaacaaaagtacattaagggggtttggatttttaaaggaggagttactttcattacacgtactaatccccaaactctcccctttacatttgacagtggcctcattcctggtattagctaatgtcatcagtgttaacttctatttcagtagagaagaaaatgtatcttctcaagatacttttaaatctttgtttaggcaaattctcaatatacagtaaaggaaatacaaatagaaatatttctaaagtatctaaagtctttgcttgaataacgatgaatagaaataatacacaaaaagacctgtgttctcttcaccccttgatgaaatgaaatgccacaaataacaagtgaagctccctgtattggcctccttacttcctctcccatcctctctcctcatagataaccactttcttcagtctggcattcatcatgtccatgaatttatgctttctttatgtatgtataggtctctaaaacataaacattagaggcacagtggctcatgcctgtaattccagcactttgggaggccgaagtggatggatcatttgaggtcaggagtttgagaccagccttgccaacatgatgaaaccccatctctactaaaagtgcaaaaaatagccaggcatggtggcaggtgcctgtaatcccagctacttgggaagctgaggcaggagaattgcttgagcctgggagacagaagtttcagtgagcctgagatcatgccactgcactccagcctggacgacagagtgagactctgtttccaaaaaaaaaaaaaaaaaaagtaatgaataaatgtggcagactgccacagttactacttgagattgtcactacaacagttactactgttactacttgagaccatcattacaagactgaatgaaggaggaggaatgcagagatgctaacaaaaaacaaaagaaactgttttcaaaaaagggtccagggaagaagaagatagctccctgcttctagtgagcaaaggcagcagccctgagcttctacagcccttcatatttgttgggtagaaagagcagggaggaggaggtaacgattggtcagctgcttgattgatcacaggttaacattatcactaacaggcttcagatttgcctaatcacaagaaacacttgtgcctgggttctgactgccctcagcattccttcttggcagcagatgcagtttgtcaatttgccaacatcctgctttcatgagaacagtttgctgtttactaatgtagcctccagtgatttactgagttgatcaggaccctcactcatgtagcctccagtgatatactgagttgatcacgactcactcatgtagcctccagtgatatactgagttgatcatgaccctcattctttcggccttcaataaataaaggtatgtatttattttgtagtctgttcttttaaaagccaaaatgtgggtctgtgagatacattcagattgataaaggtaactcaaattccttcattgtcactgctgactgatattctattgcttgaatttgctaacacagtctacttactcatccactgttgatagtacagtaggtggctccaataaattttatataagtaatgcaaataatgtttaacactcttaaacaagtatccttatacatacctacgaaggaaattgctgagtgttggcatgagcatgtctttaaatttatgtctactgacaagttgctcttcaaagtgtttacatcaatgtatatacaaatgggcattgtttaacatttgcttttgctacctgattcatgccaacacttggtatggtaagataccatttttagtattctgatagctgtgaagtatcagctcttatttttatatgatttttcctaattgaaaccagttgaatagttttccttctgtttattgagcattcatttttcttcttttagaattcttttttttcttttgacagagtcttgctctgtcgcccaggctggagtacagcggcatgatcctgcaacctccacctccagagttcaagtgattctcctacctcagactctctagcggctgggattacaggtgtgcacaaacacacccagctaattttttgtatttttagtagaggcggggtttcaccatgttggctaggctggtcttgaactgaactcaactgatctgcccatctcagcctcccgaagtgctgggattacaggcatgagccaccacgcccgacccatatcttttgcctatcagactgcagattggcttgtcttcctcttcatattcacagaagttcttttcatattccaaataataatcatttgtcaattatagaccttgaactttctcaataaagtttatctttagtctttcattttgtgtttgtttgatgcacaattatcaattttgataaagtcaaaaaattttttaactatgaaaatatttatgattttgtcttgcttaagacattattttttactctggactcataaattgttctcctatatatttttgtaaaagtgttaaaattttgtttattacatttagatcttgaatgcagtacaaattattttgtgtaatttacagaaataataattgtgagcattttggatcattcctgaatcaaaggaatggttctaattttcatcattatgtgtctggtttgctaaagtttttttgtactgttatatgttttttgctctcttatcaactgcctttattttttgcttttaatgacacatttaacaaattatttttatatatgttctcctttgatagatttattctattataaatatcctgatattgagtcatccttgtatatttgagatatcatacaactttgtcataatgcagtagatatacatacatatcaggatatgatttcctagtatttgcttataattttacatctatgctagtacttgatattagcttttaatttccttcctcattctgtcttagattcaaatgtcataaaatgagtgggaaacagttcctttctttgtaacttctttactttgtaacaaatttaaatttgtaagtatgcttcagaatatttgctaaaattgcttttgaaaatatcaatgaatgaaggggtgaactgattcttaattactgactgaatttccttcatgggttttttcttttaaggttttcatttcttttgttatcagttttgtaaatagcatttctctatttgttctagttttcaagtacactgaaataaatttctttataatattctttttttgttacttgggtttctatattttaattcttgatattcttaatattgattcttaaaattcttcatgatcacttttgttgtttcaacctgtattggtagaatatttgtctttcagtaaacaaatatctaattttgtttactctctctaggtttttattctataactttaatatcatctcttacaaatgtgtttaactctcctcaaatttttggagttcatcctggctttaaagttgataatttggtcattaattttttggtcttcctcccacaaaataaattgtttgcagatataaatttcctgtaaatttctataataattctgttgtaagagttttaatatgtaatattttaccacatattatttctaacttttttctaatgtccaatatgattctttcttttttgggataagatcatgctatggtgcccaggctggactcaaactccctggctgaagccatcctcctgcctctgcctcccatgtgtctgggatttcaggtatgtgccactgtgccccactctatgccatatgattttttaaatctataatgtacatatgattttgaatgtctaagtaaacatctttttacatattttctttctgtagttgctaaaaattcaccttaacattacctttcatgcaaaaatgtggtttacctgataattcttgaaacatagcatcacttacataaattttataaatccaaactgccaatcttgttttataattgttttataactgtctagtttactgcataataatatgttggatgtgtacttattttgtcttctctatttttattgccttttctaagcatttttacaaatattttcttatttcttttgcattacttgagatttgcttcctcatgttttccttttaccggtttggaagaatagagtaaccttagaaccatcagatcccatcacttctctccaaagttacacgttcgaattttactttgttgttgacctctcaatcagacaccattaatttattcagccaatttattttgatttacctacttttatacaagctgcttttcttctcgtaagcaaaaccttttattctgggcaaaaataaattttagcacttccttaagtgaaaattaattagaaataagctctcttgctttgtgtagaaacatattttcatttcctatttggcctccaaatgataggttagcttattttcaaatcatgggttgacaattatttgtttcagaactttaaaaatattattctcctgtactctgacttctattgtcgatgttgaataatcagttgtcactttagttgtgttccttggaagataatttgtcctttccctctggaactttaaaggttctctcattctctctttttctctccactttgtagctttactaagacaaatttgaaaattttgttggcttgtttgagtgtttgttgttgttgtagtttttgaggtggtgtgattctgcataggatttattatgatccctggattcaaaatttgtgttctttgtaaattcagcaacattttttatgcactgttactttaaatattagctctctcaccttctatttatcatttacttctggattctaatcgcatgcttctctacttaatatttaatttcttttcattttttaaagctctttccctcatgttttactctatcttctgtttcattaatactccttttagctgtgtttaatatttatcagtcctctattgtggattttttctaatttaaatattcatattttacatttatatacattgaatttggcttgtttttcaaataaattggttttgtaaacaatagtgagaccttgtcaaaaatattggtataatatcacctgagttttataaatcctctttatatctacaactgcaacatttttattttccttccctaaaaattctaacatttttgtgtacaattttgacattgtatatgatagttattatcttagttttattcagttggtacctacatgcattattttatcttattgataattgtatatatgagtttttttcttagtaaattttcacttaatattatagcaatatcctgtatgacaaaatgataaactatgtgttcattagaaacattatataatagttgacaagtgtacagacttttcaggtggatgaataagaattcatatgcggtctccaacagttacaagttttgtaacttatttgatttctctaaacttcagtttcctaatctagaatatttggatagtaaattggtagcattaaatgctaaaatataaaatagtaacaatataaataacatctgatgtttattgaaaattacactaagcctttgatatcagtcagacatttttatcctcaaaggagaatatgatggtagtcctattactatccccactttacaaatatatgtaatgcatgtaaagcttttagcatattgcctattacattataaattctccgacaaataatggttattattatgtttacaacccttcaatttctgaactcatgaatattgtattattaagagtggtataaaagagcataaaatataaataatatactgtcaaaaccaagattcactgggccactaataagtatttctgttaattccttgcagtaagtatatttgagaaatattataactatttagttactagttcaaagtgccattttttcagttgctaagtaatagaaatatggcattaattcttaaagtatttcagattctctacctgtaccactattgttcccacctcggtcacttatatattctcattctttctttgagaaaatagttgtaaagactttcatcttttctctctcttgttcctttattcttgctctttcttttctttgtagctcctcaccataatgtatagagtaaaaactttcaagtcttctaggatgacaaaccctgaaggaaatggaagagtgaagtttctaatttcttgatttcccttttcccactatatattttaaatatataatccaagagctgctacattgctttgatttattatgtggaagaggaaacttgtaattattaccaagcaaaagtcaattgatattgaggaaaaaatccaaatagaactatcccccaaactttgcaatagcccctttctttatttgtcagccatgtttctttttatttgcctaaattatttcaaaatgttttaccaggatataaaattcagaaatgtatttaaagaagaagaaacagcagaaaggagataatgaagaggtaataacacgaaggtaaaatgcataatctgaagttctgtgtacatggtcacaatttgcatttaatcaacagtgattataagataaattgaaggaactgctcaataatgattacagtttctgatcttaacaggtagaaatttttcccaaggatcataaagtaaaatctgtatatcaaaaaatagtgtccctaataacttatatccattaaacacgggtataagtttcatgttttttataagccatcagcatcttatgaaaatgctatatccttctttaataattttgatattctgaaacatagacgtaaagttgccttccatgaaagtctacttgtttatgctgtaggaaataactagaagttctaccaaaagtgaatatctacactgaagggctcacagatattttttacttttaaattaaatttcactaactataatttataacataaggaaaacccgtgctttcttgacttaattgaatatctagttcccctttcacacatatcccaactaaaactttctccaaatacttcttgcaatctcttgtttagtcaatgtattaggtacttcatgaaggcaattccctttgaagtcaatttgtcctctaaaagacttaagagaaaatccgggcgatagtagacccaagagccagacaaacttactgtgttttaaaaagcagctacttaaccaatgtttcattcaatcgaaagtggttcttttcttggatagttatgtgcacatccttaaaatctcttctgagatcctcatcaaagcttcctgagaatttaggtaaattgatttacttagtctttcatcaattgctctgtttactctttaggagtgatacaatagggcaaagagcagttaaacagaaattcaccttgttaatttttaccacctttcatatattacttaggcacatgacatacagacagacactcagtgggatcattaatggcaacttaaaaaacaattcaactaaaccttgacttatgatcacatttttgaatggtaatgtactcaacaaaatacaataaaactcaactttataagccatgttttctgagctttctctaagttttcctcttacttagctcaatatttgctcaatttgtatgaaaagaagtgtttaaagtacctggtacagggttctgtcaaaaagacttttgtccagggacacatagaggctcatataaaaacaaattcataaacttggcctcattaatgccatgctctaatccaatagtgagagaggaggcagttagaggctggctaggcagatagagagggagagtttcaagagagagacggtgcctatgggaatgcacctgtatcgcccctgtggtgtaactagcaggtggaaatgtggttaagaacttcctcttataccaggatgtctgctcagaagggactgtcccaacttaggcacaggcacaataaattaactatgtttccttaacttgacccactgctaattgtaatatcattatcattgtagttttggcaaaccctgtgggtttcacttagggtagtaaccaaggtggagtcactatggccaaccccaggtatgcacggatgcatcacccctagggggaactttagctcccccatcagggtggaacccacagaagacttccttgtttttgccacatgaaagaaatagaactcagccccttactggcagccctcttttggggcccctctactgctgagagcttttctgttgcttaataaatcctactctgtcttactcattttctggtgtctgtgtgccttattcttcttggtcataggacaataacttggacctcactaaactaaagaataaggagacagcaacaatagcttccacatgtggatcaggaatagggtacattaatttattgatatgggtctgaaaattcacatatgcagagttacttatgtatagaaatagctttgtgttgatatacactgataatttgtgaagatatttatttttaagttagattataagataaatttaatttaaagcatggtatattcatgtttagtttgcatcgttttatcattttttaaattttctccatcattgcatcctaaaagtagagctaggaacatgtccggatctcacagatgaaaatgttcaaaacacttctagataccaaaatacctgtgataataatcatacagtgtatcacagccaagttgtcacagcacacttactggttataaccactgactttttctaagctccttttgtgtatcagaagctttttcttgactttgacggtgtcgggaaatcctaatttccgcagttcactgggaattttagatgatttaatctgatttttagacggtgcttggtcaaaataaaactatctaaaaactcacagagtgacatttaaatgccaagaaacttagacatttcaatctctttaaaacacaataaatctctttgttgaatactccagtttatgcatgcattcactaatctgctcattagttttctcattctccataaatttattgagcagttttgtgtgcaagacagtatgctgagtgctggtgtgatgttttccaggaatttaacaatatagtgggagagagattatgaattacaaaaataatagaagagccacataatgctgttacagcctcctctatgagtactgggaacatttggaagagaaagatacttaggaaaatggggtggagaaagaaagcattatgcagaaagtggaattaaagaaggatgctgaaagttgtggttgatctcatgtgtaatttgggggtagagatgggtgtggtgttgggaagataatcagcatcctagtttgaggaaaactacaggttaaaagatacaagcaagaaaacacaacatgcactgaacactgattagaatgtctgcctgtagttttgataagactggaaagtggaaggcagatggtagtaaagaccttgaatgtctggctaagaattctgaatgctgtgttatgcaacagggaatcctaaatattcctgagtatgaccatgacattgtaagttaaacacttacaaatgcacttgtgatgtacactgtttaaaatacttttgcaaaaaacaagtaatttacttttcataacaactttctaagatgcttagttttattatccaggtatttcatacttggagaactaaaaaacggatacgttaagtaagttgcttaaggtcacaattaggaagtggtagagctgggattcaaatccagacaagtctgtttcaaattctgtgttattaactattacactatcaaagtgagggaaccgagtcagattttaagattaatttgagtgcaaatatgggtgtgttcaaagaactggaaagactaagaacagaattcaataagaagaattttcagcagtatgagcatgagataatgttatttaaaccagagtggtggctgtaggaaacggatgggtgcaatagatacaagtgtccttaggaactcacaactacatataaaaactacagagtaagttaaaccatgtcatttctcaaagaatctatgtctaccaaatatacatagaaaatattagaacttaataatcacatattttaaatgcttgataagatctgttctttttacatacaaactcagcaagtaattttagtaagtaatttttcctaattagggaattattattttttgttgatgagcaatagccgagtgttaaatgtggaaaacattgactatggtttgtcatgttctgttttacgtggtgttaactttctgtttgtgtacctttgcattttactgattccctacagacgaaactgtgtctttgagaattgtctgtaagccttctgggatataaattccaggttattttgaagttatgcctgtttgtatcattcgcccactcaagacatcacacattcttccaaacaccccctacacttggaacaggcacccaattaatatacgccatgcaggccaccttgctcttctccttcaaaaactcctaaaaaaccatctgctctgggaggcattccagctacaataaccacctactactttcaattgcctataatatctgcattcactttcctgaacactgcttacatcttttaccattataaaatccataagacaagataatttctaaatatcttgcagagatatgtaacctcctctccaacatctacattcctttagagtagtagtatattcttgcaaagatttctgccatgacagattaaagaaatatcagctttaaaagaataagagcattaacattgtctcttgtatcaaaatgttcagccaacccagttaggtattctgattaggatttaatgccaaactctcacggagaatgttgagtgacactatctaattagttctttatgaacatatgatagtgtggaaagtaaacaaagtagtgaattgtttttaaattagtgtactttgcttctcaaagttcattatgtattacttgctaggcgacaggaactaattttgattttatgatattttggataaattgttccctgggattaaaaaaaaataagctatgacaagaacacaatttatcaatatgcaaaatagatgaaaccaagacaatttctttttaatttttgaaattgtaagtccatatattgccatgctggttaacaccaaattcctgaatgcctgtgaatctcctaccaattatgtcaacaacatgaatatcttcatagggatgccactgtccaggtaataatctaaagacatgtatcttttactcttgcaagtgttaggccttgctaaatgataaagcgtttttctttgtatttccacagcagagatttcagatcaacagacaagtcccagaggactgaggacaaaataattaatatgccaaagttatataataagaaggcacagtgggagatttctgccaaactaagagggcaaagccctacagtggctgagtggaggaggtgggtggcaaagcccaaatcatgggattagagagacaagagattggatatcaggattggtccccttattcttcaggtcaacacctaagagtagaaaaaaaattcctaagtaaaatatggcaatcaaagaatcctaggggtaatcttgggagatccttctgtgactgagaagaatgatgcccattttcatcattctgtgccatggactgcatggaagtagaaagtagcaaagagcagaaggaggtgtcctatcaagtggatctgaggaaagtcctcgccaagtcacatagaccttattaggttggaggaaaaaagcaccttagaatgacaagactcttgaacaatgtggactcaaaaatgctgagagaatgaactaggaggaaacagaggtcaggacaagtagttggtgggatgttgagaatgaaggtaattacacagtctacaaccatcaggaatagctatcagtcagatgcccaaaatatcagatgggtctccacagcggataccagtgtaagatgcccagagaccaggtggcttctgctacctttcagcagaagtagagaccatctgccatctgggagacagaatcttcccctattgtgactattaatattatatgtcaacttggctgagccatgaggtacccagatatttggttaaacattactctgtgtgtgcctgtgaaggtgtctatgaatgagatcaccatttgaattggtagacagagtaaagcagattgcccttcacaatatgggtaggactcatctaatgtgttgaatgtctaaatagagcaaaaaggctgggtaaaggagaattttttctctctgactgatacatttaagctgggagattggttttctgccttcaggtttggactccactaaaaccgttaccctgtcctacttctcaggctattggactcagactggaactatagcatcagctctccttgatctccagcttactgactgtggatcttgcagcttcttagcctccacaatcatgtgagccaattccttataataaatctctctatctgtctctctctctctctctctctctctctctccatctaatctccaattagttctgtttctctggaatacgctaaaatactcctatgttataagaaactgtgctatgccctttgtacttaaacattgttctgagaaagaggaaagtaaagtcaaagccagtgagttgagaaagatacccagaacaactgggtagttacatcaatgagaaaatgtgttaaaccagagaagactgaactgcttttaatgaacaagatcagctatttacttaatcagtgagatgccccaaactcttacttcaccagtaagagtggccactcaaaaacaaaatgggatcaattaaagaaattaatgaaactcactcttttgcacagtcagacttatgattgtttaatattttactgcttgtattaaagttgttattgctaacatattcctaatctgaagcccatcaagagaatttttgactcttttctgaagtcattcaacaagtttgttttgaattttatttagatttatttggaaaggtacacctgtttttgactgtttagaaaatattaattatcaccatcgatatgcttgcaatatttcctgcccaatagaaaagaacatgcatgacatacatatgtgggcttaaatatctcaagagcaaataaaataatttatacaaaagcaattatttaaaactataaatcagtaagcatatgttattttattactgaagcaataataatacggatcaataggtttctcagaatgtaaaacaaccagggtaattacctagaatctattaacaaccttattctcatataaattccaaattatttgaaaatatattttaaaataatatttactttgcaattgagaaaaatacctgagatcctagaattgcaaattgtatcatttagaatgaaatatttatgcttcatttcatctattaagtctctgaaaaaatatgtggatagcagctaacatttggataactactcctggcaaatcatttcatagtgtaacttgataagggcatttcttactgaaatttttaataagagtcacctgaatgtgaatttaactcagaagactataaagacaaaaatgggtcaagtgaaactgactgaatttatattatataataaaaatcataggtagaatgcaaaaaggaaacaactaatataagctaatttacaatcatgtgtcactttacagaaataccttctgagaaatgcattgtttggaaattttgttattgtgcaaatatcatagagtgtacttacacaaacctagatatttttatttatatatattatatggaaaaccaagtgtcccagcaccattactgaatatcaatcatttcctctacttgatttgcaaaaccaatatcacatgccctatattaagtttctataaaggctccattaaatcttacagaacgtatgtgttccatcactggcttaaacattgtaacgtggtccatgactgcatgcgtgtgcatggaaatggaaatagcaatggcttacacatatagtgattactacgctccaggcactgttcttagtgctttagatgcattaactcatttactcttttgtactctatggagtaagaaccattattgggtcattttacagaggaggaaagtgaggcacagaaagggttaagctgcttgttcagggtcacccagttactaagtggaggagcctggatttggacatgggttgtcaggttccagagccaccacagtcatttcttgtcaccaccacagccatttcaagcatccggttacgtggttctggtagatattgccttttctaataaagaaataagcaaaatcgacacagataagggactagtttgctccagagtctctattccatgcattttgtgtagcacatatggttctggactagaaagcattacactttgcagagaatctcagtttctccaccaaggctcaaaattcccatgctacttaaaataagtctccttaagttccccattcactgcatttctaaccatctccattgtatcgttctctgtatgacagaacatgaagtttttactccttttatctgttctgaaatttatctgtaatttttcgaacactttctctcagagctacagtttttcatctatcacaggagtagtaaactttctttgtaaaggcccagatagtaaataatttaggctatatggatcatatggtctctgtcacaactcagctctgcccttgtagttcaaatgcagccaaagatagcagaaaaacaagtgaccttggttgtgttccacaaaacattccttttataaagtaagcagagggccagaactggcatatgggccatagtttgctgacccctgatctgtcttattacttatcagtgggaagtatgtatatcttgctttgtcttttttgaagggagtacaattaagggttttcttggaagtgtttcattaatattatttttgtattatatcttattgatatatcatagttacacacattgcagatacatgtgctattttgagacatgtatataatgtgtaatgatcaagtcagcctaattggaatatccatcacctcaaacattcaacttttctagtgttagaacattacacttcttctcttctacctgttttgaaatataccacacattattgttaactatacttttcctactgtagtattgaatactacaacttattccatctatctaagtatatttttgtacccattgatccacttctaatttgaaaatacttccctattttaaaaaatcacttaattctatggtatttcctgtatgtctctagcagacctatgttcttttattgactaggattttgactgcaaacacattttaaggcaattatttagtagcctatgtttttacaaacattcatgttcaatagttgcagtaactctgtgagattgtcttaagaaaaccattccaatttacaaaggtagcttccacgttcaggaattataatatggcttttaaatctaaattttgtgctcttgtgattatgtgacacgatctttgcattatatagaaatcatatatgattgctatcagatgcacgttaacttttaaataataaagctttcaatgaactttcaactccatttttcactttctaagaatcacctaatatttctgacacatctttgtaaatcccagagagttactggacccctgcattatagcatcaatatcctgcatacacttgagtcacatgatagttttgatagtaaattctgatgggaataaaaacaaaagaaatggtattactctagctaacatgacatgtattattcaatttaatttaatagtataacaatcctgagaactaagaatcactattctactctcataggtgatgaaatggatgctactaaattctaaataatttaccctaggcttcagaactggtaagaggcagaagtagaattcagacacagatagaaccgaaggtttgtctttttcatatgacatcagaagtgtctcctggttatctatggaacccaatatcacgtttgaacttcccaaccatcaatatactttttaattttctataaactctgtttagaattctctgtatttctttatgacaaccaggaaaacttgcttataccatttgagcagtgaagttaaaaatcacagacataacttcaatatgaattttattactggttatctgctagagagcttggaacattctgaatggaattaaaatgcatttcattggtgtggaatcatgaacatttgttaaaattgttttgtaaaaaactccctaggttttcacagctgtagaaatgctccctcaaagaaataagtgcagaatgaataaaaacagatgtggcatttttgcatattatcaacaaaaatctctttttattttatcttgtcaatgtcttaccataacattatttatgccattattctgttcacaacaagtgcaaagaaattacatgacatttccagtacatatactggtcttcagtagggttttctggttacttatatttctctagagagtacctttgcacaggaagtaattttctatgttttctaactaaaacccaacctttctggctgtgcactctgagaaacagcaaacattctccactctattaaaagtaattgagtcggaacatttaaaggtattttaaatgaatgtgcactgaacattcttcaacttggttcaggaaatagatataagaaagtttttaataccctgaaatttttaagaagaggaaattacctttggttatttaaagctagaaaagattgggtttaagaactttaagacaacgggctaaaatcaactccaaggcaatgaaagcgtcttcctttaaaaagtcactagtgttttgtgtttataaatttgtgccttcactgttgaatttgtgccttcactatttaaaatgtatacaccgtatacaggtttagcatttctaatccaaaaatccaaaatccgaaatgttacaaaatctaaaatttttgagggccaacgggatgccacatgtggaaaattcaacacgtaagtacttaactcaaactctgttccatgcacaatattattaagaatattgcatgaaattattttcaggttatgtgtataaggtatatatgaaacataagtgagttttgtgttttgtgatagacttgggtcatatcaccaaaatacctcattatgtatatggaaatatcccaaaatataaaaaagtctgaaatctgaaatagttaggatcccaagcatttcacataagagctgctgaacctgtagtactcttttaggcactcagatgtagagtgaagttaattctgtataatataagctaaaaaacataatcattggcagtacctagtggtaactcaagctttcaacatcattagaatttgaggatgttaatatacctgcacaaaacaatcctatgtgacttttcaaagatgaaattgcactcagtgtggtcaaatgaagaaattaaatcatgctatgaataagtgatgttttattaggtagatgttctagcaaaacctaatgctttacctgagaagttaatcacttcttacattatttttccaattgtttgtcttcccaagagttgtgctaacttaatattaatttgatatattagctgtattcacttaaaagtttacacaaaaatattttaccatttgtaattgtttcaagtttatataaagaattaaatatattttaacaagcatctacataattgacatgatttttttctaacctgaaaacctaattatcaccttcttatagaggacaaggaacagctttgcaggcaaattaatgtatcctatcagtgggacagtttgtcacttgcttaaataatcatcatctttgttataagctttacagaatgaagaaaagagataggacccctctcatactattacacattaaaattaacttcccacaggtttttcaacagtttcctacactttcactgtgctgaatcataaagtagaaatgacagcattaactgcttttcaagagataagaagcaaatatatttcatatcagctttgtcaaataaagtcttcagtcaccacacagatacatcatatatttaattgtacacaagttaaaaagtatgccgcatgttaaaataatatgatatcatagtgcactagtaaagagggtatgtaaaaaggactgcgttattaacaattagttgatattattaagtaattacctaaaatggacacctgccattaatttctgtacaataaagagctggcacatgctaaaactggtttccttattttcttatctaactgggtaaagttattaaaattacggtaataaaggcacctaaaatacacaagatttgttaaaatgctcttaaagtaaatatagtattgcttgcattttggaaactttaaaaaataatattcttgctattaattgctatattaaagctattatttctaaactgaattacttataaataaaaaagatttttttaaagactgatctcagttccaactagcaaattatttcagacattttgcatttatttaatttccaatgctgcaattaagaaagaacatcaacactttgacttttagttggtctgaagcaaagtcccttccacgtgagattaaaacttgtcttgttcatcaaatgggatcaaaagctccttaattagtaggctggactaaggtacacagatgccctttgacctcctatgacagattgctaacattttagcatttacaacagactctcaagtatgccggctgacattcaaatataactcaaattacacttggttaaaagaattgtatacatctacatgagaaggactactggtgtaaaaaatctaagtcccggcaacgcaacacaaatcaaaacaatgactttgccagtatgcttaatagggaaggactcatccagtgttctctggattgcgggaagtgcggcaaggctgagtgcatgtgggctagcgccctctgctggttagattcttcaacgtctttaaatcaagaatcttcaagccttgattaaaaaaaacgatgctctaaagattctttctctttctggaattaggaatctatgggaagccttctaaaaatttaaattttaattcgatttcaggtattctaaccacctgaatatttatgtgaggatcacaataaaattagatccccaaatttcttttaaaatttaaattaaaaatttaataaattcttatgactacataataagtgaaccatctgataaaatagtgtaacaataaataaaataagttaaataatttaaatttaaataaattctgaataaatacctctgataaaactaatcgttaataatatagtgtgcccagcggtggctggcaagatggctgagtaggaacagctcctgtctgcagctcccagcgaaatcaatgcagaaggtgggtgatttctgcatttccaactgaggcacccagctcctctcatttggactggttagacagtgggtgcagcccacagagggtgagccgaagcagggtagggcgttgcctcacccaggaagcacaaggggtcagagaactccctcccatagccaagggaagccctgagggactgtgccatgagggatggtgcatcccggcccagatactaagcttttcccacagtctttgcaacctgcacaccaggatattcactccagtgcctacaccaccagggccatgggtttcaagtacaaaattgggctgccatttgtttgggcagacaacgagctagctgcaggatttgttttcataccctggtggcgcctggaataccagcaagacagaaccgttcactctcctggaaagggagctgaagccagggagccaagtggtttagctcaggggatcccatccccacagagcccagcaagctaagatccactggcttgaaattctcgctgtcagcacagcagtctgaagtcaacctgggatgctccagcttggtggggggaggggcgtccgccattactgaagcttgagtaggcggttttaccctcacagtgtaaacaaagccactgggaagttcaaactggacagagcccaccgcagcttggcaaagccgctgtagccagactgcctctctcaattcctcctctctgggcaaggcatctctgaaagaaaggcagcagccctagtcagaggcttgtagataaaactccaatctccctggagcagagcacccgggggaaggggtagctgtgggtgcagcttcagcaacttaaaccttcctgcttgctggctctgaagagcatgttctaacccaatgcaaggaagcaaagaaccttgaaaaaaggttagatgaattgctaactaaaataaccagtttagagaagaacataaatgacctgatggagctgaaaaacacagcacaagaacttcgtgaagcatacgcaagtatcagtagttgaactgatcaagtggaagaaaggatatcagagactgaagatcaacttaacaaaagaaagcatgaagacaagattagagaaaaaagaatgaaaaggaatgaacaaagcctccaagaaatgcgggactatgtaaaaagaccaaacctacgtttgaatggtgtacatgaaagtgacagggagaccaagttgaaaaacactcttcaggatattatccagaagaacttcaccaacctagcaagacaggccaacattcaaattcaggaaatacggagaacaccacaaagatactcgttgagaagagcaaccccaagacacataatcttcagattcaccaaggttgaaatgaaggaaaaaatgttaagggcagccagagagacaggtgaggttacccacaaagggaaccctatcagactaacagcagatctctctgcagaaaccctacaagccagaagagagaggggggccaataatcaacattcttaaagaaatgaattttcaacccagaattccatatccaggcaaactaagcttcgtaagggaaggagaaataaaatactttacaggcaagcaaatgctgagagattttgtcaccaccaggcctgccttataagagctcctgaagaaagcactaaatatggaaaggaaaaactggtaccagccaatgcaaaagcataccaaattgtaaagaccatcaatgctatgaagaaactgcatcaactaacaggcaaaatatcaagctagcattatcatgacaggatcaaattcacacataacaatattaaccttaaatgtaaatgggggaaatgccctaatcaaaagacacaggctggcaaattggataaagagtcaagacccattggtgtgctgtattcaggagacccacctcacatgcaaagacacacataggctcaaaataaagggatggaggaagatttaccaagcaaatggaaagcaaagaaaaaaaaaaccagggattgcaatcctagtctctgataaaacagactttaaatcaacaaagataaaaaaagacaaagaagggcatgacataatggtaaaggaatcaatccaccaagaagagctaactctcctaaatatatatgcatccaatacagggggacgcagattcataaagcaagctcttagagacctacaaagagacttagactcccacacaataataatgggagacttgaacaccccactgtcaatatcagacagatcaacaagacaggaaattaacaagagtattcaggacttgaactcagctccagaccaagtggacctaatagacatctacagaattctccaccccaaatcaacagaaatacattcttctcagcaccacatcacacttattctaaaactgaccacataattggaagtaaaacattcctcagcacatgcaaaagaacggaaatcataacagtctctcagaccacagtgcaatcaaattaaaactcatgattaagaaactcacccaaaactacacaactacagggaaattgaacaaccagatcctgaatgagtacggggtaaaaaagcaaattaaggcagaaataaataatttctttgaaatcaattagaacaaagacacaatgtaccagaatttctgggactcagctaaagcattgtttacagggaaacttatagcactgaatgcccacaggaaagagcaggaaaggtctaaaatcaacaccctaacatcacaattaaaagcactggagcagcaagagcaaacacattcaaaagctagcagaagacaagaaatagctaagatgagagcagaactgaaggagatagagacacacatacacaaaaacccttcaaaaaatcaatgaatccaggagctgttttttttttttaaagataaacaaaatagaccactagccagatgaataaagaaaagagagaagaatcaaatagacagagtaaaaaatggtaaaggggatatcagcactgatctcacagaaatacaaactaccatcagagaatactataaataccactatgtaaataaactagaaaatctagaagaaacggataaattcctggacacatacaccctcccaagactaaaccaggaagaagtcgaatccctgaatagaccaataacaagttctgtaactgaggctgtaattaatagcctacaaaccaaaaaaaagcctaggaccagacagattcacagccgaattctaccagaggtatgaagaggagttggtatcatgccttctgaaactattccaggtgatagaaaaaaagggactcctccctaactcattttatgaggccagcatcatcctgataccaaaacctggcagagacacaacaaaaaaagaaaatttcaggccaatatccctgatgaacactgatgaaaaaatcctcagtaaaatactggcaaagcaaatccagcaggacgtcaaaaagcttatctgcaacgatcaccttgacctcatccctgggatgcaaggctggttcaacatatgcaaatcagtaactgtaatccatcacataaacagaaccaaggacaaaacccacatgattatctcaatagatgcagaaaaggcctttgataaaattcaacagcccttcacgctaaaaactctcaataaactgggtattgatggaatgtatctcaaaataataagagctatttatgacaaacccacagccaatatcctactgaatgggcaaaagctggaactattccctttgaaaactggcacaagacaaggatgccctctctcaccactcctattcaatatagtattggaagttctggccagggcaatcaggcaagagaaagaaataaagggtattcaaataggaagagaggaagtcaaattgtctctgtttgcagatgacatgactgtatatttagaaaaccccatcatctcagccccaaatctccttaagctgataagcaacttcagcagtctcaggagaaaaaaatcaatgtgcaaaaatcacaagcattcctatacaccaataatagaccaagagccaagtcatgagtgaactcccattcacaactgctacaaaaagaataaaatacctaggaatacaacttacaagggatgtgaaggacctcttcaaggagaactgctcagggaaataggagaggacaccaacaaatggaaaaacattccatgctcttggacaggaagaatcaatatcatgaaaatggccatactgcccaaagtaatttagagattcaatgctatccccatcaagcaaccattgacttttctcacagaattagaaaaaactactttaaatttcatatggagccaaaaaggaggctgtatagccaagacaatcctaagccaaaagaacaaagctggaggcatcatgctacctgactgcaaactatatgacaaggctacagtaaccaaaacagcatggtactggtaccaaaacagatatataaaccaatggaacagaacataggcctcaggaataatgccacacatttacaaccatctgatctttgacaaacttgacaaaaacaagcaatggggaaaggattccctatttaaaaaaaggtgttgggaaaactggccagccatatgcaggaaactgaaactggacccctaccttacactttatacaaaaattaactcaggatggattaaagctggaaaccatcattctcagcaaactaatacaagaacagaaaaccaaacaccgcatgttctcactcataagtgggagttgaacaatgagaagacatggaaacagggaggggaacatcacatattggggcctgtcagggggtggggggcctagggaagggatagcactgggcataatacctaatgtaggtgacggatcgatgggtgcagcaaactaccgtggcacatgtatacctatgtaacaaaactacatgttctgcacatgtaccccagattggctccaaagtcatttgtaaaacttctctttatcttttaaaataatgtatcaggttttatgcaaaaccttcctaatcagcactatcccatcactgcataagaagtattttctcctttgcatcctctgtgtatgatactccaaccactgcactcatcttacagtattatatatgtgtttgcatgtatcttttccccactaagctataaactctaagtggttggaatggtgttaaactcatcttctaccctgagcaaaagaagtcttttctggaacatattagccttgcatcaaatgagtatttatctagacagaatgtttagtaaattgctacatatgtaaactagagcaagttatacttctgaatttgttttctaatatgtgaagtaaaaataataattgtaactatctcctaagattgtgtgtggattaaataaaataatccagaaaaatcatttagtagagtatctggaacataccccagcctttaagaaatataaatgatgagttttattgtagtctattgccacaaggacacacaacttacacgttaggtttacaactgtttattaggctataataactgagaataaaaataagattgggactaacgattagtgatattagcttaagttttcatggtaaccaagcttttttttttttcccctagtaagatgtatagatctagaaaaagcaatagaatttttttgtaactttgtgttcttttctgtatgtcatatgatactttaaattactttagttatatttgaaaataatttttatcattaggtgagtagaaaacaggctaaagcatccaggttgaaatgtaaaacagccaaaataattaaagtaattgaatttgaacataaatgaattttatattcataaatttgcaaactacatgaatcacagtacatgaaactttctggtattttagaagttattgccaaaattccaaatgacttttgtaatttaaatatgccttaaagattaaagcaaaatgaattaaataagacaaagttagtaaaagtaagatgaaaagtaagtaaacaaaatattaaaagaatatgtataaagaacaaactgtgtctacatattaaaaaccaaacaaattatgacatcacagtgactactaaacatcagtaagtaagaagagtgcatagtggcatgtgctctgcatagacataaatgtacatgtaaagatttattctttaaaagcatataaatgtagagatgcttgcttgcacagcaaatggttttgttacatcaggatttctccgtgtacttgttagtatttttatcacatcattaaaaagtttcagtagaagatgaggatcatagaaattcagatttaagtgacctccttaaagctgagaaatgaactgccaaacccaaagtctttgcaaagcccaactcatttttaaaatatatgaaggttttggcagagaatgctttttgacccgttattcatttttctttcttcctgtgtacacaagaacctctcagactttatgtgagcacatgacaccaccatgcccctgccagagatcacattttcctgagctcttgcctttaagggtggctaggtcactaagttgtgatatgagtagcagcgacaggggcgactctcagtggaaaaacttggtgaagatgctgtgggcattggacatgggtatgagaagaatactttttggggatgtcttctccagtcctcagacagaaagaggcacctcctcctggtagcatatcgtactccattttgcatttacctcactgatagtctttaccacatgttactgtgattccatgtttggcttttgtcttccctgtaggcccaaaggctttacaagagcagagaggatatttcatattaacattactcattctccaagtactttcacattatagaactataataaatatttctcaagctatacaaaataacgaaaagaaaacataagagtctgcaggtatgatcctgatgatgaattctgactttgaaagaacaatcaaggcaaaatgaggaaagcttggaagagagtcagaatgtcctgggaataggtatagaatgaatccaaggaaatgccagatggtgagacttggaggcaataagtgataagatgatcaatcataattgctagtatttgggggaacacaatatttgctagacactgttaaaatgttcttcatccagtgttaatttagttttgcaacacagcccccaggttgatgccattagtatcaatcctcattacactgattagaaaattggggcatggagagaggagaaattttcctaaagtcacacagttaggaggtggaagagccactatttgaagccagggagccctaactagcacattataaatatctgggggaaagaagaggtaaattgaggagacccaagcatgactccgcaataacatcccctgcttattagcgttgtcttaattcttcatagtgaagtatggcccataggtcacacttgctcacatgtgatatatgtagtgtgagccttactcctagctgctggtgtacacaattattgagactttctgtgatgcattatccatcggatttgcatgagttggaagtagacgtttgcatgtgcacacaagctggcctaagaacagaaatgagccatcaacagggagggggaattatcatataaatcctaaacatttcaagtgtacatctacttccagggatcataaacataaaaaggttaaataaggcaggagttgtcagtggtttggtgactatgaaacaggaatgaggtaatcaaactggtcttatctttcattgaaaaatacgaacaagcgctcattgagtgcctaggagcactcaacaagctttgatcaacagagctttggaccatacttaaaatagcaacattaaggccaggtgtggtggctcatgcctgtaatcccagcactttgggaggccaaggcaggtggatcacgaggtcaagagatcgagacaatcctggctaacatggtgaaaccctgtcctgttaaaaatgtaccaaagaaagttaaagtcgattttagtaccagcaagaccagttaacaccttagaaatgttttttaaacacagtgacaggcctaaacagttgcagccagtcaacactgcaaaataggggcaagaaccttggaccaagattcactagagtgtaatttactaatcacaaggagggtttcttgtttactactgtatcctcagtgttccataaatacattcaataaatctttgttgaatgaataaaccaaaaaaaaaaaaaaacacaaaaattagctgggcatggtggtgcacatctgtagtcccagctacttaggaggctgaggcaatagaatcgcttgaacctgggaggcggaggttgcagtgagctgagatcgcgccactgcactgcagcctggcgacagagcaagactcgtctcaaaataaataaatagcaacattaataacgatggcgtttatatagagaggctagatggattcagcctgatgactttgtcagtctcttattttgaccagtcaagctactaaagttcctatctagggagtgatgtggagctgtgcttgtcaaagcacatttcttggactatgtccatcagagtttctggaggacatggtcaaaaatgaaaatttctggactatgccttgaaccaattaaatcaaagcataaaaggacagaaagttgtatatacatgtaccatatttatgcttaatgagtttttgtatgttatgtatataactattatatgtttatataagctaattgtcataaatatatttatttatataattattttattacttactgtttttaaatattttattacatacttatttatataactattaactatattatttatataaaattgctagaaattttctaaaagaaattttaaatgttaattccacaaaagtatatgagttaatgcatgtgtgaaatatcttgatttagccattccacaatgtatacaaacatcaaagaatcctattgaacatcataactaaatacaacttatgtttttaataaaaataaaatataaaatataagtaacagacaaatatatgtacgcatattatatatatacttatataaaacataacacacatttttaattctgtatgatgtaattattatgctgactgaagtttgggaaccatggcattacatatcccaatatgaaaacactgttaatgcagaaaatacaaatttcaaaatgctgcatatgtgagaatattatttttctcttcaaagagcaatgtttatgagtgaaccattttttaaaaaataaatcattcaagggtaatattttagaattaactttgttcagtcagaaaataatgttgaacattttcacataactacatgtattccaaaagaaatgcatgagtaactaatgcttatgtggagggagaagcaacgcagaggatataattagttccaattagccatgccaggggattactttctaggtaagattacctataatgaggtgattaacctctttggaaaaagttcaagccaggcttaccttctacttaatatgtcctgtaaagaagtgttacaacgagggtcctcacaattgttccctgggataattgccaccaagaatcaattgattctattccagaagaatcaaaaagcattcttattatattattgatagaatgaatcctaacacatctatatattagaaattaagtatttaaatttcatatcaaattaactaaattatatggcacggattttatttatactaacaaaacagcaattgaactctagtcaattccaaatacagatctatcggctatctatgaacatcaaaggggaagaaaattctatcattgatattggttaacgtcacaggcttatttccaaaagtagactgtccattgtctaattagtttagagggtctcttctgtctccagcacacaattgaattttgttgcagttggagaggctgatgctaacctaggtggcagggctgaacacaagggaacagaagcttcagtgttttcaccataaaacacgagataaattgaggatagggattttggaaataatagatttaactgttgtccaagcttatctgcagtttcttccctttaaactaaattgatagtttacttattatggactaattaaaattattatatataatattatctatgtaatatatctgttacatatatatattgttgtcagcttataaggaacaataaataattttctttgtgttttaatttaacaaatacttcctgaaagtttgcgtgtaggcatacaagctacaacaatgagtagaaattttttctaaaagtggttttttactgtttaatactcttccctataagaaaatacttaaacttgaattattcttgtaatcttgtggacatctctgaattaattactgttactttacaaatcttgtttctttatttgttatcctagaagtatttgtatgtgtgtgtatataaaatttttgcatagaccacatgcaaattcatgtaaagtaataatacaaaccctaggaatcgaaaggcaaaatcaaggggaaaatatttaaaatatttgcatggaaatgataataataaaatgtaagtgtcttgcaaacagaaactagaaataaatatttctgttttatttaaattagagcatatacaatcaagccttacttcagcatgtatctgttagagctcaatggtcaccttaatttgggagccccaggaaatatcttccctctgtaaagttacaaagtagaatttttctctggtttatattcttctgtggaatttacgattatctaagctctctctgatcccaagttccatttcttcatttatcttagattctaaaaatctaggccttagctgaatgcccatcaaacaaacagggctccttagtaaatgtttgcagacaaaggaaacaaccaaatcaatagcagataagcagtattttatccaagcttcagaaactttattaatattttttgttacttcactgcagtggcaaaaataaaaaatgaacaggagaataaaaaatgtggtgtgaaagaagaaagagagtgaggggcaaaaaaggaagggagaaaagttattcccttctttattcatcctccagtcctcactcactctattccaaagagccatcttacaaacatgattttaaacagcctggatacagaagtaagtgttctggttttattaatggtgccaagaaatgatgcaggaagcttcaggtgaattgaaaccccctgcatgagaacacacacagtcctgactcatttaaccattctcatttctacctgctcagatccaacaaagtatttaagcaagtctcaacatacaaataaaaatatatgaatcgaggagcatagtaaattattttaaaagctttacattaggaatacacacatagaagagcacatataattgtaagagatttatataaatatgataaaatgaaaactcttagcaaatatatatgtatacaaatatataaatcgatgcatcacaaatacatatatgtatacacatatatacatctatatatttacctatttatctgtacactatatggtttataggcaaaccgtaatttagtcatatggaaaaactggcctcatgataatgcttacacacacaaatttcaaaaatttcatttaaatgatatagcaaagtattctaagttagaatgaaaaatgagtatgtttcttctttaaaaacacatcaattcattctagtacacagaaactaaagacataaaagtgctttaggacatgaaactctcatgaagatatgattctcttcaaaaggtccctgcacaacaccactatttctaataaaactgattttattcaaaacactaaaaatgacaaacatttaacttttaatttcagtagtcctgtttacctagttggctaataaaagatagtgacatatacacaaggtagaagtgtgccttaaaacatgataataatttacatttttaaatgaaaaaaattcagtctacaataatgaacttgtcttgactgaggcaaaagtgaggtcaaatacctgaatgatgacattgtgatatacttcatcctttctttactttcactgtttttaatagattgtgaatgtcagtaatttaaaaatcaattgtactcctgaaataacagtttaattcctaaaagtttaaagtgaaagaaaacatgaattcctacaaatgtgattctacaaagatacatgttaaaagccttcagaggaaaataaatacaaatatctcctatattctatttgctatgtcatacctgactcaaaaatatatgtaagatacacatttaagagaatatctcatgaaattgattggatgccaattttcaattggcttttttcatttgtacattaaagattcttacagaagatcaagaaaattataaatatgaatacatcaacagaatatatcatcatgatgtaagacaatttgaattgctctggaacttcaaaagcattttgttgaattcacagaaataatttctcaatggtactttatatggtaagtaaaaatatttggctttgatatagcatttttctgtcactactgaaatattatatttttaacttctcattatattctagaactttaatggaatttttatctctagataacaaatggcaattttgtgttctattactctagtctgtgggcttttctttgtctctatagcaaaatagaaaaaaaatacacaggtttgatttttctattcttagaaatgataattttccatatatatggaatatatgtatatatacatatatgtatggaatatatgtatatatacatatatatgtatggaatatatgtatacatacatatatgtgtatggaatatatgtgtatacatacatatatgtatggaatatatgtgtatacatacatatatgtatggaatatatgtgtatacatacatatatgtatggaatatatgtgtatacatacatatatacacacacatatatgtataagcatacatatatgtataaggagagtgatattttatatttagtcttcagttcaataccatcaacacataaagaataataatttgaaaattgtatactgctgacatataaattgataagaagaagcacaaactaatctataagtaatctcatattatttatttgtaggacacagtgctcagggatttatgttaaagaatttttgtttgttttgcattgctggttcttgaaggttatgtacgtaaaggctgagaaaactaaaaggtattaatacctcaaataatagttatgtagaatgaagactcactctacatatcacagttcaatctttattgcattttttgcactataaaagcataaactataaaggtagtaagatatatagaaaaatatagagaagataaatataccatgaaatagtaaataacttacagaataaatacctattgagtacacagtatgttccacaaactgtgtagttactaaagcccaagaaagaaaaagcagaaagtagtacagaaataaatcacatacttctgaccagggggctgagaacctatctttgtttcattccaaaaattagagaccagatactttgaaataagctgcgtggatttaaacagtattattgtgatcgctggccataagtgcttactagctaacttcttttagtttattctagtaaaatggttttaggtgttacacattaagaatttgaattgaatcactgaaatcatgctatgactagatttttaagaaatctttgtaagaccacctgatacggtttggctgtttccccaccaaatctcatcttgaatttccacatgttgtgtgaggtacccagtgggaagtaactgaatcatggaggcaggtctttcccatgctgttctcatgataatgaataagcctcacaagatcggatagttctgtaaggaggagtttccctgcacaagctagctctctcattgcctgccaccatccacgtacaatgtgacttgttcctccttgccttccaccatgattgtgaggctttcccagccatgtggaactgtaagtccaataaacctttcttttgtaaattgtccaatctctaattaatgtctatcagcagcatgaaaacggactaatgcaataaattggtaccagtagaatggggcactgctgaaaagatacccaaaaatgtgagagcaactttggaactgggtaacaggcagaggttggaacactttggaggactcaaaagaaggcaggaaaatgagggaaagtttggagctatctagagacttgttgaatggctttgaccaaaatgctgatattgatacggacaatgatatccaggctgaggtggtctcaggtggagatgaggaactggttgggaactggagcaaagatgacttgttatgttttagcaaagagactggtggcactttgtccctgccctagagatttgtggaactcaagagagatgatttagggtatctggaggaagaaatttctaaacagcaaaccattcaagaggtgacttgggtgctgttaaaggcattcagttttataagggaagtagaacataaaagttcggaaaatttgcagcctggcaatgctatagaaaagaaaatcccattttctgaggagaaattcaagcaggctgcagaagtttgcataagtaatgaggagtcaaacgttaatccccaagacaatgggggaaaatgtctccagggcatgtcagagacctttgcagtaggccctcccatgataggcccagaggcataagaggaaaaaatggttttgtgagccaagcccagggtgcccatgctgcgtgaagccaagggacttggtgtcctgtgtcccagctgcaccatccatggctgaaaggggccaacatagagctcaaaccatagcttcagagggtgcaaggctcaagcctcagcagctcccacatggtgttgagcctgagagtgcatagcagtaaagaactggggtttgagaacctctgcctggatttcaaagtatgtatggaaacgcctggatgcccaggaagcagtttgctgcaggggcaggactctcacagagaacctctgctagggcaatgaggaagggaaatgtggggtcagaacccccacaatgcatccctactggggcaccacctagtggagctgtgagaagagggccaccatcctccagaccccagaatgatagatccaccgacagcttgcaccatgtacctggagaagccccagacactcaatgccagcccgtgaaagcagccaggatgggggactataccctgcaaagccacaggggcagagctgctcaaggtcatggaagcctacttcttgcatcagcttgacctggatgtgagacatagagtcaaaaggagatcattttggggctttaagattttactgccccactggattttgcagttgtgtgggggcatgtagcccctttgttttggccaatgtctcccatttggaatggctgtatttactcaatgtctgtactcccattgtatctaggaagtaactaacttgcttttgattttgtaggctcataggcaaaagggacttgccttgtctcaaatgagactttggactgtggacttttgagttaatgctgaaatgaattaagactttgggggactattgggaaggcatgattggttttgaaatatgaggacatgagatttgggaggggccatgggcagaatgatatggtttggccatattcccactcaaatatcatcttgaatttccatttgttgtgggaaggacctggtgggtggtaattggatcatgggggtaagtttttcccatgctgttcttatgatagtgagtaagtctcatgagatctgatggttctacacgggggagtttccctgcacaagctctctctctctttgcctgctgccatccacataagatgtgacttgctcctccttgccttctgccatgattgtgaggccttctcagccatgtggaactgtaagtccaataaacctttcttttgtaaattgtccagtctcagatatgtctttatcagcagcgtgaaaacagagtaatacactgccaatacttttcctataactggttccattttgcaagttacttggaagtccttttcaatgttacatagttttacacaaggaattccacactgctttgcatgtttttctaaaatcattatacgcctttataattgccctttttaatgttgcttattttagtatggtaataaataattattaatatcctttttttcaaaaaaggaagtatttaaagtcatctctctaaatagcaccatgagaagtattatgtatgtgaattatgaatgtaaatatgtttatgaatactaattgacaatttatataaatattttaaataccaatattatgtaataaatagtttaaaattctagtagcataaatatttagtttttttttttcttgagtctaaaggactggaagtttttattcaaattccgtttgttggaagaatatcttaaagtttagaaagttaaacagcatgctttcttttaacagttaacttagatttatatagaaatttggaaagaatatgatataaacctttcaactagcactctcttaagcaacggaaaaatcattacctttccctgttctttcaatttctgtcataagaagcatagagaacagaactatatattgtggtaattaatttccttaagataatgttagaaacatcatgttctttaaaatataaatgaatttcaaggtgagcatgctagaggataatattaatggcatgtgatttattgtgacaagagatctgatctgaaataccattattaggagtacttaaaaaaatccatttgcaaattcctgaaaatatgaaagtgtgctatggctgagcctgtcgcaatgttgaaatctgaactatctgccattgtaagtatgaaattgcttgggtacaatatgtcttcctcacagaaattcatcagaaaatgttcatatcctgaatatatcacattatggtttagggaattgcctaaatgcttgaaatgataactgtagacttaatctgcaaatgtatagattgaaacatacatgcctaattgacgtggtaatatatggaattctgtggctgatcattatcttaaaaaatatttggccaataatacattgaacatctactctatacctggttcttgaactcgcaatagaaacctgtgactttgtgtcattttagagagcattttctatgttattatctctagcaaagactccctataagctatttataagcgaggttcattcatgactcaaatttgcaaagaagttttaatacagttagttttacatcttataaaaaacattgaagtttacaaacacattgttataaatggcatctaatcacatactgagcagtgaggaatgtcacaaattagtagagctattagtaataaaagattaaatagatatgtgaataataggagtctttatgagtaagaagacttaaaaattattctgcagaaagaaattcattagcctctgatgcttgagagagggtaataaatattggcattcttacacataggttgtcaaatatgattagcacataaatatattgatatatctctctataaagcctttaatgaacttttttatgttaaactctctaagaggtacactccaaaaggtattatccaaacacactttcgttttttgcttgaaacctattttaatatatgaatataaacttctttatgaatataacttaaataatatatatgaatataaatatgaatgcttcatagaatgacatgtgggaaagcatagactactctatcttataatatgttttgtacacattaatagctatattcatttccaggatatttgaggtgtataatcaagtgctgaaatctatacagtacatatactttcactgttatgtcaatttatttttacatgtgtttcatgaactgaaactaaatcttgtaaaataaaaatgtctattctaggtacaaaggcaacttatagtgcaaaattttaattagattactttgatttaattttgaaatgcacctggagaaaaattcaaacagtacaataaagaaaaatacagttgtcaccacaaccactttgttcccatctccagaagcaaccagagttataaaatttgtgtgaattattctgaaaatatatgtacacatatatatccatatatgcatttatttcattttctttacgataaaaagtatagttttctgaactataagaaaaaagcaaatcataaggtcatgatttatttgtagggtaaaaaacaaatcaaggaaatacccaacataggtattagattatgtttttagttactaaaaacatttttttttttttttttgagacggaatctcactctgttgcccaggctggagtgcaatggtgcaatctcagctcactgcaacctccgcctccagggttcaaacgattctcctgcctcagcctcttgagtagcttgggttacaggcacccaccaccacgccctcatttttgtatttttagtagagacatggtttcctcatgttggtcaggctggtctcgaactcccgacctcatgatctgcccgccttggcctcccaaagtgctgggattacaggcgtgagccaccgtgcccggcctactaaaaagatctcaataggtaaatttaaggaaaaattagatacaaactcatgaaacatttgctgtgatgatttatgcataaagtagtgcaattttaatatttagaaaactataaaacaattttgaaatagtttttaacagcattttatttattgtgaacctacatgggagaagattacatcaatgtactcatgagtgacaaaactgaaataaatttaagaatgtccaggtgcaggtatctaataaatggtctataacatttatggcaagatgtcagccaaatgcagcgacaataaagcccttggctttgaatattaatagataaagtcacttaaatatctatacagaaatgctagttatggttttgtagctttgtgagctgaatagagtggaaatgagtataattgaagcaaaagataattcacttcttctgccccacttttctaggggagtgaggtggagagagccatatttccttctagaaatggggaagatacggaaccaaggctttcctgtttccctgagtaactgtgaaggtcaatgtctacatttttgaagaaaaaatgtttgcctattgctcttatgaggaaagaaattttgttcgtcaagtcttttctccttgaagaaatgtctctaaaaataatttatattggtattgatattactataatttcttttgatttagtttaggccaatttgaagctgatagtccaaagatatataatccctatgtaatatacacttagcattatcaaatcagaaccctgtgtttttccttgggatcaaggttgattgctgttcatatacgtcatgaaaacttccagtgtgtcttaaaactattaatttcatgttttacttgaaatctttctttataatacatgagaatgaaatagagatgacccattgcattcctcattatagtttcatcacaacctaagaaaaatttaattcatttatcctaccatcttaatatttacacacacacacacacacacgcacacaaagcctcataaagccagtagattataaaatattctgtaccatctagtgatctttttatggcaaaattcagcaactatatctataatttcatctcttttgtcaccttacctactgttgaatttctctgggtgtttttctctcatgatgtggaatctgtgtgcaatggaggcatcctaaggggagaaaatagaaaacaaaaacaggatggtttatgatcctattattttatgaaaatgtagactaaataaaaaaataacatttcaaaatgaacttttatttacaatattattgccaagaaggttatgtaaaattaggcaaaaatgtgtgatccatatgcagaagtgatttatgtaattctatgcagaagtgatttacgtaataatttcacaattgattatttgttacatttacatctaagactttattgctatttaatttctatatctcctttaatgactggctttggcctcatgttcaacgtatgttgaagatagcacatatgagtgtaaatgtcaaatagtaatggaaaatactgttaaacaagagttagaaggatgccctaagtggagaaatgatcagtacagaggctcctaattatttgagataattatgagtaaaaggatggtgtgagtgtgcatgtctagtaaagataagtgcaatacttgacttcagaatttgctcaggttgtcttgatgtgtaattaataacagtttggaccacaagcaactttctggcatagctcgttgaatagaaaaaaaaaacaacaacaaagagaaacatttatttttggggaattggtgacaaatacaatttgtttctgagaccccaagtgcatcggttctgaccctaatggatgtttcttacttttagcaaatacagaatttttccatgagatagaaatcatactcaatgtgtgagactgctgaaatactgctatccaagcttttcaagcacggactgctccaactgactctaaacaattatctctgttattccaagtgtggagatattttcccattcttcaaccacacatgattaatcactcaaatgaggaactaatatatttaccagtcatctcaacagaaaagggctattgttgacattcactgttaattttgtttcaaagtggagataaaagaaaaagaaaaccaaactcaaggaaataaagaagttgtgtatttgagagaatcttgaaaacactaatcaaggattaaaagtctaatgaatgaaatgaaaggctaatgtgcttactcatgcataacaaagcatgaagcacaaaaagagagggaccaatgcccactgcagatggcagagagttgcaggatacagctaactgtaattttttttctgtataaacatttgataccctaaaatttgtcaagtaattgaatgaatccatgaatgaaaatcacccagacatatagatagaggtgtatagaaacaatgcttataataaaggttacaaaaatccccctctacggtttaatatttaagacgttattttgttatatatacatggccaacttcctggtttgctaggaagtacaaatatcaagatggttcacttttattcgtccaacgataactctctaatctagtcacagagttcctttttataaatttaattctattaagtcataaacatattatactttataatatgaagttgtcttactgtggtatgagattacaggaaaaacacctgaactgggctatttatggtatatgtagcatgatcaattaattaattttgaaatgcacttacttttactttatccctaatctggtacaaaatcaacttggaataccttccaattaaaggcatacattcagcagactagttaaacaaagcaaaggaatatgaatcaaacactaagaatgaataatcaatattgcttcccatagggagagtatcattgaatttacttctgcttgaattgtttctgctaagttggggagactgagacttttaaaaatagattgtgtagtacaattttttttacaggtgtatatttttgtaatgacaaatttcttcctttacaaagcaacataaacagaatagagaaagggagagaggcaagaagacaggagggagaagagaggggagagacagcaaaagaccatttaagtagactagactataattgggtaaactcctagaaacacaggactacatagccaaagatagaactaatattagcttatttatcttcaagatacttgggcaatggatcatttagttaagaggggaaaaaataaaacttagtgtcaaacactagcaggtcttttccttgtgttgaataggttccaccataaaaagagaactggcattgccaactacaggattgataaggaacaatgacagcaggtgttcatttggatgagaattcagatccaattcacatgggaccctgtccctttggcataaccccaaagggcttgatagagtactgccaaaatctgcaacactatccagcagccatttttcaagagacaccaaaggttctctaaagacagccaaataagaaaaagctaaaatgccattttaaaataaattttaccatttctgtctgaatgcattacagtttttagacaacagaaataaatcagcattacttccgcttcctagaaggcacaaactctgaattcagactttctacttccaagccttgtgacttcaaacaaattatttattcattgagaaccacaacttccttatctttaaaagaggatactgacatcccttcaaagtaccttggtggagatttaatatcattctctatagcaattggaacagtattctatatagctcatattttcatacatcttatatacaaaccagtattttcttaaagttaaatgagaatgctaaatatggttaaatgacatatttttgaaatatatttttaaagacttacattgctttttattatttccttaacctatatagctttatttttaattaattaaaaaaatctaagaaatgaaaataagtcaatcttattaaagcaaaacaaatttaaacctcattgtgttattcaaacagtaaaaatgtaattagcaacttttcttgctacgtgtacatatataagtatatgcaaatatatgtatatagaataatcagcttattagccatatgtgtctcaaatacttgatcactagtatttttctgaaatgtatttttcctttttctgtataggcttatttatgttttaagtaaaattgccctaaatctccaaatttgcattttatgatattaatttgaaaagctgaatattttctatggatcataacattttcaattgagagaatgttctatatgtattgagatcccagagcctatagcaaattctgctgaggagaatattgtctttataaaatgtaaaatagaggtacccaaatattgtcatcaatattatcttttattctgtttaaataatctttctctcacaaatagtttctaaaatttgtcgagtaaattgttcatttttgatgatttgaccattgcaccacattaaatatcttttcaatttttttccattttagaatagaatataaatttagccaattagaaatgagtgtcatcaagagttattccaaaatctaattttagaattaaaagtaatcttgcatactatatgggtttttattgttgaaataatttagttcttccttgtttttggaggaatgaattccaatctctccctgtgtgcaaacttttctttttctcaaaaattgtaatttactaaaaagtttcaaaagctggttttcggtgctgtatttgttgaatattttgttaaagatttccagtaatatttttggagtgttactgcaaacaagaaaattgccaattttaagtgtatacttcaaaaagttttgtcaaaggtacacaataacaacaatcttttcctatgcttttgttcattcatatttcttcttatgtggactacatattgaagtctgtgtccatttatctctgtatattaaattgactgggttcaagacccagctctaaattttactgaatattttactttgaaaagtttgcttagattttcattattgtcattttcctatattaaaataagaataattttaataatacctgccttgctttgaagatctggtgttctaatacctggaagataactagaattgtgcctggtgtatagaaagcaagaaaataaatgttaactattactattactgaaaaatattcatgattttgagattcataataccttctcctttggtttattgagatggttaattaaataaattgcataatctttaagatgaagtatatgaggaaatttttgctttggtattcagaattttttgggttatgcattcatatatgataaattatctaacaaactcaaaagggtgaggaatatcacactatacttaaacttcacataaatatttctgcactagtacatatgaatattaactcaaggaaagataaattaacaatgtgagatagagctaactgtaattacagttatactagaaacactacactttgtaataccacaaagagcagcttagttcaggttatagttctcactaagaaactataaaaatctgggttttcaaagctttgttagattgagcttttaggtaagagattgtggttctgtatttcccatctggaataaaacaatgtttgctctcctgatagtgtttacctgaatgtactatgctctcctgacaatcattacctgaatatactatgtatataaggcactattttcacctgttaatatttttaaagaaaattacaataatagccacaagtgggattatttcccaggcagactgtatcagatattgatatctgtagtgctgggttgattaaatagagccagaaggttttcttctttatgctgcagaatagttaataatgcatgggaattatttgttctttaatcatctgtgaaatgttggcctggcatttttttttttggagaagttaacgttttggttttcttaatttctctgctatattagtttttctatctcttcataaattatgttttttattacatcatctgtagtgggctcaatggtgccccccaaaaagatatcagatcctaataactggaacctggtaactttttttacagaagtgaccaagttgatgattgatatcgattggaaccagtgacccctctctacattgcactttctttttgcgggaataggaatgcgtacaactgtgatactatgcttttttgccactgtattttgaaagcacataacttgttttctactttaacatgtccacaaatggagagatattttacctgaagatggatgatactaagtgtcatctgtatctgatttaggttatttacatgatgagctttgagacttggagctgaagatatttagatcagattttctacttaagttgatgacgtaaaggactgagccatttggggatatcaagaagaggtaaatgtattttgcacacagacatgaatctttgggggccagaggacagttagcagtgggatgactgtgatccctaaacatatcaggtcctaatctctagaaccttgaaatgttacctttgatggtaaaggtttttgaaaatatgattaataatttggtgatgagaagattatccaggtgggacgtaattcccttcacaatttccttatgagagagagacagagattagacaggaggagacgatgcgactacaaaggcagacattggagtggtgcagccacaacttaaagaatgctgaaagccaccagaagccaagagccacaagaaatgttttgttctccatcacctctggagggagcataaacctaggagcacctcgattttagtccaaggatattaaatttggatttatcatctcttgaactgtgagacaatacatttctgttgttataagtcaacaggtttgtggtaatttgttacagcaggcatgggaaacttatacttcatctgttcatgtagggtttttttttttttgagaaaaacattattctataatattttaattctttcttgaatccatggttattttgatcctcttaatttgaatttgcattatttttgtatttaacacacagtttagaatctataacttagcaaaaaggcataagagcacattagaataggcatagcaaagcctatatatatgtcaactccacaaagttgacacacaacaaccaaacagtaaaactctagaggtaaaaattgttgttttgaaaagaaggatttattttaacgcgacaatatagtgtagatgttttcccctctgaacatcatgttgaattgtggtacccagtgttggaggtggggcctcgtgggaggaaattagatcatgggggcagatttcttatgagtgcttcagcaccgtctccttggtgttgccacaatgggtgagttctcatgagatctggcttcctaaagtgtgtggcatctccccccacctcttgctcctgctattgccatgtgaggcacctgttgcccctttgctttccgccatgattgtaagcttcctcaggcttcaacagaagcttaagctggtgctatgcttgctgtacagtctgcagaaccttgagccaattaaatctcttttcttagaaattacccagcctcaggtgtttctttacagcaagcaagaatggcctaacacaccccagatagcactgctgagtatctatttaagattgtatgtgcgatctttagaaatataacacatcaagaattagacaataaaagttacatgtatcataaagaaaaagaaaggctatcattatttatacatgatataatgttatatacagcaaattcaaagaaataaactgaaatccacataaattgggagaagagtttaaagtttcccagatataggagtagtatataacaattagtggaattgacaacattaaaacaaagtaacagaaaaataataccatttacaatggcaaaagtaattataaatatataggtaaaaagtctgttaatctgagtcctatggggaaaaatgataattactgaaagacacacacacaccacacacacacacacacacacacacacacacacacacacaatcagtggagatacacactatcctgagttacaaagatttagggagttgatgttacagtgtctgaggaatgatacaagctcttctaaatgcgagcacaggtagcagcacctggactttactctgctagattgcattttttgtcttttagaactaatgctcatgaggtgtgtgtgtgtgtgtgtgtgtgtgtgtgtgtgtgattcgacaggaactcagatgcattatgatgcacatctgcaattttgcctgctgtgaatacttcagatggaacccattgtagatttctgttacttagttttggattacactgctggaacaaccagggcatttttctagaatgaaataacttagagacttggagaaatacatgattgagagcaagttaatgggatttagaataaagcaaatccctagagtaggatataggatttgctgaatggtacatgaaaattcaaaagcagattttaaatagggacacctggccgggtgcggtggctcacgcctgtaatcccagcactttgggagactgagacaggcagatcacttgagaccagcctggccaacatggtgaaaccccatctctactaaaaatacagaaaaaaaaaaatacccgggcatggtagtgggcacctgtaatcccagctactgggaggctgaggcaggagaatcatttgaacccaggaggcggaggttgcagtgggctaagactgcgccattgcactctggcctgggtaacaagaataaaactccatctcaaaaaaaaaaaaaaaatagggacacctttgtatgaaggtggctgcacccgtgagcaggttccaagtgaattatttaatttcttgggtatttgatattaggtgatggcaaaatttataattagaatccagttcaagttattaatctcaaactttacaatccacttcattcttttttttaaaaaataattattccataaagttggacatggtcatatcactcttgtgattatgttgcagagggcagtgatacctgggttatctgtgagataaggcctgccttacttcagcattttcccattgtccctcccattcaggaagggccccttgggaaagtagtagctatacactgggagaaggggcagcatcattgttccatcaaaaacagatggtggcctctaatctgaagaagtgccctattgtaattggaggaaagtttactctttttaaatgactaccaaaaagtctgtgggaaaccacataggatcatgcagaatactggggtaggtaaaacactcgtatgtccaaagggacaatgtgaggagctagttaccagacccagagggaaagagttatatagagaaaacggccttgggaggaaaagacatccagccccaggtgacattttcaccgaggtatccaggaacgtaagaacctgaaccctgctttatatcctctcatctactgtggggatctcaactggccaactccactagaagaaagagggcaagggaactttgctgtcttctatacaggacatttctcaggcagacagcagaacgaacaagggcagagagaatatctagagaggcaaacagaagcacccagaacacagggaccacagtccttgagattcaatgcttatggtagaatggagagctgtgtgtgcacagaagtctaaaaagcaccagtaccaaatctatggtaaagtattgacaattattaattaaggtgaccaccggagtatcagtataaattgttttatattttccactatacattatgcattaaacatttacatttaaacttcaacaatttagattaaaaatatttcattaaatctatagatttaatttaactgaagtaaaagattaatcttttgtcttattaaaattgatacgtagcatcacctttaaccttttcataatggcaagagtcatcttgttaagtaacacatgccacgtaccgtggtgggcagagtgtgtagggctattcactttccatgaaatgactccagactgccgagtggtagttgtgccttgtaatcgtttctggatttttaacttatttcctcttccaccacattagactgttaacattctaatatgttaaattctaacatgctgcaaacaacacgcctgtccctagcagtttcctccggtttgcttgattttaattttcatgtgttgaaaagaaatgaaaccttagaattttaaatttagaattgaccttaaataatgctcataggttagactagtaaagtggttttaaaaaagccaagatgaatctagaataggaccaataagcataaaaggagctggattaaatctctgtggacttctaccataagtgaatgttagtaattttctatgtgaactttaagttaatcattgtaactatttctaaatatttaattatgcctactgcctagatttccattttactccaaaaagtcaaagttcttaagaaaattccttttttttttttttttttggagacagaatctctccctgtcaccaaggctggagtgcagtggtgacattggctgcagtgcagtgcaatagctcactgcagccttgaactcctgggctccagtgatcctcttgccttgacccctcgagtaagctgggattacaggcattagctatcatgcctgactaacttttttttttttttctttagagatgagagatgaggtcaagctatgttgtccaggctactctccaactcctggcctcaagtgattctcctacttcagcctccaaaagtgttggaattaacaggtgtgaggcaatgtgcctggcaaaaatgacctttgacaaatcaattattattggaaataaaatatatttctcatctgctgtaaataaaaacttatgaacattgtaatggaatatgacaggattgaaagcaaatgtacaaatgattactatgagtctcaattccaaaacagaaacccatgactacagctagggaaccagatgaagagattttaattaagttttaataatcttactgagaatttctctaggttacaaatatttcatacagaagagttcatgaaattgggcagactaattcaaaatatgaaaaaaattgacctcagagaatctagagacaacttccaagaagagaatataaattataaatcccactcttgctctttcctgcgtacaatatgtagcattagcaatgccagaaaacgtctgtaatggtcttttcacataattaactgtaagcttcagaaacaaacttgtagaaagaataaacttactatacacttactataaccacagatatatcatttctgtgattaaaatgctcccttaaatacaaagtttcttctaccaagcaaattccagactcatttttaatggattaaagagatggaatttctctcaaggcgtttattttaaatctctagatttaggccaggtgcagtggctcacgcctgttatcccagcactttgggaggctgaggtgggcagatcacctgaggtcaggagttcgagaccaacatggtgaagccccatttccactaaaaaaaaaaaaaaaagtatatatataaaattagctcggtgtggtggcacgcacctgtagtcccagctactcgggaggctgaggcaggagaatcgcttgaactcaggaggaggagattgcagtgagccgagactgcgccactgcactccatccaaacggggtgacagagcaagactccgtctccaaaaaaaaacaaaaaaaaacaaaaaaaacccaacaacaacaacaacaacaacaaaaattattttctagaaatctaaacaacaaaaattaggtctagaaatctaaaatgaagaaaattgtaaagagcatacaatcagcaactgaattaaaagtgtaatccaacatgtcactgaagaaacaaatcatctgtgtcttaacatagaattaatctacttccctaagtgtcacctgacaagaaaatacttaacaaaaatctttactaagatgatcataggcctagaatatttcacaaactctgcctgtatctattgaataatgtagggttccagtgtgttttggtctccctctaatagaatccttatttcatagtttccattcctctttcccaattagaaaacaatgacaggtatataaacttatatagctaagatatttactataatcatttgattgagattttgaattgagaaatcaagtcaatgtaatatatttaaaactgttcatttcacagtaaattagatatttaactctgttttagtttctggaaaccctaagtgtttttgctgatatatattattttcaataatcaagatatctttctcagttaaggcacaaaggttgtatccatcaattacatttatatgtctcaggttgattggtcattacagtattcattcaatctgataaaagctgcaaatgtgttcagtgatttgatataatttccgaaaatctgcaaagaaagacttatcatctttgaatacccaagggtttgaaatgtgacagcataatacttaattttgcaaaataaatccaagtcaaaacctcatgtgcgtttgcaatcattaaactgaagtggggaatgaccaaagcggtatgagtggtcaccagtaacttgggatgagatgggagagtaagaggtagggatacaggcagcagtggagcctgaagtggacacaaaggaggaggggaaatgagatagaagaaaaatcatgtttactatctacaagtaggaatgagaatagatctcaaaggcgcgggaggatataagcctgcaattgaggctaaggggtcccttgagaattatactgggacagagagaagggagctggatagtgtggtggaaccagaactagaaataatataactttcacggcaaaagtctgaaagtaaggttctctataacattcattaactcaagaacgccaacagtatcgatgctgcaccaagaacagagtgcaaagtacaattatatagtttttaatcccatttaatttccttagtgagtcaatgaggtaaatattgttctagagaaaaagctgaaacttaattggtttacataactcagcaaaaatcaagttaaggtagccaaaacttaaaccagaatatatgtaactatatgtaaatagcacatagttacatagtctactatctcaaaaggctttagcttatgaattccaaagagaatcaagctttattataagaataatttccaaaatataattattttctttatacctgaaagacaattatcttaataatttggttaatttcaattagatatctcaaagtgacagcatagtttatttatttgcatctcatttcatctaggcagccacgtgcccagctaataaacaaatacattctgattttcctgggtacctttgtaactagaaatggttatctagacagaggtccattccacccttcattaccaccaccttactcacagaaatgtggatttaattcctgaaagttgaaaagggggacaaaaaggagtccagtcctttaaaacaacttgaagctgtcctactggctttgaactaacttcttccagttgtcctgggaaaagaagcctatgacttagaactttgttattgttccataaagccaattacgatcctaattgaaacaaaggtaatcatttattcagcgcttcattcctgtgagaacataaaattagggagtcagtgaattctgtaatggcgatttctacaaaatatttcactcaattatttttctttagagacaaaatgacaaaactttgtatttatatagagctgtgtgatttccaaaggattttctggtaaattattcattttgacctgattaattgtggtaattttttttttttaatgcagaaacaggagagatgctaatgtttgccctttagaaagaatagatctgagtttaaggggctttctagagattatgcagctccctagaagtgagaatgagtttagtctttaaactctcaatccatgactcatggtgctacttccatattgatatggtttggctgtgtccccacccaaatctcatcctgaattttagttcccataattcccatgtgttatgagagggagcagatgggagataatttaatcatgggggctttttcccctatattgtcctcatgtagtgaataaatctcatgagatctgatggttttttaaggggaaactcctttcacttggctctcatattctctctcttgtctgctgccatgtaagatgtgccttttaccttctgtcatgattgtgagatcttcccaggcacgtggaactgtgaatccattaaatctctttttctttataaattacccagtctcaggtatgtctttatttgcagcatggaaatggactaatacccatcttgtcaagcaatatggattactggataattcacttgatgttaattttcatgaagaaccacttctgcttttctctaaggtatttcatcatttattgttgctaatgccattagcatccaatatttcctaaaagaacacatattattcagaaatttagaggctgcttgtgtccataattctattcttaacataatggtaggttttatttaattaacgatttagttcctggaggatgttaaaaaacaaaatatcgttgattgattctttttaaatgataaataacatttgtcctcattctttgttctcaagaataatattattttaactgtcctttattgtaatcatagtaattaaagagaatcaaatcagtaaattaatagcttaaaaccatgagagactcataatttatctaacttgttagaaaaattgagtccaacatccctcagcaaaaatatctcatacctcagtgctacaaagaacattgtaaaaagtgactgcagaactcccataacactaaactagtatttgaaagagaatataggcctattacattatccttataaatgattaatttttaattcataaaagtttacagagataaaagtgttttgtttataatgtaatataaaaattaaaatctattgtgtatctagaaaaaaattctagacataaaacctataaggggaaattgctcctgttaatctttgcttttattaccccaaaacagggctataactagtctattgaggactttcctatgggcagtagagaaaggaacaataatgtgaacaggttttatgtactgcagaaggatcaaatcttgttgagggagtgaggaggtagctattgtctagggtggggggtgatggctggagttgaaagccctgagggaaaatttaaaaataccaataaaagaacatatataagatattgcattggtggcacttaaaatatttgctcatgtttttccaacctaaaaacaaaggtctagtcttcatgcaaggaaaattatccatattttggattgtttgaagaaaagaaaatacaattgacacatttgttagtgaggtacagcttacagggattcacagaattaatgggtattagatgtaatactttaatctctgttttctgcaaatcatgaacccccgccatgatgggtttctacagttctagacctgatgtatttctaggtctgacctttatgccaccataaagtaatttaacaaacacctctaaaaataaaagacatggttcacctcaaaaataataagggccaagaaatttaaatccttttgatagcttacattcaatagcaataacaactcaatacaattacacatttaaagtacatgacaaaaaagggttaaactttaatggattgaaagaaatattttaattatactgtttgtaggctgtcataaatagtaatagccatagtcaaattttgcaaacatggaactatccctgtatgcttacatagacataaccatttttcaatacatctactttgaatgcttaatctatgcaaactttcagaggcatatttgcctagtgttagtatttctgataaaatagttttatgttagtttccagcaaaatggttctctaattaggcaagtatatgtggtcaattatgtttatttgaataaactatggattgaaaatggagttttatgttctactctgctatttgaagactaaaaggaagagatggtgatgcttgatgaaacaatggatgctaataccatgttttccccttatctacagggtatacattctaagactctcagtagatgcctgaaactgcagatagtacagaaccgtgtatataagtatatatatggttttcccttacatatgtacatacctatgataaagtttaaattagaaattaggtacagtaaataataacaataactaataataaaatagaacaattatcacatatactgtaataaaagttacgtgaatgtggtgtttatctctcccaaaatattttcttgtactgtagtcaccctacttcttgggatgaaacaagatgatatgaagcttacaggatgagacaaagtgaagtgaataggcactgtgaatgtagcattaggctacgagtgacctaagtggcaggtagcatattcaacgtggattccctggacaaagggatgattcaagacctgggtggggaggtccagggacggtccaagatttcatcatgctactagaacagtgtgcaatttaaaacatataaattgtttatttctggaatatttgattaatatttcagactatggttgactgcagtaactgaaaccgtggaaagcacaaccacagataaaggggactactgtaatattaagcattctacatttctggacttatccagcatgtaaacttctcacatataaaaaagtcatcataaaataccatggctatcatggtatcatacacacacacacacacacacacacacacacacacacatctatgtacacatcatagcaattaaactgaaatgtgatgttaatcatatgccatatccaatataaaatctataattacatgtatggccaaaatgctccacgttattttggcaccgatgtattagcttcaatgtttcaagctctttgaaggtttaaaatatatgaaaatgctctgcatattaaattcttttaaaggcccccttgttcaggaaagtacataatcaaaatatattgtcttatggaagtattccttaaaagagtatattttctatgatattaacttagtagtcaagtattagtattagttcatttcttatctagcattttatcttttatattcatatagtattttaattttagaattttataaaatgagattttagatgcctaacaaaatgtataagcatcttgagacaatctacacttagtgattcaaacgggacacttttttctgtattgtgctaatcttaatttgtgaccctacccaccaaaagaaataaaaagcagtctttgcaaatataagaatacaaatttagcctaccatttttcatcttttcaaataagcagtatttatgggttaaccacacttatggcttaatatggcattcacttattaagaatgataaccaccttaaattagtctcacaaacaaaatattatgggacaccttgtattgcaatgttttgccaggcaaaaacatcactcattctctgacatcaaatatgcaaagtgaatagaaggttgaaagcgcctatgactttttaaaggtattcaaaattacacatttgtaaaacactgctttgcttccatgatttagttaaatcattttatgtatttcaaattgtatgtctttgtttcactctaacgtgaaatttaaaaaaatacatacacttgaccagtatctagtcctactaatatatacaatccacgtggatctgcatgttatatggcttcatgataaaacagtaaactatcttcacaagattagtaatactattttttaaatgtcttcaagaaagacaaaggtttaataggctaaatttgatagtattgttgatatccagcagaatcaaattatttattttctgttgcttaaatgaaaagtacaaatatattcctattgtatttcaagttgacccatgattctctagatgtagtccccactaatcagtggcaccactgaattcagagacaaatccttcctgatacacacaatggaaaatactttaataagtgaacacataagaatctataatactattgcacaaagagaataatggtcaacaaatggctcttttaaaatgcattatttgtcactaaatacactgccattataacaagaaaccttttgtgctttaaaagggtatgtttctcagtaaaatatttatgcttttagaaattaccagactatatagcccctgcacaacaatttcactgttattacacaaaattgtaaattatttctttttaaattattaatgcaattgaaaaaagaagttttcaggcttatagtcttttgaaaggacagcaaaatagacgaaacaaaaccaagatgacaatttcagcatttaaaatctacacatgataattcaaacaaatgttatgacatttaagataatgaaacccttcatttattctactatctggtatgagttttatttcacatataaggagtcagaacagatgtccaaatattgtaatgccaaaagaaagttagggcatatcttgattaataccctcagagctgcctgtagtgtctctttaaaactggcatggtttacttcaaaacaactattcaaaatccattctaggaagcctagctagacaaagattcccaagacaaaacgaaaacaataaagcttagtataacccttttagcaatgtgagttgcgtattattgacagaacattcattgcaatcagtaaatgattaattgcaaatttgttgctaaattgaccacacaaaaaaaagagacaagcttcaggctactgttaaagaggaaaaacttatgttaaaaattattggaggcttcttgtagtgaattaattctaatcaatatactttttgactacacagtggaataatgacttccttaaatatcagaggtacccattattgtagacattcaaattaataattaacatactgacttgcatttttaaaaaatttacggaagtagctttttcttttgccttacctttaacaaataaatagttcatgtttcatcaaacatgtgcataagatttgtttttgaatttcaaatgtagattgtagaagtaatgcccatatggtcaaacttataataattgcctgaagcaatttgttcttgggtttttatgaagataaacctcagtggcatattaaaaatataaaagtttaaaaggtggtaagatagatggatgggtatttgtttctcagttacaaatggctatgctttacaaaaatggtgccttttgggttcttttattcatatcagaatgatcaagcaaaaatgagtggtataagggtacaatataatattttgcacaaaagcaacattttcatcaaaataacctgcaaagtcattttcagaatatttattgagcacctattgtatgccaaacactgtgctaggttctgaaaagacaaaaattaaataaaacatagaacttctgttaggcaaataatatttgtaaatctcttcttcccttaactactcatttttctttgaaacttattggaaatgcatcagtgacaaagaggcagaaacattattctaaagtttttgaaaacagaagcaataacttttgctacaaagatgaaaacagaggataaataaagctgcttcagatatttataataatttgatgactaaaaaattatgtcagtgattatgtagtcctatttctaggtaaggtatccaaagtcactacagctaataaggatatatttctaaaaattatgtgagggtgcttcaaggtctatattgaaggaggtggggaagtggtaagaaaagtgcacatctttaaaatgtggtataatatatacaatggaatactactcagccataaacaaatgaaataatgtcttttgcagcaacttggatggaactgcaggccactattctaagtgaagtaactcagaaatcaaaaaccaaatacgcatgttcttatttataagtgggaggtaagctatgggtacacaaaggcatacagagtagtatattggacattggagactcagaagcggggagaaagaaagggggaaaaggaatgaaaaaatgcctattgcatatgatgtaaactattagggtgatgggtgcactaaaatcctagacttcaccactgtacaattcacccacataacgaaaaactacttgtacttctaaagagattaaaataaaaattttaaaataaaacataagaaatgttttaaaaaaagaaaagtgaacatctttggtttctacagtagccctctatattgagactgtgttatacttttgggatgactttacaaagaactatgaagtccatccccccatatcataagatgccttccttagctctatgttcctaggctctcctaatggtattaaacaatcatgtccctatattcctcagtgtgctttcagccaggcataaatgaccataaatagcctctgctgcataatccagagcaccaaatggcctggagctagcagacaagaattcgaactttgctgcatcaccccaaataacaataattcactaagttattgaatgttgtatgttattatgcagagagtgaacaaactgacattcagcaatgctagataatttgtgcaatactgcaaaaccaataggtgggttcagctggtatttgaacacagctcaattgcttccttctgttctaggagatggcttgttatcttatttccacaatacccactgaatattgaaaaaaattcctttatataaccaagtgacactcatggaaggacagctcattttctagcactcaaagcatacgttttgttgtacatttaactttattgacacaaagatgcatttaatatattcttatttatggattatgttccatttttgagttagattcttaactgttataatacatggggaatatccatgctttattgtatctgagagttttaagtatagaaatatttttcacttaaaaaggtatgtaatttatatctatttctgcttaatttgtgaaaacaatcttttaaagcaaacaataattgtcctagtgaagcaaatttgccaccttacacattctccttaatagcatttgttgatttgttgaagatgcttaccttgctcaaatctgtttaaatctcattaaaatatattcacaaacaagtgctccatttttaaaattgctctgctaaggatacattaatacagtcaacttaattaacacaaagtattatacaatcataatgatacaaatttaaaaggaaaatggaataggtaaaaagtcatcaaattttaaaaacttgagtgatctgtagaaagtcaagaccagagattcagagaataaaataacctgtctaaatgttaatgctgaacaggagtagaactaaagtgttctgaattaaaatgcaggcatccttttcgattttatgattaatcatcagaattaaagtcaattgaaggtaattttggggaattgctaatttagttgatttttttgccttgaagtttacagcattctgtcaaagcatgctataatgtatccagtagtagtagtacactttttgttaggaaggaaaagagaatccaactaatttgtattttgcaatgagtaaatattaattccaacagaataacaatgtcaaaattaccaattaccttatacagcaatatagtttatttacttgcggtaagtttaccaattgctcacataagggaaatagattatatttggtaaggaaggtcaagagagaggaatcacttggagatgggctggaaactgggttttgaggatgaagaaaagacattgtgtgtaaacatgaaggattttgaaagtatgaaggtaaagagttttaatttcatttcattgggaagtttagtcctctgaattaaaaattcttgaacagaggtagagaaaaggtgtttcttagagatgggcatcattctaaaaagataactctgtggttcggtttttgagttattattattattttataaatgataaattttgcactggttgcttgagtagtaaaatgtagcaaatagtcccaaacttctatatgtttaaaattattttctgccccttttactgctttttgcccagaaagataactaagtttgttctgggctggtatctaggagttaatatcatttattattattgcttgaggctgagacttaacaactttggcaggaagcaagtcttcatttgatttgaaaaatatggttaattttgcagtatgttttgctcattcagaataattcttcaaaagaaatatgggtgagtatttgctagcatgatccacaaaaacattattggctatcacccccgaaagattagttttggtttgatttctctcccttctggcttaagtcttcttgaataccaaaagttagaaggaagacatggcagatcagtgatagattatcataatcataaaatcacaaaggtggagcctcacagatcatcttgtttgaaaattctttttacaagcaaggaaactgaggcaacaccttaaatggaatgatttacaaataatgagctggtggcagagctatggctcatgattcctagtacataacctttatactacataaactaacgttaatatcaagtagtggagaaatcaaatattcttctgaaacgtaaatgacagaaattgctcaaagcatagcctagtgtagtaagataaaggaaagaatgattaaatattttccaaatgtggaaacaaaaaacataagaactgtcatagtgaatcagacccgtggctcatcccagcgttttcttttaggcattggctttgagaagagaatacatttcttttcccacaggtcaacttcaaatgttagaaattcaaataagttgaaccaggactactataacctaaacaggttattttcccttgtggagttaatattcacaaattcgttctggcctttttcaatactttacatatttttatgttccctaattttatatgctccataacattttaaaacttttaaatattttatttgctgtaaatccatgctaacttttaaaaataaaacaatatcctccttttctcgtagtctaaattttattaacatctttgccctttaactgtattgatccagactataagttttcttaaacttcacctttttgataaaagaacaaagtgttttcaaattatttttattgatcagccttttaaataaaattattttacctttatcagcatttaaaaataggtattttttattatgaatttgtttattcattgaacccttattctatgtttagtactggagtaagggtttaagataagaaaatgaaccaaactaaaaagtttctttatttttttttttgctatcatctttcctaaaatagtacaatcaagagtacaagtttatttcaagtagcatttccatatatttggtaaaaatctttctacctccatgtttttaatttcactattattattaaccataaaaaataaaaagtaaataatacctacaggtattactcctacaggtaagcagtctcgtggtgttttaagcatggtgcctggtagttgggtgtgaaattggattcggtactaggtgattgatagaagctcaaaggaccttatggagtctactggtgaagatttgaaggacagtgagaaaagtgttatcgagggctagaagaaacaggacaactgttgtatagcggtgaaatatttagcaacattcttgcttctttttacatgaaaaatataaaagatatctataaatatgacaacggctgtaaacatttctaggcaaaatgtagaaaagtgttcagacatattctagctgcatataataataaacgggacaagaataaaggaatttaaagttttaaggcaaaatttacagaaaatattaataagcttgatgagtttgaggataaaactatttctcatcctgagatactcccagaaaaaatattctcaagataagaattggcttcagggaaaaaatcaaatccagtgtactaccaataacatggtgggatctagggttataggaatcacaaggttgtgactgtatgatttttgttaaaaccttaaaaatatttaagggcctgcccaggaaggcttctagaactcttaagagaatgctttatagacggattcaattaatagggatcttcttaaggacagtgtcccaaagtagcatctcaagttaaagaaatatcatcaggaggaggtatatggttatggcttttgtctgattgagcaacttataatttaatacataagaaacatacaaagtttttaaaggaatgcttatagtttggctaaaagtgatagaaacagtacaaaatgaaaagaggttgttgaacctccaacctactgtgagaaggcagcaggtggagaaacttgcttaatgaaaaacacaaatatgtgtctctggaaaagaggtaatgactcaaacagaagaatcaagagctcagagaatcatctccaggaagctgaactgagttaaaaacaagaaactggcaatacgtgttctgctggatttcataattgctatgaacaaatgactgctgtgtattttgtgtttccttacttttcgaatgggagtgtctattgccattatcctatgtcattttatgttggatgtatatatggggtgcagataatttgtttctttagttaataggtttttatttcaagatgaactatattcaaggagctgtacctgaggaagtacactcaggaaccccatctatatcctgacccgatttaaataatggggtctggacttcgaacaaataccataatgggatgaggtttttgagggtcttggaagatggtgagtatattttgcatgtgggattgcaatatatttttgggttaagagggtggacattgtagcttgtctcaatagtagctgccattatttttttccctacttgttcacacatgtcataccccagtgaaagaggaagtctatttatcttaatgtcttggatgtgggcttgactaacagaatgtgatgaaagtgacattctaggcattgaagctttcacctgtttctcttggaaagcttgttttggaaaaaaccagctttcacataagaagtccaactaatctgttaccttcatgttttgagatgagaaagaagccttctcctggagagagagaagtcaggtagaaccaaggtactaggcatgtgagttaagaaaatattttagaattttatccccaaccccagctgccagagctaatgcccatgaatcaaagaaaaaaacatccagctatgcactttccaaattctccccctacaaaattgtgagtaaaataaaatggctgtttaaagccattacactttgaagtcacatgttacacaatatacaactcttaagtaaaccaaacacaactatactatcatttcaggattcatttataattctgaagtacttttggcaataattagttttctggtgggaaaatattatgtttacaagttggagtcttaaatgtagttgatagaaatatagagatcgcaaattttgacattagattggaaacttaaattgaggcctgatttagattatacataaagtatctatatgcataatccttaaaaatatgatgtaatctatataacactattctcttcacagagcaccccaactgcaaaagcactcttgctgtatgcactgatcattcaaatcccatcacaatttctatctcctttgaaataaacatagctaggattctggctttcaacattcctttcccattcacctactcctctcatcttcaacactttccaatcttcccctaaaggatcagtttacttacagaaaactggaatcaacaaaagaaccactagacagcttaacatttgagaggactagctctttctttgactttctgccttcactccagtaactgtttttctcccttgtgatttatgcctctccagaatctaatttctgtaaaatatctgcgtgcttgtgcttctaccattttttgttgctcaattgctcaaaaaatatgtttcttacctatttcaacatgtgtgtaagatctactgctgaatctacctgatattaatttttcttacagagacaataaagctttaagtttgtaagtttttagacagtttggtaagacgttattcttaaaactcttttgaaaaactaactccacatttgtgtgtctgtcatctccaagactagtcaatccctgcctatcacattttcccaaagaggagatggtcatttgaacagactgctttctctcttctataacactgcatgaattacttctattaccttattttttacctattttaaatttatatcatgatctatattttgactcatctttacttaatataaaatgttaatcatttaattatattgggagtacccttgaggcaataatagattcttatctttttatggaagtggttttaaaaaattgtagaaataaaaaggtggttttcaacaaatagtataaataagattaactccgagatttattctatgggtctgagatgaggctaagaatctgcatttcacttactttaggattccaattgtttctggtgcagatggccaaagactatacaacaaaatgctgctttagacaatagggatgtgatttaagacaatttcctatagtaatgtaaggcagcgagtgactaaagggcagagtccagttagaaaacctttgcagaagtccagagaagatatcaggagagggctgatctacacagaagcattagcaatagaaaggaggggacagatggaagctaaactagctattaacaagttcctgaaactgttttctattaaagctgccttagaaaatgaaaatgtactgtgtaagcactaaaacaaacacaaccaaaaagatgttttcttaactgggaaattatgatgtgcagttatgtttggtatctaaatgcaaattttgcatgtaggctgcatttatggaagaactgaaaacaaccacaatacactatatcatagtagaaacaaaacagactagctgtacttggcatagtaatgataagccctttaaattaaatctttatgcagattctattttatactccaaacttttcatggagccttgtgtaattctgatgtgtaaaccaacaaacagagaggctctgtgtatggagtagctggtttggataccagctggcttggctgtgcgcctttctaatggtaatgaagtcacacagctgctaggacaatcagctggagttcagattgtcactagctaaatggatatccattgactagcttcttatccggactcattaaagtttagtattgacaaatagtggctggaggtttacaactaagaggcatgtagaaatgaacttgttgactattttttccctatagcttttgctttgtgattcacagaatgtcattcatctgcttgagatgcatgattactaatgcactgtaaaattttaagcactcttctgcttataattttcaaagtgaatgaatgttctgaagcaagtagtcacaggcatcaataagttgtcagtatatgaaaacacaaagaacaatcagaaagtactatttttctttaaaacaaataaaaagaaggtatgatttgcacaaaaagtttataacttgaggttgatttttattttaaatattcttataggtattttactggataatttctaagagttgactgcatctacactagtcaacatgccactaaatactagatgatttcttttaaccaagcaaattggatagataagaatagtcactggtaattttgttaattcgatagtcatctcttgaacatgctaacacttttccaaatcctcaaaggaacaagagccagaaatcaacacctgttgggtcagaagtgaagaataagccttcatgttgataaagctctacggtgctatctcttaacccctggcctcactgaaggcatagagcttagatataatgttccattccttgtcctcatatcctatgcagtttgtgttcttaagaacatgttttgtcttgtttcaagaatagactaaacttggccagctgcagtggcttacacctgtaatcctaccactttggtaggccaaggctggcagatcaactgaaatcaggagtttgagactagcctggccaacacagtgaaaccccatctctactaaaaatacaaaaattagctgggcgtgttggcacacatgctaatcccagctactcaggaggctgaggccagagaattggttgagcccaggaggcagaggttgcagtgagcagagattgtgccactgcagcccagtctgggagacagagtgagactccgtctcgaaaaaaaaaaaaagaaaaagaaaaaataaattcaaacttacttccccactcattgtcattacagactcacttctacctttcacaactttgctgccttgtgaaggttttgaaaacactggatccatgctacccatgttttgcctccaaagaccaatgtaaaattgcctcctgactgtgtgtgtgtataattatctgccttagactatgatgacacctttaggctctttgtgaactagaaaaataaaaagttagcagaccttcctcaagaagatatggaagtagaaaatgctagagcaatacaaaatgtgaatgacgctcaaacgccagtaatttgcttctttaccatgtcctcatgtgtaaattctctttccctttccttgatctacaggacacttgcttactttccaggtctctttcctgtggattccaaaggcagggcaacattcttccattgtcagtagtgtaataaaaaatgttctcatttttattcatacccagatttttttttataattctgcctaatatcgtcaagtgtaagtaatacaaagcaggcctatggcattcattgttaaatgtatactctctagctcacaatgtgaaccacaaaaaataatccagttgtggattccagctgtttctagtgcaaatggccaaagactacaacaaaacacttcactagacacgatgactaaccactcttcctggtaactcagaataaagattttggcaaaattttctgattagagtataaaatttcatgcctcccacaaatcaatagatgtaaactcacccacataaaggatgttgtcttgactcaacagagcaagcttagtgcaagtccagaccttcatatgatgtaaaagtttttgtaaggcaaaatggaaaattcctacagttaaaaacttttgcttaatcatgttttaaacttcttaaagagaaaaaaatagactatgtagctataaaacatttattaaaaaaaggtagacaatatgcaaataaagtttctgtacactggcagagaactgtaccaggatttagacggcctggctaactctgggaactcaagcaagtcatttaatctctcttgatttgataagcaaaataagagttttgatttcatgaattcattcattcattcacaaaacaaagatgtgccatagattcagcaaggcactggaaaattggagagccacgcactaacctctgagggcagcatacctggaatccctagagtccctgccagtccaggatactataagtgggtgaatagagatatcattccttggaattttccacacaaaaaagaacaatgactgctgatattctctgctatggctaaggctgctggtactccttgataccctgtaatttgctgtcttttccagcaagttgaccattgattagctctggccagtggattgtaagtagaagtcatatatatcaattctggcccacagtagttatgtatcaagagttccattttttgccctcttttctattccatgtgcaggctggatgatgccaaggtgacatacaaatttgtattcacattgtgaggacaaatatggcagaggcactagctgcaagtgcctgatgtctgggttatttaaaagagagcagcctgactgatagacaagatataacacaataacttctattgtgttaagccatagagatttgaaggcctgcttgttgttgcagcataacctagcctagtgtgcttaactcaaacaactatatattattataaacctcactcaatgacatctaaaattaagagcaatgtattttttgatgctttttatggcaattcagaatctagtatcttattcactgggcatcataaattaaaattagtatttagattctgatattttctatagggcatattgccagttttaatgaaatacttaactcccctgagcatactgtcagaaatgctccaaaaattctttaatgtgccgtgtgaaagtctcaatggtctcttactaatcaacattataatggaaaatacacatactagttaataattaaatatgtcaaaccataaagtatatgaagatattttcattttgtattacactttgcacagaaaatttcacagtgttctcattttttactgctgttaggaggtatctgtgatttccatttcttctttcaccctttcttttcaggtatccagggagggccatatgttgaaccaatgtgataccccctgaagcaggctttcctcattagtatgctacgtcttgcagcattctatgtactatctatcgaaattccactatgttggcacaggtctgaccaacttgcaagtaggcacaatgccaaacatgcagatggcaggaggggaaagagccaaaaaaacacgtgagtcaactgtgggtactgatggcaaaattcccagaaatgcaggtccaaacacttgtccatcctaagcttatagtacatacttacagagacacagatttgtcaacaataatctagcactgagttagatcaattatttaaaatattttaaatctacttttggctactgtgggtaacaacaaggcaatgattcaacaaaggttggtgtttagtctttcgtctttacccagatgacttctcaatagacaatcaggcggcatatttaaacaattatttctacctatattagttatgaataaaggagaaacgtgcatcttgtctttatttatataaactatataattaaaacacaagaaaaatattaagacactatacactgagactaaatactgttagcacagtagggctcaaattgtggctctattaaatattcttccttgacctcttctgcctgcttgatcaaaaaaatttattgtgttttataaactagtaaacttcattatcaggactggatctgtgaacgcataaaatgaatagtacctgatttgaagatctttaaaaggctcattcatttaaataacccattttctgctgttttggcagtttgcctgaaatgtctcaaattattgccacttaggttaagctattgtatctcctgaaggtgttgattttagaaggaaaacattttattgagaaaagaataaaattaggttttgaatatataggtaggatgaagtttaatcattgcagtaaatgctccttagcaactactgtaaaaggctcccagaatctctacaccttacttttgagctttaataaggacaattcctattaaatcagttttagggagagcatctgttagataagttgatactgaacttctagaggtaaggttgaaaatactttgaaaattaatttgtggtatagatgacctatttaatatgtttctcaatgagtcatataatttagtcatgtctcttgaccccagatctagtgtttttgttactatactatcattctgacgttttacagaattgaattggttcatttatataagcattttcagtttaaggtatatgtaggaacatcacattcattcttcaagtgagtattttatgaacaatgtcatataaatttagaattttaatctagcatgaagaaaacaatttgccctttcaaaagtgagtctttacatcctgccacatttccagaaattacttaaattccagcatttagtacacatgacatttggtctctcttttgattggacaccatactgccatttatgttttgattcctggtcaatttatgtctattgcctacaggtatagcttgtataccaaacactgaaggcatataggaatacctcagagatattgagggttcagttctagaacaccacaataaagctaatactgtgggaaagagagtttctggggtgccagttgagttggtctcccctgtgtgagacacccatggggagccatgggtggcctctgaagagaaaagtctccctattgccttcatgtctttatgcccggagagaataaccactcagcggcatgccacaggttgctcagggagataacactcccttgaagcagtggagtataatcaaacatcttggctcctcctgaaacccactcccacccatttcagtcctgataagttaaagatcttaagtagtttagacacatgcctttgctcaaggaaattcacagaaaccgccactgctatacatcttattgaatgactcacgagttctccttcacatattaatccttttcctcatcggttcctccccctctcatctgccctaagaacaaagggcttataaaccaataaatcgggcagagcccgagagctctgggccgtgagcaagcctccgacgctctggtcccctggacccgccttttaaaagcttattctgtctctttctaactcctttgtctccgccagactcggggtacctgctgggtggtgtggggctggtttccccaacaaatccagtaggaaagtgagtcacacaaaattttctatttcccactgcaaataaaagttataatcacttggccaggcatggtggctcgcctataatccccgcacattgggaggccgaggcgggctggtcatgaggtcaggagatggagaccatcctggctgacacggtgaaaccccgtctctactaaaaaatagaaaaaattagcccggcgtggcggcgggcgcctgtagtcccagctactcgggaggctgaggcggggatcttgtctcaatgctgaggctgttgaccaatcagggtggtggttgctgaaggctggggtggctgtggcaatttcttaaagtaagacaacaatcaagtttgccacatccattgccacctcctttcaaaaatgatttctctgcagcatttgatgctgtgtgatagcattttatccacaggagatctttcaaaactggggtcagtcttcttaaatcttgctgctgctttaccaactaagttttcgtaatagtctacatcctttgttggcatttcaacaatgttcacagtatctttactaggagtgcattccatcccaagaaaccactttttttggctcatccataagaaccaactccccattcattcattttttcatgacattgcagttattcagtcacatcttcaggctccatttcttattcttgctatttctaccacgtatgcagttacttcctccactgaagtcttgagcccctcagagtcatacatgagggttggcatcaacttcttacaaactcctgttactgtcagtattttgacctcctcccaagaatcataaatgtccttaatagcatctagaatggcaaatcctttccagaaaggtgtacttttcccaggtccatttgatgaatcactatctatgacagctatagccttacaaaatgtatttcttaaataataagatgtgaaagtaaaattactccttgatccatggcttgcagaatgaatgttgtgttagcaggcataaaaacattaatctccttgtatacctccatcagagctcttgggtaactaggtacattgcaaatgaatcataatattttgaaaggaatcttattttctgagcagtaggtctcaacagtaggatgaaaatattcagtaaacaatgctgtaaacaaacgtgcttctattctggctttgttattccatttatattgcacagttagagtagattttgagatgattattaagggtcctaggatcttcagaatggtcaatgagcactggcttcatcttaaagtcaccaactgcattagctcctaacaaaagtcagccagtcctttgaagctttgaagccatgtactggcctcttttctctagccatgaaagtcctagatagcatcttcttcagtaaaagtctgttttgtctacattgaaaatctgttgcttagtgtacaccttcatcaatttagctaaatcgccaaatcttctggataacttgctgcagcttctctgtcagcacttgcttgctgtgtcaccttgtactttaaagctctggagatggcttctttccttaaaactcaagaaccaacctatgctagcttccaacttttcttctgcagcttcctcacctctcttagccttcatagaactgaagagagttagggtcttgctctgaattaggatttgacttaaggaaatgtagctagtttgatcttctgtccagaccactaaaacttgctccatatcagtaataaggctgtttcactttcacttcatagttcatgggagtaacccttttaattcctttcaagaacatttccttttcattcacaacttgaataactgtttggctcaagcggcttagctttcagtatctcttggctttcaaaatgccttcctcactcagcttaatcatttttagcttttgatagaaagtgacagatatgcaactcttcctttcacttgaatacttagaggccacggtagggttattaatagcctaatttcaatattgtgtctcagggaacagggaggcccgagaagaaggcgaaacagaggaatggctgcagcttctccatcagcagtcagcgaagaagtcagaatgcagaattgatgaggttcactctcttttatgggtgcatttgtggtattcccaaacaatgacaacagtaacatcaaagattacttatcacaaatcaccaaagcagatataataatgaaaatatttgaaatattgcaagaattaccaaaaagtgacagaaacataaagtgatcacatgcatttaaaaaaatggtgctgatagatttgctcaaaatagggttgccatagaccttcaatttataaaaagcacagtgtctgtaaagtgcaataaagcagagcacaataaaatgaggtatgcttgtacttcagaacaacaccagcatacttatgtttgcaaaacatgaaacacaatcatagaagctgatgtttgagaaatccacgttatttttaccttctttacaagatggaattattgggtttcatttgattaccaagaaggattttaataagttatacataatcaatgactatccaaagagtagaattttctctatcagaactatgtttttcttgtagtatattaacatgttaagagatagccttactcttaaagttcaacttgtacatcagatagattaaaatgtcattagcttgctggaatgctctttctataatctcttcctgacaactcagtcttttattttcttttttaatttttcttaaatcattcctatagacgtctcaggttttagaatctgacttccagccattgagaaaacaaagaaactagtatggtagtgtatggttttctcaaattataattaaggtgtacatataaaaattttaacacctttttttctctactaaatgtgattagaaggctccctgtcccttatatattatagaactcaattataacacagcttattattatacaggttttgaaacaccagaaattataaaatctccctcagacaaagtttacacaccaaaacctgaaagagcttatttgaactaaacgaggaggttttgctttatgatcattcattttactctcttctatattccttccttccttcaatcatgtggtcatttattcattcaccaagtaattgttgaaaatttactacatgtcaagaactggggcagatacaaagaagatatggcatgtagccaaaagaaaattcctccttggtacaaggttcagaattgaaaagattatataatttctgtaatgaatacgtgaaaggagatgaggttttcattcaaggtagaaaatgacatccattataaaagtgctattaataacagccttttaatatttaaaagagaagagtgattaagacagaacccatactttattattctatcttctacatgtattaagtaggtttgaccatattcaggtgtattacatataattaagaataaagctaaaagttctctttttttaatccatatgggacacagtagatggctgtgcctattttaagctatcatatttatgtaaacagcttaacttgccttttctgagtgtaaatttgttgtgtattttgcactttctcatcaaattaaaatgacttagttatgtgagctcaatcacataatacctttgagagtttattcattcaactttaagacagtcaaacagtctcattctgggagcaattagcactcagataattattacctatattttcatactatgtcaacagaatgattttattaaaacaaaattttttaatacatctattgcattttgggcactatagttgaaggtcatttttaaacaagagcagtgtcaaattttacactaaaatataaataaaacaatattttattactagattgtgaatgtctttatatgtaggaactatatgttgttcatctttgtatactccctaggatgtagaataatgtttagttaaagcagaaagttaaaaagtgtagaattaaattaaaataatgagcatatggattgttttctaaatataaaaatgttttatctagttgtaatgttctactagttactaactagttaaaatgttctaccttttattttataccaaaatttgctggtattgcttttggtctactgacatttctagcatttaattaccacaaaagcaatctgattcttttttaacatgttactttttttatcaatgtaaattaaaatcttaaaatccataagataaatgataaatgttaaacatctataaaatgccaatggaaaccctactaattaacttgagaactgatttgattttgggtaccacttaaatcacaaggcttttatagttctatccaatgaaattatttttataatctctttctaaattgtgatatacatttttaaaaatatttgattttcttgttgaaccatgatgatacatttccccccaaaatacataaaaagttgaatagactgctgtcttcaaaattaaacatttagttcagaattgacaatgaaagcatatatatgaggatcatttttccaccttgaaataatcttttgaaaaataggatattaacttgactttcctcaaagctacttacaagtagaactctagaataatcagttgcattatttggacaatatgtagatattttcagcttttacttttacttgcacccaatagaattttattgtaactgcaaataattgtttattgacagatttgaatatataatttaatatggatgggtaacttaattataaaaccagcatggaattaaatatttctgttattaagacagatgctcatcagaatcacatatattgagatcttatttgtatcaaatacagatatttttatttttatcttgtatcaaatatagtaataaaatgaatgttctcaattaattgtttcaacaaccttatgagaaagatgccattagtgtcccattttaaaaaaaggaggccaggtacagtggctcacacctgtaatctcaacacattgggaggctgagacaggaggactgcttgagcccaggagtttaagatcagcctgagcaacatagggagaccacaactctagggaaaaaaagaaattggccagtggtagtccgcagtcctagttactcaggagcctgaggtgggaggatcacttgaacccaggaggtcaaggctatagtgagcctgcatgacagagtgagaacctgtctcaaaacaaaaacaaaaacaaataacaaataaaagaaaaggaaactaagggttagtggcctcaagatctccaactcagagctgagacgttctctgaataatgcatatttcttaactaacaattgttaggtttagagggttagaaagagttgattaacaaatatcaaaatcaaataaaaataaaaagtagaaacacattatgacatcaatatattatttcattatttttcctaaattagcaattgtagaaaaattacacaatatctctgaggaaatggattatggcagattctgtgattatttgccaggaaaacatgaaatcagtgataactgtatttgagatctcataataaggaaaaaagttgtttgcattgagatggattgtatctctgatgtccttgactggcagaccaaacactttttccctgctgttacaaataagtcagaaactgaatcaaacaatctaacatgtttaataattaaaatatattaaactacgttttcatttgcctactaaagttggatatcaacagatttcaaaaagagatttaggcacctcatccaaaaatgtataaatcaaggaaaagaaaaaatcaataaatttcacattttaagtgttcaataccaaagtatttattcagcactgttgtaatctgacaaactcaaccttctgtctttgtcatctagaaatagaaccttcatcactaaattatttgaataatcaccttgactatttttcttaaaactacttggattatacgtaaataatgtagttattacagaactataagaggacttctcattccaaattgctactttagaagagttagattttatttattttttgagagaaaggtcttgctctgttgcctaggctggagtgcagtggcaagctcatgactctctgcagccttgacctcctaagctcaagcgatcctcctgcctcagcctcttcagtagctggaactacaggtatgtaccaccaccaccacctggctaatttgtttatttttggggggatggggttttgccatgttgcccaggctggtctcatactcctgagctcaagcaatctgcccaccttggcctcccaaagtgctaggattacaggcatgagccactgtgctcagccatatttttaaagaaaaacaatttttcatatctcaagtaaactaaacaatgtattactctagttatgagtaatatgttgttggaattctcagcaaatgaaacaaaaaagtaaactttaaagaagtacatatttaaacaaagtcattgaacaaagacaaaaaatatgtctataaaaatcaaatatccactctctcccagtgccatttgtaacaatactgttaatactttcttgcctagttgaagggttcaatgtactttccaaaatctgtaatttgcattcataatttggaattaagttgaagatctgatctggaataagccattcacatagtaaagatgagtgaagaaagctgtgtggttcagaggcacactgaagaagagcccatcctctctcaagggaaatctggtgccctgcttcagttcaacactgccatgcaagaaagatgtgagggaagttatatttctaggcattttattctttttgtggccattatgaatgggattgcattcttgatttggcttcagcttgaacgttgttggtgtatgggaatgctactaatttttatacattgattttgtatcctgaaacttagccgaagtagtatatcagatcaaggagcttttaggcagagactatgcaatggaaatcacacaatactgctcaaagaaatcagagataacacatccatgctcatggacaggaagagacaatattgttcagatggccatactgcccaaagcaacttacagattcaatactattcctatcaaactaactatgaattcttcatggaattagaaaaaaaaaattttaaattcatacagaaccaaaaaagaaccttaatagtcaagttgatcctaagcaaaaggaacaaagctggaggtgtcacattacccaactttaaactattctacaaagccacagtaacccaatccgcatggtactgctacaaaaacgaacacatatagaaatggaatgaaaatagagatctcagaaataaggccatgcacctacaaccgtctgatcttcaacaaagctgacaaaaacaagcgatagggaaagaattccccattcaataaatggtgctggaataactgactagccatatgcagaagatcgaaactggaccctttccttataccacatacaaaaatcaactcaagatagattaaagacttaaatgcaaaacctaaaactataaaaaccatggaagacagcctagggaataccattctggacataagatttggcaaagatttcacaacgaagacaccacaagcaattgcaaaaagaaaaaaaaaacccaaaaattaacaaatgggacctaatcaaactaaagagcttctgcacagcaaaagaaactatcaatagagtaacaacctacagattggaaaaagcttttgtaaactatgcatctgaaaaaagtctaatttccagaatctaccagaaatttaaacaaatttacaaggaaaaaacaaaacacctcattaaaaagtgggcaaaaaacatgaatggacactgcaaaagaagacatacacacagccaacaagcatataaaaaaggcccaaaatcaataatcattaaagaaatgaaaatcaaaatcacaatgagataccatcccataccagtcagaatggctatcattaaaaagtaaaaaaaagtaacagatgctggcgaggttgtggagaaaagggaacacttatacactgcaggtgggaatgtaaatgagttcagccattgtggaaagcagtttggcaatttctaaaagaacttaaagcagaattatcacttgacccagcaatcccattctggggtatacgcccaaagggatattaataattctgccataaagacacatgcacgcatatgttcattacagcactattcacaatagcaaagacatggaatcaacctaaatgcctatcagtggtagtctgggtaaacaaaatgtggtacatatacactatggaatactatgcagccataaaaaagaatgggattatgtcctttgcagcagcatggatggaactagaggccattatcctcagcaaactaacacatgaccagaaaacaaaataatgcttgttttcacttataagtgggactaaacatcaagtacgtatgaacacagagaaaagaataacagacactgggaactctttgagggtgaagattaagaggagggtaaggatcgcaaaactacctattgggtactgtgcttattacctgggtagcaaaataatctgtatatcaaacccccatgacacacaacacataatttacctatatagcaaacctgcccatgtacccctgaacctaaaagttaaaaaaaaaagatgagaggagtactgccacatcttgtgattctttaagagatacgtgaactttaaaactttgtgtgtaatatataatacttctatttaaaaatatttgccaatctcacattaaaaaataagtttttggcttctgaggactcaggagataagagttgttccccagaaaagagagaattctactactataggaatttataggaatgtggctcttaaattttagcatatacctccatcacccagggcatttggctcctggggactcaggagataagaattgttcccaagaacagagagaattctattactataggaatttataggaatgtggctcttcaattttagcacataccacaatcacccagagcttgttaaaatacagattctttgggtcctttccttgacatttggattcagtaggtatgggatagggtcagagaatttgcatttccaagttcccaggtgattgtgatgctgctgttccaggggccatactttgagaatcactgacccactttggtcataatttgaaaaaccctacacacggagttttttcatttaaataaaaggaataaattatgagccactattaactttttaaacaattttattgatgttaatgtatgtatcataaaattcactcattgaaaatacacaattcaatattttttggtaaatattttatagagttgtgtaactataccaaaattccattttagagctaaaattcagagctacaattttttttccaaatctgtttgcaatcaatctctcctctgaccaccagcctcaggcaacctctgatataaatttttttctgtataaatgggtttgttctgctttgttttacataaatggaacatacatgcaatctttccatccagcttccttcacttactatgatgcttgtgaggttctaccatgttatagcacatagcaatattttgtttcttttaactgcaaactaaattttacaggtaaactgcattttgtttgtccattcaccagtttatgggcttatgaattttcccagtttttggctataaagaataatgtcgatatgaatattacatacaactatttcaatgagcataaattttcatttttgggaggtatatttctaggtgtagaattaacttcttaagaaacttccaaactgctaaagtagttgtttcattttatctactggaaactagtggaggttccaggtattggacatactcaccaacactgggtactgtatggttttttgattacagccttctcagtgggcatgtagtgatatatctttgtaattttaatttgcatttctttaattattaataatgttgatcacatcttcattttcttattagcatttataaaaaatcttttgtgaaatgtctgtttaagtaattagtctactttttaaattggattgtttctcattattattattggagagagatatttatataatctgggttcaagtcctttatcagatatatgatttacaaatacttttccactctggcttatctttccattttcttaatggtatcttttaaagaacaaatagttttaattttatcagattccaatttatcttattttttatttatgggtctttcaatataatgtctaaagacaccccgcctaacccaaagacacaaaagatttcctcatattttttccagaagtgttatagttttagaacttattagtattattgacttttatcttttttcctattttttttttttttttgcaggaggcagcctaactggattttgtcggttttcttatcttataaaaaaactagtctttggtttcattcattttctctactatttttcaactttatatttcattgatttgtgttctaatgtttattattttcttccttctgctttagatttagtttgcttttctttttatgatttttaaggtataaacttaggttactaaggcctttttttctcttctactacaggcatttacatctataaatgttcctctaaaccctgctttagctaccttgcataaagttttgtatgttagagttaaattttcattcaggtaaaaatatgttttattcttctttgtggttttttttgatccatgagagattcaaagtatatttatttaatttttactctttgttgttttcccagatttttttctgttgtgaatttttaataaaattttgtcatggtcagagcaacacctagtatgatgtcagtctttttatattcattgagacttgttttgtgaaacagtaaatggtttctaatagaaaatgttccacaagtgcttgaacagaatgtgcgttctgcattcatttggtagggtgtttaatagaagtcgataaatgccagcaatggaatatttgtcattttttaatctgggaaggtctgtcctcagagatcttcattattaaatgattctattgatgaccacactattatgttcatccaatttcatcatcattagaccataatattgctgaacatactattcctatatgagaggggttttttctttcagccctttgaatatgttattccactatcttttggcctttgttgtttctgattagatgtcaggaatttttttgtattgtcctttacctgtatgtaaagagttatttttatgttgctgccttcaaactctgtgtgttgtatgtaatattttcgtttaacaacatttgccaaatgcacattaaaacaatgtactggtacaaaaatagaagcatagaccaatggaacagaatagagagcccagaagtaaggctgcacacctacaaccatttgacctttacaaaaattgacaaaaacaagcaatagagaaacaactcactattcaaaaaatggtgctggaataactggctagccattttcactttctctttgtctttccacagtttgactcagcgtatcctggtgcagatcacttgatatttatcttatttgtggttggttgattttagagtgctgtagattaatgtattacatcaagtttgagaaactttcaaacattatattctttttttctgacaccgcagacctgctgttgagccactctagtgaatttttatatttttccgttattgtactttttcatttccataattcccagttgtttaatttaaagtaattgttatatcttttttgaaattatctcttcagtgagttattttcatggatccctttaattctttgaacaatttttatttttaaaacacatttataatgactgttttgataacaacatctatgttttaacatctgggaaaattcagaaactatttatactgactgcttttgttcctcagtatgagtcacacgttcttatttctttgcatatctcataattttctgttgaatattgaactttttatgcaacataacaactcttgatttttactttctcttcttaagatgtatattttttttggcttgttatttattttgtaattttgcctggactaaatctgtgaagtctgccttttcactgtgtatgacctgcaatgcagacctcttctacttttgctttttcttattctttatttttaagctttgcgtcctaagggtgtggtagtgtgttgctgttacacatagcttagcgttcacccaaagattggtcagagttgtgcttaccaccttggttattaagtgtttcattttttgctgatagatatatatgtggcctaaacagaacatttacattttagattacatttgaagtttttccaggcttttactttacataaggctttctgacatctttgtcgcacatgcatagataggctttaaaggcccaggaggtgtgggtagcttgggcctgttgtgttctctgttgttcatgcacataaactccagtcaacctgagatatatgcggcgtttatcaagccatctttgactgtccaacctcccaaaaatgtctgtcaaatccttggctagtccactgatgcactgaatgcaccatataaatgtgcacactcatactaacgaaattgccacccttcctgttctcttgcaactgagatggccacttaaactggtgatactccaaatcaaacgagccctttcggcagtggcagcaagccctgccctgtcctggttgaactaccatattgacacaactggaaagggggtggatgggagcatgcccaggaaaaaatgccatggtcttacaactgaagttcatgcattttattcataaacacttagttggttttatgcctttggttgaattctggagcaaagaattacttgtttttgacaagtttgtccagctttacagttttttggggaaagaatttgtcagcttctcactttgtcatgccttccattgactttcgactgcttgatttatacaaaattatttaaaaataacaaaagtttagatagagaaatatatggtattcttatacagataaaagaactgagacaagaaagcatacggaattggcctagtttttcactaaaagttaatgaccaagttgaatgtaaacccaactttttgattaacagtcccatattatctatggcctgatattttctgaggccagaggattcaaaagtatacttcacagttcatagctgttggttataaaataaaaggtaaatattaataacaggaagctgtgaaccaagattaaatggatgttagatatatttttaaactatggttttaagtagatttccttcctaaataataacttctctttgaaagcatatttaaaagtgaaaacttttctcggcagtcataatttatctaaaaaccactttattttgacaccatctcctttgaagaaggcatcatggagaccacctatgaaaagagactaccttttccttgttcatgaaagctgtttcaaaatgaaatgactacattatttccaatagctggtatgagccatagccatgcatgctccctcaggtgcagccttcttaactggctgaaaaataggtcagtgctctacattgaagaactgtttccttcttatagttcagtcaacagcctacagtatagtcttccatacagtaagctcaggatctcaggatatttgtgctaaaattatactccaatcaaggccacacataaaacataaatgcttttatattgtaacataatctgaataatatcaataaaatagtcatatattatcttgtttggaaattgttatataatacaaacgtatataatacaatgtattctattataaatataatattatctgtaaacaataatgaggtatatggaatcaaattgctgctgaatatgtttcatggggaacattgtgtgttgtagtagaaagagcttaagttttagagtcagacatatcagtgtttgaatcctaactctattacttaatagctatgtgatttaatgttatttactctctctttgctaaaccctagtcatcttattgaggggttacagtgttatgtttctgcaatgactaaatggttatactatatagagaacaccaatctgacctatagaccagtgctaatactgctcattgctgtgcatttcccagctctggatcgagacacacgggcatatcaaatcagctgataattttggatcttctccaactgatgttttagaaatgtttgtttaacatatatttaacgaatactgagaaactcattgtctaatgtttgtattttatatttattgtgttatattcagaatataagacatatttcatattctaaaaatttcttagatgatacaccaagagtttaaatttgaaaaaaaaatctactgctcctggaaaagagtattcataaggaattggtttcagcttctttctctctccgggattaggtaactgctaccattccttgcttcagatcaatagagtggtagaagaataccttttcctagatacttgccaggctactgaactatcccccgtctcttgggctatcttcaaaccctgcttacaccttgagacatagtctgttcattaaactattctttaaataatcctaattcaggccaggcgcagtggctcatgcctgtaatcccaggactttgggaggccaaggcgggtggagcacctgaggtcaggagtttgagaccagcctgaacaatatgacaaaaccctgtccctactaaaaatagaaaagtcagctgggcatggtggtatgtgcctgtagtcccagccattcgggaggctgaggtggtagaatctcttgagcctgggaggcagaagttgcagtgagtggagatcgcaccactgcactccagcatggatgacagagtgaagactctgtctcaaaaaaaaaaaaaaaaagattctaatttaaatgtgccatctctttcctgataagaccacgaaaatactaaaaaattactgttaattttgtgagatatgatgaaagatggtcatatatcatgtataatgaataaaaagccccatcactgaaatacatacacactaaaatatttgtaggaaaaatggcctaatttctgcaatatatataaaaacttggggtgggaagaataaaattgacacactgttgatcatgattgaagctgtgtgatgagtacatgtagtcatcctagatttctctccatcttgtggcatcattgaaggcttccataataaaaagtttgggatttttttttgaactattggtactttgaacccctttgataaattatttttaattatgatctctggtttggtaaccctgtcatgaacccaaatggaacaaccatttctacgataagtaagtcactgttttctcttttatccattctgtagccctgatctgaacaatgctctccctattccagttgaaaacttctttgtgcatgatcccaaacttcatcttcatttgtcccagggaagctgaaagatgcatatgtgaccttagttgcagattaaaaatgaaatattcttagtttgagttagacttttctggaaacaagaatgactgttctggaaattatactcttttgtcatatttataccatcttgaaaagagtgttatcaagttgtccccactaagcagcaaggaaagaatcattctgcccaacaagggattctctcttgttagactaatgattgggtacatgtccttagcaggtcacttaagtaacttgctctaatgacctttaaattagagacataacactgttgacagtagtcaagatatgatgatccagttactgacaattaaatacttgacaagtagtcaagatatgatgccagttacattgacaataaaaaaaaagtagaaaaagtaaaagttttatttgtgtaatagaaaaattttgttttggtcttttttattatttgttcgggtaactagaaattcaaaatattttccagtacttattaatgcgttgtcatcattacattggacccacaaagttaaattgtgaagtaaaggaacaatatttgaagaaatatagcattggaaatggaaggcttaaaatttttaagtcagtaatgatttagtatgacattttacatatgctgaaaaatatgtgcacattctcaaaaagctaaacaaactaatttctatattatattttatgtaacattagtttttcaaattcaatcacatgtaaatattttcccaaaagagtattttcttcacttgtctgtggtttaaataatttcaaggaaaaaaatgaacattctactggaattccatgtgattaattatatactatcaaggtcaattcagtgtgcactcattcatttaaatcaggttttttaaaacctcactgcaatggacagtctgagccggattcttcgttgttgtggggggctatacagtattgcacattacaagatgtttggcaatatccctggtctgtactcataagataccagtagcactcccaccctcaagttgtgacaataaaaaatgtctctgaacattgccagagatctccctgggggcgaaatcaactccactgagaacctgtgtttcaaagcaatgagttctgtattacatctgcctaaattttaattactttccaaaagattacagctcaaacaatgggaagagtcaacaaataaaaagaaataaaagattttgagaaaggcattgtgataagagatagcttttccaaataaaaacacctttaagagtaaatattttaaaaaataatatgtggttaatgtaaagatatgtaagagagtgccatagtgaactgatatttaaaaactcaagttgcttacaaaatcgtggacatgataggatatcaaacaatgcattttcatcagactgattttgatctgtgcatctaatgcagttcgtaatagagaaagaatgaattctaaacctccatacatacaaaccaaaattacacacacgccacacacagacacacacacattgatgtgagtgtgtgaacttagcagttcacctatttcggccaccattttccatcaaatcttcatgttaaatctggttgtgtgaagatctaattgggtttacacctatatgcttacaaatcctactagtaatatgtttaattcatttatttagctttcaggaacctctattttatgctaaatatcctcagcatttatattcaatggtggtgtaacactactttgaatttactgtcatatttcagcatcgatttctggttgctttctttcatctctgcaactgcatagttagtccagttgggtcaccaggtcttgcctactattaagtgttatgcctataattgaaaagtcattaaagcaagttacttaaatgatttgccaaggatatgtatccaatcattagtccaatgacagataatcttttattggaaacagttcatgggttggcattatccactgtatacagaacagaattgggaatttatttagtaatttgtttagtaaacctagataaatatttgaaaacttatattgagctttcctctgttttgtggtcattttggtagctctatcaaaagctgtgggtattatttttctcattcactggtgaaaaaaggagaaaaatagaataaacatccaaatttctggcataatagcaattctgcaattattatactgaagaacacaccaagaacattagagttagaatggatttcaactgaaaatattctccagatccttatgcatacttgactctatataaatcatttttggaaggttcaaaagaagtgtaggataagattatcctgaagagctataatttttgtcgggtttaagatctatttttccctgttaacatgaatacttccaattttttaatgaaatagaattataatgtttataaaatacaacattgtagaatgaaattacatattttagtaggaaaatagaatcacagaaaaatgatttctaaagcagcaacttttatttaactcccagagtaaaaaactatcaattcttgccatgcaacaactcaataaaaagaaaacgcgctaactatgatcttttgtggaggtgccgagtactggcactaaaaacttctgctatatggaagtaagatggaaatttttagtgtgtgaaccctataccatgtaattttaaatggtttgttagtacccaaaaaagcatctttgggtaaagtgaaataaataccttagagaaaaataacttgctgaaaagtacaagttgatgaatttcataaaatttcaacagtcaatgtaagctctggatcttctgtttttatacatattttgtattcatttgccaagtcaaaaatcttaaaagccagtcaccacaacctccatctaacaggtctttccactgcactgacagctgctctcacctttataaaatagcccattctctcatggagtttttgccctgatgcagactgcagtgacctttctataactgagtcatgaatccctaaacacagagacgaaatcacccacgatgccttacatatggtggtgtgaatgtctacaataattgctctgtaattacatggtaattattgaccatttaagtacatttaagaacagggtgactatgtaatcaaagactaattatctgattatttctgtcttttaaactgtgggcttataagatataaaaattgcaagtaacatggtgattagtcattgaactacatagtaacttgcagcagaattatgaagtaatctgtagaaaatgtatttgtattgtcgtactcctggacagtaattgaagagtagttatatggtaatacacattctatggagtgaaaacagaaaaaaaactatcaagacattatgctaatagagcataaatatgttaaccaaaatattacatgattcattagagcaatatatgaatgggatatatctttcgcaagacaggtaattggtaccttaaattagaatttctatggtttctctataaaatacagaagtgccactgtgccttttaatagttcttataaaattccgttgcatatttctttaaaaaattgctgtgatatgacaaataacttgggcacggacagataaaaggaaggtcaaaaaagatggagttcagaatttggtctactgcactgggattcagtggctaaacccaatcaagggggtagtttaacttcattagcaattactgggacccaagttggagtcgtttacaaaccctcaacattttcttcctaaaataatgaagtaacatgagaagtatatgggtaagtatttacaatgattctgaaacacactaaaaatatttacctaaaatattttaaaagcttctactttaaattagaaaaggagataataaagaagtttcccctaagaattcatttgatgtaggctgaatgtagaaatttcctgaagaaatacagaaatggtggagttttgaagatgggcaagaagagaagggtttggagaaactatggcttaacatgtgtttgttataaaagttgaaaatcaactattttgttgagcagtgatgctaaaaatgagtaacctttaatctttaaagtctatttaaataaataactacttttttcttggtaatatgattaaaaacattaatatgagccctgaaataaagatcatgttgattccatcatgaagtaattataataatattttgtacataataaaggtatggaactctaaaatgaaaaatggattctacatgaaaaatatatcactctacatgaaaaatgtattggagcaatagttataaatcccttacctaaggaatatgaataatttgaccacatctaaagaaatgataatgctctcaaaactaaacttgattactttcaaattctgattatttgacatagtgttaatatcataattttttagtgattttctactttctccaacaggtccatgaaacaaaatacacttttgagtattgttgcatggcttattttggattgtcaatttacattgtttgcctggtatgttccttctctttggaattctacactataataaagtatgaaatcttctcaaatattctcttgtccaattagttagatacaaatacttagtcaagtgaaatgctataagtagtaacttataaagttgttactcttttgacctgagcagctactcataaagtgaaatcaaaatggactggagtagatttatttgatcaggatcgattaattcatgtatcattactgaagtatttcctttgattgagagctcattaaaggtgtctgctttacatcaaaatgtcaataatgcttctaaaatggaaatgccattttattaaggctgtgttttttaaagtaataacttaaaattatttacaattgcttttcaaaaaataaaatttacagtcctaatttttttaaaaaaattatatacactgttttacgaagcatacaaaaagagaaaataatgaaaaactatcatgttctgagttatgcctttggtcatcctgagaaaaggagttaataagtaattaacaaggcttgtcattctgtatatacaataactcatctcaaattgccttctcccttgatcccttttcagaaaaaaaccctgtatggaagtatgattgacctataaatagttttacatgcctcccttgatttcttcttaacttatataaccttcaatttaaaatttatacctcctttataaagaggtgaggcttgaaaattggatcacatatattaaacatgaaacaatgttttaattgagtttaccatacgatattgggatttccatgaaaatacagatgagataaagctacccattatatcgaattcctgaggagatatgtgccatatacaagatatagcaaggtagttcaaactgacttcttgccaatctcacaaagaataattcatgtaacttacaattagactaaatctttcctttgtctctcatttctcccactaattcgttgttcttgtatagaatgtcattttctataagacaaagatgctagcagaaaatgtcatgaatgaatacaaactttatttcccggttcattttatctaggctattttctttacaaaataacttcagaatatatacaatgtaatcaaataacttaaatttaaaccaaaaaaatctataaaatatgaaataccatgataactttagaccatttaatatcatctccaaatattgtcacagacatgttataattacttctacatttctatattagaaaatacacataaagtgcagcttgtttctccaaatacacttatctattccttaaaaatctggtacaccaaagggaatgctgacttttaccacatataatcagtctttcagtagaggctatttcattggacgctataactaaagcaataaagaaaaagagaaataaactgaaagtatctaaattgaaagagaagaaaaaaaacaatgttttctttgaagacaaaaatgatcttgtgtgtagaatattccaattttagagcccaacaaaaacatcactggaatttataaataagtttggcaagggcacaagattcaaaatcaatacagaaaaattaactatttctatatactagcaagtaataatcatacagtaaagtcaaaaaattattccacgtatggtagtttctaagactaaaatatttagaaatgcatttaaccaaagaatggaaacttgcattataagaactaagaaacgttgctgcgagtattgaagaaggactaaatgaagtaagagacagtttatgttcatagattggaaaataaaaatgccaagatagtaattgtgaaaaataaatgtaataaaatccttatcaaaatgacagcagattttttttttgagaaatcaacaagatgattctatgtggagagaaagaacccagaaaagccaaaagattttgaaaaggaagaagaaaattggaaaagttacactatctgatttagaaactttctacagaagctatagaaatcaggattgtggtattggtataagaataggcatataaataaatgaaaaattaaagaaaaaatactcaatatttatggtcaatagatttttgagaagggcatcaaacaattcaatagagaaaataatagaacttttatcatgctagtgagataattagataccaatatgcaaaaaaaaaatgaagttaggccttccctttaaaccatatacaaaaattgcaatgaatcctacatccaaataaatggatcatgttctcagaactatatccatatcgttctcataactcagaacactgtagtacttttagaataaaatataggagaaattcttcacgacctttgggttagggaaaatgttcccagatataacaccaaaagaatagctcagaaaaataaattaaacttcacaaggaacaacaagaaacctaaaatgtcatgagacctacaaaaaaaaaaagacaaaatggtagatggaaaaccaaccatatcaataatttcataaatatgaatggactaacacatgaatcaaatgtcagagattgtcagctaggatacaaaacaagatctaactatacatactgtctacaagaattatgctttagaaccaaatatatatatggattaagtgtgaaagactggaaaacagctattccacataaatagtaaaactaagagagctggagtggatttattaatatatgagaaaataaactttaagtaaaaatagtgttagagatgcacagttatgtttcatattgataaaacagtgaatatataagaaatacataataataataaatgtatatacatatagcaataaatcaccaaaatgcatgaagtgaaaagtgacaaaattgaaatgaaaaatagacaatttaacacatatgcagatgtataaatgccattctcttaatatttgataagaccgttagaaaatcggtaaagacatggagtcctaaacattatcaagcatatacactagaactgacatagaacaccccacctaccaacaggagctacatgctgttttagagtgtccatagaatattaccaaggaaataaaatatattaggcaattaaaattataagtgaaagtctttccttgacaaagtcagtctgtaaactattctgcaaatgggcagacaccattgcaagaataaaaggatcacaaagaataagggttacatgacactactaaaggaaactaataaaattcccataaccaactctaacgaaatgaaagtctacaaagtacctgtcaaagaattcaaactaattatctttaataaactcagtgaactaaaagagaacacagatagacaactaaacaactgactataaacagaaagttcagcaaataaacataaaccataaaatatagaaatcctacagctgaagaagacaataagtcaactaaaactttcaacagacagcctctatagtagactcagtcaatagtagattcaatcagaacaaagaacagtagattcaattaatcaggtgaatgaatgaacttgaaaacaggtcatttgaaattctccgatcataaaagcaaaaagaacaagaataaatagactgaataaagcttacaagacttttgagataccaccgtgtgaaacaatatatgcattatataagtttcaaaatgagaagagataagaaaagggaagaaaacttatttaaaagttattatttttaaaagttattatttaaaaaaataatagctaaaaactttctaattctgggaatggaaatggacatccagattcatgatccacaagtaaccgaaatagttttaaacctaaagaagtctacaatgagaaacattataattaaattgtgaaaaggcaaagacaaagagagaattttgaaagcaataactcatcacagaaaaaaggcaacacctataaactatcagcagatttctcagcagaaatgtttcagtccaggagcgggtggagtgatacattcaaagtactgaaagcaaaaaattgtcaaccaaaagtactcagcaaaactgtccttcaaaaatcaaagatagataatttcccagataaacaataactaagggaaatccttatcactagatatatcctgcaagaagtactaaggaagttcttcaagttcaaatgaatacatgctattcagcaacatgaaagcctatgatagtacaaatctcacttgtaaaggtaaatatgtaggcaaatatacaatgttctaatactgaaatgttatataaatcattttaaatactagtaaaaaattaagagacaaaattattacttataactatcaccacaaattttgtttaataaataaacaatagaaaaataataagtaaactctgataacaataacaaactacacgtggaggagaataaaagtatagagggctcatatacagttaaagaaaagttgttatcagctaaaagtagactgttataattacaagaggttagtccaggcttatggtaactataaaataaacaaaggtagtagatatgcaaaagacaaagaggaaaaaatcaaagcataccactacaataaaattaccaaaccacaaagaaagccaggagaagaggaggggaacaatataactacaaaacagacaaaaaacaatggacaaagtgggaacagtaaaaccttagccaacaatattcactttaaatgtaaatgaattaaacggtttaatcaaaagacatagagtagatgaatggacaaaaacaaagaaccaactagatgctttctcccaaaacaggacccaactagattctctctataagagactcaccttagatttgaagacacacataggctgaaagtgaatcaatagaagaaagataatcttggaaatggaaaccaaaagagttgggatgactatacttagacaaaaatagacaaagtaaaaaaaagaaaaaatacaagagacaaaaagtagaatacattttcttttaaagcacacacagaatattctctgggataaagcacatattagtcacgaaacaaatctgaaaatttaagaagattgattatttcaagtatgtttcctgaccataaaggaacaaatatagaaatcaattgcagaaagaaaactgaacaatcacaaatgcatgtgaataaaataaactctcgaaaagtcactgggtgagaaaagaaatcaaaaaggaaattagagaatatcatgagacaaaaatgaaaacaacatatcaaagcttatgggatacagcaaaagcagtatgaagagggaagtttatggcaataaatatctcttttaaaaagaataaatggcaaggcacagtggctcacacttgtaatcccaaaattttggaaggccaaagtagcaggattgttaagacaaggagttcaagattagccttgtcaacacagtgagaactgtctcaacaaaaaaacaaaataattagccaggcatgatcgtgtgagtctgtagttccagctactcaggaggctgaggcagcaggattgcttgagcctaggagttcaaggcagtagcaagctatgaatgtgccataaaactctggcctgggtgacagagtaaggccctgtctcttaaaaaaagaaaaaaaaaaaaaaaagaaagaaagaaagaaaaattaaaaagaagaagtatctcaaatcaacaacctaactttatacctcaagtaactacaaaaagaacacgctaaagccatagttagcagaagaaagaaaatgctgaagattagaacagaaaaaaatgaaataaagaatagaaaatgatcaacaaaactaagagttgctttttatttattttttaaaattcatttggagacggagtcttgctctgtcacccaggctggcgtgcaatggtgtgatctcagcttactgcaacctccgcctcccatgttcaagcaattctcctgcctcagcctcctgagtaactgggattacaggcacccgccaccacgcccagctgattttaatatttttagtagagacggggtttcaccatgttggcaggatggtctcgaactcttgccctcgtgatccacccccctcagcctcccatcgtactgggattataggcatgagccactgcacctggcctgttttttttaagataaacaaaattgatgaattcttatcgatagacgtactaagaaaaaaagagagaagacccaaataatgaaacaggagtgaatacaaccaacgccacagaaataaaaataacaaaaaggactgttatgaacaattatatgctaacaaattggacaatcaagaaatgaataaatccataggaatatacaagctactaagacagaaagaagaaatagaaacactttaaagatcggtaatgaataaagagttccaattagcaataaaaacctatcaataaagaaaatctcaggaccagatggcttcacaggtgaattttaccaaacatttaaaaaagaattaataccaatccttttaaaagtcttccaaaaatatagaagggataaggaatacttccaaactcatatgaggtcagcatcaccttgataacaaagtaatgacactacaagaaaagaaaatcatatccctgatgaacatgaatgcaatatccctaattaacctggatgcaaaaatcatcaataaaatatttagcaaatcaagttcaacagcatattaaaacaattttgtaccatgaccaagtgatatttatctctgggatgcaaggacaatttaacacatgcaaatcaattaatgggatacatgaccttagcaaacaaaagaaggagaataaccacaaaacaatctcaaaagatgttggaaaagcatttgataaaattcaacactctctcatgctaaaccactcaacaaattagttatatattagatatagaaggaagctgtctcaacacaataatggtcacatatgaatatcctacaactaaaatcatactcaacagagaaatgctgaaagcttttcctctaagatgtgaaagaaggcaaggatgctcattctcaccacttctattcagcatagtcctggaagtgccagcaagagcaattaagaaaggaaaaaaacaacaacaaggcatccaaattagataagaagaaataaaataatatctgtttgctggtggcattatataagaaaactgtaaaaacctcaaaactgagggaattaaaaatcaaaatgaatcaagttacaagataggtagtaaacacagaaaaagcagttgcatttctatccacaaactatgaactatcccaaaatgaaatcagaaataccgtcccatttacaatatcaccaaaaagaaaaatacacccaagaataaatataaccaagaaggtgaaagactagtaagttgaaaaatttaaaaccctcataaaagaaataaaacaagacacaaacaaatggatagtgatccttgagtatggattggaaaatttaatattattaaaatattcattctagctaaaattcatctatatattcagtgcaatccctatcaaaatatcaaagatatttttatacagaaatagaaaaataattctaaaattcatacagaaccacaaaagaccacaaatagccagagcaattttgaacaaagctgaaggaatcacacttcctacagtaatcacgatagtctagtactgacataaagacagatctatagagcaatggaacacaatagagagcccagaagtgaagccacaaatatacagtcaactgatatttgatgaagatgccaagaatacacaacagagtaaagagagtatcttcaatacatggtgtttgtaaaattagatatccccctccaaaagaatgaaatcagacacttatcccatagacaaaaattaactcaaaacggattaaagacttaaatgcacaatttgaaacaacaacaacaaaacaaaactttcagaagaaaacataggtaaaaaccttgttaacattgatcttgacaatgattacttcgatgtggcaccaaaagcacaggcaacaaaaacaaaaataaatacgtgggactgggctgggcgcggtggctcacgcctgtaatcccagcactttgggaggccaaggcgggtggatcacctgaggttggaagtttgagaccaggctgaccaacatggagaaaccccgtctctactaataatacaaaattagccaggcgtggcggcgcatgcctgtaataccagctactcaggaggctgaggcaggagaatcccttgaacctagaaggcggagtttgtggtgagctgagatcatgcgtttgctggaagctccagtctgggcaacaagagcaaatctctgtctcaaaaaaaaaaaaaaaaaaaaaaaaaatgggactacatcaaaccaaaaagcttctgcacaacaaagaaacaagcaacaaaatgaaatggtactctatgcagtgggagaaaacatttgcaaaccatgtatttgaaaagtggttaatttccaaaatatataaggaactcctacacctcaatagcaaaacaaaacaaaataaacaaaaaacaacaaaataacccagttacaaaatggggaaaggacttgaacagacatttttccaaaaaagatacaatgatgctcaacagttgtataaaaagatgctcaatattgctaaccctcaaggaaatgcaaatcaaagccacaatgagatatcgccttattcctgtcaggatggctatcacccaaaaacataagataataactgttggtaaagttatggagaaatcggaatgcttgtatacttttggtaagaatgaaaatgttgcagccactatgataaaatagtatagagattcctcaaaaaaaaaattgaactaccatatgttctagtgatcccacttttgaatatgtatctgaaataatggaaatcagaatgtcaaagacatatcttaacaccatgtttattgcagcattattcacaatagccaagacatgaaaacaacccaaatcttcatcagcagatgaatggataaagaaaatttggcattttatgcattggaaggttattcaccctttaaaaagatggaaatcctagcatttgtgacaacacggatggacctggacattatactaagtgaaataagccagtcacagaaggacaaacactgcatgattcctcttacatgatgcatctgaaacagtctcatgtatagaaatagatagtaaaatggtagttaccaagcaacggtggaggtgggatatggggagctgttgcttagtgagtgtaaagtttgttatacaaaatgagtaaatcattttgtaattggaccaattacaaaattgagcactatggtgctcatagttaataataaattactcacacttaaaaattgatcagagtagatatcctgttaattgttcttactccaaaacaaaaacaaaacaaagggacaccagggaacttttggatgtaatgtatatgtttgttaccttgattatggtgatagtagtgagaatgtatacatatgtctaaactcaccaaatttcattaattatgtgtggtttcatatttttgtataccaattattcctcaaagctggggaaaaataatgaaccaaatcccacactgtcatgttttccttgcactaatacatgaaataagatacatgaagtattgtaaagatgaataaagcttaatcaatatggcaaaaataaaatagcattcataaaagtgattgtataacttcataaatttactaaaaacatcaataaacttcacccctagaatgggttaatcatgtggtatgcaaattatatttcctaaccctgttttaatgctgaaacatgaaagttaagcaagggtttttaaaaatctcatttgtaatttcaaatcttacataacatacagtcttcttgatagccatgttaactcagtaatgaaaagcacagtcctagaatggctattcagttcctcagacagcacactataaaggcttacacttagtatatgacctttgctcaccttcacattgttgatttgctttaattcttaatcaaaatccagaggtgtgtattttatcacaaactaaatattcatagtatgtggactgacttccaggggtaaccacttcagggtataatactcaggtttttattactgatcacaatataccttttttattctctataataatttgaaaaataattttaattaatctcgtgtagcatgaattttcatgtgatatgcagaaaaacatcattgagcatgtttttctcatttatatactactcatttgtggacttatcacatcatttatttaatatttcacttaagtaaaatatttattaacatgcacagaccctgtacttagtcttccaaggaagaagctaatgatattatgccagaatcaatagtatcatttaataaaggaacattcccatacatcattttgggaggtataatatttgttattaactttgcaattgttgctataatactatcagcaaacatgtgacatatttactataaagatgcaattttaatgatgccttggaagcgctggtcttttccttgcctttggcaaaaataataataatttatattgtaaacattgtattatgtatgttctgacataactcaattggtttaccagagaggtgattgtgctttgtttgaaaattaaacaaaagttcatggcccaaattggcagggatgtctaacctaaaaagctctggggtaagttaaaaaaatcatcaatccaattaaatctcattttaaaagacttttatcttcataattcctatcatacttttctgttttgactgcttgtgcaaagtcatcacagttgctaattcgtttatctgagaatatacagatttaccttctacattggtaatatagtttagtttactatttgagttacaaatttatgagtggttttattttttcattactttcctattgcagtgatttatttcaagttttgtttcattttctacaaattgtggaaagaactcaacgtaatagtaacaatgccaactacatatttaaaacacataagcagtaacaggcaaatgatatgaatatattggctgaggggaaatgtagcctgttagctgaacatgttctgagacaaactgatcaacactgtcttctttttagccttgatagaaccttttgaattcaatgatttatagtatggtaggatatctatgaaaatggtaatcttccttttcaaatgtatgcaatgtatatgaatgcaactatttcattgtggctgcatctgaagccaccagactccttcttgatagaccacaatgatccactagtagcaggtagttgacaccttgagaaacactgcattaagaatattgttggtctccttttttttttttctagacacattcatatgacaagtgatgccatgtccaaagatctgtgggattccttcactagtgggagcagagaatagcccaagcaagtggcagctgtagtattatggttatacaaatgatgctacactaataaaaatgaaaataaacatcatttacaaacattaggtcagctatcaatatcacttcatttgtgagcacactgaagtgcttctaaactgcatgaaaatatttggcaatgcgaaagaaccaaaaagaaaaagtggttttgtagttgatacagcctgctctcacgtagcacagcaaatggaacaggaatgaactgagcctattgagaataagcaagtcataaacagataaaatatcactgaaatgccaccacaaacacctgtatagaacagcacatctaaaagttaatttctctgtttatattggatcacatacataggtcatatttagaaacaatagattgatagttatttttagagaaccacatagaagcaacctaatccaaaaccttcccaaagcatattgtgactaattcactatgtcctaggctatgccattgtaccttctataggcttttctgagcaatcacatccacatcaatctactccttaatttttactgctgaaaccctttcttccatgttccagacctgcattcccaatttgacgtcagtaagtcagacaatgttgtaatgtaataatattttaatagagatttcaatttcaatgccaaattcattaccagatgctatcaatagtctcttttgttctcagcacatttagatttctagtatttccatcccagttatcctacccaatttccttacatatcatctcatagcattgtgattgtgctagactccatacttgttattggcctccctgccttcatttttgtcaaatgtaaatagattttttgtctgcagtcagagtactcttcttaaaacaccattccttttaagtgatcaattgcctttacaaaattctacaatggttcctcatgggccattcttaacctccacactctttttaaataaattaatatatctatttattatcattattattattatttgtagaaacacagtcttgctagttgcccaggctggtctcaaactcttggcctcaagtgatcacatcatcctgtctcgtctttccaaagtgctggtgcaagccaggtgctccctgctgctttttcctaacttttaggatcatctccttctcctctgcatctacttatcttctgttaagccacaacagtcaccttccctaaacatgacttgtactacccgtattctctactttaaagctttactcacaacattcttcttgtccagaaaactctcacacattagattttcctatttaatccctacactcccttacatgatcctagagaagaagattttctatataatttcactagttttgcatttcactgctttgcctggtcacctgaaccatcctgtagctgccactccccagcagaggcaaaagattcagacattcaaacgttaagtataatatttctgctttccaggggtccaagcacagaattcaagggtctctgatgctaagggtttcaagaaggaatatctgcctgagatttttaaccatgtgtctcctgtcccggcagattgccactcacttagcaatcgcatccagaggacttttggagattttatctgttgttactcaaataaaatgccctatctctatctaaagccacactgctctcaaatctgtgtttacggagatcccagggagtgttgcttcagctgactttgctgtgatgattttgaaaaacggagatgggttcatttaggccaattaaggattttgagataaagggaaagatatggatatgtcagtgtgtgagctagtgttacactctgggttgtaacatattacttgtccatgtcatttttcattctatctgaaaactgttagaaattgaaataatgtatacacaatgataagcaagtgtccattttattaatactacagtatatgaaaaggatatgtttgtcaagaaagaccatggccaggcatagtggctcacacctgtaatccccacactttcggaggtgggaggatcgcttgaggccaggagttggagaccagcctgggcaacatggcaagaccccatctctacaaaaaatagaaaaattagccaggcatggtggcatgcgcctatggtcccagctactcaggaggctaaggtgggaggatcacctgaacttagggaggttgaggctgtggtaagccataattgcaccactgcactccagcgtggacgacagagtgacaccccatctcaaaaaaaacaaaaacaaaaaaaaagaaagaaagacctaaatacaatagagttagaagttctatctgaaagaatgaaaataaaacactgtttgcattttgatagtgccctctcaataccagctgcacgaacttgagaaaatctccctgaacttcacttctcttcagtggaatgagacaataatagtaacttgctcacagtagtgtgcagataattaaattaaaaactatttgtaaagaatttagcacaatgttactctcacacatagaaactcaataaataatagccagaaattttgttatggccacaaatttaaaaatcaagacactgctagctcagaaggtactgattggttataattcttacagagaaagctccaaaaatcttttccagacacctgcatacaccacagggatttcaaaaggagcagaatgataatataatataacaagggacaggtagagtatttttaaaatgaagtatataatgtgcatttaagaataaatttgtgataacacatgaataggtgcactaaaatttcattttcatgtcttattaaataaattgtattgctattagtatatgatttttatttccgtagaattaagggattatttctgagaatccaaatcaggagataactgaaaatattccttgagttatagatataagacaatcatttgatatgcaaaaattgcatatatttagaaaacctcagcagaacatcacaataaagctgttgtcattgttctgtttataagataaaggaagaaaaatgttctcgcttttgtaggcctttaaaaatgaagtagatgcagttattggaaatatgaactgactaagccatctaataggaattacacagtgtgaatttctctgacattttgtttgcagattcttagtagaaaagtagtggtttgtattagccttgaagatgttttaatcaaaggacacactgcttgtagaacaaagtgaataaatgtaaaatacagtttcattcaaataatgaaaaacctgtgctatagaaatttaaatctcatttaacttaaattacttattaagttacatatttataaattcactcatttttgtatataaaaatgtcaatgacatctccttttattctcacagggtttctaacattgctgatacacaagtcaaacttcagtgtctaatggaaaacaatttaggttattatttttcaaagaaaaaattctcaattatattagtcacatttataattacatggctagtcaaaaacattggagtctggataatagtaatgataataaaaacttgacatgttgttttttgacaggaaaagtcttctaggacagggtgttaaattccttaggagtgtctttttctcttttatagatctccatctttgctttccaggcccatcacactgtgtttttcccctgtaagtcagttcttcctctatctctgctttctaggctttctcccaaatgtcaattttcccctttactcactcccacttgtatttttactgtcagatgcttcttcacgttgatgccaaaatgtttttttttttaaaaaacagattttaaacattcccattttctttatacttgctaccatatcctcttttctatcactgtcttcagcctccctttttatgttttatctctttgtcaatttttttctaaaattttgttttctttttctactcatttctatgcatctatgctgtgataacgattaaggcaccctaaaaaaatgttaggctaataacatgatacacagtacattttttcagttgcaaaagacaactcgggggaaaaatgattaagggtgagagactcccactgaagtctatatgatgaaagtaacctcagatacaattaactatgagtatgagtgttcgaccatgttcctgactgaaatcaaacaggtaagaatccaatgaagtttgtgaaatatattgccaaaagcatggacgcaaagagattgggactctttcagacttgcaataagccatgaaacctcaacagtctgtgagcagaaagcatactgagaaaacatctctcaaaaatgacatgtattacgagatgtctacatcagatgtggccaaagaggataataaaacagactagagcaaaggaactatgaagaacaagtgaccatggagcccagactaaaggcttaatcagcttccgccacaaatctcacacttggaatcctcacaatagctgctcagcaggatttaagaattgctacactgggatctgctgggcaatgcccactcttccctttctgggaacgtttatttttgttaacttgttcctgatctgacatcgtatactgggtgagaaagagggcaggaaacttgttatttttgattctaggtctctacctctagaaaggccatatgaagaactaaagtagaccacttttatcacctcttgaagaagagacaattatcatgaggccagagcatctggactttgaccagtctgcacagaactcacagggactttaaagttaacaatcttgttaagggaacgagagtattggctgtcgtgtagagattaaactgaatgttttctaagcaaaggagctgactgataatcattagacatgttctccaatctccaataatctggtttttcttctaatgatttgtcaaatcttttcagttacattgcaaacatctttggaggaaatattatttattatgatacttatgtgattcacatcaccaaggaaaattccttgcataaatatggaacccaaccaatcccaatttaatttcatttgaatttcttttttaattttttttttctcaaatgactgcccaagtttttgagtaagttctagtgaagaacttcttgactttgcctgtcaagcaacacagaactctctttactatgcagaacatattccctgtggctcaagtagaaatatcctcatcaacattatctctcctcttctttcgcgtgactgtaactcaggccatttctgaaacaactgagacttgagtacatgcagggctggcttcatgggcatggaactggtgcagtgcaggtcttagccttcagcagggcctcctcacaatttaatgctcaactactgcattttaaacatccccctaggtttttctggtggaactggaaggtaagattgtgtctttccactacggatctggaatttcaggcagcaaatttccactaggtcgggagcatctgaggcaagcagatccaaaagtggaaagagaaattgaatccagaccatactgttgggacccagctagaaaagaatggactcaactgacctgaaagatgcaacaagtgatatggcattaatgatgttgttaagtttctaaatccagcctgatgccagaaacactcctggaccagtgaaatgagtgaatatagtctcatttcagtttaaagttacataagtgggattctggccatttgaatcccaagcaatcctgatcaaaacacattttctttctgtacttagtctaatatttttcccaactttccaaaactattcttgaatatgcctaaaaccaccatactttgcacaaaataggctctttcttagttaactcatattaaaaggaatcattaagcttgccataaattcactgctcaatacagaatgagcaatatgaaattaaaattgttgatatgtgttttaaaggtcaaaatccttttctccttttcttttgagtttttttatacttaatgttactcagagctatgcctctgcttttggctcaatattgattacgtacacctccacatcctcaaagaaaacaaaataaacctgctacatcctgtgccagggataactaatctaataataagaaatcagctttattttcaaatttttaatttctgtacataccacataaaggatatagttacttctgtctttccaatagtaagtaaatggaataaaatgaaaatgtatgacaattatattatgataatatgactaaagtattaagatgaattgttaatcattacttagcaaattacaactttcatatggagaaaataataccttacatatataatgaataatattacacttgggctaatatggttttgtaagttaattatagactacacagctgatttagtttcatttacctaaggagctgttctgaccctgttgcagattaattacatcttcaggaatacactctcatttatcattgtcacttggagcattatagctcttagcaagagtgtagaacttttttttaatgttaaaaaaattccttagctgtgatacattttgcaagtttagtcattaaaaacacatgacagctaaaagcaggtaagattaaattagctatggaacattgagaaagttcatgtcctagaaattaaatgactgaaagaaaataaaaattctgttaaaatcattcatgtcagacagaggcttcatctacatcctggagcattttttagaagatcccttgctttgaaatatgggtatgaaaaatgtttgccacattctaaattcttcagcacacattacacagctttttactattcccattttctataattgttagaagtatttaaaagaataacatcgttacctttatctatacctagaaagtattatttaaattatgatgggaaatttataccatttgcttttacctaatgatggtcatgtccttaattgtgaacatgagaaagagctaaagaagtctgtctagctttgaatactgtagaatatttatttacatgtgagtgatcatttaacatctgtttgagaactacgtgtcaatgtatgtgcagattaggcacacttgaataacttacattccttcacctggaggagctcagattataggggaaaatagaccaacaggtgcaactgagaaacaatgtgtaaaatgtgattaagattacataaagatatgcaacagttaatacggagtgccccaaatgagtggcaagcccagtttggtaggtcagaaaaggcttttggagggaagagaggcttccactaattattcaaaaatggacaggagctagccttgtaactcctgaatgaggaaaaggtggatgtaaagaggaaattggaggaaggagatgggaatggtcagtttcatccaaacagaattgatgataggagcaaaggaatagagtaaagtaaaagcatcttagaaactacaggcagtttctggagatgagattggagattgaggcaggcccagaacatgataggaagcttggaattcatctgtatgcaacagcagggccactggagccatgactagctatggggagcatgggtttgagaaatcaagactggaagcagagagagcaattaggaggcacggtgattgcaacagtaagaggtaatgagagttccagatacccaggggactatataaataaaaacagaaaagatttagagaagattgaatgataaaatgacaggatttcttggtcagtagtggggatttgtgaaatgctaagatcagttctagatgagtgatctagggcatgctgtcttctgcacagatggtggttgaaatcaatgaggaggagtgaaataacccagggcaatgcagagaggaaagagtagaacagaaaaacaatcctggtgatcatcagcaattaaaggaaaagtaaagttagaaaatctcttgaaagtgacataaaaccagcaaggtggtcagagaattataagacttgagagagtgtaaggtcatggatgcccaaggaagtaagaaaaacatttcaaaaaacagaaagtgagtcaagtgctgcaaaacactcagaaagatggtactattgaactggttaatgtgacatcaagggtgaccatagccaaagaagttttaggcatgtgataggggtacaagtaagtctgagaaaccagtttgcactggttctgcaaatggtgaagtggtaacataaaagaagttgttttacccccagaaattacctaggaataaatatttttttttaaaaaattgatatatattttctgttttcttctttcaccaaataacctatatagttattttaaaatattctatttaatactttgtattttttagaatactttatattaaatacaacatttactattcttcagaaatcagaaattctggttcagtattcaaaacccattttaaactttgttgagcgataaagagaatgcagggaacaataacactgaaaattatatttaagtctgaacatttaaaaacacagaaaagttatctggtgaaaggaaagacgattaaaatctctagctggctggacatggtggctcacgcctgtaatcccagcactttgggaggccaaggtgggtggatcacaaggtcaagagatcgagaccatcctggccaacatagtgaaaccccgtctctactaaaaaatataaaaattagctgggcgtggtggcgtgtgcctgtagtcccagctggttgagaggctgagggaggagaatcacttgaaccctgggaggtggaggttgcagtgagccaagatcacgccactgcactctagcctgctgacagagctagactgtctaaaaaaaaaaaacaaaaaactttagccattagttgcttaatgaacaagcaatttttgaaaatttattaataaaactaaaacagtaattttgttttattctgtcatttaaaattctagtttggggttttaagtattacagataaaaacaaattattcattattggttattatattatggatctgttttgaaaaaatcctattatattcaatttgctgcttaacatacaacttatttatcattcattagagattaggttaatttttttctaaaatacttatttactaaggagtttagtgtgacttacttaataaaacagaaacaaaatgtaattgaaagaaaatagctgaaattacatttgcaatgaaattttatgagtaaaataaattgctctgaggtaaaattatcaaatatttgagattaagaatctttttgtgattggtaatttactcaactaatctaagtcattctggagataaataacctgtttcagaagccaatgtcctattagaaagcatcttccaaaaggatatgaagttgattttccaagaaaaacattacagcagtatagcattaacatcattaaaaatttctttatgtcacaaaacaataaaaaatacaactgaggacattttctttctttcatgtgctttatagtcttcatttggttgctatgatcatccataacttgtcaatttctcaaatgtaaactccaatctcacttaagaaccaaataacaatgattgtcatgaacatgatgacggaattatctgcagaccaacagaattttatcaaaccaaatataaatcaaactaataaaaaatgacagcttctaaaattatatcacagtttcactaaagaggtagataatgtagaaataaaagaaaatgaaatttaaaaaagactttgatcattttcaaagcccaattatattcatctcacgactagacaaaaaattcttcctttttaatcagtctgtgagcattgctaaatttctttggttaaaatatttcctttgtgttttcagtaaagatataggagaatgtgttacaaagggctgaaaactggagaaattctgttaactatttccactaacttgaaatttatggttatgagaattaagtagtcatatttttcctacactggcagaataagaggctcttagtgactgactaaggctgaaggatattaaatcacaaccatgcaaatatctatttgataggacatttgggtggtaatatatatgtgtagtaaaagtccacttgtctttgtcagatttcttccagacttagaagatttctacagttaacatagacccaattctgatttcagaagaactaatgtggataaggttttcattttcatgttggctttcactttttacacagcatgtgatactaatttgtttctggatatgttctacaaaaactggaggacctttccagaagcctttacaattcttattgccttgcttgtttcttctcgcagtgctgacttctgtgttgaagagtgtccaaattggaacttactgggatgattaacagctgctacaaaatcaatactctatgtagggaaaacagaattgggctaagatagtcttacatgagcactattttgtggctgaatatctgttgatgtcagcaagccaaatacaatttatcttggtggaagcatttccatggatataatacaagagcttttcagacttggcctcagagacataagaggtggggaagataattcataggtcttaattgtgcataattatgcatattctcagttgcaaagatgatcactgttatactcagtaagaaatgggtttgcttaaatctttcattattttaacatttattatggttgaaacactaagtcatattactattgttactgcaatctgtctcacagtgagtcttaaattttttttcttcacaaattaaattgaaagataatacagatgtttgtggatttggtttattaagccctaatgttctaattacagaaccataaggtggtcactaacatatgacctaaaaatcttttgtatctctttttggagggctaaatatgctttataatattatatttaatattaaacaacaggataaatatgctaacagtttaaaaggtaataaacaattccctgagcccttacttatttgtatcacctctagccacatgcaagggaatatgcttgtgtgtaatgttttacctccaatatactagaattcacacttctttctggcaacatgttcatctttgtatccactataatgtctatgtcagcaattagacaatacgcatttgtggaataaactaataaatgaacttctctgtgattaaaatatcaaggagctaaatgctaaatgcccatgataactcaatattttagatttttatactaatgtaagtacactgtcagaagtagttaagaaatgtttattcaacaatgccatttgtaaagcccagtaagtgacccataaagagtatattttgcaaatctgtttaactggattatccactgggaataatattgtgtgctaaccctcctccctccctgtctcatgatactctccctatttcattgttgcacatgttgcttggataaggaatatgtcaccatgttttttatgtttttaaacacgaaaagctatcaggtttaaaaagacttaaaataattgttttccggggcagctaccatgaatttgactacacttttagcacattaagtaaggaatctgttttcctttctctccactaggaaaaattaaatgttttccaatagggagctatcacaaaatatggattctatagttctcagatgtgtggactttctaccaacatgttaaccagaaattgatcctgtagctcaaagccacaaggacaagaacatgataaggcagggtcagcgttgttatggaccgggaaagccacagctatcaataaaccagaaacctagaaagtcaaattaaagagccagtggtcttaaggctgatagtgacggctttgagatctttgggatgcttaaggcctaatccccaaaggggaaatcaaagataaagtcaaatgttaagaagcaaatgggaagaacaatacatgaaccagaagaatttgccacggtcagctcaagcagctcagcacagatgaattcattctacaaaatgaatctaataatgtattgcaaggcaaaaattattttccatctaacagtgaaataaagaccccataacatatgcacatgctttgtcactttcctttatagtaccctgtatcttttccttcaaaatactgagggctgtttgaaattcacttgtttattgtgtcccattcctaagaaaatgtagactaaatgagaactggttttccctcttgtgttctccaatactaattccgtttatcttctagtgctctgaagagtatccagcacatagtgattagtcacataaataaacaaaattgctatataagtaagtgaaggaaaggaaaagacacaagagtgtgtgaaatgaaaaagaatcagtagaacagcagctatagttatatctatccagttaaaatgtgatctaagcaaataaaaccacatccaatcgcaaatcattattaaaacaattcaataaaaggcagcactgtagaacaggttgaaagtgaatatttgaatgggaatgttagcatcatggtatgtatgggtttacaaacgtttaaatacattgaataatgctatgaaactttaaagattacccacagtcccaccacattttaaatttacattaagaagttttatttctctctgtctcctcacatgctggaggtatatatatttgcagattaatttatatgttttcatatacatattttgatatatatatttgtgtgctcctttacatgctttttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcaaccgtcaccacgcccggctaatttttgtattttttagtagagacggggtttcactgtgttagccaggatgatctcgatctcctgacctcgtgatctgcccacctcggcctcccaaagtgctgggattacaggtgtgagccaccacacccggccttcctttacatgttttaggagacagctaggtaaagacatttatgtttgatcaccactgtgttccctaacatttcttgagcactactgttgagtgttgtaagagctttaaaagtcccgaacaactccttaagatagtttctgtattgtcttccttcacaaaagtaggatatgagaaataatgttatttatggacaatttgtttttgtaatttaatgttaaattttggggacctcttttctagttgtacattattttcaaattgataaatttttaggtttcccaactattatgtctttaaatatgctttgtgcagcttacacttttgtactcttttccctgtggaatagatttttagaaatgagatggatggatcaaagggtatgcacatttttaaattttaatagatactatcacataataaaatattttaatttataagcccattacacaatatggatgtggtgatttttctatttacatcatcatgtcaataagtatgacagcatcatacttactgatttattgactgatagagatcatcagtctttgtaattttgaacaatttgaaaggcaaaatatggtaacctattgcataattttatcgttcattgttaactaaaaatattagggatttttttcatctggctattcagtatttttctattacatgcttattttttaaactggaattcaatatttaagtttattcaccctatctttattatttttgttgaaaacattttttgaaatttaaaagttaatgagttttaatatatatttttaaaatgaaagatcaagaaaacacaaccataattaccttttagattctagatttcttgctggtctctgacaagttttcctgttccggatgatagcaatttacttctatattttcttctaatataagtgtattgcttccatttgtatttttaatctatttgatgtatatttcacatggctttgaagtagaaatatgaatttgtttttatttaaatgaataaccaattctgtcacttcatttattatgtattgtgcattttatccctctccaatgatttgatacttcaacatctaacaaatattaaatattctgtatctctgcactttgtttttgtctaactttatattcaattctattaatctatttttgtgccaccgtattttagttgcagaaatttggtagcatttagtacacggcaaggaaattgaccattgtaggacattatttcagaatattttaatggcatttttgttcaactgcaaattacattgaatcaaaaacaatccccagtgaccctatcagaattctcagaatcaaggaattaatatataaattaatttgggcagacttgatctcttaataatactgaatctgtccatgaaggaatgtcagaggcatttgaaccagagcaactccatctagaataggagtaaggtaaaataaggctgaaacctactgggctgcattctcagacagttaagaaattctaagtcacagaatgagatacaaggttggtacaagatacaggtcataaagaccttgctgataaacaggttgtagtaaagaagccggccaaaacccaccaaaaccaagatggtcacaagagtgatctctggtcgtcctcactgctacacacccgccagcaccattacagttgacaaatgccatggcaacatcaggaagttactttgaagggtctaaaaaggggaggcatgaattatccacccctagtttagcatacaataacaaataaccataaaaatgggcaaccagcagcccttggggctgctctgtctatggagtagccattctttcattcctttgctttcttaataaacttgctttcactttgtagtgaaattagtaatttttctaattaattatttcttgcaggagattcaagaatgatctcttggggtctggattgggactcctttccggtaacaggaatacaagacaaattcttaatattcaagccttattttataactttgcataaaattatttagatttcctcatatatgctgagtggttttttaactaaatgtaaaccttggcatatttttagttttgctggtattgttaacaaaattttattcatattaacataataactggtaatattaaaaaggaaagttagaggtttaaaaaatatatatttagtatttattacattgctttactagtttcatttctagttgatgaatatttattacatatataatcaccttcaaatattaatagctgatttctctacataaacatttaatttttcattattaaattagttcacttttaaaaatttgttgactgacatagtgagagaagaattatggtcttcctcctcattttatttggaatgcatcccctatgcccctatacgtgtattttgatttattaaaaaagcttaaatttttttcaattagtttttaatcacaaaaaacagcaactcttgtttttatttaaaacaaataattgtagtaatattgacccgttttggctttcttgaaataaaccctattgggtcaatagatttttgtccttagacatactacttgaatttatttcctattatttttgtctgctattgttgcatttatattcacatgtaaattttattttggaagctatggttatgaggtattgatattgaggttttcaatctatgtaaaatgaattggagaaactttcccttttaatctgcattctgaaattttgttaaaatataaaaactacttgtgctcttaagagtaaatggaattgccaccaagtttagtagttctcttactacctttctacattttccccctttggctaactgaaagcagtggttctcaaaataggatactggacaagcaacattaggatcacctggaagcttgttggaaatgcaaattctcagcccccgtccccaatctcagacctaccaaacagaaaacccaggtgtagagaccagtaatctgcattttaacaagccccttaggtgattcgaattcatgcttaaatttaagaaccactatcttagatgtgctaccgcttgctcttcagcaaattttagctatttatatttggatgcaaaatgttccatttcttctatataaaaaattattgccatataaacacagatgatatacttatttaaatattttccatagctgtggctatgtctttaaatttattatgctgtgtatttatttctttctgttaaaaaaatatttgtgccggtctatgtgtattctatttgtcatttttttaggggagaaaaaagctttgggctttgtctgtcattatacttccgctctttttttccaagttgttttctttttgtcaattgcatcttaactttctatttgtcttgtagctttttcctagttctttcttaatttgactattgcttatttttatctttttaaaaaaataacatcttcatggctataattttgtcctccatatacagttttgcccatatgcatattggcttttgatagaaaatcttcatatatttgttaacttgtaaataatactttttccatttttatttccattttacctaaaaaaaaatttaaatgatgcttatggaaattcttaaatttcttaattttttggtgttacttggtttatttttatttccaaatttatttcattgtcatcaaggaaattatcatttagactccttacatatttattatttattatggtatacaaaaattcttaaaattattttcctgcaacattggttgattattttatctcatttatcattcttaatgtttactattttgttcttttacttgtttgctgtaatcaaatttctaagatgttctttttcatagctctttttcaagaaattctttctagatgcatccattattggtcttatcgggaaacacatctccacatttttatctgtctctttatatatatctatatggttattatatataattgccatttatatatttatgataaatatctatataatatgtaaataatttagatatatatacatatgtataccttctgtatagaggatgactatatcataattacagcattgttagtaatgaattttctcttagtttatattatctttgtatctaaatttctgctataaatattaaattctttttttgttctagaaatgaaagtttataaatcttcttctgaggatgcctttcacaattttacattagaattgtatatttcctgtatagtttgccatttttcctttttatttcaactttgatccaataattaaccagaaatgttttacaattttcaaatgttaagatttttagaccaactttttgcgtacttgtaatatgactgaattatatgagatcaatttgcctttaagatttctgcttttttaaaaaaaactgattttccttgtggccacatgtgtaattgattttaataaattgttcatggatattccagaaaacacacatattccctaaagatgtaaatttcttggtatcttttgaaaatccaccaagccgctaagaaaaaccaagaggctgtatccagatgtctaagtgagaaactctactcacctgctcagcaattttatggctgttggagaccagaacactcctgtaggttcagtatgtttggctcttgtgtgcctcagatctgctgctttccagtccttacacctaggactccatttgcttactcaacccacttggggagaaatccctgcctgaagtacctcagctaaggctctaacaaagccaaaacatactagctcccagctgcccctggtctccagcatccatttgaatcaggagagttgaagcaattgaacaaagcagatcacctgcatgtccctattttcttagaagcctccaaatattcccctgggaaagcccacaggtgtgtgtgaaatgtgctaggatgtgttccctgtgaccaacatgacctaacaccatgtccaacataatggtgacttttttcaaaaatgtagaaatactctgtaattacatcaattttcttagcatatagactttttctatctctaaatttctgtagtactttaggctagaataacctataaaatcaattatttttccttgcagttttatcaattacatataccaagtttattgaagaatctctccctatgcactatatcatgttatgtctctaaagtcccagttactttttgctctgcagtcctcctacatcattttggaggaagggggcacagcgtagagggtaatggtctgctcattctgaactgaaatccctcaaaaaaccctctgtaaaggtagctgacctaaaatacaggcagtctctttagtatgcattcaggttgggccttagttctggggtaaaagcaataatcttatgcaaccttctattacctacagcatatgccccttagaggtaatggggtttatactatacaatttatttttagaaaactcaactactattgtcaattgaattttttgttacatcatgaatttattaaattatttcaaaaacttgatgcattgaaaataaaatatttagcagttgcctaatcacaatactaaagtcactgagatgtcaaagccttggatctcaaacatttgtgaacagagttgtgatagcagctatttagtgaaactccaggatgtcacttggcccctctgggcactgggctatttctaacttaagcatcttcaaattatttcttttttcttttcttttcttttttttacttttcttttctcttctcttttcttttgtttctccttccttccttcctcccttcctctcttcctctcttcttccctccctttctccctcccttcctttttgccttcctctctttttctttcatttaagtgtggagaaacatttattcaatcttctgcccattttgtaactaggttattagattttttttttactgtttaattgtgctaattacatattttggcgattaacccttgtgatgtagtgaaatatttatatttagtctttctcctctttttcttttttactttctcctctctttttttattgttgtaagaacacaacatcagaacttaggacttaacatgagatctaccttcttaacaaagtataaaatacattattgttgagtataggtacaatgttttacaacatatcactagagtttatccctctagctttactgaaactttatttatgtccgttgattaataattttccatttccccctcttcctagccctggtagccacaattccactcttcagttttatgaatttgaccattttatatacctcatataaatgcaattatgaagtagttgtctttctgtggtgggtttatttcatctaggataatgtcctcaaggttcatccttttagttgcatattgcaaaactttcttttttaaaaaactgaataacattcagttgtatgtatagaccacatcttctttatccattcatctgtggttgagcagttatattgcttctatatcttggctatagcaaagtgtgctgcaatatacatgacagtgtgaacatctctcttcaagatcctgatttcaatccttttagatagtcaggagtggaattgctgaattatacaacagttctatttttcattttttgagaaacctccacattgtattgcatagtggctataccattttgcatcccaacattatgcaggagtcccaatttctccaaatcttcacaatcacctgttgtttctgacaatagccattctagcaggtatgagatgatatctcgttgtgcttttgatgtgaatttccctgatgattaataatattgagcatttagaaatatatactggttcattatttgaatgtcttctttggagaaaagtttgttcaattttctacccattttgtagctaggtgatacggtatggctgtgtccccatccaaatctcaccttgaattttaataatccccacatgtcattggagggacccagtggaaggtaactgaattatgggagcaggtctttcccgtcctcttctcatgatagtgaataagtctcaggaaagctgatggttgtataatggagagttcccctgcacacactctcttgcctgacaccatgtaagatgtggctttgttcctccttttctttctgccatgatagtgaggcctctccagccatgtgaatctgtgagtttattaaccctatttttctttataaattacacagtctcaggtatgtctttattagcatcatggaaacagatgaatacagtaaattggtaccaagagtggcgtgctgttttaaagataccccaaaatggagacgtgactttggaatagagtgacaggcagaagatggaacagtttggagggctcagaaaaagacagaaaaatgttgcaaagtttggaacttcctagagacttggagggctcagaagatagtgatatggacaataagatccaggctgaggtagtctcagatggagatgagaaacttgggaactggagcaatggtaactcttgctatacaaagagattggtggcattttgcccctgccctagagatctgtggggctttgaacttgagagagatgatttaggatatctgaggaaagaaatttctaagtggcaaagcattcaagaggaagcagagcataaaagtttggaaaatttgcagcctgacaatgcaatagaaaataaaaatccattttcgggggagaaattcaagcctgctgcagaaatctgcataagtaacaaggagcccaatgttattcaccaagaaatggggaaactgtctccagagcatgcgagagacattgtggcagcccccctcatcacaggcctgggggccttggaggaaaaaatggttttatgggctgggcccagggcccccctcatgtgtgcagcctatagacttggtaccccatgtctcagctactccagctgtggttaaaagggaccaaggtacagctcagaatgtggttccagagggtgcaagccccaagccttggcagcaagctctaagccttggcagcttccacatggtgttgagcctgcaggtacatagaagtcaagaattgaggtttggaaacctccacctagatttcagaggatgtatggaaacatctggatatccaggaagaagtttgctacaggggtggggacctcatgtagaacctctgctagcatgcagaagtgcataagggaaatgtggggttggagcccctacacagagtccccactgggacactgcctagtggagctgtgagaagagggccaccatcctccacaccccagaatggcagatccactggcagcttgcaccttgcactggaaaagttgcagacactcaatgccagcctgtgaaagcagccaggagggaagatgtaccctgcaaagacacagaggtggagctgtccaaggccatggaagcctatcttttgcatcagtgtgacctggatgtgagacatggagtaaaaggagatcattttggaactcgaaggtttaatgactgccctatttgattttggacttcccttttgttttggacgatttctcccatttggaatgagtgtatttacccaatgtctgtacccccattgtatctaggaagcaattaacttgcctttgattttacaggctcataggcagaagggacttgccttgttttagattagactttggactatggacttttgagttaatgctgaaatgggttaatactttgggggactgttgaaaaggcatgattgtgttttgaaatgtgaggataggagatttgggagggaccaatagtgggaagatatggtttggctgtgtccccacccaaatctcaccttaaattgtaataatggccatgtgttgtgggagggacccagtgagaggtaactgaatcacaggggcaggtctttcccatgctgttcttgtgatagtgaataagtgtcaggagagctgatggttttatgaaggggaattctgctgtacacgctctcttgcctgccaccatgtaaggcacgcctttgttcctcttctgccttctgccatgattgggaggcctccccagccatgtgaaactgtgagtccactaaacctatttttctttataaattacgtagtcttgggtctgtctttattagcggcatgagaacagagtaattcactaggttattcatttttttactatttacttgtggaaattacttatactttggagattaactcttgtaatgaaatatatatttggttttccctgtttcttgacaaaaaacttctaaaattcttgaaatcttcaaagtggtaagtgccattttgtctgttaatgagttgacagaattgagtgaattttttagttcaattattgttttcttccattccatgatttctatttggtaccttttaatattttctatctttttgttgaaattctcactttgtttatgcgttattttcttgacctcaatgagtatctttataagagttattttaaattatctgtcagataaatcatacaactctgttttttttttttttttaagttggttcttggtggtttaattggtccactgttgggaatatccttgtctactttttcatttttcttgattctctatgtttatgtaatctgcacattagacaaaacattcacctctccctgtcttcacagactagccttgtatggaaaagacccccaacaactagccaggtgaaatattctggggtcttcaccaagttttccttcctcagagaaaagcaagctgctgtagttttcctgctcactctgtgctcagccaggggaatgaaaaagctatggtttctgctagcacaagccaccatttctgttctcctaaaggcagctctgtgttagacccatcagagtttcaagactggtaagacaaatgctagctctttgggcagccctggagaaatttgtgtgatgaactcatggagctactttttatttaagcaggcagaagctgagagctgaaaatttttgtctgcttgctctgtgctgagcaaggggaaggatcaatggtatccattagttaagccactgcctgtattctcccctaggtggctggttttgctgaagccattagtgttccacctggaaagacagaaactagtcttccagggagataccttggaaaagtggaagtgctggacattcaaactaacctcttccttcctctaagtaaagctgggggttgagggttttcttactgatcatgtgatgctgtgcctgggcctggtcttcagtgagagggtaacccaattctccctaccaacttaaatgagtctggttttgcattatcccagggtacagtagcatttcaaagattttcagatttctcacaaagggaattagtctgtaaaagatttctgaagctatatgtttgtcaggggaagaagatgtaggtcttcctagtctgccatgttgctgatatcactctggttatttgtattttaatattaaatggaatttaaaaattcctcttgaaaatttcttatctctgttactatatagtctttatagatgcatcttcactggcccaatttcttcagttttgtcctgtttttaccagacttcttagcagctttctatttagtcggccattcttttcttaatctttttttttcttttttgcttacctgaacattatatactttttgttttcctcctgcttcattggccattgttttccagggcatttcccatgccatcttcttctagtagactctaggtattagtaaacctcaaggctttatcctaaagttccatttcttctctttttgagctctccctattaatctcgtcagtccacactgatttaagtatatgtttaggtagatggaaaataatggataaactttctcccattcctgaatgtccccttgcaatgtaactgtcttccgtcaagaggtagattctatatcttctctccttgaatataagcttagttatgtgatattctttggctaatgacacattagcaagctggatgcaaacagaggtttgcatcaagaggtttgcattgggctttaccctctttttctactgaaaatttttccaccattatgtaacaaagtctggcttaacctgttggatgctgggagtcatatggcccattatcatcatcagcctactaacagctagaaccaactgccagatatatgagggagaccagcatagaatagctccaggtaatcttccactaaaggcacaaccacccagttgacacacagacttgtgaataataaaatggttagcatattaagccactgaattttaggaaggtgattcataaagccatatagaaataaatatgtcaatgactccaaattctccctaagtgagatagtcttctaagcttccaacttaaatatccaaccatagccctgaaatttccactatgacatgcacctcaaactgagcatgtctttatatcctccactaaacctgaatcataaataattaagcccatctcagtaaatgagaccacctagttgttaaacttaaaacctcaggatattttatttccttccatcccctggacactgtcgattttattttcaaaatatttcttaagtctttccagtttttttcagtatccatggctcttagtgtactcatctgtctcttattttactagaagatattctaggatggtctctttgcttccattcttgaaaacttccatgtcattcgccatgtgaccaccagaatgatttttaatatagtaatttttttaaaaactgagcttcctttaagtgagcagccagattaatattttttcttcataaattatattgaatctgaatattgttaacagactattgtctagcaaatctgcacatttttctttttagtttttgaggtttatgatgaccaagagtcgcttgtgttgtttccaaacctgtttatgcctgttttactttccattatacttatataatttaatcacatataattggaaagtataattttaaaaagaatcattttatagaaactaaatcaaatgctttaggaagatgtaatataaatgtaatgctgaaactttgctgtataattatatgtaagggtaataattataaaagatttttaaaaacaattttaagtatctagaaggattttactcatatggcttcacaagtgtcttctgagtttttactctaaataaactgaaactgaaaataatagatggtttattatggactgtggtttacacaaggcagagtttatagaatctcagtgactgacattcaaaaataagacattggctgggtttatgagggaagatggccaattcaattatatttatagattttaggtagaaagaaaacatttaaagttgtttgtgtcatttttatgacaattgttttatttttcaattaatatccaactatcacctttagtagaagaatttctgctgcaaatggatcgggttacctcattccctaatgataattatttaattattcagtgacctaccacttaaaaggcaaatatcacaccatagtcctacaggagacttcgagacatggtggcagctgtgttaacagcagcctttcatgttactcactccccctatccctctccatgctccaggcacattgacctagcagagctttgaaggcactaagctctttcttacctcaagtctttcacatacagttatacttgcctggtatgctcatgacatctctttggtgtccagctcacttatgtatattcttcagatctcttcttaaatgcatcctctttatataagcctttcctgactctcagatctacggttgatgtccttcatggtagcttttgttttctttcacagcatttatcataattttcaaaaatgttgtatttgtgcattggttttttgctttttaaaaatatctccttgcatcattaaactccaagttctaataatgagatgacctgtatatatatatataaaaaattatccatttatatatatgtttatatatattatataaatatataattatatgtttatatatataatatacaattatatttatatatattatatataattatatatttatatattatatatattatatatttatatataatatatataattatattatatatattatatatttatatattatatatataattatattatatatataatatatttatatattatatataattatattatatatattatatatttatatattatatatataattatattatatatattatatatttatatattatatatataattatattatatatattatatatttatatattatatatataattatattatatattatatataattatatatttatatattatatatatttatatattatatataattatataattatatatttatatattataattatatataattatatataattatatattggataattatatataattatccaattataaataaagatatatatatatatatatatcttttttattgagatggagtctcactccgttgtgcaggctgcagtgcagtggtgcgatctcggctcactgcaacctctgcctctcaggttcaagcacttgtcctgcctcagcctcccaagtagctgggactacaggcatgtgcctccatgcccagctaatttttgtatttttagtagaggtgcggttttaccatgttgaccaggctggccttgaactcctgacttcaggtgatctgccttccttggcctcccaaagtgctgggattaaaggcgtgagccacagcacccagccagatgacctgtgtctttaatttactcccataaccctagagcctgaaaaaaataagtgcttagtttttttgtttaattaaacaagtgaatgaagaaacaactatggaaattaaactaatggggtagaaagttttattcctgggatatttaaagatatctgtagttggcttttgcttctaatgtccatctgtctagcatctcatgacaatcttctttcacctcactgccatgtaagcttagtgactatacagacttctatcattttcattgctaatcctcaaacagtacctggtacatagaaggtactaaataaatatgcttttattgatggaccatcactgtggaagaatatctatttttagagttaattatgatttcaggatcatttccgatagttctggctaaattggaaaagcattaaaaagaaggaattgccatagtgtctagttattgatcaatttccctttctacctaggcagacaaaatttatttcctcagctttcttacaattatgtgcaggcaagtgattgagatctggccagtgagttatgagtggaaatgatgctacatcttccaggtatgggcccactaaaaaaaatccactttctttagccattcagttgttgaatagagaaggttatctgtcaagatggaaggagcctgggtcaccgattgacaacatagagcagagcctctccccaatttttaacctatcctgacctgtcacgtgaggaaaaactgatttttattcattgtcagaccacggataatttgtaccagcagtcaacccattctgaataatacaaagggtctataacaatgaatatgaaggtgatatagctacatatttctgacctcgggctttctaaaaattggaggcaaggttctttgtatattgtacagcgctagctgtcagtaaataagggacgatagttgaaataatgaaaacaatactgagattagaatcaaacttggaaatcactttgtaactagacagcagaagggttcctaaagacaatttcaagtacaaactacgtgctcatctgaagctttttcatgctgttatagcataaagttgagatgcatcccatatgctttaaatccttcaactccactatttgttatatattcaggaatgatttgagacaatttattttatttcattatattctagattcattgattgaggaagaggaatgtaagctgctgagtagatgactttgttgaatgacattcaaggtagaagatctattgctctgattatgtccctgagcattgagattttgtgtccctggggcaggaataaatctttcagggaggaatgcctcctctctttatccccctaatccccatattatgctcaggtaaaggaggcccaagtcaaaggaaacaagaccctttaaaagaaaactcagtcaaagccaccttatttgtttaattagttctgatctgccttaaaatcataaacattctatcacatagtttttattagtttctaaatgtcatcttttaaatttagatctttaataagtctggcgtgtacttatataatatgaggtagagttctaacaaaagttttttctttctaggaagctaggtttgaacattatcaactaagtaatctgccatttcctcagtgaatttttgtgccatccctatactaagttccaatatgtgtctctgtacttcctcattggttcattcatctattatttcataggaccattctgttataattatccaattcaattgtagcatgtataatttagtaaaacaaatttatttctctccttattgttaaaattgacttagctattttgtcatacatattttaaataagtttgttataaaatccagctccaatcttgcatagttatatattaaatgtataaattaattgaatattatatcaagaaatctcatataagaatagaaaatgtctccatttattctgatcttgtgtgtctttgcagagagttttaacattttctttatataggtcatgtgtattttttattaattcttagatactttcaatttttttgttattgtttctggaaagtcattgattattgctaatataagcatatactagtgaatatttaagttgattttatatttggcaaatttgctataatctcatactagtcataatatattttcaattaggtatatattttttcaattggaatatatataaatatatatttatcattatttttattacttttttaaattttttgtttttcaccatatgttgtttacttataattctctatagagtatttttgcaaagtcaatttttcaataggtctgattaacttttctcaataatgcagctttcagttttgctaacattacgaatttttgttgttgttgttactctctgccattttctgtctcatttctattatagctttccttttcaagttttttggttttgtatcatttctctttttcaaacaccttgactttttgtatttaaatacaattgacccctgaacaacatgggagttaggggtgctgaccactcttgcagacaaaaaaattggagcataacatttgactacccagaaacttaacaactaatactctactgttgactggaagccttaccaataacataaagccaattaatatatattttgtatgttatgcatattatatactgtattcttaccagaaagtcagctaaagaaaagaaaatgttaagaaaattataagaaagagaaaatatatatactattcattaactggaagttgatcatcataaaggtctttatcttcatcatcttcagattgagtaagttaaaggggaggaagaagagaaggggttgatcttgctctcccagaggtggcagaggcaaaataggtggagaaggtaaaaggggaggcaaattacactgggtataacttttattgaaaaaaaaatcgataagttgaccagtgccgttcaaacctgtgttgttcaaaggtcaagtgtatttctgtttcctaatataagggttttacaacctcgacactattgacattttgagctgtatagctgtataattctttactttgtatttgaggtgttgtcccatgcagtaagcgtatttagcagcattcctaactttacctactagttagcaaaaaaaccctgctttagtcatgacaatcaagcagacattgccaaatgtcttccaggaagaggcaaaattctcctctgttgagaaccactggaaattgaccaaagcatataaaaaaaatgagaaatgtttatttaggaaaaactactgagcctcagataagaactctctaattagtgatatttcagatttgggttgcttcattagccttcagctccctgggtgctgtagttctatcagagtggaataagctaagaaaacaagtagattcattgtcagtggaactgacttgatttgaaatggaagccagaaaatctctatggcctagaacattgttttacaacttacacttacagtagtgatatctgtggcaaatgaacagggagagccagtgtcatagctagcctgagtttgtgaaactgactttagggccagcagctaaccagcagattggccagagatttaacaagagatctcggaatcaaactttcatatgggctgtgataaacttctatatattcctggctgtctgaaaatctgtatggatttgcaaggctacacaaatgctcagaagagacaaaagaggatcctagttatctacacatccttggttaaatgagaggttttgtacatgagcggaagagacgaaagaaaggccagattatattaaaagccgaagtgatttctaattgcctgaactttgaatgtattcttcagtgaccatatggatgcgatgacaaagaaaagaagacttactggctcaaagtgtttgagcgcaatctctagacaaccattttgacacaggggtgatctctaggaaagcagtatacaccataagaaagaaaggctccacaggtaagtcactaaatagacaaacataggaacaatgataaccactgtgggcagataaaaatccagagaattaaagatataaacaattttcagtattcaacaaaaaacgaggagatatgcaaaggaataggaaagtgtgtcacacatttagggaaataacaagcaaacaaacaaggtctctgatggggcacagatatttgacttcacagacaaatacttccaaacagatattataaatatgtcaaaagaatgaaaagaaacaccatttaaagaataaagtataggccgggcgcggtagctcatgcctgtaatcccagcactttgggaggccgaggtgggcggatcatgaggtcaggagatccagaccatcctggctaaccccgtatctactaaaaatacaaaaaaaaaaaaaaattagccgggcatggtggcgggtgcctgtagtcccagctactcgggaggctgaggcaggagaatgtcgtgaacccaggaggtggagtttgcagtgagccgagatcgtgccactgcactccagcctgggtgacagagcgagacaccatctcaaaaaaaaagaaaaaaaaaagaataaagtataaagtatagtaacaatgactctccaaatagaaaacgttaattaaagatacaaaattataaacaaaagaaccaagtagaaattctggagttaaaaagtctggtaaccaaaacaaacaaaaaatcctaagagacttaagagacaggcatcattaatatctaaagattggaaacaatcaatatgtccaccaattggtgaagggataaccaatatttgatacctccatgccacagaatcctattcaacagcaaaaagggaaacaatatttatacagttcatatgagtgaactcaaaaacttcatgctaggtgaaggactccagatgcaaaactcctatattgtgtgattttaaaaattattttcccataagtttttggggtacagtggtatttggttacatgagtaagtcctttgtgagattttagatatttttaaatatagaatgtccataaaagacaaatcttagaggcagaaagccaatcaattccttcctgaaactgggaaaaagagccaagattgaataaaaatgggcatgagggttctgatttgcgtaataaaaatgttctaaaattggattaatttactaaaatcattaaaaagtacacttacaatgaatgaattaggttgtgtgtaagtgatacactaagaaagctgttaaaaatactgtttttataccaacgtgaataggagggcttctctggatcaagacacattgcatttttctttcaaataataatagtcattacagtattagtaaccattgtatatttagccttcatcatgtaccactctatgagattctttaaatgtacaatcatatttgtaactctatgagagaggaaataataaccagcatggcacagataaataaatagatactgagattaaataatttgcttaaagacttttacccaggtagcttacctcttaagttcatggactcaaccaatgctttctatattctactagcctttttataatctatctctgtgtgtgtgtgtgtgtgtgtgtgtgtgtgtgtgtgtgtatgagatgtgacatgacataaaattagcatgggatgacatacattaaatttaatgtaatgctttattttctatatttttagatttcataatcattggctaaaaatatatataaaatcactattaaaattattcctttaggattaaaattttaataactatttcaactgccatataatattttactctgtgtaagattctaaaagaaatgaaatgaaaagccagccttctgacttattaatcacttgagaatagtagcaggattttttgtagacttttcatagatttttagtaagttataatgattttataaaatgcatctcaaagtaagataaaatttaacgcaatattttcacattttcaataatatggagttttagcttatactctaaaacttgtaagtatattaaatcattctaagcttcattttagtaacacaaataaaccaattacaaagaatatagtttttttcctttgcttaagacatgaaaaatatgtcaattgctgatactctgacttcaaattggtaagcgatgataataatgatagtcattagagcaataataattgcctattagaagagatgttttgatggcacaaaaggtaaaataagttatttataatcagtaaattttcatagtttaaaagttttctcactgtgattatacagtacaggtacaaaggtaaaatttagtggagaatcttaccacgccaatggaaaagtaattattgatgatactgtaaggcactgggtctcctttctcatctttgtcattaggtatgacttcaaacttccacctgtccaacatgatttctgtgctgttttcaatgtcttttagaattttcatcagattctcaccttcgtaacctagtgggaaaaaaaaataccttgagaaaagaactctaaccaaataaaaaagctgtatttttatgtttcagtgtgcttatgcatatgtaatattctaaaggtaaataatgattttgaagcacattctgccaccaaatgaagaattaattataagattatactcatacccacatttaattcttaactttaattggtaacatgtactgtatttctctttttgtggtgcaaattctcagcatatacaactgccaagtgaacatttctactgtattccccacaaaactttataccaatagattcaaaactgaatgaattctctgcttccatatcttcctcctgggcagctgacttcacaaagacaccatcctctacccagctgctaaagtcagaaacgtggatgacattttagacttttccctttccatcactctcttaccctcaccttttcccgtctagtgatataaaactttcaatttaagtaaaaggtcctactttttgtaagctttaaaatttcgtttcttattctgtctactcagggtgtcccttttctttttggctggtttgcatctatttctttggcattgttttatatttgctaatactacttcccagtgctgctgcttatgcctgtagtctcagctactcaggaggctgaggcgggaggactacttgaggccaggagttccaggctgcagtgagctatgattgcaccactgtatcccagcctgggtgacagagtaatattccctgtttaaaacaataaaattaaataaaactaataaatttgctaacacttctttctggaaagcaccctttcaaaataatggctcagatgcccctctcacagtccgctatacgcagttctcaaaactagccctatcttagaactagtacaccacattgtcattacttgtgtttttctcactacaggtccctcttaacccagcctgcaatagagtaaatgctcaacaaatcaattttttaatgaatatatgatagacggtcaacatgacctgaaaataaaagtcttgtcaatattacattctcaatattcaatttatttgtaggtagataacattatagttatcactgcagcctaaccctgacagagttactgtttttgtttctgaatcttcctcaacattagtttccttccctgtaaaaaccttagggttcttgtgaagattaagcaagataatgcctaaaaagttctcagtacatgagtcctaaaacagagaataaaaagttctcagtaatattttactactgatgatgataccatcagaatttgaaatattgtactaagttaaatcatctctcttttcacccacacaaaagcacacacatagtcctaaaatgattattttgagtcggaacaacattttcagtttttatttttttctgttcattatttaattgttgaacaaggaaatgccagaggctatgagtcctcattagagctattagcatacatatcattgaataaactcattgggttaaaagaaaacaggcactctcatataccaaaattccctaaagaggaatacgttacacttaaggtgtatctgttcaattaactattagaaggtgaaagccaccagaaactagaaatacctcttctggagctcatcatcacttcttaccttacacaggtttaaaaagtaattactcgctacttaatacatacagtaaagggtacaataagtaacgattacataaacattgaaaatattaaatattatttcagaagagattgggtctattcagggtggtatggccatagactaaatactatttaaaaagctatcatatattttacagtataatttgaagctgttaagtattaataatatgcatataactgtactcagtggcaaaacactgaatggcttaaactgcaagattacaataattatatttactaacatttcatgtttcttaatagtgctaccttattttaaatgtttaattaatttctaattgttaatttcttttaagaagtataagtaatagctccccaaataaattatatacatatatatattattttacctactgaattaagtaaaaaacacttaaatatattcatctattttccaaattctgctttcatgtcagaataagcttgatagtctctaggcataaattaatttgcatataattatatattataatataggagtatcgtgtgtgtgtatgtgtatacatatatacaattagcagaaatactagtaaataataatgctttcaaaaaggttgaattttttctcagtcatgtctcaggttaatagcagcaccgtccaacataacactggaacaatgtaggaacagcaacctaaccgggagagaacatgataggaatgaatgtagtgaaaatcaattaccacatctagattgtagcagggtcacgcagcttaaaatctttaccactggatatgtgtgtagggatttttatgactaaacatgaaaaaggctggtttaaatctgtcttctagccaagcaaaagtagaaagaggcaataaataaatcttgagaattacaacatctgcaattcagaagtgattcacatagataaactctgaactgtagtcccccatttaacaaatatcttttccctacttcttgtatgtatctatgcccaagattgttaaataatgataagtaactattaatagggttcctgtacccaagaagatcatgattttaaaaaagacaaatcaaatccactaaatatgccagcaaaagatttttacagaaaagaataatgctattttactttcattattttggtttaaagcctgtaatcaatccaggctaagaaacaaaatgaaaacatgattaatatttattttatatttaatgatattatgttataatgactgaatctaaaaagtcatagaaatttttgcaaatgaaaatcacataaagaaatgcaacaacaaatctgtataaaagtgtgttcaggccaggtgcggtggctcatgtctataatcccagcactttgggaggtcaaggcgggtggatcacgaggtcaggagatcaagaccattctggctaacacggtgaaaccctgtctctactaaaagtacaaaaaattagcctggcaaggtggcgggcgcccgtagtaccagctactcgggaggctgaggcaggagaatggcgtgaacccggggggcggagcctgcagtgagctgagattgcgccactgcactccagcctgggccaaagagtgagactccgtctcaaaaaaaaaaagtgtgtccaatttacaactattacttgcctccttattctacacaaacaagattttccttgcaattaaatttttgttaagagagactaatgattgccagaaatttacaaaaagaatgctaattaagctagaatatcctacattcttacagtgtcaacttttccaaaatatgaaaatatattcctataaaaaagaggcttcaagtcaatagattccctgaatcttaagtgaaccaaatgattattggttgaatgaagtactttcttctacaaatattaagcataataataattactgcaactgcataaagtacttaacacaaacattgatatggtttggctctgtgtccccactcaaatctcatttttagttgtaatccccataatccccacgtgtcaagggagggacctggtgggaggtgattagatcatgagggttgtttcctccatgcagttctggtggtggtgagtgagttctcatgagatctgatggttttatcagggactatttcccctttgctcatttgcttctctcacctgctgccatgtaaaaaatgcctttgcttctccttcaccttcacgattgtaagtttcctgaggcctccccagccatttggaagtgggagtcaattaaacctttctttataaattaccgagtcttgggtatgtctttatagcagtgtgagaacaaactaatacaaacactgtgcaaacaagttatcggtttagcacgagaacctacaaggcactgttattttcttcaaattctgatgaggaatctacagcacacaattgttaagtaacttgctcaaagttacacacctgtcaagaaataatcccaccgtaaagcatatttctttgttaataatctctagcaaatggcttctccatttccctaattgctcaacttgggcatcttgataccttgctttccctaaaattcctaaccaatccactggtaagtacaattaagctaagcctgaaaatgtacctccagtttggctacttgcctgatttaaatcatgtaagctctagtctgctcactttattatgcaattgggacaactataatagaagttctcatttggagaactatagttctgcatgttttcacattttctgaccagtttattttctacccccaaattaatctgtttttgaaaatgtgtcagtgtgttactctgcttctgagactttcgaagcttcactttgcatgacaaattcaatcaagtaaaactctcacaatgacaaataggttcctgcattatctggctcccaattgtctttccaaagtcatagtactcactatccctaattgcccaccatgcactgctgcttcagcaaccccacctgcattccttccttcagtccttgaaacacagggagctatttctcctccttcttatattttaggtccagttttaatgttacctcctcagagagaccttcttggccatctagctagatagttcatctctattattcattcttctgattctttgatattttataattatatatttcattattgttcaatttattttcaattatactcaacgaaaatgtaatctccagaaggatagaagccatttgtttatttcctcactgtatatttagcacctagaacagtgccaacacatatcagacactcaaagggaattcatcactaatagattctttgacacatgctacagtccttgcctttgtccattgttagtgctttgtatgtggtttcacaagaattattagagtatgccaaatatggacttctttaacaaatttgagatttaggccatttgttaatctggaagcaaaaataaaattattaattttcatatacatcaaatatatgttccaggagaacatggcaagaagactcacatattttccttctttttaatctatgcacttgtatgaacactggcaaatacaagtatcttatcagaaatggtgatgtctttattcatttctttagattgcatgaactctaatgcaactcatgaaaatactcctgaagtatattcttactgaacatcccaaatagactacatactaagctcttgacttagtcaagcacgtatacagcttagagctagttggtcagatattcatggaattattctccaactttgccgtaaatcagagttacttagggagtttgtttaaaaaaaaaaatcatctgctcaggtcccaattccagatatttccattcagcatgtctggggtggggtcaggccactgtatttttaacaagtgccccagggactctgttcaccttgtcttagtagacacttttcaaacttctctaagtgagctttgatgctaaaaatatttagcattcaagtcctgcttctttaccaaagtctgatggtgtttagtgatcttacctagtggtgttcagtgatcttcagataaatatagcctattagtgactctgcaaaatgttttaagacctcatctccaaatattctctctttgcttaccctactccatcgacactatttcagtttcagttccttgaatatgtcaagtgccttcccacctctgggcctttgaactcaatgttccctccgcctatgaagttcacacccagctttacatggctgtgtcattatctagctagcagttttttcttctatgtcatatcctcagtgaggtctttccctataatgatcatctgtttacttgttagtgtaaggtctcacatatgattttatgtgccactagaaatcaaggtacttttgtttttcttttgtcaactctgtatccaaagtgcagagcacagctggctagcatagagtgagtctcaaaactgagtattatttaacgtattcactcctgggaaactaattcattagcctttcatctttcctttgtttgtgattttacctcccaacttataaatgaaaagtataaaaattaccttgaagtgcatccatgtgtaccttattttctaaacaaaaaaatcaaaaaccaaaaccagagatgtttggaaacttgacctcctttagtttaagtctctatttaatatcacattaaaacccaatacccatggtctcttttttccactatttgttcttctatccaagactattgttcaaaatcatatattatatataccacatcagttatcttcactgaaatcatatcgtttttgtttcttttcttttctttttgttttgcaagggaaaggggtgttgtgtactgtttctgcttttgttgttgcagctgctttacctcctccccatcgcaggcatcttgctagatcattgccagtcccaagaggcagaatcgcaactggaggatgcttgcctacattggccttttctgcagaataaaaaaaaatacaaataaagaaaattttaagttcagataaaacgacggaaataaaaagatagcctgatgacattaaatgaaggaattccaataggtactcataaacaaaacataattgtagttttagatatacacaataatgaattatggataatttgtatacatttgtagcaattgataagacacaaatactattattcacggaatgatggaattttcaaaactcaggcaagaggaaagctttttaaatatcttaactcagctaaaaattgtggtgtgtcttatctccactacaatcctcagggatattattatatacagcataagattacaatacagagacacaactaggatggatgggtaggttcctacataaagtccttttgcaacatcaattctaggtacattttacttaaaggaataaaatatttgaaaactgttgaattataaaagtgagtaaattgctaacaatgtccttgactttttcccacccatggtgctgctttgtgtcagagcaaatggaacacaacgttaacagctggaatacaacgagatcagcaggttttccatgagattaatctttacatcacataatgctttgggttcagagcagtaaagatctctgccgctgacatcccatatgctttggtttgaatcattgcatgccttgaattaatctcacaaatgtatatcactttcttttatttgtttcttcctccttagcccctcaaaatcagtgtacatatgtgtgtagggatagaggggatagataatgtagggaaatgtcacaatgaaatagccgacaataagatttttgagggctaaaacaagctaagaattcctgctgtttttcctctaaaatccttacaagtcctcagatacttttccagctaactcattaacttttgtaattcttgaattctggttgtcttctcagataaaacatataaatatgatttacattgtttaatggaaggccagatcagaattttcactgtttctttttaaatcaaatattagtagattaaagctgttagatccttatcaaaagtgttgccaacatgtatttttcttattttgaatatttttagtgtatgcatagacagaatgttttctgcattgactaaataggtgtctgtttcaatttatacagaaggtaaaacttcttttgaatcaattcgttttatgaaagggcctgttttaaacaaagaattgatcaatgcggtaactgaaatgagaccaaaaagagtcaatatttgttttggatttatttcctcataaaggccaattcatggtctctttttctaactagtaaccagttccaacaactgactagatctgaaaaagcaaataattttcctgaatttatactttttcttgtgctgcatacttaccttatatcctcagtgatgttcctgtattatttgctcataaaaatcgagcgttttcagtttaaatagagaggcaatatagaataaggcttaactgtgcattctaatctcagctctctcagttcacagctataagactttgttgtagttatttacttttttccaagttttaggttccctatctctacatgggattattaatactatctgtatcatagagttgtgaggaataaacaagataacatgatgaataaaaattagctatgatgatgatgatgatgatggatgataacgatacaaatgtatacagagggtaaggttttgagggtccatgttttaaaaacgtaagcacatcaatttcgcacagactttatcacaaatactaagactgctccttcagttccttgtctggggcacacaaacaatctgatttcctagagcccctgaaaacaactctgaaaatttggtaaacactgtaagaagtggattagaaaggaaggacttctatgtacttctaaactattttgccagttgaatttttgaactacagaataataagttaaaccagtgtgcaaccttccagatgtccaattatatcactgcttccaaagataatgatacaagcaatagacacatagatgaaacaggatttaaagctattgctctctccccagccatattaagtatgtgtctgcattacctatgcaatccaaaacccagcccacggttccatctccaccacaggctaacactctgaagtcaggaacatcacggaaaaagtttaacctgaaaaataagcatgttatggcacatgattaatagtttaaaaataagatgttttcagttttgtatcattaacattttacccgatgaaatacgtttttattttataaaaactgtaaaatatctcagtgataacttacatatcctttaatcctattttataattatatattcaagattctataatttaaaaatattttgtaattacatattctagattccataatgaatatactctttttctttaataaactctaaaattttaaggataaaattagtaaattataataattttcattgatattctcccagatgtgatttgcagttcgcataacccagaatgacatatactacattatttcatttaataaatttcatcaatccaaaattatcttttgagtgaatatataaatgtgacagttatgtcagtaaatatgtctttaacaatgttctactttctccattactgggagaaattgatcagactgcaactggggttctagccaactttccttttgactgagaatctgcaaataggaggcaggcttcaccttgtattttgacctggttgacagtgttttccacccaggaacactctagcctaattgctgggtcagctgccataaatacccactgcttctgctgttactgcatgcagggtgcttaataatgcaacctaccttgggaaaagtcacaaaggcaggtaatgcagccagctatacagtcatagcctattttattgcaataaaaaaattgaaacaggacagaaattttggtatgttatgtgtctcttcacctcccttgtcccaaacataacaactgatagtgatataatatgcaactatccaaggaatttttctacgtacttacgtatacaaattttcgtacataaatctttattacacacatattttcaacacgaataaaactgtgctatacatactgttcattaacttgtgtggttttattttaacttcaaatatgtctaagagaactttgtgtatcagtatataacatatgcatatgtcatgtgttgcattctgtcagattattatttttaagcactgcatcatgttttataataagttcatgtactacaagataaaatgaatgatctctttttatgaatttttaagctatttcctgtgtctcattactacaaaaaagtattgtatttaacattagttgaagaacatttgtgtaaatgtgcgcatgtgttttgaaggctactctagagaaaaatattccattacatcattatatccctctgaatggctcccactgtcaaatatgcaaggattcatttccttgcaaccacaaaacactacatatgaacaactttatgatatgtctttaataataagtgaaagccaatgtctttttatttgttgtaaaatcacacttccctgtttactagtgagttcagcatatttttatacatttcctggagatgcgtaacctgtcctatgaaaagaacactcaaagatgtgcctttctttctattgaattgcctttttattttttatttttattttttttttgagatggagtttcacttttgtcgcccaatatggagtgcaatggtgcaatctcgactcactgcaacctcctcctcctgggttcaagggattctcctgcctcagcctcccaagtaagctgggattacaggtgcctgccaccacgcctggctaatttttgtatttttagtagagacagggtttcaccatgttggccaggctggtctcatactgttgacctcaggtgatccattctccttggcctcccaaagtgctgggattacaggtgtgagccaccttgccgggcgagatgtcttttaataatactttaaaactctttgcatattacagcaatcttcgcatttaaatttgcatcatttaaaaaaattttgtcaaggtaataccaacactgcataaatataataaaatatgtataaaaattactaaaacccatcatctgattataatatccatggatatttagaacaggaaactttcatgcattttctcatttattatattgtggatatttaacctttgtgagacatgttgcaaatattttattcggttctaatactcattgttttgcttatactaatatatatacaatataataaacacatatgtaccagttgcccattccaggaagtagaacatttctaataacttacatatttctctgttttctttccctatagcactgccctttctaatttacaaaggtgagcactactctgaatactgagttaccacgtgtctgacataatcaacatgtgtctttctacttttcccacttacattggtactcagattcattcatgttgtagctgaagcttttcccacgtgtagctgaagttctttctacttctactgctgtgttaaataccacttacatgtcttttaaaatccatgtcaatgggcatttcaactggtttgctttacattcttgcaaaaagtgcattcttgtacaggcatacctcattgtattactctttattgagtttagcagatactgcattttttacaacttgaatgtctgtggcaactctgcttctagcaagtctatcagtgccatgttttccaacagcacatgctcacttggtgtctgtgtcacatttttgtaattatcgcaatatttcaagctttttcattattattatatctgttatggtgatctctgatcagttattatagtaattgctttgaggtgccatgaaccacgcccatgtaagacagagaacataattgtgaatgttgtgtgtgttctgactgctccacccaccagcggttctcctgtctctctttgtgtcctcaggcctcttaattcccttagacacaacagtattgaaattagggaaattaacaaccctacaatgtcctctaagtgttcaagtgaaaggaagagttgcatttctctttcaatcaaaagctagaaattattaagctgagtgagtaaagcatgtcaaaagcacaggcaggccaaaagctagccattttgtgccagtaagccaagctgtaaaagcgaaggcaaagttattgaaggaaattaaaagtgttactccagcgaacacacaaacaacaagaaggcgaaacagccttattgctgatagggagaatgttttagtggtctagacagaagatcaaaggagccacaacattcccttaagctaaagccaagtccagagcaagcccctaactctattcaattgtatgaaggctgagagatgtgaggaagctgaaaaatagtttgatgcaagcagatgttggttcttgaagcttaaggaaagaagctgtataaacagcaagtgctgaggaagaagtggcagcaaattatccagaagatctagctacaattattgataaaggtggtacgctaaacaacaatttttcaatgtagacaacatagccttctaatggaagaagatgccatctagcactttgatagctacaaaggagaagtcaatgcctggcctcaaagcttcaaagaacaggctgactctcctgttaggggctaatgaggctgatgactttaagttgaagccaatgctcatttgccattatgaaaatcctagggcccctaagaattatgccaaacttactctacctgtgcactataaatggtggaacaaagcgtgagggatatcgcatttctttacagcatggtttactgagtattttaagtccacgactgagacatatttctcaaaaaaaaaaaaagattcctttcaaaatattattttcattgacaatgtacctggtcacccaatattctgatggagatgtgcagaaagatgaatgttgttttcatgcctgcaaacacagcatacattctgcagctcgtcgatcaaggagtaattcaactttcaagtcttatttaaaaaatacatttcatatggctataggtgccacagacagtgattcattttggggatctgggcaaagttaattgacaacctctgtaaaggatttaataatctaggtgtcattaagaacattcataattcatggacagaggtcaaaatatcagcattaacaagagtttggaagaagttgatgccaagtctcatggatgactttaaagggttcaagacttcagtggaggaagtcgctgcagatgtcataaaaacagcaaaaagtagaattgtaagtggaggctgcatgtgactgaattgccgcaatctcatcatatttgatgagaattgaatttgaaaggatgaggaattgacttttagagataagcaaaaaaagagggtttcttgaaatggaatctactcctagtaaagatgctgtgaacactgtcgaaatggtaacaaaggatttagattattacataaatttaattgacaaggcagcagcaggatttgagaagactgactcaaattctgagggaagttctactgtgtataagatgctagcaaacagcatcacatgctagagagaaatctttcataaaagtaagtgtccatcaatgggtcaaacttcattgttgtcttattttaagaaactactagagccacctccaccttcagcaaccaccactctgatcatttggttcccattaaaatcaaggctaaactctctaccagaaaaaacattatgactccctggaggctcacatgattgttactaatttttcgcaatgaattatttttaaattaaggtatatacattttttaaaccacaatgctattgcacatttaatagacaacagtataaacataacttttatatgtactgggaaacgaaaaaatttgtgtgattcactttattgtgatattcactttattgtggtggtgtggaaccaaatccacaatgtctccaaggtatgcctgtacgtacttcctagtgcttaagggtagtggccactttagagtaatgcatattaatatgcaactttaccagataacatcaatgtttttcgcaaagaaggtgcaccaatgtacaatggatgtgctctattgaatccattctctttaacacttgtcacgctttttcattttatttcttatttttgtgaaatgcctatttatccttttggtttccattatctattccttttcaccttgttggtttgcaaaaaaattttacacgtctttgattttagtcctttttgaataacttttttttcaaatatcttctacaaatttaaagttttttcttttactttcattaatgtgtattttaatgaataagaacctagttttaatattcaatttcatcatccctttgataagtagtcagtaccttaactagtcttctgtaagacaagcttccttactcagagctcagaattcacatacactctcttaaaatgtcagttttacttttgacatagaaattcttagtttgttgtggtgtgaagtactttcttttcttctctccccactttctcccatctcccctttatcctggcctccggccctccctctcttcctttcttactccctttcatccttccttttggctgtagtggagcactttttttctatttattttttatccatcttttcatttattgaataattcaactttctactatgcaaagtccatgataagtattatttccacatatgggtacatttctatttctattctctattgtgttttactcacgactttgtccatctctgcactagtaccatactctcgcaattactacagctttccagtaagtccatatctcagggcatgaagaatcttaccaattatttcttctttttttcatgtacatttaaactcatcatatttcaccaaaactaaaataatagtaagaaaaaccaatcatgattttgactgaagttgcattaaaactatatattaattttgggagaaataacacacgtataatatgaattaagtttccttattcatgaatgtagtattgctcgatttatttacatattctttaatatccttcaacaaagatataaattttctactaacaggtcttgcatatattttgttagatttattcttcgttgttttgtggtttttgttggtattttaaacatttaaaaattatgtttattaatattaatatttttgttgctggcatatataaacatatttgagtgttatacattgattttataaataatcatattatcactgtttttctattgcttacattttgtttgtggatacatttggatttctatgtatgtaattgtggcatttgctactagcaatggtattattagtaatctctagtctttataattgttatttctttccctgagtctttttccttgacagaattccaacatattgttgaataggagtattcatagtgaatatccatatcttgttcctgaagataagaattacttttggaatctgcccatttaggatatctgttattgagattttatttttctttctttttactttccttctttttgatggagattttttatgaggttaacaagtttctcttctactcctatcataagaatttttactatataaaaatattaagtttttctgcatttttgagatttgacaaggtctctgtcctttaatcggttagtgtgagaataaacatttatatatttctgcattattaatcattcttgaaatcctttcaggcacccaaattgattcttgtgtattaatatttttaagataattgagtttctttgctaatattttgtttagaaattttgcatcaatctttatgaacaaattgacctatttttcttcctcataccacttttgtctactttttaaaattaaaattataccgcctcataaaatatgttgcagagtattccccattttacgattttttgtggaagaatttgtataattattgaagttctttgaaaactggtagcacttgcatataaaacctaaatgtcgggtcgggggaggggggagggatagcactgggagatatacctaatgctagatgacacgttagtgggtgcagcgcaccagcatggcacatgtatacatatgtaactaacctgcacaatgtgcacatgtaccctaaaacttaaagtataataataaaaaaaaaaacattaaagagaaaagtcttacatcattgtttaaattactttagtaactattcttaaaatttatgattttaaattctccttaagtcagcttttttccagctatacttctgtagcaatttgattctccctcctagattttcaaacattggcactgaagcttaagaaaactttgtaaaacacggcagtagctgcaacatttcccaccgagctaactgtttctggtgaaagcctaaccatccagttgactcaccattgttcttctattccatgatgatgtttcatctgttattcattcttgttttctttaaaaattgtcatcattggttcttcagcagcatcctacccccaaacataaaccccatgtgactgtcagaccagcttactctctgtaaattgattgctaatcggaaaatttgacctctctttatctcaatttcttgatccattcaatccatgcagttttccctagaaactcattcattccttactacattcattcattaatatccttgggatttatttagtgattctgaccctcagtttccataactttagaatagaattaacaccacgtggtttgttgggctctttatatacacataaagaaaatgtgtatgtaaatacaccttactattcacatgttattactgatttaattatatttttttctttattaaaagtagtataggtatgttttaggtcagagtgccactcctctatttccccacctcctccgcctgcactgttctggcagaatagtcacaattttctaacaagcagtaaggagagtttttctgcatgcaatctgaaactgtagctagcggacaattgggagacctgcctacagcactggagacacaaggtacagaggaaaacagctgtgatagaagacaagtaaactgaagagtctcagcaagagccaaaatgcagggtcctgcatggcactgacttttcacccaggaaggctgtgatgaggagcagctgtgaggcttccacattacaggtcatccttccaatggggagaagtgagaaaatggggagtgtcaggaaggatttcactctggggaaacttttgtactgcgtattgtactttttacctatcagttccacagtgttccatgtgaagaatgaataagcatgaacattttgcaatgaaatcatgcttgggtcctgaatttatttgcaccattttattaatttttttgaaattaaaaattcaaatgatgtatgaagaaaatgaatgatgatgagtttccaatgttggcctttatagcattgattcacctagagagtttcctatgtatctccaatagctatatttgaaagcaagcctattatttgggtttagcagccctctgtcagacacttctttttttatcatatttgctctataatcaccactataacattccataaagtttcagttatgcaagatgaataaattctaagatccactgcacaacactgttcctatagttaacgacacttttttgtacatttaaaaagtttttaagaatgtagatctaatgttaattgttcttaccacaaccacaacaaaagagcaggtggtgaaattgtgatgcttaatattactaaaaacaaatccagaaaatttcatctaagattcagaggcttactttgtgttaagataaaattgatacagaaaaggcagtaaattttcacttgtacctaattgttattaggtacaaagcacaccaggaaaaccttttttaaaagaaaagaaaattgtagtactgattccagaatcttggaaagtgtcataaatcagaattcttaacatcaatacgtaaatattactttttattccaatcttatattttattattaaaaaatactatcgcttacatacaatgtggctgtatgggttagaaatagattaagtatataaaataaataaatatatggctctaagtagtatatatattataaatcataaaataatatttttgatacttagaggaaatcagtgtgagagtcataaatattttcagcatatctatacatggtgaatgctcgctttaattatacatatttacatctctttgtattaaagaaacacaaggctgaaggatccaaaatgactttaccatatgtcatcaattctctttttcctcgttcttgtttagaaaaaataatttcaagagctttccttacgaaaggtctgcattttgatttaagcatttagagacagaaagaagcatacttatctctgattattctattcaattcatatttatacttgcatgtacacagttacatactatattattcttaaagttacaagattagatggattcaaaattgccttagtaaaatctggctgaattttctgatttgtgatgttaccgttgtttttgaaacaatatttatggtctagaaaaccaatttttaataactttcagcttatttattaatacccaaactgtatctgtacataccttggtatcattgatattattattattgctggtgtaatatcttttaaaaatccatgcatgaattatttatgctccctaaagtttcactctattatatatattacaaaatgggggaaaggttatttcatgtttttctctgtgggtttcgatgttttatcaatttaatgtgactctctcaacattttaatttaaagtaaaattaattataataatatcctccaatctaatatcttatgtactttagttcaacaatacattataaaatttagttaaactaggaaatgcacctgtttcaacaaattcgtttagagttttgagatattgtgtggaagctgaatttacactgttttgggaagacattccatgtggctaagtgggatagttataaaaaattaatttgaattaatctttataaacccagtgtaaataattatgttaccataataaccagaaataagttttagagtatttgaaaaatatacatattccagtgggccattaataactgaaacatttatttcattatttctggaaatctcaaacaaatcttttatgcttatgtgtgttaaaagtgaaggagagagggacagagaaagggaaaaacacagactgaaatgacaaaagagagcatgagacacagaaaatgagagaatatttattcctggggaacctataatgttatctcattaaataactttaatattccttctaatataaagtgagttagaaatgaaaggtcagtaaatgacaggttctatgatgtagcctaaatatttttcctttcttcactaatgtacatgtttctttaaaaattaatattggcagaaacatcaaatttttaatgtcatttctgagtgaatagaaacactaatatttagttgaaatatccttgccatcatatagaaaatatttataattttattagtataagtaaaacacttttgtaaatatatttgttaaaatataaattttttctattgcatggaaaattataacccttgaaggatatttttaaagtacataaattaatattcaaaaaccaagtaaccgatgttaaacaaaaattatgagtggtcattattttagactgagcttctgcactaggccccaacagaccagaacaaaccagaatggagtcacttgtgctaagtgccatgtaatcaaattgaactttaaaatggtccagttaaaaaaagaaaaaaacaacacaggagatttgcagcatccaatcagaaggggcccagttcaccagagctagcatgataaggaagtcctttcggttttgaccctgtaagaaaagtaactttgaaatgaccaatctgcctttcatgccttatttctgctttcttcagccctcttctgcttataaagccaaactcctgtgctcagttcattggaacactcatactattctatagaattaggtgttacccaattctagaattgcaaatataagccaatgagatctttaaactaactttgttgtaattttgttttttaacactgaagaacacaaaacaccttttaaaacgccattttctctcatctgtaagtgtgttttttacattagaaagggagggatttaattgaacttagtattttcatactgtatttactgctacaaatacgcagtaaaatttatggtcatgctacatgaaagtccatctcttaaggtattaatgaatatgcataagttatgtgtgtactgatatgcatatatatatgtttggaaatgcaggttaaaatatttcttgtaagttacatgactaaacatagagaattgacagacaattctgatgtagtaagttgaaaatgaagggaaaaatacgataaagagtgtcaattaaaacagaagttacacagtcttcctgatatttgaaagaagttaaaatggaataattcattcttattacttctaattggaaagcacatatattttatggtccaaattcatcatctataaaattaacccctaaaatgtagcagcacaagtgattaggttgctgaagactgtttgacaaatttactgaaatccattctgtcgtgtgaatgattttaatattaataattagaatgaggttttattctgtacacatcagatcattccatggagttagcttagagtgtgaagtaagaatgtattttgaaaggaaataaatctagacttctatagggaaaaaagactttgcttagggtcaaatacaaaagaatagctctaaatactttataaatgaaatggcacctgtatctatccacttatttaatttaaatgtagtaactgcaactatgtactaggaactgagatagattccagagattcaaaacaaggtagaattcttgcctttgagtatctcactggcttaactgagaaggcagacaagaaaacacacagttcaggtcactataagatgctctttgagggcagttaatgtggactaggtagggatgaggggtggcttaataaacttggagacatatgagttgaatctcgaagcttaggtaaagttaattagctgatgaattgggggacagaagtgaggagaaattgagtgaagggttgttatgtaagaaggagggtaaatatagatcctaggagagtggttagatgacaaatcttgaaagcctgaagtgacatactgtcagtgggaatgagaaagcggttctttagtgaatggtctttttattcatcaagttagagaataaaaacagtgtgtaaattcgggaaaaagggagaaaactagtttagtaatagacatgtagaatttgagatactcatggaacttgtgttcatggactattgaacataataagttaatttcctccttatgatctctctttgataaataaggagcaggagagtgaatcctgattatgtagggcctgatgtttataaaaattgaggcccccctttaagaaaaaatatgcaaaataaatgtgtacaaacttttataaaagtgatgtatatatataaatatgtataaataaatacttatctataataaaaaatcacattagattgtaaatttaagatagcttacaaacattacatcataggatttcaaataacatagttttataaattagtaaactgcttaatgcttcgtttttacatttttatatggtaatttaaaataatatttgtactgaggttaaaagataattttcttttcctctagaatgatttattaagatatgtttaaattgatgatttattaggaatgttccacttagcttcacaagtcatcattgataaagtaaatttttagtattattgttaaatacgtgaaaatcaatattgggtttttggtcatagccaagctgtaagacttgcaggcatttcaattttttgttcaatgactaaccttaagtactgtttgaattcatgatatacattaaccattgttacgttaataacatgacatattgtgagttttaggtatcttcattgatggcgatatttcatagagatttataaaacatgtactttacacataaacatgcctgcttgttgtagagctgatataggctgtgctctacaagcacaggaataatgatacatttaatatcatgtaactttcatcaataataaaaatttaaaattgtttatactgcattgttaactgtattcctggaagaataacgcttctgttttgatgacacattaaagagaactgaatgggatgattagaagaattttccaaggataagctttgaactttgtacatttcaaacctcatttctcccctactatacacatattctgttaccaggcaggctctggaccatttttatcaagacatgtcttctggctctttaaatttatgtcagaaaaccagtgtaaagtcacactgagcaatggggatatgcctggaagtcatttttacaccaggagaactagcaataacaaccatacacaaaaatatccatgaaccacatattataagtctcagggttcaatcatgtaattggacctcatcctcttttagtcagatcctaaaatgctcatgctcattccaatgctactagtcactaggtaaagtgtgatgaaaaaggagttggaatggagacaaaagtcttttttgttttttactgttttatttttccatatagatgcccaatttttctggttaataccaatacatatacagggcatgggggagggctcttaattatcttccattgatatatttgcctctctatgcattactactgagctggcttaactaacattgttcataaaaattcttgtagttaaaataccctctttttaaaatatcaaaaactcaaatgagaaaggcaatacaaccacattgctaagatccttcctatagtcttgaaaggagtccttgcaagtgagagacactgaagttgaagattcattgccttcaagagcatctgcttctgggcacacatcttactatagcataatactggtcagagaccataatttaaaatatgacagctactcgggaggctgaggcaggagaatggcgtgaacccaggaggcggagcttgcagtgagccgagatcctgccactgcattccagcctgggcgacagagcaagactccgtctcaaaaaaaaccatgaataatttaattacacagaattctaactataggcataaaggtaactaaatgaaaaatacatgactcatcaagaagagataagtaaaagtaaataatgtaattggagaataaaacattatgaattcaacaaacatctgccattttcaggaaatgatatgtacataattgaagattagtatcttagacaccaagatatttatgattttaatagttgtaaatataatttgtatcaattttatcaaatgtattatattccaaatccaattatctgcttttcggagtgtgtttattaggctaaacttgtcttgattacgaagaacactgttacccaataatataattcaagttgtagatttctatatgctgataacctctatattaaattaccttaaattttcatgctccttgagttgcagattttaaatagaagaggagggtatgtataatcaggaaaagactggctgaaggactgttgtccagagagatttttacagggttttattacttgagtcacctaagacttgagtcttattattattattattttggtccagaaggttcctgggtgactactgaatcagtaggagaataactgaataatttacatgtgtgtgtgtgtgcatgcatgtgtacaagcaatataattatggcttttattttaattattagaatattaaaatttcttgggatgtgattataatttatgtgagcaatcaatttaaagcacaatcttttttatcaatcaattcattactgtattagaaatcacgtttttgccatgatggcatgcttcaccagaatctacattcaaattattcccacagaaggaaattattgtatcagtagtgctaaacgtttatactgattttatgatagcattatcactaatatctaatgtctcaccttcatccaaatgaacttccaaaaaactttatttagagtgcatgaattgaatgaattcaaatcatctttgcaacaaacagatgtttcatttaaaacattctgatcactctgatataaaaatggcattacttgatcttttggaaaagttattctgctaatggagtcaagatattaacagctataacttcattaataatacacataaagaaacttggaattgaaaattaacactaattttgaaaagtcatttgatctaaacgaaaagtcatgcttcaaagagtgatatgcaaagggactttctgcatactaaatgattgctttggggcagagaattaactattaattttaaagcagatgctcatgtttcttcagcatagttgtgtttactgatttctgcatagtcaatgatatcactggagctctcattgcagatggtaaatgttcataaatatttcacacagattatgtattcatcaactctttaagaaacagaaattcagaactattttttgttttgaaattcagattatttttatttaaaagacattttatttttaagctatcttttgctgaaaagtgttattgcaaaataaaaatctattataaagtaaatatttataaactatatatttaatgaaaaataaaacattgaggaagtatattcaagccattcactatacattcttggtaaaactgctcatgctctttttctcacatacatttcatgaacatctaacctatgatttgtcaatatctccacaggcatttctgattggtatatttgtgaccctttgcaactctcagggagctgtgaggtccaggccacagcataatgggctggcataaaagggataccaattcttcaaaagttgtcacttgtttttgtgtttaaagaacattggaaaatagtttatttttggtcacgttttaggtataatgattactattaaagtcagatctctcttccttggacgtgtgtcttacacattacaagaggataacacagcaaaagctggatttagaaattggagggctgccaaacacatcatcatcattcttcattgcaatgcacttattaatagcaatacttaaaatacaatacagtcctgggcaaatgctaaattgggccagatgctaggacaccagaaacaacctgaagaatcttaggtaaacctaattattatggtcacaataatcctaaaaccctctgtgaactagcccttagtagctttctgacatccgactgcccttcactctgttctagtctccctgggcttcttgctaatgtttcccaaacttacacaatattttccaatcattatgcttttatgcttgctgctctctctgccttaaaagctcttgtacaagatgacaatgagctacctcctcatcttcacatctatactcagccagttcttctccacctcatttaaaagaacaaccacgaaaccctcaccaacaatgcacactccttgtttacattccctgctaatatatgtatatttcacctgtttattagtttaatatatgttttccatcactaaaatataaggctgtgagggcaagagttattatccgttttgttcagagtggattggcagtgatgagattgttcctggcatctggtagccattgaataaatgttttgaaccaattcatctgctatgggttttcttatttttacttattggtaagctatcatcagttaactgcctggggctggaggtgaatttgagccagtaattttactatgtacacttacataacagtaaatgggaggatatttaagtaaaatatgttatttattaaaaacttaactcctatagaaaaaaaatcagaaacagattactttagttcatttgtgctgctatatgaaaataactgaaactggataatttataaatgacaggtatttatttctcacatttctggaggctgggaagtccaaggtcaagacatcaacagatttgttgtctggtaaggcttattatctgcttcaaggatggcacgttcttgatgcatccactcatggcagagggatgaatgctgtatcttcacatggcagtagaaggggaaaggcgagagctagttcccttgagccattttataagggcattgatccaactcatgagggtagagccctcataacctaatcatttgctcattgctccacctcttaatatgattgcattggtgattaaggttcaatataaattttggagagacacaagtattcaaaccatagcattctgcctctgctctcccaaaatttatgttcttctgataagtaaaatacatccattctatcccaggagccccaaaagttttaacaatttccagcatcaactaaaaagtctaaagtccagagtctcctctaaccgtcatctaaataatacagagttaccactccaggtacaatttattttgaggaaaattccccaccagctgtgggcctgtgaaatcaagcaagttaggtccttccaaagtacaatggtgtacgatagaatggacaataccattgaaaagggataaataggaaagaagaaaggagtaacaagtcccaagtaagtccaacacccaacaaggcaaacaacattaactcttgaagctgggaataacaaaaaccaaaaaaccctctttgacgatgtgtcctgccttctgaacacactgtgcagagtttaagcccctaaggctccgaaacccccattccttccatggctgtgctgtgtgcagcccacactgcatttctcacttgttagagttgaatgccaacagctctctcaggctggctttactagcctggagtctcagaggtggcccagcccccatagctccactaggcattgtcctagtggaggctctctgcaggggcctgaaccatgtagcagttctctgtctggggtctggggatctcaaggacctctccatcctttgaaatctaggcagaggtaggcatgccttcacagcttttgcactctgtgcctgcagagttagcaccagctggatgctgcaaacctttgccacctctgtctcctgaagggtggctctggttgcactgaggctcactggagccacagatggagtggcccaggagtgctgcactagaatgcattgagcagaaacttgaggcagctctgggaagtgagccctgagatcccacaggtgctctgaatccctctttgaagtctttctgtcctcaaggccctgacactgtgggcctgtgatgggagtggcagccttgaagatctctgaaacgttttcagggccactcttccattgtcttgatgaatagcattctagattccttctagacatactaatctacccaaactttcattggtaacacccttggtgttttatcataaacacatttctctttctttaccaattggccagtctgagaatttgtcaaatccttaatttttgcttcccttttgatgacaaattctgtcactaattcatttctctcttattacatcttactataagcagtcaagggaagccatgccacaccctcaacactttgcttagagatttcttttaccaagtatcactccatggtatttcatcactctaaaattcaacctcccacaaaatagtaggacatggatacaattcgacaaagttctttgccacttcataacaaggattgcctttcctctggttgcaaataacttgttccccattttcgtatgaaacctcattacaatggcctttcttatccatatttctagcaacattttgttcgcaaccatgtagataatctctaagactgaacctctctctatggtcttctttctttcttcttctatcccccacctctcctcctcctcctctacctcctcttcctcctcctctttctcctcctcctcatcctccatattgcagcctctccccagtccacatagcaccttctacgtttttaggaatttgttacattagcacctcactccttagtaccaattctgtcttagtccattctagcagctataacaaactactttagtctgtaaagtctaaaagtctataaagggtaatttataaacaacagaaatgttttgatatcacaggggtacagcagaagagcaatttagcccaggatggatcataccttgagtctcatccatatctgatttagaagatatttagatgagactctgggttttagatttttgagttggtattaaaacaaattaagactttgagactattgggatggaatgaatgtaatgtatctgtatgtaagaagaacacgaattttgggggacccaatccagaatgctatggtttgaactttcatgtgtctccaaaattaatgcttaaaattagtgcccaaagcaatagtattgggaggtggggtactgaggatgtgattaggtcatgaggactctacgcttacgaatgggattagtgaatttgtaaaggggcttgaggaaaccagccagctgtttttctgctcttctgccatgtggagactcagcattcattctctccagaggatacagcaagaagacaccaccttggaaacaaaaagtgagccatcagcagataccaaatctcctggcccctggaccttggacttctcagcttctagaactgtgagaaataaatttatgttgtttgtaattagccagtctaagggattttgttatagcagccagaacagaataaaacacaagttaaagcacacacacaaatacgaaacggtcatttcaaatggccaattcagaacatgtttgtttctttagagtgtttcagcaattttgataggcaataatctttaaacagtgacacacagatctctagtctaattgctatttggcctttgttggtgagatagataataaaagctagacttttcaacatctttaaaatcatagtgcatttgtggatgcatgtaaaaggtgactaaaggcctacaatgactcaaagggggaaatttgtgtgaaaggcaagcaattatgtgaccttattcattgtggtaacatatttttgttacttttattaatccatagatctttaattttagaagcatgaatcaattttcatactccatcactccagtgaccaaggcagaatcagaattatgcttacacatttaattgggggagagcttgccgaatcatctgcattttattttatgattaatcatgagaaggatagagttgagtgcttcacttttatattagtaaagaaaattttttatttttgaaatttgcaacagagctcaattaaattttgatgaacatttccttagccttttgaggattctgttcatttctgtgtcataatttcataacaagaggcatatgtaaaaggtcataagctctgattttccttaaataaaatatggtagaaatttggttatataaaatgatattttaaattaagaagataatgaaatctgtgaaatctgttatgcattttctaaattatacatttattttaataggagaatatattccaaagtttcactatgaaatatgcatatttgaaatatgtaaatctgtaggttgactgttgcattatatttttaaaattatgtgtcgtttgcatttagttcaggtagatggaagcaaagatttctaagagcagctttctcacacacaattaattattcttaattatcctgatcaatctgaaaaataatttacatattttaaagttatcttgtattttatttcaattcattaagtgcttcctatttctcacttaaaattttagaaataatgtgagaataaaccatctgtattttcatgaagattagattcagaaggggaaaagtaatgtcacaagtatacaaaaaacttgatatgaacttttcataagtcacattaacatgtgaagttggtgtacagctagagctatacatacttattttaatgtagtgaaggaaaacatattgttatataaagcccaagagtaatttatattttatatttcatctcttctaactaacctatacctccaaataatttattcaattatatcacaacatgttccattaggaaagaaacaacttatttgaaagagactattgtttcagacaccttgaaacagaataatcaggatcagggagagatgatttatataaagagatagaatggaaacacataatacacacccatttctgttttaaaaacaattaaagataaaaaatgaaatgcccagtgagttttagtatttgccagataatttagattaggaatagttttagttcaagaaagttatttcctcttataaacatagtttttgaaaaaaaataaagttgggataaaagaagagttgtataccaaaagaatacatcaatctggtgtggtaaagaggaaaatatttttaaaaaagaatttggaagaatgcataaccacaggtttaaagtagcagaaaaaatgcatactatactttcaagagtatgcattcaaaaacctattgttagcattggaaaagtaataaactagaaatggtgataaaactaaaatgtataaatcaccaagggtatcagagtaatagggagaccttatgaaacagagcaacttctaacgccatacattaaaagggaatcactgcaataggacactcttagcatgatcaggggcaatacagctagaaaacagggctgggaggattcacaagtgagcagatcagtcattgagttcagagaaagggcaacatcatagcctggccagagtccccgttctgagcaactacctgtggcatttgcctttaggataaacaaagactagctctctaacagaagtctgagtctgacactagggatgcagtgtgggcatcagtatcagaggcaaacaggacattctcatgttgatcaagatgaagctaaaagttcaacacaattatatttaatcattttttaaaacaaacttttgacattgaatattttcagccaggcaattctactcatagccactgataccataaaaatatttgaacacactttcaagaatatgcagataaattgatagatattgacgtagcatatttggtaataattgtaaaacacaggcaatataaatattcatcagtaatgggatggctcacatgattatggaatatcatgcagcagttagaaaaatgaaactgatcaatgtctactgaaacggaacaatgtgtatcacctgctttagagtgcagaaagcaagttgcaagataatataaaatctatattctgttacgtaaaaaactatctacctatatttcatatatatatttcatatatatatactatatatatatacacctatatatgtgtgtgtgtgtgtgtgtgtatgaatacgttatagatagaggggaatatgctcatttatatgtgtgtattagattgggaagctacagcaaacaaccacaataataatttctgaggagtagtagtgctcaaagtgggacctttaaatttttttctaaataatattcattgtagtgtagactttttacagttacatacattactttcattttttaaacatgttaagatagagcagaggataacaggatgcctagaactgaaagagtagaaggaaacatgtagtacatatttaaagtgtagtaggaaaaaagtgagatgagagaacagggctaaaatcaaatttattccaatatatttacatagtgctacaaaacagtcatgtttttattaattattaattcatatttgtacaaataatacggataataaaccacattcactgaggacatgctatgcagtaagtacattgttatttgcttcataggcattatcccatttaacttcacaactatcctataaggcaggcagaaatcctcattttacagataagataatgaagccacacagaggtgaaactgtaaggcttgtaattagcagagccaattgacctcttgtttaactatgaaatacaggaaaatcctggattaacttggtttgattcaacttacaggggtcttagaatggcaacagttttgaatgcacaatatcctaattcaaagaagagctacttttttgaagtccagagaatattaaaggacaagaaaaagagccatcctgactgagcttgagtttacaatactttacttttgcttggctttatctacttggggacttcctgcatgtagctagctcacttagccaacagtctgatcatgatcctctagattctggattgtgaagcttgacaaagacattgttctgaactaaattcctgtgatgagcctgtcttccacaggaaggaggttctgcagatcactgctcagcattgggaaactgatcccagacagcaggcagcaaggcagtagaagaaagagctgaatataatgctgaaagactatgctaattaattatactttatgaatgtattttttgggtaagacactatggtacaaattttattctgagtttttaaaagagtactatttaaatacttggtttctggttcctgagaatgagaagtaagactaattttaaatcaactgccttttttttaaaaaaaaaaaatgaagcatgcataaagcttatagagcttctgtccacttcatgtggtctaatgtttaccctcatgttgacagaaagaaaagaggtcaatgaaataaaatgacattaattatttaactaagccaaattaatggtgatttgtttaggtgcatatcagtaacttcaaaagtatacagtttatgttaaaaatttattttactagatcttacctgttaacaatgaagtataagagagtgatattgattagatttggtaagtagtaaatgaaatcgtatgatttttttcattaacccatttatgctggaggttgcaatttttaaaatttaacttgaatttaaaaataagaccttggcaatgaccttaagctgtagaatataaataactcctacatgcttagtgttccaataatggaacactaggcataaatggactaactagctttctctttacttttagcagatattttaaatataagaagtacaataaaagagaatcgttcttcaaatacatggtttggcagtgttcaaactggcattcagctagtttgtcgtgtgtgtgtgtgtgtgtgtgtgtgagattaatatcatcattagtacaataaggagcattacttcacaatatttagaaagaagaaaaatctgctagaaatggactattttggaaaaccagtatttgcactcatttctcttacgtagttgatatttcatttttatgtactaatatgctgctgtgttcaaataacattatttctacatatgtcaggcagcttatttaattaattaacattaactgagttaatggtaataatattatccttggacttaccctggcattggtccatttccagaaagactgtaaacctgacgaggatttaatagatactggaattttctgtaaattctataaaggtgaaaatgtggggaaaaaatttaataatattcaatacttttaaaataagtaatgtctctcagtgttataaaatatatatagttgcaattaattatataatttaataaaaaatttctatcaatttaataaattttgaatcaatatcagaagtccaacagctcaataggaattaatggttttttaaaaggcttagtagccactattaaggcaatatagttcataagttagaaatattgcttggatccttaatatgcacatacatttaggatattctctaacccgcttttgaacattatttagctaactagatttcaaataaatgtatttttttaatatttcagtataaaattgcctaaatatcttctctcagtaaatccttgtgaataatttgtcctctatagatctctgatagatctgaaaattatctatcccctatatgaaacgggactgtacattgtatatgtgtacatgtaagcaaagaatgtagcctcatctggcctaatcatttcacataaacaagatcttgaccagtcatctcacaaaattgctaaactgtcttagcagcatatgacaaataattctttttttctgaaagaaaacaatctttataaataaatgcaatagaaatgtttctatgcatgcacatatctcacactgttttaattcttagacaaatactaaaagtaaagagataaatagtacatcaaaaagttaatttaccacaatcagttaggcattattcctgggataaaaagttggttcaacatacacaaatcaataaatgtgattcaccacataaatagaattaaaagccaaatccatataattatctcaatagatgcagaaaaagcatttaataaaatacaaaatcctgtcatgaaaaaaaatcttcaacagactagacatcaaaggaacataactcaaaataataaaagccatctatgacaaacccacagccaacagcacactgaatgagcaaaagctggaagaattccccttcaaaactggaacaaaacatgcccactctcaccactcctattcaacatagttctggaagttctaatcagagcaattagacaagagaaagaaataaaaggtatccaaacaagaaaataaatcaagctctctctcttcattgataatgattctatactcagaaaactgtcaaaattccaccaaaaggctgttagaactgaagaattttagcaaggtttcaggacacaaaataaatgtataaaaatcaatagcagttcaataacatccagccagagtcaagtcaagaatacaatatcatttacaagagtcacacacaaaaaatgaaatacctcggaatacaactaaggaaggaggtgaaagtgctctacaaggagaaccacaaagcactgctgaaagaaatcagaggtgacacaaacaaatgaaaaaaaatccatgctcatggaagaatcactatcgttaaatggctattctgcccaaagcaatttatagatttaacactatttctatgaaactaccaatgtcgttcttcaaagacttagaagaaaactcttctaaaattcatgtttaaccaaaaaacagcctggatagccaaagcaagcctaagctaaaaagaacaaagatggaagaatcacaccataaggctacagtaacaaaaactgcatggtactggtataaaaccagacactcaggccaatggaacagagtagaaaactcagaaataaagctgcaaaccttcatctgatcttcaacaaggccaacaaatacaaaacaatagcgaaaggacttcctattcaatacatgttactggaatagctggctagccatatgcagaaaaatgaaactggactcttttctttcaccacatacaaaaattaactcaacatggattaaaaatttaaatgtaagatcccaagctatatttctaaaagaaaacctaggaaataccccacgtgacaatggctttggcaacacattttttattaagtcctcaaattgcaacaaaaacagaaattgacaattaagctacagagcttctgcacagcaaaagaaaccatcaacagagtaaagtgacaatctgcagaatgggagaaaatatttgcaaactattcatccaacaaaggtgtaatatccagaatctataagaacttaaatcaatgggaaaaaaacaacaacaaataaccccattaaacatgagcaaaatacatgaacagacacttcttgaaagtcatacaagcaggaaacaaacatatgaaaacatgcttatcatcactaataatcatggaaatgcaaattaaaaccacaataaaacaccatctcacgccaatcagaatggctattattaaaaagtcaaaaaccagtggatgctggcaaggctgcaaagaaaaggaaatgcctctatgctgttgttgtgaatgtaaattagttcagccattgtagaaaatggcttgaatatttttttaagaacttcaaacagatctaccattcaacccagcaatcccattagtgggtgtaaactcgaaggaaaacataccatataccaaaaagatacatgcacttttatttgcatccctgctgtattcacaagagcaaagacatggaatcaacctaggtatccatcaatgctgggctggataaagaaaatgcggtacatatatagcatggaatactacacagccattacaaaagaatgaaatcatgtcctttgcagcaatatggatggagatggaggccatttccctaagagaattaacacagaaacagaaaaccaaatactgcatgtactgcacgaaatgttaagcagcagctaaacattgagaacacacacacttaaacatgggaacagtagacatgggggactaccagagtggggaaggaagaagtggaggaagatatgaaaaaaactacctgttgggtactacgcttgctacctgagcataatatactcatgtaacaaacctgcacatgtacctcctgtatctaaagtaaaagttgaaattaaaaagatttttttaaagttaagggatatatttaaacctaaattggttttatatacatgtgaaaatatgattattttataaacaaattcttatgatatttactgataaaactctccaaattcagtatgtaatatctgctcatatcacctagagttgttctcaataccctcttttccctggcacctgaacctactagtggacaactctgtgccttcctaaaagaaaacctaggaaataccctatctgacgttgtccttggcaacaaacttaaaaaaaatgcctatcaaacctggctattctatcccactgccttacttaaggtcttcaagttctttcaccagctttataaatttcttggcaatccagccttcctctatactgttgtctaagtacagccatgccttatccatgatgcaaagtttatgccagtgtccagttattcacaatataaaattaagacatcttcacaattcagccacagtttctctctcatctttcccctctttttccttacattgtcatcccggtaaattcctcttggttgacaccctgccatttcacaagtctgcctttctccttctttcattgggcaaacatctaccatataataacctataaagaagctccttcttctctaaagacttcttggtcttcagagatagttatctccttctctgaactttgatagcacttttatcttaaacatttctacttcaacctgtaatatatggtattgcaacagatctatttatgtccctgcctctctgcacgactgtgtattatgcctcttattcccagtcactagtagagtttggattcaactaggcattgctgtctgaacacatatgtgaacattttcagacttattgattgatatggaaaagtttatgtggatttatgattctgtgaccttttgcaacttatctaacatatcaaagtcaaaaaagccaaaaaatttggaaaggaaaacactgaacgggatcaccttgtgaaaggtgcctcttatgcaggcagaaaaattatgtttgcattgaaaacagatcacctttaaaacatatttacatttcatttgacttcgcgtggtcccagtcaatgaataaagaacaaaacacacgtggatgtgtatatagaagagctcgaagttgaagcccccagtaaatttaatttacttaacattttagtgtaactatatatatatatatgtatatttttaatttagggaaaattatttatatgtactggtagaaagggaaggcaaatattcaactaagggtcattctacatgattcatattatcttaattggagaaaaattattttcctttgaaaatactattttttttctcttcaaacttcaatattctgtaatttccaatgtggatttaagtctcatctaatcctttgtggaaagttttctttttttgttaaactatcaataacatatacagctaactgactgtaaatagtaaagaagaaagtaatttcagcattattatttaatgattattttatgagtaaaactattccctttaataaagcattaggaatatttttaattattaaaacattatttaaaataatttctatcatgtttagaggagtaaaacataactatatactgatgaaaagaaaaaatcttatactcattttattttattttattttattttattttatttatttgagacagagtctcacacggtcacctgggctggagtgcagtggcacgatcttggcttactgcaacctcccaggttcaagtgattctccttgcctcagcctcccaagtagctgggattacaggtgcccacgaccatgcctcgctaattttttcgtattttagtagagacggggtttcactatgttggccaggctggtctcaaattcctgacctcatggtctgcccacctcagcctcccaaagtgctaggataataatcttacactctttaaagcaaaaatgttttgttgattcaataatgaaaagcattcttcatttcatggaaagaaagctggaaagttaaatggtagaaaaaaattactttattcatggaaacatttcaactttgctatttggtgagccacaaaggaaatttgttatactgttatcatgtttgttatgagtgctttcatctgcttgcttatttttggttgagattaggagagttatctaaaaagcattaaggcaggtataaatgcatttttgtttatgactgtcatctttaggaagacataagatttactcttcaatgtagtgattttcatatttgtattaaataatatgatttaatcattcattcattacaaaataaaatgttatcagccagaatgctgaaatacctgataatgcagctcattattattcagattaaatatattgtacttctccaggaaatatggcatcatgttctccaaaatgcacatgcagaaaatcattataatatattttgcctagatgttgggtataaattcggttcctcagtactgaattatgatttatgtggattcatcttgttaaccatttagagaaccaattttcattcaacagtatttatgaagccagactctttgttaggggataggggtgataggtggggtagagagaattcaaacacctgagctataatagtaaaaatagttacaaaaggccattgtattaaaatttcaatcctaaaaacaagatcatataaacatattaaatgctagcatcatttattttgcattaaaattagcagagaggaataattgtttttaagcatttttacatcatagttttgtctatttttttacatatacatgacatagacactaaaatcaatcaaaaaacataccgttctccttgttttccaccacttttggggttcacaaaaactaaaagtgggtgagtaccaggcacaggagtgacctataagaaaagttatatacatggaaaaattattaggcccattatatatgaagaagactccttgttatttctaaattataaaataccaatacgcaatttcaataatattactttccacaatgtgtgtgtgtgcatgtgtgtgtgagtgtgtgcgtgtgtgtgcgtgtgtatgtgtgtgtggtgtgttcaacaggaaaacctcctccacaaagaaaggcatgcctatctagatagagggccgaggggaaggcagtcaggaagagggaataacatttgtaattcctgtaagataaaaaaaaaaattacgattttcagacagtaagtgaacaagccagaatacagcagaatttgaggaaaaagggatgagaagcaaagaaagagatcaacttatagagaggcctccttttacgcaggagtcctaattgagagtttcgaggcatgtgtggaatccatcttcccaaccacctgtgaactggaaagaaactcaataagatcctttgaggtcccttttggcctaagagtccttatctacacaatttgttcagtgctttcttttcctccttgctgaataggttgctagttaatcaagtatatttgctaagtagagtccattaactattgatctctctttcaggtaacacgaattgactcgactatacgtcatgtgctactgctttcatcacaactcagctctcagttgaacaagaaagacaaagtttctgtcctaatggagcttatattatagtggagaaatatacaataaacaaatacatatttagcaatgaaacatgccacgatgggaaataaagcaggtaaggtgatagcacgtatttttgtgggtagagttgttttacgtagtgtgggaaaggacaagtgttgtctcttacctgattccaatgttaaataacagactttttaaaataaaagtattcctattcaatgtaaccctatgtaactcccatctaaatacagtttgatgaaaaaaatttaataacaaaagtattcagctaattgtgtcctctaaatactaagttgaacagttttggatcaatctgcttttttgaaagtacattcaaattatctttactgcagtgttatttctcccctagaaagtagtcttaaatgtttaatgagacaattaaaaacactcattttaccatatcatgcccttccttcctgtttaacaatataagttaaaatattctactaacatattttcctccacttctttagtaaaatggcatttttctaatgagaataggcaatggggaaatgttaaaatctccacattaccgaagtgggaagattgactgagatactcgtaatttttctattcatatccaactagctctcattataatttactgtgtctgtttctattttactttccattgcaaagaggacaaagtttctttcttcctaatttgtctccaattcagctgggagaaggatgagcaggaaaaacttatgcactaacttcccaggtctcccctgaaccaaatgtgtgcaatcaattaatgtacataaagtgtctattatctttaagccatggtggctgcggattgcaatgggtaccccttcctcccattaaaaactaaaatcaaacaaacaactatatctaaaaacctgtgttcgattttctttatttctcatcctattacaaattgaaactcctaacgttttcataagcaaatagcaataataaatagatgtagattttagttgactttttagtcaatttgaactgtttctactggtttttaagtagaaatgggaatctcaaagtaaacagatttttaagcatgagcaaagtattaactctgaacccaaatactcattaggatgagttttccttttctccctaaagtcaacattcattttataactatatgagattatacaaaaattcatgctgagtccaatatatggaattattttcaaactatgttttgaaatgtctctcagagatatttaattgtgagaatatttatagacatcactataaattgtcaagtaaaggggaattaaaattgtattttaagttatatactgttatgaacaaataaatatcccactggaatagattatagtctgtaaggaatttcaaaataaaatacaaaatcttgatgtaatttttaggggtagttaaatggagaaacagattaaatgtattagaaaaatcagagaatttaaagaatttagagcaatgatgatattccacaagtggcaaaagttgaatatccaatatggatatacaggaataatatcaatcaattagcaaccattattttacataatacttctctcattattgagtatgagttcattttcagacagtcctaacatataaagtatgagataagtaaaattgtggatattatcacatgtagtctttcaattagttaatttgatctgtttgattccagattctggttttcagagaggtccatcaaataagaactatctttgcattgtattgcaatgcaaaacatgtctactgacaaaatgaatataaatagttttcttagtttctgaaactcagtatatctgattttggtgaataaagttttatggaaatatcttacattaatattttttaaattttacagtaatatttttatttttttgaaaaactctcaaatttacagaaaagttgcaatgactctcaattaactttttccctcaaccacttgagagtaagttgccaaaattctactccatcactaccactcccatttacattagtatttcctacatataaaaacattctctcgtatatacatatatatacatatatataatatacatatatacatatatatatatacacacaatacaaccatcaataacagaaaactaatatgattttggactagttttgtggaaaaaaactattattgggacaactgatgaaacctaaatgggatatgaggtaccaatgtagttaggtaccaacgttatattcaagcttactaattctcttttggattgtatccaatctgtctatgaatttagaatttttactttcacaaaacaattgtgaaataatatgtaaaattcaattattctgaaaatacatttgctgcaatcctaaaatattgtgtcctttttgttatagattttggtggagtaggaggtgaaagataaaaacacaactatgtcaaaaattctgtcagctgaaaactattcattctttgaagtacatatatttatacagcatttgagatcatctgaagtagaacagcatatagaacagatgacttcctagttgatttgtttaaaggatgaaagaaccctcaacctgctctcaatctcccatgactcttccattgtgcttgaggctctctctacagagccctgtgtcttttcaaaacagttaaacaatacttgagatacagtaatacggtttcacacacacaaaaatactgatgaagagagaaagtgtctaggaaagattttatagcatctgtggtagttgaaatcttgaagaatggttataaatttgatgtgcagggtattccaggagactgttcacactggattctccaccatactgaatagaattcatcatgtaaaatcttacttaatcacataaaggggcagttaaaaacagtacatttaaagagcatgattttagagttagactggttttggatcccagttcaatcacttctctctatatacacactctgtcctttaatgatctcatcttatctgatggctgccatcaatgcctttcactcccaaattcatgtctgccttttcttctaatttctaggttcacatattggtctacctacttgatatttttatttggatatctaacagcagcagaaatttccctctaaacattcatacagatgctcccctatctcagtcaatggcaatttcatcatttcagttgcatggtccaaactattaatatcttggagaagttcctgattcctcacttttctcataaaccctgtagtcaattcatcagcatatcttttgctcattcctcaaaatatatgtagaatcccatcacatctctctacttccactgctccatcctaacaagcctacgtcttataacccctgaataacttcaacagtaatctactggactcttggctccccaacaatctaatctttataagagtaagccttttaaaataccattcaatcatgtcactcctctgcttatctttcccaccaatatcttctcatcacactcagatcaaaagtcagtctttattgaagccttcaagcctttaaaaattctagcccctgttacttctctgaattacttgctaccactttccatcttgcccaccctactccaactacagttcttactgaccctaggcatatacttaccttagggttgtccattccccatatatccaaatgaccaactgcttcatctcttttaagtctttacccaaatatcactttattaatggggcctaaactagccattgttcttaaaattatagacaattctgactcttagccctgatctttcttatcttactcagctctatttttacatcatttattatctaccattttatgtatatggagatactcagtttaaaggttgctataatgctcaaaactatagagtaacaattctgggtttacattgagagttagaatgtcaatgaagtgctaagtatgaaacagtcaacagggttaagaattctaaaatgagcaaaggacatacacacacacacacacacacgtacacacacatacatcaaagaaagtgaattgattatatagagataattaatttaatatacatatatactatacacttacatttagtgcatgggtgcatggtttacagtcttggtgattacaagaataagatattacaaataaggaagataaaataaagaggcagttttgtgaggaaagacactggttcagttttagatatttaatcataaaggtccccctttctttctcgtgctaaaagtgttacaaactagattcgttacttcttaaatgacccttttatttggaaatgtttctcaaagaatatttaggaacaaggtaacttcaacataaacacagtttaaaacaattgttctgtttttctccttatttcttcacatgtgggagagccatctgtaattttatatctcttgcatggtaagaagtcgcagtttcaattacatttgatcatatgtattaagtgtaaacctatggtgtgagcgatgacaaagacagagtgcctaaccacctctatttgaagtcccctaggacttgggttaattaatgagactcatcctaaggttatacatgatctattacttcctctaattagaaataataatcctgatcattatgctggttagctggaaagaaataagatgaatgtgcttaactatgattaatagtcttctttaagcagtgtagatctcttctgtcactgaagttatatgcaaactgggctgcaactcaatgctttttaatgatacatactttttaaagctcatggaaaaaattaactttatggtagatctttttacctttcttgataataaacaaacattttggtattttaaaattgataaatacaacacaaaattactattttttcattttgcatataatagctatccagaactttattcttttattttttttctccaaaactatgtggctatatatgtgtattctattttggtcctttctgctgaggtacaacaggcttttgcacatgattatataccaactttttttaattcaaaaaattattactacacatatggtatttttttaactggtgtttttttagggctgatttctatacttgtcccactcacaattttagctgacacttttatatgtcaaagaaagttataaaaagttattatctggttagagagatgaaacacttccacaaagaatgttaatcatctaagatttttaatgtgactaatttagctgtaataaggtcgaatatttcagattattttaaaatagaaaataaaatcaaacatattactatgtaggtttaaaacctttaaaacactgcatgtactatttaattttggttttgatgtccgggcaaattgaggtatgattatgaaaatcttggaaaactgagattagaggagttaaaattctgttgcatacataaattgtatctcaaagcctgcagcaatataaaagcacacagaagaacaagatgttcagaagtttagcagttacatacatgttaaaaaattttaagcaaagagacagggtgtcttgggagtgaaacacataaactctagtcagatggtcttcattcaaaccttggttttaccactgactgtgcccttggggaagttatctcacttctgaacatcaacatgattttgaaaatgatgataataatggtattgatctcatatgtttattgagagaattaaacaagctaatatgtataaaataccatcataatgcttaagctatcctatttaacaaatgatatatgcttcccatctgtgatgagaagtatgtgcctagtcatgtgaaatacaattagatttcagaattaggcttccctttcattaatttcattccaggaacccagagtagctgaagatttaaacttatcaatattaggcatccacgtattgaattaaaatgttgatttttttcaataaaaattttataggataatttaattaatttttttgctaataaaattgtggatagattttatatttgacagctcctatgaaatttctaaacatatggatatgagttccaaaatgtacatcttgatttacttttttaaaattaaattttctgttctctaatatataataattttattattcagaattccctccttttatatttgagtttaataatttatgaaaaattttctattcacaatggatttttagataaaaaacaaacagtaacttagttatcaatatttaataaattattattaaattttaatgacattcaagatgataaagaagcaagcatttaggcatcttctctgtgccctgaactgtgctctcatattgaaaaaatacaaaagacataatctatagtatcagaaataaaataagaaataaaaaaagatgatagaaaatcaaatataatgaatgcaagtgtgtgacatactgtttgtatgttaaattgttggtaaatattcccagagaatgtgaaacttgaagtataggcagttggaacacaaaaacataagtagaaaaacatacttaaatccacaatttcataaattaagccaacgttattgaccatttttctgttgaagtaagaaacacaggtaaaaaatagaggtaagtaaatgttatacattcaccccatacaatgtcttaaaatgctattcttgatgccacaggcggtaaagataacttacacgtttttatataatagtattaaaaaatgactacctgtgtttatttaacctagatatatatttgaggtttaaattttgacttaaaattttgacttaaaaatttgaaagctagaaatatattacaatacattctttattattaaaaatatttatttagaaaaaaatgcattcagagttcattttcttctttcctaaagtcttttttgctatcagagtgactcttcatatcatacccatactaaatataaatatatagagagatataaagtatacctgtaaataaataacacatatgtatttaataagtgtgtatatttagcaataattttcaaatctttcaaaagatctcttgccaatttgagtttaaatggagataaaatcataaatgattaatttaaccagaatgttactctgtcaatcaaccgtaagactgacatcttgataaattaataaagatctttctgaaagagtctactaagctaatatgcagattaaacaaatgtgttgatagctgaacatatgcccctttagagcctagaagtatcaaatatgaaacctactaaaattttgatttaaaaaatcatacctgcaggccttgtccatctacagtaacagagttggctctttgcattttattcttgtcaatcactttgtttggctgctgggaaccactcttttcctttttcactgttgattgtctttcctgtaaaaaagaaaattttgataaaaataaaaattaggaaaataacataataaaatgttaagttgtttttactaatagaagagtttcatggttacaaacacaggctcaactttctaatttgaagttcctagtgaataatatgaaagctgttgttttcaactggctcaatatatatgatagcttcatgatcgaaccaccatttaaagaaataatgagaaagaataccaaattgtattatccctatgtgcccaattatgactctttatcaaaagttactaacgattactgaagttgattattttcatatgtaatgatacagataaagggtacaggattataatttaaagaatgtggtattgagtactaagaaaagcttataaatacatgcaatattgaaaattatttttaattgcatgatggacttttaagctactatttatatcaaaaatagcatatatcttaaaactgacattccatcccagctaattactttgttcctcatagtaaaaaaatttcttttaggagttgcctgctccctgtttctatttcctctcttttcactctctcttaacacaacccaatcaacttgtatcaccattactccaccaaactatcttttactaaaatcaccaatgaccgtctcagtttcacatctaatgatcagtcttcatcttctcaaatctttcagcagcatctgacagaattgatctcttcttactctttgaaaacttgcctcacgtggcttccaggacacttctttctctgagctctcttcttccttcacaacttcgccctcatagtctcttttgcccattgcttctccagctttgccacctgtaagactcagcctcttccttggacctctcatcatctctatctaccctcactccctaggtaacttcattcattcccacaactttcaatttcatttttatgaagatttctaaatgtataattcttgttctgatttctacctgagccttaatttccacatgcagatgctgtttctgtatgtccacatgaaggcctaaagcacaacattgtaaaatgtccaagattagttttaaaatttcctgcctactctgtccctagaaaataaatctcaaactggatgacaactcaccacctgcctcattacatggcttaaacatccattatctttttgtgcttggattattgtaactatcacctaatgaatcattctacttccatttttgtctccctacactcagttctctacacaaaagccaaactcatcccttttttttaccctactccagctgcactggcttcctcattgttccttgatcataacaatcatgctttaaattcagagctcttgcaatcattctgcagtctgctggaaaacttgccactgcacatttgtgggccttggtcctgacttcaggatgtggtcaaatgtcagagaagtttctctagtcccttgagcctccttttaaaacatcaattattacaacctaaagtattatttatctgatttgtttaattgtctgcattctttcatcttaatcaaagttccataagcaaaagaactttctttgtgtcactggtctatatcagatcctaaatcagtgactaacaaaagtcaggataaatcaagaaataaatgaaaacttttttgaaaagttttctaagttcttgaagcaactgttgagaaggattcttagggattttaggcttgatgtgaaaaattgtcctaattgattggcaatgcatgccatgggtgcttaagtgctttagtgccacacatttcctatcacttactcagctatatatatttcctagttcctatatttgcttgttagagtaccatttcaatttctataatttagaaagatcggattttatttgtgcaaatgtatggggtaactgagaaatgttttacatgtaaagggtatttagagtgatcattgcccaagtacaatacatttattaagtataatcacccttctctgctatcaagcattgaatttattcctagaaagacatttttaaatagctttgaaagtaaagctgtttttaaatatattagggctagatggatcagaaatcgtctctgactaaaataatgctaatcaatatagtccatttaccttgcaattccatggtgcaaaaacactgaatatattttgtgtgtggctgaaaatggatgccataataggattcctgaaattcaagtcgtttggaaagtgatgtgctttcatataagcataatttctggcaaaaatattgatttttaaaagaaagttccttctttttaagtttgcaaattataattttattcatagatagttaaatggcataatgtatataggagtgaattattagatgaggtctcgaatcagaatgcctgagttgaatctcatctctactacctaagtattatgtaacctagagggtttatgctttggcaaaatggagatagtgatacctatttctcagagttgtgtaaggtttaatataaaatgtatagtctgtaatattgtcactacattaaagtatgtattcaatataacagttactatgaatgatgtaaaatagttgtggttgcctttttgggtactcatcaacattgtttttatatttccaaatgtgtgtgtgtatgaaaaaacattcagtggttacgtcaggaacatatttaaaatttaaaagttcaacgcttatatttgaaaatgcatagcttgtgttagctgttcaaaaacttaatgctgttggtgagtgtggaaataatttactccagcattcttgcatgcatatatataaaacatggcatcaatattttgtaaaaatctgcaatgtgaaagatataccttaatacagttattcttcctaattatccaacaattgttgtttggcattcaatttataaaatgcttacacttgaagaattaaataaaattcaatttgattagttacaatggaactgggaatttgcaccagattatatatttatgttttaatggaaatttaagacatgcaagtatatgtttttaaagagctatgaaaccatctattaatatgactttacttttggccacacgtatagctagggaagttcttgtgttctaagaacctccaaatggcagagatagcagttgattaaatggcatcatgtccctccaagtagtcacccccctaagtaagttgggcaggagactaaacaattgctttagtgtaaacaatcagaaataatacaaacaggctgcatgtggtggctcacacctgtaatcccagcattttgggaggctgaagcaggcagatcgctggagcccaggagttcaagaccagcttgggcaacatggtgagcccctgtcgctactaaaaacgcaaaaatatagtcgggcatggtggtggacacctgtggtcccagttactctggaagctgaagtgggaggatcactggagtctggggatggaggttgcagtgagccaagattgtaccactgaactccatcctgagagacagagtgagactctgtctcaataaataaataaatatataaataaaaacaaattttaaaaccctaagttgagttttcaacttatgagatttcatttatgaaatccagaattatgagaaagaggtatataacaagttaatttttaaatcctcagtgtatccatctgtctgtgtattttattatagtatctaatactaaaatggtaagcattcatttaaacacaaacacacagacacacgcatcaagaaaaccaagtgatttctttggggaaaaatgcaaatgtgtggaatttgtgcaattaatccagtctaaaatcttaaaaacaggagagcctcatcactatttaatttttcttctatttccattgagaaaattgtctctcctttttatatgagggacaggaagggggaggcaactgtatcctcaaaaaatttcctgtccaccaggtttcactagcttttttgggaaggtaaattgaccctgactggcagacctctattatgatatttatgagagttaattaccaatgttgaagttattgaaagtttcagaaagagctcaccaatcttaggttgcacaatcattcaggataaaattgctctctgataataggggacaaagtttgccatttaaccttcagtttctttctttaagttttggggctctaaaccacaaaataaattacattgttgtaattaaggcaaatttccttctgccagataaatcatcctagatatacaaagagttggaaaattgttgctttaatcaatagaaattattcaaacactgaaaagagctactctaactaaaaaaaagtcatgaaagaaaatagaacatataactacaaaatataaaatacagttattgatatttgagcattttcaaatatcaaccatttgtgtttgctatgtagacattttaaatatagaattcagtgttttgtgatccgtagactccacaagtagcacaacagatcttaactggggaatatattgtattagaattccaaaagaataatcatcatcataaacagagaagaaaagccaaaaagaccattcacagaaaatagaaaggtgaaatgaataaaataaaaagacctcactttaaatatgtgctctaaaaaaaaaatctttgtctacatcatgctgattctcagaggtagagtatttgtacactggtgaaaactgctttcacaaaagggttgtttaccacaatacttaagcctgctgttatcgatcgctggcaaactgcaagcagcaagtgatgattacctcaagaacagggttttcttctttttgtccaatctcagcatgagaaactggcagcagcaaagcacctccactggtacaaagctacaaaggcgagtgctttcctgccaacagcatccatcacttgtatcgtagaacttactttccctgctactactgcacaacttgcctgaatggagatttagtcctttctgccactggagctaggccacatgaattttccagaaaccctagagtttttaacccaaggtatcatatagattcacagcagttaagatctctctgatgcagaaatgttaccacattcagcagggcttacgaaggttcggtctgagacaccaacttactaacaaactgcaaagctgcacctttaatcaatatggactgaacgtgggatttgaacattttaatggttgaaggaaacaaattcatttcaaaaatgatgaaggctctaaatctattagtaatctttggaaattgcagcaaaactatttgctgactagaaaaaacagttttgattgtttttaattataaagttttaaagataaatataataaacgatataaggtctaaagatttttatttcttttaaacttagttaagtaagtacttttaaaaaaggcaaaaacaactttttgtaaaggcaaaagtatgagtttagaagccaaattgcagctttgtcttttatttctgtgtaagcttgggcaagttatttaccattgctatgttaccacttattttaactataaattggaaagcttatgttagaaaaaagtaagaaaatttagacaaaagtactgacataaaacaggcactcagtaaatggcaatgattttaaagtatagataaaaaattttatttattttattattaagttaatcacaggtatactgcttggtcatagcagtaaaaggtaagtgttgtaagaagtatgatttatttaacatcctgtactttatttgcccactaagtcaccatagctgagaataattgctgtggtgatttgggtggtgtctttttgggagacgggggacaacaaaacagacaaaatgacaactggtcttaaagtacctgggggtgttagtcacttcctacacttgaaggtacacttggtgacttgatccataagtcccggttttcacacattacacatgaagttcatattttctcctaggatgattttatcctgggtataaaccacttacaagatttctgttaaggaaattcttattggagggaatgaaatttaggaataagagggtctatgccaaaataattcaattttggctatgtgctagtacatggcagcaccattataaaataatgtgtgtatgtctgtgtctgtgtgtgtgtgtgtgtgtgtagtatacatacacatatatgtatgtgtatactttatatacaaaagaagactttgggctaggcgcggtggctcacacctgtaatctcagcactttgggaggctgaggagggcagatcacgaggtcaggagttcgagaccagcctggccaacatggtgaaacctcatctctactaaaaatacaaaaaattagccgggcgtggtcacgtgcgcctatgatcccagctactttggcggctgaagcaggagaatcgcttgaacccgtgaggcagaggctgcagtgagccgagatcatgccactgtactccagcctgggagacagagtgagaccttgtctcaaaaaaacaaaaaaaaaaaacaacaaaaaaaaccagactttgtaaccaacctcaacattcctctttctccaatccctttgtaaaccatactgactgtcatccacagtaaactgaaagtaagtaccaggaggcagctctcttatgctcacactcattgtctctttctaccacctaagctaaatgctcaacacagtgacttattagccctcaatctgtttatgccagttctaagtaaaacttaccttgtaattgtaactgtgtaatttaattattactcaaatcattgaattttgaatacaaaatgaaagagtcatctttataaaaaataacctgcaagctttagaaagacaaaataacacaagttatgtgtgtgtgtgtgtgtggtgtgtatgaggagtggtcaagttaagtttagagagaacaactgtgcaagctttgggtattaataataaaaatagtatttttacactcagatttcttcacagatgttcttgagtttttgctatactttaaaagaattgaaactattataagtgataagattgtgatatatacaagaaaggcaagataccatttccaattagaagatctgtcctcatagaaaagcccttaatcttcaaaaatatagccaatgaatataaatgtacatattttaagttaaacatttaatgtatgtatatatctttctatatgttctcccacatatactttaaccacattttccgttaaccaaggagcaactgttcctgatggcagaacataaggtttcttgtctttctgtgtgtatatatgtgtattcacacactcagccatgcatatatccatgcatgggcttaaggaaatttttggaacaacaaagttgaaaaatcttatataatgactttgagggatactggaaagtttaagttaatgtaaaccaatatatagtgccagaaaaaaataactataggaagacttttaaaaacttcatatcaaaataaagacttttttcctgaaaattaaaaaaatatataaaaacaaaaatttggatctatttactcaatctatatgacacaaattatataactgaatgcatggggatgctttggagattaacagatctaaagagaaaagtttagatctcaaatgcaatgcctatatttgcttgattgggctggtaatcggggcagaaacaaactcaagaacctgaggatgcaaaattaattctctcacacttaaataacccaatgaaataataaactgtcctaatacttttgtcacttgagtgtgtaatttagcatctctattttataataataattgtgataataatgtcaccaactcacttaaagaatataaaatcagtttaacattttcttagattagaaacattatatttaagtgtatgtccaagtatttttgagtatgtctctggttaaaaatgagaactttttttttaatttaacgaagaggtctacactgattaaaaagccatttttggtggggagaaaagagcagttatgacacttttttacaaacatgttatcctctaaataaattcataatcttatgtagcattcatataagcaatactttctaaaataagcagattttaattacaattttagggaaacaataccatttgggcatttcctatagagataataacaattgaattggatactgtcacagaacaatgtggaggctttgcatcatcaatgcaaaggtaaagcaaaaatgttactgaaaataatgttgtggcaatgcttacatttgttttcaaaacaaaagccatttattctgactatattttattctgatgtttctctatacaatggcatgggctaggtgattaatgctgcattcatttgaaagtgatgggcacttcaaagtaagcaagagtctctcaacatactgccattgaaacttatattttgatggctcaaagaataaattcttttggatttccagcaatgtatctacattttaacgtgaaaaaatgggagtggcactatttttctatgtagtaaaaactctttgtaaagtaacctttatttttctctgtgaagtctaggtcacataacttcttgttttcttaatgcttatcacaaatatagatggaaaattcttcaagtctatcccatcactgaaaatatgaaaaccaccacttccaattagcagaatatgaaaaaaataaaatataacatgctggtattcgaatgtcactgagccagcacaaaatgttctttacagcaatacaagatgtataatgacctataattttaagtgtgaaaacctgtttttgcttacgcacctcaggaactgaaactcctgaagtgggcagagtctgctgaaaaagagaagttcatatgaaagctgaaaaagagtcaaactcaaaacaaatcagtgaagtttctcatatcattacatgcctgtgaaataaatgagtaaattaaaaatacatttccttggtataattttactgcttccttgaattaaataattaaatatcttttcattgaataagaaattatctaacacagagtgggttaggttgtgaaattatttatccaaaacacaacttcatctacccaaagcatgctgatcaacatctttggtcagctttagctccaagttccattctctttaataaataatttccactaagtttttttaatttgcccctttacccatcccaattttcattttgaagtccaactctcattctttcctaaaaatactgtgtcttttgaacacagacatagcttatgatgttcattttgttttgtgatactctggaaataagaaaacatattccattaataccagtaaaagaataaaaactataattaaataagtagcaagaattttacttgagagtaatttttttaagatggggttaaatacattgacattagtcttcacaactgtgttttccattatctaccactactacccactttgtagttcatattggaaagcctttttttttttgacaagaaatgataaaaggtcactgaattccaaaagcctgcattctatggaaatgagaacataaaatacaaatttggataattagttgacaaatcacacacacaatactagataaagtttccccatgctggaacgggagaagaaaagttggatgggatgccagttcttagatatttgtgtccctgaaaagaaggaggtagtcagaattcccttttcctccctagatacgagctatctgagggagggtctgggcagtgctagatcaccaagatgggtatgaaaaatctgatagtccagatattattatagtcccttacccaggagaactttagaaaggcagcaagaaccaaaaaaaaaaaaaaaaaaagaaaaaaatagctgaatctgagataggtaaaacctgacaccctcacagctgtgcagaatagagatggactaaaagcattcagtgcactcaaaagtgacacagaaggagaagaagaggtctagcacagccccacagaaaattaaggtgttcaggaatacagctctatttggaagatatttccataatataagtagaaagtactgtagctgcagatttctagtcaaaagaagccacgaagtggaagagtatgagctctggccaactatccattccacaggagaatctaatggaagtaattattgttgttttgaagatgaattgacagtaggtttggtagagcctttactgaaaacttcctgatttcagtaacattcttgacttctgagtccaaatcagtctacataacaccagggacaacgaatatttgtgctagtttctctctgggtcagttcaaagatatttgccaaccttattatcattctttcttagcttcgggttgaagcttaaggtctgaataaaattgcaagacatggatatagtccttccatctttatcataatatatacaagtttgttcttcaaattcaggtcaggaatgtaatcctatggatccttatcccattctgtgccatggacccaggaaactctcagagactctcaagcaaccaaaataagagacttcaatcagcctccagagcctgagtcagagatgccttttaccttagaagagtgtatgcttaccatgcatacatttgcagagagcaggcactggaaagccaagtgaaaagattatggctgtctaaatggttcagaataacaaccaaatgcaattcaagagcttcagatagatcctggtccactttcacttttaccatgcccaaaaagtaaataaataaaagcaacagaaggcattttggggataactgtagacatttgaatatggacaagataatgactgatattatggaatcattgttaattttcttaggtgagagtataataatgtcattaggtagaaaattgtccttagtcttagaaggtgcttgctgaaatatttagtgatgtggtgttaggctatgtgcagcttactttcaaaagcttcagctttatatatatatatacacatacatatatatttatatgtaaagaagtatatataaagaaattatggcaacacaatagcaattattgaatatatgtggaaaatatattggatttttttattgttagtgaatattttctaataaaatttgagagaagaaagttctttctacctcttcattatatcctttaacgcctaaaagtgtgtaaaaatgtttctacaatgaaataaaaatatgtacattatctcagtgaaaactatgaagttgctagaaggttgggagagaagtcataggagtgggtgggagagaaataaggagcactattttcatggaaacagagttctcatttaagatgagtaaatagaggtaagtttctaggctgctgggaaagaggaacagagaaagagggggaactgttaaagataaatgaaaaacaaggctttttagaaaaaagcaatatttcaattagagcagaagcccttattgacaggcatcgcacttttccaaatgtgttccttttgggtctcaaatgcagaaacccacagcggccaaaagataatacaaataggtaaaacaggtccgatgttgcaaaggtaaagactgtgccatgctggataataatcctcccatttgaagttatccaaaaaagaaaaagaaaagacactgtggtatgaaattgaaacctagctaccactttgcaattaattggcaattcatggataacatacttgaagtcttcctctttctcagagcagcaggggtatgagatatctactgatagagagcaagtgaggttggcagagaggtggtacaatgaaaaaggtaatgaaacagaggtttgtcacttcttttctgaaaataaaaaagcagtttgctaaggatgagtagcaggatcaaccaaaactgatgacccagctggagctagaagttttaaatatgtaagagagaaagccaccagccctaagaattttcttatgcaacactcagccttctgagagcaacactagaaatttactccaagaataagagtgacaaaaccaacatatatctaacctcatttacaatcaaaatgtgtaaagagttatatattaaatgtacatgcccatcagtagtttattcctgttacaatgagcaaaccatggtacttagatctaaaagaaaagtagaaacttattagaaaataaatttagctatcgtatcacttctttttttactctcctgtacttaatttttaaatatcaaagatgagcagagtaaatgttttggtttttttgaaaatcatcatgagtgcatgattctaaatgtaatatatttttaatcagaattaatacagaaactgtatatttttatttaatccaatgtgaggtgtgactacagaggaatgtgattgattttatttgatcagtatctttttaatattaaatagaatacacagtacagataattagtttaaaagatgcatttgccttcagggcactcattaagttcaatttaatatcaaagaattttttaaaattctattattcttaagtattaggatatctcttgtcttcatattttctaatgtgtaatcattttaaattgacaatttaatccaaattgtcataggacaaagaaaaatctttggtggagattattggaggtttgacttagttaagatataatgagagcacagtactcacattaaaagggtcattagttatttcaggctaaaggaaaactttaaaaatgataccttatacctacataagaacatttatatttttatatatatattttacatttatatatttttcatgtttgctatcttgcctcatttaatactcccactgaaacaagatactttatctttcaggttaggaagctgaaaatcagagagcttagatgcctaacccaggaaaacaaagttagtgacagaatattgcttccctaacccaggctctatttattcaaataacagtagttgcaagaggagactttttaaaattactatttttagccttgccttcattttttaagtggtttggaaataaaattattttaaaatattgatgaagaatgaaaaatatttagaaatcactatatctacaaagtgatacacacacacacacacacacacacacacacacacacttgttttgcctgaaaaactggcttgaataatgtgaattaatttaacacaataacttccagtgtagtagttaaagtgttccaaatatacaattggatatctctggcatcaaaaaagtagtaagagacagagaaaaaaaactagggtaagataaagaaaaattgtcttcataaaatgacactttgtcttagctggacaggtaaagttgttctctcaaacaagataataaagtgtattatctctaggatataaaaattacatatatttttggcttccatgttttttttatatttcagtttcatataatttgtttaaactttataattcttgaggtccttaattgtgtacactcacacatatgaatacaatgcaagttttaaaaaggacgtgagataaaaatgattttaatactattgttgtctttattaaaacctttagtaagagattatttcagtcataatacaagcaagacactgaaaagaaacataaattatttttcttttccacaaaaattctgatatgtctaattaagatgtaactataaaaataaaacattttaaaagctacacatattgtaatcttatccagggtcccttgactacttctcacctgactcaaattttaaagtttgcattaacagaaatttaatggtaaaatatatttttaactgtggttacttcactacccttcaactgtaattgctcacaaaatattccattcttacttagtaaatatgattgtttatgtctatttgtagagttttgtctggaggctattgacaagaagggaaccaacagaattttaaaaaataaaaacatgtatttgggggctattagagacacagaagaaattatggaggagggtagaaaacatatcaaagatagaaagcaatggagaaaaatggagacagaggaagctcttagaagaaagaaagaacaaaattctctctctgttgttttcctcaattatagaaactgttctttccaaagactgagcaaagaaaactatgaaatcgaggaggagaaagaggggagctgatatttagagcacccatcttcaaaacacatttcaaaatgaaacatgcacatcctattgactattttttcagattattcttcagaactcttaatttacatataattcattaatagatacctatttatgaatgtgtatatgtatatgtgattatgtttgtgtatgtttgggacagggatctgagggaagttggtaacttgaaaaaatcacccccttcaaagaactcagtataatagactgatacatacaaattttatgttcataaaattaatctataatatttcctgttatgcctattttatctccctataaaaacgagagccagttctagaaatatatcattgtatagttagcgtattgctgctttccagaatacaaatatagcactataggtaatgaaagtatattgataataatatttagaattaaagcctaggtctccttttcaccatccttgaaaaagatcttgaattaaaaaacaaagaggttataatggaatttgttcttgtcttttgctcctttaaatatccattgatctcatgccaaagtattttctaaccaggttaaagtccaattctgtactcacgttaggctaagattcaattgagttaaaattttacactgactgccagtcaaccttatcatgaactttcattatgtgcatgtaattaattgggtccaacgaacaatatcagttctgagttatagactcttttcccccgaccatataattagaatataattacccacaggatatcagaatgatgcagaacctttcctctaaatgcgccctcattaggaaacaagtctcaatgtacacttattcaatcagtgtgaattaattaaaatgttactgaaataaaagagggtagcgataaagagtatctgacatctattaagagtctatcactagagatctgcatgcacagtttatatttaaatccttttagccgaaatagaaactttgctatgtaatgttatatacatccagtgtactaggaaatctgagtacatacatcggtgtgtgtcatcatttttgaaaagagtacaagatacgataactatagaatctttaagaattgggtaggaatctaagagccccattattccataaatatgtcatcatcagatagaatctacctggcgggcaaaaatcattttaactcaaactacctaagcaattattggtttaacccacaaccttatattacaaatctgaaaatatttgtcccaaaattgcttaggagacaacaattcgaaaagcccagatttgtgaaaacactaattatttttgtctttataaaataacctgaattccttaagctagctcaagttattacagtagcatattttctttaagcagcacattcaaatacagctaagaatagcttctttttaagagaataaataatacatcataccacacattctgattatataaaacacatttaaaaatagtaaatgcacaaagaagctgagggacacatgatacatagcgcacaagaagctgcggattcaaacagtaacattctacctaagagctattcatctttatttctccaggtgtatagttatattcaataaaactttgctaaataaataacccgtgtacaaaggaatactcagcattagtcagaaacaatgccatgaactgttaacataaaaatttcagagctgcatgtaataaactaagatatatacatattttcaagctttcagtgttattatatattcctcagaaaattttagatacagaaaaaggttttataaaacatagttctggtaataaaaatttggcattcacttttataagtagacatgcaccactttgtaatggaaattctgcatgagtattaagataaactaggctatctacaaatgtatactttttatatgctctttaggagcaaacttcaagcagttttaaattattagtcttttttacaagaatgtttaactctataagattatatatatatgtgtgtatatatatatacatgtgtgtatacatgtatatacttgtgattacaacattcaaaaatatgttttatatacctatatatgtgtatatacacatatatacatatatatatatgcatgttgtaatcacattctggtataatattctattcagacactaaactcatcttggtggagaccaaaagtgagagaaataatggttccactctgctaagcaaatgaagattgtctcacaaaggtttgctttattcttaacctaaaatttttttagaatttcagtaataaatacatgtagctacagttgcctgctgaaaatattctattggagtaacattcactaaaatgccacattaactaagagtaattactaccaaaaagccacaatttctaaacaagagaatgtgaatatttttgaagttccattctataataaacatcaattttcattttctgaacacaaagaagaatgattatttattatattttacatggaaaactatattgcttaaattatatttaaaaatcagatttttaaatacaatttaatatccagagaaaaacatctcaattctcctcagaattctgaaaatgttccctttatattctctacctgctgtaactcctcattttacatgtgaggcattttacagtaccatctattggatattttatataactacaacacataaaactcaccagcttttcgaaatttagtagtaactataagaagctgcaagagccattccggaaactaaatacaatgctactttggtatccactaacatttcctcatcatcacacactttaaactcaattttattagcttctaacaaaatgatttaattatgagttaccaatgattttttaaaaccaagcctccttgttatatatttgttttaatttttacttgatatatatgttactgtctgatatattttttcttgactcagggaaaagagtgataaatgatgggaattttcaaaagctgactgaatgctattcattcactcagcaaatatttgttaagcatctagtctatgaccaaatcaaattaggcactagacataaagagatacacccttttgctgggagtgataagaataatgggggtgctagtcaatgagcataagggacagtttcacaagaaatgtttcaagttcaattcctgctatgttgactttaagcttctgtgggatatatctgagaggaaacttaaaacatgaagtgagggccgggtgcagtggctcatgcctgtaatcctggcactttgggaggctgaggcaagtggatcatctgaggagtttgagaccagcctggccaatatggtgaaacccatctctactaaaaaaatacaaaaattatcccggcatggtggcttgctcttgtaatcatggctactcaggaggctgacccaggagaatcgcttgaacccgggaggtggaggttgcagtgagctgagatcacgccactgcactgcagcctgggcaacaagagtgaaactccatctcaaaaataaataaataagtttatttattaaattaaaaaaaacacgaagtgagcatttcgatctagatgtatgtggggagaatgggctcatacagacacatgcaaacatggtagctgtagctctggaactggataacataatttataaagtgtgggtgtaataagatgagaattgaagaaaaaactgaagttttacacatattaaagaatgaaaggaagactagggatttagtaatattgacaaagtgtggcttaaaaggtaaaagaaaacctagtggaaatgcactggatgagtgttagaggctatcaaaggtaagcatctcagtgtcaaacactgtagagcattcaaaacagattatacttggaaagggtttccagtagatgctgttggtagctcaaagcagatcctttgctaccttgccagagcaactatcaccagctgctatgagtgttaacttctgaaagcttgcagccgtccctaagaattaacctttatccacagaaataggctgtgccaggaggccctagataatgactgacacataggtgaggaaaggccagccttcttgccttaagttaggaacaatcctatgattggatttttgctgcaaagccctaaaggtacgggccaaggctaaactatcactatgatcaacattcttgcttagagcttgcctcttcctttttctgcctccctcccttcattataggttgttttgtttttgtttttgtttttttctaaagaactttttctccctccataaatcacacaaagccaaatcttggcttaatgctctactccttaggaacccacctaaaagagtgcaattcgatttagtaaggatagcaagaacaatttcatatccatgttacagtcagaagttacactaaagtgggttgagaaggaagagaggaatgtgacacagtgggtgttatctacacacctgcacaaacatacttatggttatgtgaagagccagacaagagtcagcatgcaaatacaggaaatagaattgcacaggagaaggacaaacagccctttcactggaatgagttctacaacacactaatagtaaaaacaatattcacctactggactcaaatcatgatgctgtttagtactaaattacataagtgtgctggattataccttgtctgggtttttcctattgtaaattaggaaattgatattttattaaagatctgtgacaaatgccatgaaaggagaaaaatgtggaattccaggagaattaaggcagagaatactagaatgaaagaaatctgaaagaatatacgcattgggtggctcaaggatgttgaagaaatgataatcaaaggaagtaatttaaaaatatttgtggtcaagataaaatgagagtaatgtaatgaagaatagatcactaggtacagagccgtaatcttccagggtttgggtttccttgggcaaatgaggttgaataagtcaaagctctttagagtattagcaacagaatttcaactgatagatttttatcaactggactggacagcaaggagtggtcatggaaagctcgagaactatccttattccacataaaggggaacatgggttgaactagggaacaaagacaggcaatgagacagagatcatggtagtatttacaaaattgatgtgtggaccaaaagttatatgtgacttaattcttcaccaggtttcaagtaaaagttgagaataaacaagccatatttaatagtaaaacagagaaagtcatgtacataaatactttctgatcaccactgtttcagcaggaatcattaaaactacagattacctttgcaaggtggaatttatcccttaatgtctagtggtggttaagaatgtctggttttgactgcattcaaaatgtaaaaattaaaagataaaaatgatataaagcatttgtctctactctaatgctattagctctagatatatgccttgccccaaccccaaatttctttgaaaggtgaaagcagaaatatcaacatagaagttcacatatttgggagcttttatgccatagtttgtggcaatttagtttcaccagtgtttaatgagaatagcaaattttgcacattcttgccaacactgggtattatcattttaaaaatattttccaaaatggatagaaaaattaaatctcattgttttaatttatatttcttcattactttttacaatatagggatttggtttacaatatagggatttggtttacaatatagggatttggtttacaatatagggatttggtttacaatatagggatttggtttacaatatagggattgcattttacaatacaaagatttgttgttgctgttgttactgttattatgatccttatctttaacttgatttgtaagttttgggatttagcattttctttaaaataaattttcattgctcaaggcagttaacattttatctttctcattttggaaaaaaaaaaaaggctgtgcctaggcaaaaattaaaccctgaattcatgtttgatttttttgtaatagatgtaatgtagaatttaccttactttattttcacgtggttatacaataatcctgacgcctttgatgctccaccagatttcatttgtgacttttattatagactatataattacatatagttcaatatgtctttagactttctatcacatctttacaacttttagagccatattattttgatcactgaaaatttaacaaacatatttttaagactttttgttagaataagcatttttttattactcttcgtttttaagattttataatgtttatgtacatttattcttccagacaaaattagaaatcattttgtccagccaaaaaattgcatgcaaattgcaccaagtagataaattaatttgaagtgacgtaggttctttttcattcagtttaattttctttacacttaagagaacaatttagttttttgtttgtttgtctgtctgttttgcttagggatagcatgatctcttttcaatttgttgccattctctacagtagtaaaaggagattttcgtaatcctcttctccagattacttattttgttgtcctcagtgttgatttttgccttattctaatacagatatagttagtttctgctaaaacattatttttttctatactctttcttaattcttttgtttctttcaagtcagtgcattataaagtaaatgttttctttagtattcttgaccatctaaaactattgctattgatgtcttcttctgtttgatgcaataaaactttatgtatggcattcatctaacttttatctgccatcctttttctttatttttgagttgcataactattagtattttatttggcaacaggtagactctttaataccaaaaggcacttgggtcataaaccatcagtctgcattggcagttgatagaaaagtcaaaggaaacaaatacaactacaccgattattgcaatattgtttaggtactgtccaatacagaaacaacttcacacagaaaaattaatctaaggtctcagtaaccacaaaataataaaaaatattttctctaattgaatacaatcaagcctataatatttatttttgctaaggctaccaagaaactcagggaaattctgaaaaattacctctgttaactttgaatggtattgtgaaataaatttgagttttaacttaattttggcacaaacttactacattttattttgctgcatatggtatattacataagctgttttgaatactgttagcaataacttgtagaataatttaaatcattcatgaatacataatttcccatcctcactttagaatcagacatatataatactctttgttttaagtctatttttaaaatttagcttttaatacattgtaatctctctttggataatgctcatgtatggctatatgtttaagatttcccgacaccatcaagatggctgactagaggaacctagcactcatctcttaaacaaagaagggccacaacagcaaataaataaccacaaatcaaatggagcatctaagggagaacacaaattcagcaagaaaatgatgaagcccttctaagacatggaaactcctgatggcacaataaaaataaaagcaaagcagctagccaggatcagcatagaggcaggagagactctccattgcaggaaaaaggtaggtgggagattccccagccatctacattcccatcagagatgtctggaatcctagggagagaaaagcccctctgccctcacagaccccgagcctagtgcagagagtttcctggagttcacatgactgtattgttccagagaggaaaatcaaactgggtgccctacactcctgggaccaaagctgatgcatcatggcattattttgagggaagaaccatcaccagaatacattctgacttgggccaaatagcccctgtatctccacatccatagtattccactgatattcccctacatccactgagaaggctacagtctcatgaaaccaactggaactggtggtacaactgtgttcccagcatctgagcccatgtagctccctgtactccagaaaataggtgatctaaacccttaggaagtctgcctccaggacacaggtagctgaagcatgtgcacaccaaagcttgagagccacctgtcttatctgccgtcaccaacagtgacctctccccctctagcagtggggccaccacatgtccatgtgcaatgtcaataacctgcaaaccagtttaactggggtccactgccagtgccccaatgtgtgccatccaggagcccgaggccatcctcctcaggaattgctaccacttcaagcccaaaaaactgacctctccaatagtggggctgctgcgcacctttgcacaccatttaggagccagaggagtggaccaaccagggtctactgccaccaacacccatgcctacaaatatcccccaggatcctgaagactggcctacctgggctctcccaaagaaagttatgacagagcctccacaaacaactacagcctaaactactgagaaaatcacatatgctactgatttgattacaggcaaaaaaaaaaaaaatcatatggagaatacattactgtacctacctagaactaaaaccaaagcactctacctaactgactctatagatacatctacaggaaaaaaagtgttaccctatgaaagctacttcagaaaattcaaagaagtgacagctatatcagagatgtagatatcagtgtagggatgcaggaaacatgacaaaccaataaaacataacacctctaaaggaaaataattattctgcagtaacagaccacaaataaaagaaaatctataaactacttgaaagggaattcaaaataattatctttcaaaaattcagtgaaatacaagagaacacagataggcaataccgtgatatcaagaaaagaattcatgatctgaatgagaaattcaacaaagatgtccaacagaaatcatagaactgaagaattcaatgaaaatataaaaagtacagttgagagcttcaacaattacagaagaaataatttccgagcttaaagacagatcttttgaagtatcctagtcacacacaaaaaaaagagaaaaagaatttttaaaaagagtgaagaaactctatgtacatacaggagaactttaagcaaacacatttttaaattctgggagttccaaaaagaaaagatggggaaagacatggaaacctattgaataaaataatacttgaaaatatcctatgtcttgggagataaatagacatccagatacaggacactcaataatcctcaaatagacttaaattaaaaaggtcctatcgatggcgacaggggacagacaaattcctaggcagacagggatgggtctccagtgaaacccaaccttccagcaaaggacagtttaaagcctgaaaaccaagctgccagttccagatagactccacaactggcatgagaacttctatctccatctcacccactcagtcttgattggttccttctgaatgatgccttttaactaatcaaatgatatttttttcaagaccaaccatggacccatcagcatgcattccccgattctaagcccataaaaaccccagactcagactcacaaatggctacctgtttaggggtcctctctcattgccgagagctttccttcagtgactcaatacaattctactatatcttactcactttctggtgtgcacataccttgatccttttggtcacggacaagaaactggaaatccttgaactgcaggagcaaaagagctgtaatgttcctgcttgctgagctataggtggtgagaataaaagagtggtaatattctctgccgctcgccgaacaacaggacagaaaaacccactgggtgccaccttctcctgcttgctgaacaatggcagcaaagagccactgggtgccctttctctcactcactgaactgtggaagcgaaaaagccacaacactatctgaggcacattatagtcaaacagtcaacagtcaatgataacaagagaaaagaatcaagtcacatacaagggagtccccattagactaacaacacacttctcagaagaaaccatatggtcagaagagcatgagatgatatattcaaaatgctaaaagaaaaaaaaaaacctgtcagccaagaatacaatacccagcaaagctatcttaaagaaataaagagtaaagttttctcagacaagcaaaaactgagggaattcatcatcaccagactggatatacaagaaataagggagttcaacatctgaaggcaaaaggatgatatctgccattatgataacaaatgagaaagacaaggaatgaaatgttatttctacagaaaacaagcaaactgcaaaaaataacttaagagagaaagagagaaacaaaacaaatacaaaacaatcagaaaacaaataccaatgggtagttagtcttcacctatcaacaactatgaagaggtttaattcaccaattaaaagatagagatttggctgaatggattaaaaaacaacaagatccaactatatgctgcctacaaaaatctcacttcacttgcaaagacactcatagactgaaagcaaaggaatagaaaaagatattccaatgcaaactgaaacgaaaagtaggcaggattatctatatttgtatcagacaaagtagactttaagtcaaaaaacataaaaacagacaaagaaggtcattagataaaaattaagtggtcaattcagtaagaggatataacaattatagaaaagtaaataaacatatatatacacactcaacattggagaccataatacaataatagctaggaacttcaatgccccacattgagtattagacagataatctaaaaggataataaattgtaaaatattggacttacactgcactatagaccaaatgaacccaatagatatttacagagtatttcatccaatagctgcagaacacacattattctcctcaggacatgggacatttgcaaggatagactgtatcttaggcctcaatataaatctcaaacattttaaaacatcaaaattctctcaagcatcttctcagaacacaataaaataaaatcagaatcaatattaagaagaactttggaaattgtacaaatacatggaaattaaacaacatgctcctgaatgacaaacaggtcaataaggaaattaagaagaaagtaaaaaaaattcttgaagacatgaaaatagaaatacctatgggatagagcaaaagaagtgctaagagggaagattacaccaatgaacacctatataaaaaattaaaatatttaaaataaacaacctaacaatacacctcaagaaactagaaaagcaagaacaaactaaattcaaaatttatggaagaaaaaaataataaagatcaaagcagaactaaacaaaatagagactaaaaaattacaaacagtcaacaaaatgaaaagttagttttctgaaaagataaactaaaacgacaattagactaagaaataataaagaaaacctcaataaataaaaccagaaacaaaaaaggagacattacaactgataccacataaatacaaaggatcattagaaactgttatgaacaactatacactaccacactgggtaatctagaggaaacatataaattcctggaaaacttacaacctgccaaaattgaaccaagaagaaatagaaaatctgaacagaccaattacaagtaacaagactgaatcagaaataaaaagtctcccaaaaagaaaacaacaacaacaacaacaacaacaaggcccaggacagagagttttactgctgaattcaaccaaacttttaaagacaaacgaaaccaattatttttaaattactccaaaaacaaaaaaatagaccatacttcttaattcactttataagtacagcatcaccctgataacaaaacgaaacacagacacaaaacaacaacaaactacaggccaatatccctgatgaatatgggtgtaaaaatcctctaccaaataatagcaaagcaaattcaacatcacatcaaaaagataattcatgggggaggagccaagatggccgaatagtaacagctcgggtctacagctcccagcatgaacgacgcagaagacgggtgatttctgcatttccatctgaggtaccgggttcatctcactagggagtgccagacagtgggcgcaggtcagtggtcgcgcgcaccatgcgcgagccgaagcagggcgaggcattgcctcacttgggaagcgcaaggggtcagggagttccctttctgagtcaaagaaaggggtgacggacagcacctggaaaatcgggtcactcccaccagaatactgtgcttttctgacgggcttaaaaaatggcgcaccatgagattatatcctgcacctggctcagagggtcctacgcccacggagtctcgctgattgctagcacagcagtctgagatcaaactgcaaggcggcagcgaggctgggggaggggcgcccaccattgcccaggcttgattaggtaaacaaagctgccaggaagctggaactgggtggagcccaccacagctcaaggaggcctgcctgcctctgtaggctccacctctgggggcaaggcacagacaaacaaaaagacagcagtaacctctgcagacttaaatgtccctgtctgacagctttgaagagagcagtagttctcccagcatgcagctggagatctgagaacgggcagactgcctcctcaagtgggtccctgacccctgacccccgagcagcctaactgggaggcaccccccagcaggggcacactcacacctcacagggcagggtactccaacagacctgcagctgagggtcctctctgttagacggaaaactaacaaacagaaaggacatccacaccaaaaacccatctgtacatcaccatcatcaaacaccaaaagtagataaaaccacaaagatggggaaaaaacagaacaggaaaactggaaactctaaaaagcagagcgcctctcctcctccaaaggaatgcagttcctcaccagcaacggaacaaagctggatggagaatgactttgacgagctgagagaagaaggcttcagtcgatcaaattactctgagctacgggaggacattctaaccaaaggcaaagaagttgaaaaccttgaaaaaaatttagaagaatgtataactagaataaccaatacagagaagtgcttaaaggagctgatggagctgaaaaccaaggctcgagagctacatgaagaatgcagaagcctcaggagctgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctcattggtgtacctgaaagtgatggggagaatggaaccaagttggaaaacatgctgcaggatattatccaggagaacttccccaatctagcaaggcaggccaacgttcagattcaggaaatacagagaacgccacaaagatactcctcgagaagggcaactgtaagacacataattgtcagattcaccaaagttgaaatgaaggaaaaaatgttaagggcagccagagagaaaggtcgggttcccctcaaagggaagcccatcagactaacagcggatctctcggcagaaaccccacaagccagaagacagtggggaccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaacaaccggtaccagttgctgcaaaatcatgacaaaatgtaaagaccatcaacactaggaagaaactgcatcaactaacgagcaaaatcaccagctaacatcataatgacaggatcaaattcacacataacactattaactttaaatgtaaatggacaaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaactagaagagctaactatcctaaatatatatgcacccaatacaggagcacccagattcataaagcaagtcctgagtgacctacaaagagacttagactcccacgcattaataaagggagactttaacaccccactgtcaacattggacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacagcctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaagagctggttttttgaaaggatcaacaaaattgatagaccgctagcaagactaataaagaaaaaaagagagaaggatcaaatagacgcaataaaaaatgataaaggggatatcaccacagatcccacagaaatacaaactaccatcagagaataatacaaacacctctacgcaaataaactagaaaatctagaagaaatggataaactcctcgacacatacactctcccaagactaaaccaggaagaagttgaatctcttaatagaccaataacaggagctgaaactgtggcaataatcaatagcttaccaaccaaaaagagtccagcaccagatggattcacagccgaattctaccagaggtacaaggaggagctggtaccattccttctgaaactattccaatcaatagaaaaagagggaatcctccctaactcatttgatgaggccagcatcattctgataccaaagccaggcagagacacaacaaaaaaagagaattttagaccaatatccttgatgaacattgatgcaaaaaatcctcaataaaatactggcaaaccgaatccagcagcacatcaaaaagcttatccaccatgatcaagtgggcttcatccctgggatgcaaggctggttcaatacacgcaaatcaataaatgtaatccagcatataaacagagccaaagacaaaaaccacatgaatatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgcgctctctcaccactcctattcaacatagtgttggaagttctggccagggcaattaggcaggagaaggaaataaagggtattcaattaggaaaagaggaagtcaaattgtccctgtttgcagacgacatgattgtatatccagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaccttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcacactacctgacttcaaactatactacaagtctacagtaacccaaacagcacggtactggtaccaaaacagagatatagattaatggaacagaacagagccctcagaaataacgccgcatatctacaactatccgatctttgacaaacttgagaaaaacaagcaatggggaaaggattccctgtttaataaatggtgctgggaaaactggcaagccatatgtagaaagctgaaactggatcccttccttacaccttattcaaaaatcaattcaagatggattaaagacttaaacgttagacctaaaaccataaaaaccctagaagaaaacctaggctttaccattcgggacataggcatgggcaaggacttcctgtctaaaacaccaaaagcaatggcaacaaaagccaaaattgacaaatgggatctaattaaagtaaagagcttctgcacagcaaaagaaactaccatcagagtgaacaggcaacctacagaatgggagaaaattttcgcaatctactcatctgacaaagggctaataatatccagaatctacaatgaactcaaacaaattcacaagaaaaaaacaaacaaccccatcaaaaagtgggcaaagtatatgaacagacacttctcaaaagaagacatttatgcagccaaaaaaacacatgaaaaaatgctcatcatcactggccatcagagaaatgcaaatcaaaaccataatgagataccatctcacaccagttagaatggcaatcattaaaaagtcaggaaacaacaggtgctggagtggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaacagcaaagacttggaaccaacccaaatgtcccacaatgatagactggattaagaaaatgtggcgcatatacaccatggaatactatgcagccataaaaaatgatgagttcacgtcctttgtagggacatggatgaaattggaaatcatcattctcagtaaactactgcaagaacaaaaaaccaaacaccgcatattctcactcataggtgggaattgaacaatgagatcacatggacacaggaaggagaatatcacactctggggactgttgtggggtgggggtaggggggagggatagcatcgggagatatacctaatgctagatgacgagttagtgggttcagcgcaccagcatggcacatgtatgcatatgtaactaacctgcacaatgtgcacatgtactctaaaacttaaagtataatttaaaaaaaaaaagataattcaccatgatcaagtaggagttatcccagggttgcaaagatggttcatatatgcaaatcaataaatgtgatataatacatcaatagaataaaggaaaaagtcttacgatcatcataatagaaaccaaaacaaagcaattcataaatcttcatcctaaaatttcttcatcataaagtctctcaaaaattggacatagaattagatatacccctacacaataaaggccatttatgacaaacccacaactaacagtacactgaacagagaaaagcttaaagcattttctacaagaactggaataggacaagtatgcctacttttaccactcttattcaacatactactagcagacctaggcagagcagtttggcaacaggatgaaataaagggcatccaaattggaaaagaggatgtcaacttatccctccttgtaaatgagataatcttacatatagaaaaacctgaagacttcacaaaaaactcttatgactaagaaatgagtttaataaagttgcaggatataaaaattaacatacaaaaaaatcagtagcattcctatttaccaaaaacaagctagctgaaaaggaactggagaaggaaatcccatttataatagcttaaataaaataataaaatacttaggaataaatttaaccaaggaggtaaataatctctacaattaaaactgcaaaacactgatgaaaaaaattgaagagggcataaaaatcaaaagacatgccatgctcatggattagaacagttaatattgtcaaaatgaccatacaacccaaagcaatttatagattcaatgtaatccctattaaaaattgcaattacatttttcttcaaataaatagggaaaaatcctaaaatttgtattgaacccaaacaaatacaagtagtcaaagtaatactgagcaaagggaggaataacactatgtgacttccaagtatatcacaaagcaatagtaaccaaaacagcatagcattgctataaaaactgacacacagacaaatagaacagtatagagaacactgaaacaaatctatgtattttacagtcaactcacttttgacataggctctaagaacatacactggggaaaagacaccctctataataaatggtgttgagaaaactggatattcatatgcagaggaataaaaccagatccccatctttcaccagaaccaaaaattgacacaaaatatattaacaacttaaatgtaagacccaaaactataaaactactagaaaaaaacagagggggatttctttgggactctggtctgagcaaagatttttatggataaggttacaaaggcacaggtaccaaaaagaaaaatggacaaacaagactatatgaaacttttaaagagcttttgctcagcgaaggaaacaatcacagagtgaacagacaatctgtatattgggagaaaatatctacaaactatttacctgacaagggccttttacctagaatatacaaggaactcaaacaacttaacagcaataataataatggtaataatcccattaagaggtggaaaagaatctgaaagacatttctcagaagaagaaatacaaatggccaaaaagtatataaaaaatgttcagcatcactaatcatcagggaaatgcaaatcaaaaccaccataagatatcacctcaccccagttagaatggctattatcaaaaagacaaaaaataagaaatactggctaggatgcagagaaaagggaattcatacattgttggaaggaattatagttagtacaactattatgaaaaacagtatggaggttccttaaaaaactaaaaatagaaatatcatataatccagcaatcctgttattgggtatttagccaaaggaaaggaaacttgtgtatcaaagtgacatcttcacccccatgtttataacagcactattcactatagccaagatgtgatatcaacctaaatgtccatcaatagatgagtagataaaataattatggtatatatgcacaatggaatactattcaaccataaaaagaaatgggacgttgtcattttttgcaacatggatgaacctgaagggcattatgttaaattagtcaagcacagaaagatcaataccacattcttacttatatatgggatctaaaaaattgagctcatgaaataaaagggtagaattgtggttttcagaggctgagaagttagggatgagaaaggcaaagagagaagttggttaactgatacaaaattacagctagacataataaataagttatgttctatagcactataatgtgaatagagctaacaataatttattgtgtatgttcaaaaagctagactggagaattatgaatatttccaatacgaagaaatgataaatgttttaggtgatggttatactaattactctgatttaatcactgcatatttcatacaggcatcaaaatatcattctgcatcctataaatatgtaaaattattatggtaactatagataaagtgaaggaaacaaaaaatgcaaaaaaccaaccaaaatcatgtaaatacaatttttaaagaatttttatgacttcattattatttttgatttgtgggactatatatttcacagcaatttcaatgtaccttctagatattatatagacacctatgatctgaacttaaagttttagaagatttctacctataataggtttttggatatttaaattttggtttttttttctaggtttgaggtcagcgaagaaaattgacattttaaattaatataggaatgatggcctaattaatcttcttgacagtgaactcctgtgtgtcaagagtcaatccataggacactgcatcctgaatatattaacttcccaattgttcatatattaaactaaaagattttcatcagatttcttcttagctgaacttccaattcatgtcttatggggcttttgtttggcttttccataaatcatggcaaaccaaatgtggcacaagtttgatttttgaaaaaaattattattgcttaccctgggtacagttatacatataggatatatatacagtatatatataggatatatacacacacacacacacacatatcctatatatatggtatatatatacatatccctgtttaaaaaatccctttaagtatacaactctaccttatgcatttaggtagaaacaaaaacaattgtctacaacacttgaactttttcttttagactagaccctgtttataattatacacgttctacataatataaactagttcaatgtaaagacagtttgtcagaaagcaacagcacacagccaatctgagacaatgtaacagataaatggttggttaacctcccaagggtaagattatgaaatcacttagtgaggctgggtcccttccagttttcttatgctatgtctctttaaaatatatgtacatgaagaaatacacggacatgctatgactctttaaaatacatgtacatgaagaatattttaaaccaaaatggatgtacacatgttttataaatattatagcaccctagttcttaatgtgttcctcatcagaatttgaatagtgagaatgtaatcctacacatttaaaaaattaaataaataaaaggcagctatcctttatgaataataccatgaaattgagtctgagttagatttccaaaatatggaaaaatgaggtttctttttgcctatcattactatgatgacaattatgaattgatctataatgaatattaattaaatgaatattaagtaatgacactgatgaaacatttattgagagctgacaatatgctttatccctgctctttcaacaaaaaagaacgttgcataggcacaaacctttggtagatgacataggatttcaaggaaatagatgacttcagtaactttgcttaaaggttaaagaggtaaatttaaaagaagggtgaaacagccataatgatgtgaaataaaagctgaagctcagtgcagcaagacacatccttagttagttatatgttcacacctccccaccagactctgcatttctggaagttttataactagcctaggaataatattacagagaattcaaaattcaaatttcagaatcacagaagatttgaatatctcccaccctccttgaattagctgatgtgtagcattgggattgtcattattaactcttgccgataaaagtcagatgaaaaaatctacagaaagtttccatactactggagctgtgagaaagagacacacaccatacttctacttcctaacaaactttctgacattgctgagaaataatgacttagttcaacacatgctctaaggaaagatttaacatactctatgctatttaagacttaatcaccatatttacaatgcataatttagtagaattcttaaaattgtggaagagcaagcaagatcggaagaagaggagaagttaatatgacatatggttttctgagggtgttataggtagagatacgtagattgctgcttcagcaacatcacaacttagccaagttttcagagttacagtgaagaaaaaagagatgcagaactgggaccattttaagtttcagcaacatagatggaactggaggtcaatatgataggtgaaataagccaagcacagaaagattaatattacatgttctcattcatatgtgggagttaaaaagttaattccatgcgggtagagagtagaatgatggttatcagaggatgggaagagtttgcatgtttgtggagtagggggataaagagaggttggttaatggatacaaacacgaggttagatagaagaaataaattttaatgttcaatagtagagtagaatgacgatagtttcacacattgtatgtttcaaaatagctggaagagaggacttcccaacataaagaaataatgaaatactcaaggtgatgtataccctaaataccctgacctgatcattacacattttatgcatgtaacaaaatattacatgtaccccataaacatgtacaaatattatatatcaatacagaataaaattcatattttatatttataattttaataaatatgatttaaaaattacgtttataaaacaggattaattaattttaatactaaagaatattttttaaatatacatttttcaaatagttttgttgtcctttctgtgaactaacaagcttcataatttatcttgatggtatttttattaactctattcttcttttttaaactttactttaaagttctgggatacatgcgcagaatgtgcaggtttgttccacaggtatacatgtgccatggtggtttgctgcacctatcaacccatcatctaggtttcaagccccacatgcattaggtatttgtcctaatgttctccctcccctaaccccctaccactcgacaggccctggtgtgtgatgttcccttccctgtgcccatgtgttctcattgtattaactctattcttaaaggctcatcagatattataacaagagagtgtattccaggaagaacacaccataactggtctaaagggctatggtgctgaacatattcattgtttcacatcctatcatttcctgctaatggacagtaataatatggttaagttcaaaagtgagataaattaccctgggcagtatggcaattttcacgatattgattcttcctacccatgagcatggaatgttcttccatttgtttgtatcctcttttatttccttgagcagtagtttgtagttctccttgaagaggtccttcacatcccttgtaaggtggattcctaggtattttattctccttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaactgccctggccagaacttccaacactatgttgagtaggagtggtgagagagggcatccctgtcttgtgccagttttcaaagggaatgcttccagtttttgcccattcagtatgatattggctgtgggtttgtcatagatagctctaactattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtgtattgaaccagccttgcatcccagggatgaagcccacatgatcatggtggataagctttttgatgtgctgctggatttgttttgccagtattttattgaggatatttgcatcaatgttcctcaaggatattggtctaaaattctcttttttggttgtgtctctgcccggctttggtatcaggatgatgctggcctcatcaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcttcctggtttagtcttaggagactgtatgtgtcgaggaatttatccatttcttctagattttctagtttatttgcgtagaggtgtttgcagtattctctgatggtagtttgtatttctgtgggatcggtggtgatatcccctttatcatttttattgcgtctatttgattcttctctctttttttctttattagtcttgctagcggtttatcaattttgatgccatccccatcaagctaccaacgactttcttcacagaattggaaaaaactactttaaagttcatatggaaccaaaaaagagcccgcatcgccaagtcaatcctgagccaaaagaacaaagctggaggcatcacactacctgacttcaaactatactacaaggctacagtaacccaaacagcatgctactggtaccaaaacagagatatagatcaatggaacagaacagaaccctcagaaataatgccacatatctacaactatctgatctttgacaaacctgagaaaaacaagcaatggggaaaggattccctatttaataaatggtgctgggaaaactggctagccatatttagaaagctgaaactggatcccttccttacaccttatacaaaaatcaattcaagatggattaaagacttaaatgttagacctaaaaccacaaagaccctagaagaaaacctaggctttaccattcgggacataggcatgggcaaggacttcgtgtctaaaacaccaaaagcaatggcaacaaaagccaaaattgacaaatgggatctaattaaactaaagagcttctgcacagcaaaagaagctaccatctgagtgaacaggcaacctacagaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccgtcactggccatcagagaaatgctaatcaaaaccacaatgagataccatctcacaccagttagaatggcaatcattaaaaagtcaggaaacaacaggtgctggagaggatgtggagaaataggaacacttttacactgctggtaggactgtaaactagttcagccattgtggaagtcagtgtggcgattcctcagggatctagaactagaaataccatttgacccagccatcccattaccgggtatatacccaaaggactataaatcatgctgctataaagacacatgcacacgtatgtttattgcggcattattcacaatagcaaagacttggaaccaacccaaatgtcccacaatgatagactggattaagaaaatgtggcgcatatacaccatggaatactatgcagccataaaaaatgatgagttcacgtcctttgtagggacatggatgaaattggaaagcatcattctcagtaaactatctcaagaacaaaaaaccaaacaccgcatattctcactcataggtgggaaatgaacaatgagaacacatggacacaggaaggggaacatcacactctggggcccgttgtggggtggggttaggggagagggatatcaatgggagatatacctaatgctagatgacgagttagtgggtgcagcgcaccagcatggcacatgtatacatatgtaactaacctgcatgttgtgcacatgtaccctaaaacttaaagtataataattaaaaaaaataaaaataaaaataaaaaaagagatatgagagttggcaggggctagaaatccagtttaaaaaaaaagtgagataaataatcatctaaaaatgattttaaaattttaaataattttctattctaagacaaatgttctgttttaggaaatatttaatcattattttcttcattaggaatgggtttatagtacagaaagaattaaacaaccataaaagcggactcatttgtaggacaaaataacacagtatggggaaaatgatcctttgcacttctgagtagagaacagccagaagaaaccattcttcataaagatgttcactatcatgttacttataataacaaaatgaggaattgaaaagatgctagacaaaaacagtttcaactaaaatatgacttctttacttaatgagattacacaggcattaacagtgatgtcccatagtatatggaaatacataaaaatttaaggatatcaagttaagtgttaaaatataatgccacatggtatattcaggttaactttaaaaaggtgaaaaaaaaacctaaaaatcaggaaggtaattttaatagtgtttctatttatatattaattgtaattcttcttatataactgtatcacaggtttttaaatgtttaaattctttttctttattattttaaaattttgtatgattacatagttatggtatgataaaatgttaaaattcacttttcaaattacagcataacacttataatagtaatattagatgatatcatcttagcactcaccatcagctatgcatagttataagcaattttcatgaattaactcatttgattttatttacaaatggaatacagagggacaaaatgttaatagctcgcttcatatcacaaaactagtgaaaaacccaggattaaaatacaaatggtatactgccagagttctaaggtaactgaaccaatttactctctcacctgcaatggatgaacaatttggctgaatcttaacaaagcttaggctttttaacgtgcttgtatcattctcttcagtgtctggtgttatctcctgatacttaacatcaattttcttgataagtaatgatggtgagtgcatattcatatgtttataggtggtttatcaatagacttagttcaaatgcctgtttaggtctcttgcccttttcaactgaattgtttgtttattattgatctatatcaattctttttatatttcacatacaagtcatttgccaccattttgaaactactggatggaaacgacttgcccacagatcaggagttcatgtaagaactctggactctagtcttccacactttctggctatcattattctctcttccttctttctcttcttccttttctttccttctcttctttcttttcttttcccttcctcccttcctcccttcctcccttccttccttccctccttccctccttcccgctcccctcccctccactcccctcccttccctcacttccttccttccttccttctttcctcccttcctttctctctctgtctcataaatcttccacacttctcctcttttctaaaacttttaactgggctccctggaaccagtgtgcaaaaaaaaacaaattatccttttcctttctaaatgattgccacttttgctaataacacttctgaaaagaggcagctcactctctcaatccttacaactgctatagttttaagggcaatctcttggccttccatcaaaattaccatttgtccagctacaaagctggacttgaggttcatgaaatctttacacttgaggttcatgaaatctaatagttctcctctacccttattcattactgtcaagtaataactatttttaaaactctgcaactatcctggatggttttaaggataatatccaataagtcattctcagagttcccttactttctaacatctaatgaacttcccctgcacatcagttgagccacccagattcatggctgcatattggatcttaccatcatctgaaaataatctattttgaaatcacatcaaatcctaatgttctactctctgctacagttttctctcctggttgcctaattttctttctctgttggtgtctcttgactattcacattgcagtctcctagtgatactctcatatctcttctgctccctgctttacatttcttttacaccacactgctagcaaagctgtctttctacaacacaaagttaatcatttaagctcatatttatattggataaagccgatctccttgacaagacaggccaggaagccattatcttggaccttgtattttctccctctccagcctcacccttacacatgccctttaaaaaatattttggagtttcatgatcacactatgtactctcttgtcactgagactatttatataaacatcactttacattttccttcaaaatacctatttatgctcagacatcatttctttaagaaaaagtttaatttactgttttcccttgggatggattaagattcccacctctagagcccctgtaagtgagtatgtatcacaccctaatatttaacctctttggatgcttcatctaatttactctgaattgcaggaaagaagacaactgctcttatctggatttttagctccattgtctttagtaaaaattaaggggaagaaaaaggaagaaaagaaagaaggaaggaaagaaggcaggaagaaaagaggaaagagaggaaaaataaacagtagaaagcgagcactgcagatattgtgtataaaaataatgcaatgatcttaaaggtacctttaagaaataaaaataacaattcatataaaacaatggttacttatgtatcatacaacttcaactttaaataatcagcatattaacactatgtcattcataattccaatttatcaatataaaatattgatattgatatgaaaaaaaggctaggtaattaacccctttgttagagaattaagaaccttgctcttcaagatcgatcgtgttcttggcaagagcatggatggagctaaaggccattttccttaggaaactaatgtaggaacagaaaaccaaataccacatgttctcacttataaatgagagctcgatgatgagaacacatggacagatagagggcaacaacgacagagggtggagggtgggaggaggaagaggatgaggaaaaataagtaatgcatagtaggcttagtacctgggtgatgaaataatctgtacaacaagcccccgtgacacaagcttacctatataataaacctgtacatggacccttgaacctaaaagttaaattaaaataaggaatattgtttctaaattataacacaaaatgtgtacatacagaaaacaaaactaaatcatggaggtgaatacaacagaaatgatttttgtgataatctgcttgattttactcttcaaagtttaaaatgtgattttctcatgagatatctcaagtcttcttttgttgatggtggcagaattaattgaataaaagcccctccaaaactgaaaaataattacataaatatgtgcactcttaaagagccactttacctcatcataaaaattatataaaacttagaatgaatgtaaaactaaaatataattctagagaaattgatcagatttgtagcctcctatatgagattactctaaaatcaaagggattctataggcctattttatcgatttctgtgacctcacaaatttatgtactacccaaaataatttcaaaagtatggacttaagccattgcagagaaacagaagagaaatttatgaatagaatagtgataaaggtatatataaacacataaaaataaacaacttatattccaacatcatagttcaatgttagtataaatttaattataagcttcttaagtaccaaaaataaaagcatgatggcaacgacacatgaagtctaagagataacatcatgataaacagaactgagaagaacttttgtcaggtaatgaaggacatttccaacatatctttttttgttaaaatagggagttttatatgattaatttttaaaactccctttcaatgcaggctgatgacataattgctgaagcccaatttaatttaagagaaactgagaagggctaaaacaacatagactacatctgtcttgagttaggggtaaattagaacatagaagagtgagtggcttgcatatggcctcattaggccatattccatatgagattattaaaatttatttgcaatgtcactttgttttggattggccagctgagatttcagtgtgttatctgcagcaagaaccaagaatgcattttttaatagattctattaaaggcagaacatctgttttgacaatcagttgggaagggttaatggccttttataaattaagcagcttatcatgagtctcgatgagttgggattcatcctacatttttttggaagtaaaataaggggaggatttaaggaaatctacctttgtaaacagtttctgacctctcttcaatatggcagtaaatgaactatagctataattgttaccagaacattttttttcttaaaaaaaagcattctaagtacctaaacacagtcatgggaaaatcttgactaaatcacacattaaataaattttaagtaatatagatttttgatagtactttcaaaagatactggatgccaattgcaacctcagaaaactaattatatctgatgtagggaatcattgtttaatttttatttgaatgaaaacaccatatgataataattttaatttcagagtagttgattttaacccatttttatggcaacagccattatcaaggccaattatctgtgaaagccgtttgtaatgcatgcttataaaaagcatttcatcagtgcagaggagatgcttaccttgctaatctctggaaatggtgagcatatatctactgaatcattaacctacagcttataacaacgattggggaggaatgggaaggctgagaagggtggtacaaattttttttaatgaccctggagaaggtgttctaaaatatgagaagacaatggctatggatcttgaccttgtggtatgtcattaagatacaaggctatgtgagcttcaaccagaaattaaggatccacgctgtatttatagaggtcattcaataaccaattcctaactacagagtcaacgactaaggaaaaaataaaactagacatcttaagttctctaatattttttataatgtgatagagataatatcaatatccactttgtattaactgagtctgaacctcatctgctcctcttagagaagattagccaaagaaactggggcatacaatttcttaaagaggaaactggtactaaataataaaaaccaaaacaacatgatatatgtgaggactaacgatttgctttaaatgaagggctacaggtcatgcagtgtgaaattattcctggaaagttactgaaagttcgcagactgaaaaggctcagagcctatcagctggagctgattaagcaattttgtgggcagaacagtttcattaatttgtttgaagtatgatcacttaaatagttaatgtgtacaacagtcaatatttttattccgtgacaagaaagtaaccttttaattcggacttagctaggtgggcaaaattttaaagcaaagtgatttaaattgatttattaacacatacgagacccgaagggcttgacacaacaagtgcacttaaagaattacaagcagttcaattatccttgatttctagtggataaggtactatatgagagaatgagtaggttgatccagttaaagacccttgtttactgtaatagagtgtttgggattcaaatagggaatcaccaaaaatattttaagagtgagagggacttataatatttgcattttttgaaagttgacccaggaagcaggttggggtgtacagaaaggaggtagttcacaaggatgctactgggacaatcctagaataaaatttgtgaggctggtatacaagacagtcacagttgggctgaagtaaagagacaggattaagaacattagaatagaattgagtaatattatattccagatgagaaataaaaaatgctacttaggtttctagtttgggaaagttggggtgtgaaggtttcagtagctgagatacaacagataaaatctctctattgggatttggagaaaatctcagagcacagctctggagtgataaccactcgggctccacttctaaattgccatgtactattcatgggacactgggaaatttacttaacctctttgtttctcagtttcctcatatgtaaaatgggaacaattataatatttatcttatgttgtcactttgaaaacaaaatgaatttatatattgtgttacttataaccataccccttcataatctcaattcctacctcactcactctcaacctgacaccatttaccttgattccaacaacctttgacttcactgtaatttacaatgtactatttctaaaatctattactgtacctcatatttaatgttcttacttccctcacttccagctcaaattccacgattaagccttacaattactcctttgcatatattctcaactctctggctgccctctctgtacatcacatttgccaaaagacacggtcacatgaagactgggctgtgcctattccattcataaagctggaatgtaactagataaatatgactgaatgtgagtaaagaaatatattcatccaagccgactggaattatatactaaatggatgattattaactagaggtagctgctcttttctccttgaaaatcacagtttctttgaacaattttgttcccactttcctaggtgacacaggcttcttacacatcttgcaccatcctcactctagctaatgacccaggtttctatttctttgagaaaacagaagtattatatctttttgccattgttgcccctcaacactacacagattgttccttttaaaatataagtcagataatttctggttctggtcggaatcctctaatggcttcctattttattcagagtaaaggccaaagattttacaacgacctaaattgtcccacccaatataaaaatcgtatgatatctttgaacttctatttttcctcctatacactcagggctagccactaatccccccagtgcctttgagatctgtcaagtgtctactgcctcagaatctgttggtgaagttctgtccccagatagccacagaggtgactccctcaaatcactcaactctactcaactgtctcttcagtgaacatcttgacagcctcttttatcactgcagccccaacatttcttctttctctgctttaatttttcccttgacattgaaaacaaaaccagtacttatttattgtgtatatttaaggcatatgattactgtacaattaatgttttgatattgttaaacaaaaattatcaaagtccattgttttggactgagctcctacaggaggccccaacagaccagaccagaccaaaccaaaatggaaaccaaactttagtacaaacaacttgtactaaagtgtcacataatcaagctgaaattttaaggaagcaaactgaatcccagaacacatcagttgtttctaaaaatgtgaaattcaagtctacctgacttgggataataaggatgtaacctctcctttaactctttacccaaagagtaacctgaagtaacatgatgttaaacaatcagcttttgttttgtattattgtgttttcttgttcccaccttacaaaatccactgttctatgtctagtgggagctctcattctactctgtagaatagatgctgtcctaattcatgaataaaggcctatttgatctataaataaatgtgttgttattttgttttcaatagtgtaaatattcatagtgaaataattattatagttaagcaaattaacataaccatctcctcacatctcctcatatagttacccttgtgtgtgtgcatgtgtgtgtgtgtatgtgtgttaagagcacctagtctcttggcagattttcagtatgttatactatatatatatatatatacacacacacatttttttttgagacagagtctcactctgtcactcagtctggagtgcagtgatgcaatcttggctcactgcaacctccgcctccagggttcaagcgattcccctgcctcagcctcctcagtagctgggattacaggtgcctgccaccacgtacagctaaatttttgtatgtttagttgagatggggtttcaccatgttggccagggggggtcttgaactcctgacctcaagtgatccacccacctcgaccccccaaaatgcagggattacaggcgtgagccaccatgcccagccatgttgtacaatattagctatagtcatcatactgtacattggatttctacaattattcatcttatgtaactgcaactttgtactctttgaccaacatctccccactcctcccctcttcatatcttcagggatcaacattctactctgtttatgtattttagtacaaccaggtactaaataatttatttagttttattgtttattgtctacattacccctgctggaatgtaaactccataaaagcaaagatttgtctttgttttaatgttttctttcctacctataatactgtttggcacatactaggcatgcaatgaatatttactgaataaattaaataatattttagcatagtctctgggatagcatatatgctcaatcaaaagagctataattattgcagtagtaaataataatatatcgggtatatgcacttaaaataatatgggtcctgcaggtggcagttctaggtttggaatttaggataatgagctgaacataaattaacatggtaatgcaatcaactgaataaacaagatctcattgagaagaatactaagagaggaatgccatgacataggagggtagaatccagggatgcaccgacatgggcatgtcgacattgtgaacccaggaaagatactgaaagcaagtatccagagaaacagagaaaggaccaggagtgaggtataatggaagtcaatgaaaggtagacattttggaaggacgaaatgctcaatagtcatcacacgcttcagagtagatagtaccacaaaaatggtaaacaacaaatgctgagatataaattattaaaactgtggggatatttaatgattagagatgaatcttcagaataaaaactgtctaaaaacagcaatgaaagatttttcaagattgttcaaagacaagaaaattcacgtaacacacgctctttacatttgattctctcaaaaaaagaagtgatagcataataaaaagaatacaccttatgtttgaatttatataactagaggttgacataagtgggccaaggaggcagaccccaggctcactgaattgagtggggtcttgcacagacagatgggtagtaggaagaaatcatagatctcatcttagagttaaaatctgagatcaaaaatgcatctaaaccagtaaaattgccatatttcaaaataagaatataaataatacaaaaattctagaagtcttcaagacaacacttaaatgaataaaaacaacatttaaattaacctaaaatgtaaagtatttttatatggctctcattttatttaattaatcttatttaccataggatgtctaataaaccttacatgaagaaaggaaatttagaattagttattgctatactcagcaatatggaggtattttcttttcctctatttttgtagtttgagaaaatgaagcatttttaataattttgtgaaataaaggcatttaaaatacaaccagtattttacagataattagaatcataagtggtacaaaatgagtaatatgattaatttctaggttgacctttagaaaagtatttttctatcatttcttagttgttataattttattatatcaaatggaagttccagccatttaatttccatgttgtttttcaaaatgagaagtgcatcatggatataaaatagtttgttttttaaaataactttaattttcaaagtaatttgggttttgaatatgaatattgtttgaatatctgcttctcttcctaccaaggttcgttcttttcatagttactttactcatgcattttcatttctatacttattgaattaagtaattattttgcaggtagttaaatttattgttcaataaaattttttttttaaaaaacagctaatagcagtgcataactttcttcatggatgtgtcatcattttaggtagcctctaacctagatgagagccctcaacattgcagatatataatgtgcatctccagcaaaattgcccataagaataacttcattattctgggaagctagatctataaaatatataaaatgttgaagtcttctgcctttacaattcctggtaagtagcagcacgactaagtgataaaacctgagtcagcgtcatttcaagcatatcgttctagaaagcgtattttgacagaaggaaaaaggaaatatagtggacaaaggtgttctgtttcagagtaacgacgtattttagatctatatacttctaccttgattgatgaaaaattatctctagaagcttttaatggtatacgatactgataagtcacagcaatcctaagttatagtagaatgataaggaaaaactcaccagtaccactggacagattgttgtgggtggtaaaatatggtccttcaaaggtccacagtcacattcaggttttagatgagaagcacatttattatgcagctagaaaaacagaaagggggatagtatcaaattctacatgacaacgcctaacatgggggagattatatttcaatcgagatacagcaaacacattaaaagtacaataaagaaattataagaacaaataaacagagtcataaaggaattcataatacatttgtccttatatatgaaccctaaataaaccatctagcagcttctgtgacccattctatacattttataattctcagaaatgtttatattaaaaatgtactttaggttttacaccaaagaaccctgatttctttgacaaacacaaattattgtccattacagttcttcctttgcttatctgttagcataatcttgaaaccactgtgcctgtgtatgctttttttttttttttttgaccctcctgttttctcaaagtcattccaaagtgcacagctcagtatggggcataattgatcccatcattagttttaactttgtaattcaatatgtaaatgtaaccagagattcatctcagtaggagcaggatataaataaaagaagatgattatgattataaaaatttatctgtatattgtatttatcagctcaacgttaagttagtatataatcatacaatgtcctatttattttttaatatgtatgagcccaaactaatatttttattaacctggtcataagtttacattaaggtgttacaacgtggtgttttaaatagtgatgttttaaaactgagatggtagttttttaaagaattacacagatttggtaaaataatacttgcttgagggcatctagagatttctccctcctgcactatgcattaatttgatatgaactcttcatactttagaaaaaaatatacatttcaataagataacatgttatgttcaaaacaaaaaagagccacattatttttccattttgaatcaaaagctacctcatttaagccttggctgcattaatttccacaacatacatacctttgtgagcagttaattatcaactaagcataggagtctaatgagagttgatttatttttagtaatagaacagtatcaaagaggtatttctgcggtcctagaatctaacactgctgtcatgctaactccctgcattggagttaagatgacttgtactgtaattaatgcccattaggttacattacatgaaataaacgtatctttccatgttcatccataattagcagctctgcttctcaggggcatataaacttctctataaaaaagtgatttaattgtattaggcactactggtctttgtcaagaggcaagaagtgttgaagatagagaagcagctgaatgcacaatagaactaaataaactgatactcagagcaaattaaaaggtatagtttcctcaaaataaaattagtgacttgtttaaaatgtattattaatttattggacctagtaattaactttcttagaatctgccatggccatggatgtttggatttagagttaacagattagcaagtgttgggatggatcaatttctcccaaaagatatgctgaagtcctaacttctgggacctttgaatgtgaacttaattggaaatacggtctttctagatgtatttaagctaagatgttggtttagctggaccctaatccaatgactggtgtccttataagaagaggggaatctggacagagagacaacggcacagagaggagaagtccctctgataacataggtcgatatctgagtgatgcactacaagacaaagaattccagggattgctggcaaccaccagaagctaggaagaagcagaaaaggattcttccagaaagccttcagagggaggatgacctgctgacatttggaattctagcctccagagctatgagtgaatacattcttgttgttttaggcacctattatatgacattttgttacagcagccctaggaaactaataaacccagtactatgaaaacggcactaaaaccaaagagagattatgggtcttaagactctgctgcactatggatgtcacagagaaagagctttggctctttaatcttgggcaacttccttaaaactgagaaaacagacgctaagaaccctctacaaaaaacagatctgagataaaaacctatttgtgtttacagcaagaaagtgttgaaatattattcttgattacagtgtaaagctaaacacgtgactctgaaggccacaggggcaggacatactgagtcttatgccaacgctgactacagatgcagtcagaggcctcagcctcctccacacctccatccatgtgtttccaacaatttgcaactgacatggtaaaggacgactaagctctctgtatagttatttgagggttactgatgtaagaaaggatgacaaaaataaaattaatttgatgatagtttgggggcatttaggctagtttcccagaaggaaggaaagaatcgaagactcagatagaatcatgcaatagatgagcttaccagagtgtgtgtgaaggggcaactctgtatattgggatttgggagtttcagagcataggtactgacagttgattccatgaaattctggtctttgcagagccaaataaatctagtatgggatttcccagtttgattgccgctgtggtcctgagttttgtctaggcggtcgtaaggcactccccaagacataggaggatctataagtttagtaaccatactatcatctgttaaacagagtcacacaatgcaagaaaattctcctaaccaagaagtctatatttgataatatgcaggaataccttatgcttgtattaagactagaatctggcagctaataaatacattttcttaaccatcaacattatgacgttgtttgtagccaagagtgttaaaactgagggcatcatgttaggagtacggatcattttacaagtcgtgaatcaaatttgtatgacaggtttagtttatgcatcatatttcttggagatatacttgaggaaaaaatatacaatgtgaaagccaatgtgaaaaatgtgtatcattttcaggaccacctataaagtgtaaaagtgaatatcatctttgctgtgaacttaaaattgctctaaatcataaagtctattttaaaaagcaaaaatcaacaaaattatacaatagaattcaaaagctacaaattttttttctttaagatactggtaatattttgtttcctgatcaggtactgcttacagaacattcatgtggggaaaattcattgggctctgccctttggatataaatgcctttctgtatgtacactttccttcaatgaaaagctttttatagtttgaaagaatgaataagacctactatgtgatagcacaacagggtgactacagtcagtaataatttaattgtacattttaaaacaactaaaagaaggtaattggattgtttgcaactcaaaggataaatgcttgaaaggatggataccccattctccatgatgtgcttatttcacattgcatgcctgtatcaaaacatctcatgtgcctcataaatgtatatacctactaagtacccacaaaattaaaaataaaaaaattaaataagtgaatatcatcaacaatagaaagttgcttaaacttatcatcatatttcgtggacaagaatataagaaaaagacacagctgggtccttctcagtgtaaataagatgctgaaggctgactattgttttaaagataacctatatcccaaatcagcaaaatcctaaacaccagggtcctcatcaagaatagaaatgaactacagcattgaagatgctgcctctttagtaaaataaccaatagcgcaccagagaaaatcaaatgtttactatttaaaatttaaaaaaacatttttgttcagttatctttgtatttttttcaagccaaggcatagaaatccttagctcatttttaaatatacatccagaaattcccattcatgttaagggattcagtgccatatgtaggaaaatcatataatagaaaccagcttttcctggaagtgaattaaacacttggaaataatttcagagtttatgacaacttccagtagcacctaatttagagccagatctatgtttattagaaaaagctgtctcaagatagaaagaaaaagaaagtgtgtggatgtctgtgtgcatgtgtgccagcatatagttctatggatggagttaggaagagtggctgcgctggtcagagaagaaaatgggatctgagaagtcaaaaggaggaaaaatggaaaataagtgttcataggaatttagaggaaaataagaagagaaataagctacttttctaaagaaaaatttgaagacctgatttggaggcacatatttactggttcacctgttacactggcccctaatattttgcagtttggggtacttcctaagactggcatttactgaagcagaaatgtttccatggcattggaaacctttaaacattactgttaggaatttagtatcttaataaacaatattatctctatatcatagcaaaagttagtaattcatttttatgaaataggtgttattttttcaagcctaaataaaatccctcaacttcccatcctggtgagtcctgcctgaccagtgagagcttaccttgacaagcaatgattcacaacatgttatacaacgaaggtcaagaaaacacagtttcagaagaaatgaacaggtataagcagtgggatattaaggatgttagtaatcaagacagaaaagagaactgaggtgaatattttgcctgtcacagaggattgaaatataaaacacagagactggttgcctaattatcagaaggcagttttccactgatctttcctaagcttttcgtatttttaattttgaagtggctagatttacaaatgaacagaaaatttcattctaagagcctaactttatatctacaagatagccaactagtaaatcaagaaactgcaagtatgaactgaaaaatgggtgtgaaaattgattcttaagtatttgtttaagtttacttgcatatctgatggagatttgagtattacaggatgatattataaaacaaaacttaaatagtacatatgtttgaaatttaatattctactgtaagaatagcatatcagagattaaagtgatcttactgaagacttttctacactcagtactttgtcaagaacttcaggtgattaggaaaaaatgtgtgacatggacaagcaacaggagcgggccacagttaacagtgcaaacgatgttagactatggtgtgaaaccaatggagagcatttgagtttttcctttggatgtggaatgtaagtacagaaactattcagaatcaagatatattagcgtcaagaaaaatttcaaggaagacaggtaacctaacttgtttcctaaggtatgattagaatttaagacaggtgcattcaagggaccgggatgaacaaaatagtaggcatgagggaaacatggcctccccaagggactgccaacagaaatacacagctatggcagagggtgtgtgtagaagaggaatattatatacagttatgtttaggtttgattctgatttctaaagaactaaaaaccaacttgatgcaaggggtgttgagggctgcatttattatcacagaactattatagattgctaaagaaggcatataacaaactagtattttcagaagatctttctggaggtggtatgcagcctgcattataggaaaagtaccttctgttagggagatgagccaagagattttgactctaatctagtcaagaggtgctaagagcttgcactagggctgcgaatgtggagacaaaacctcaaatctgagagagatattttaagtaggaaatgacaagactcagtgacaggttgtgtacaagagataaaggtaaaagacaagagtaaaaaaaattgacttcaaactttttttccagtgactggaagcatgacaataccaggtctgatagaatgagagagttgtagtaacagtctttgggaataaaaatcagtcagttgggcttaggatttagtgagattcaggaccacaggattctggatgtttttttgagtgcatgcaggtgctgttctgactcagactggacaactatccatccttctacaggagagagagaaatgacgtaagtgttcttcatggagtgccctctggaaaaccagggattggtttatgtgcacccaaatgtatttatgtatttcataatacccacaaatataattgttacttactaagcacttaatatgtatgaggtcttgtcctaaacatatctacagagaattttttgcccctttaatcctcataataatctaataacttaggtatcattaactccatttgacacattaggaaatttgtctaaactggttacataaatggcccaagatggcacaactagtaagtgaggagacgatcttaagaatctggttggtctgagttgcaacagtcaaatcatttccaaaagtcatatataaaaggaagtaatggcttttggacaaaccctgaaagaaagccaagcatcattctttctgtttctctctacaatatattcttcacggaacccgaatttcagataggcctttctgaagccagcactggcagtgccatatcccattactcccataacttctgctagctctttgttatgtccatagtactttctggaaagtgtaagagcaaaagaaagtacattcagttgtttaaaggcaagcagtagtagtagatactcatcagtcaagagcagatcaattttatgctgaaattttcatgcaatggttcaatagaaaactataaatactactaaatacataaatgttctgaggtaaatatatcctgtttaaccaaggcacaaaatcaataattaagtaaatgtgtccctaaaattgcttaaaattaaaaatccggaactggatggaggctgaagtgacttttgagaaactgatagagtctcctggatatatgataactttttaaaaatttgcacaagttgtgttttatgaacttaatacccataagacccctaaagctcattgtttatagaaaataaggctgaggatggataaaagtctcaggactttagagagtttagtaagagggcagcctttttttttctttctgactctgccttaactccaccagagatccctggttagccttgtttcctaaatagagctttgagattgattaattgacttatttattaataattttgaacttggggatttaagacatttgctgtttatgttgtgctttgccataatgacaaacaaaatcacattcagctattcaatggtatttagtgtaagaataaaatgttaagggtatattgtcttatctgatttgagacatatgatatttagatttttaaaagtacagtctattgaaaagtgatatcctttttcctgtaaaagaaactgcctcttttcctgtaaggctagggtcaggatcaagaccaaagaaaaatgaataacttgtgaatggtagggctaggtgtggattctgaagtaccagataagaagaaccattaaaacaaaaaggaaaacaatgagaaaaacaaaaagcaaaaccatgaggaaaacaaaatggaatataatacaaggaaaggaagaattttaagatgctttgtgtaccagtaagagaccactagcaatggtaactttgaggacagtggttctcatgactggaaagggtagaagacagacttcatggagattaaatagagaaagaatgagaggattcaaatacagaaaattctaacagctttgaaagcttttccattagaaaaggcagcaatgcatgtttttagagggttcaaactgagtacacacttaaaaacattgattttttaagaactaaaaaagaaaatatgaataataaacctaagacaataagtttgtaatttatgaagaataggtaaacaattggagatacaaagaagaaattatttctaatattatctaatctcagcttatgttaaagttaagatataaccagtgaaatattcactatatgaaaaaaataagaggaagctccctgcaaggtctgaaacaaaaatgacatatgtttgtaaatgcttagcaaaaaaaaaaactggtttttaaaaatctacatgaatgtttttaaaaatgaagtagttatgatcttcttaaaactgggaattcaatgtttgagtaattcatgtgtaaaatttgaatcatcgttagacattttattatactaaccaaacacttttaaaaaactatctttcataatgagaaaatttcaaatgtaaacataatttaactaatagctgaaaatgattgcagaaaatgtattcatttaaaggaaagtacttaattgtatttttgaaaagtaagtcagttgtttttctcatcattctgtatgagtgtgcatgtgtgtgtgagtgtgtgtgtatgtgtgtgtgtgagagagagagaaaaagagagcatttaagagaattgtttaagccctgggttgagggtggggcacttggggacacagtggagacagttatttacttaactgattcagtgcctcctactgttttattttgacaaaagtaaaaactttagtcctgtaacacgaatactcactctaagctgggaaacaaaacctcagccccataaatattttgtactacattatcaaaaatagctattattgaaaatgtgtgattctaattaacttacagaaattacacatataactgtagaagtaccatctaacaactgcattcattccaaaaattttttcaagctagatttgacagtcattcaaaccaggtgaaattcccaagtgtcccagaaaagaccaatttatctcttcttacttaattgtgaacaccatcaagacaagcatttacatcagtctctcttataccccaatgcatgatttaactgaaagaggaaggcaacaatatgttggaagaagcgtaagatgaatttttagatgcatcaagacctgaataaaacacggtctacttgcccttctatctagtcacgtggtcaaggacaatctgcttaacttttttggtcttagtcttcactatgtacttaaatcattgaagctcattgttcatttttctaacccttttaagcccatagattttatgactaaaataagtttacaataagcaaaccagaaaacccttattaaacagggttgtggagtaaagggagagctgagttctacccaaacagtatcctattcttattgcttactcctagccatggcctctgattaccttcctgggaacctctaacactccatggaacacagtttaaaaaccataccatggtatcatctcttagattgtcaccagctctaaaattcaggactctatggggacaaatctgaccctgagcctatctctttgcaaacaagctgaaatgagaagtttccatggttttatgcttacactcagtttcaggaagcccttctagggtaggactttcagagagtatgatatacacgtcttcagtgtgggtgaatgctgggatttgttttccaatttttactcactgtgatctgacaccaaacacaatgcagtcctgtcaggccctggtaacatttaacagttttgtggcacttatcacacttggttgggcagttaccttcaacccagtaatggtgcatgacctagaacagaatgacaacattgtgataagaggacacactacataatggccaccttcagaaagcaagcatgcacacaaacttacatcagtgttccttttggacttcacataggtcttgatgcaagagggaggtgctcgagccacacagcgctcatggactgtgtacttgcagactgaaaggaaacaggtacacaaattcagagctaatcctggtcctggttgtaattttatagagaaagaatgacattaacagaacctcatttcatatccactgctccctaatcaatccaatcagccacatcaaggagaagtccaagtcgactgtttttaccatggaatataaaaggccaattagtacaggaaatattatgcatgtgaaaaaccaaggctcctctatcatggcatagcaggaaatgcttaattaaatcagtcctcactcaaatttttcacaataattcccagatgacaaaaatattaaagacaaattgatgactgccaaatggcttggtgtcatttgctagaaggaagagatctatattttacaaagtataggcatgagagcagctggcgggtatgggaataaaagcccatgagtttatgttattttgtctcttatctaaatcttaaatggctgattagtctatttccagagaagagatttcatcatacatgccaggcctttggtgaaaattcatccttcacttgccatcatggcatcgtttgtccaaaagcaacagcctttgctgggcggcatattgtatacatatggaaaaatttatgtcactatgcaaatgtatacctacacataagcaaatatatgtatctatgtatatatataatacgtgtcagaaaaccaagacatacatttttggcatcttcaaattctttatggtttgagtctgaatatgatttagggtcaactacatgtgttcttttaataaaatgttggttccagattaagggttctaaatgcataaatatataaaacagtacttaaaaataaacatatagcctcctcaataaaaacaaaagcaaaaaactaaccactgcctcaaattaaaatgaaaaacactaaatctaaataatatttatatagtaaaactctcccaaaatattcatatctgtgattttctttggcaacattgagggagaaaacatgttttctcttctcctccgtattaaaaataatattgaatattgcattcaccacactaatcagtaaaaacttatgagcaaaattctcattcctcatataatatcactcatcttatttgagacttatcattttgttttatgtgttcttgttaacagactgtaccataaaaattccttttcttaaatataatagaactttaaaaacaaagtacttcctttgtatagggagaatgttctagtgtaactaacatgtaactaaactttcaaacgtagctgtcagagactatgttacacatggcaaatttcaggtaactttattaaaattcgtaaatagttcagaaatcatatgcatatgtggcattaaaacatggtattaaatttcaagtaacacagctgagagaaaggaaattctcaaacatattaccaaagaagctgctagctaacgacaaacaaacaaacaaacaaaaaacctataaaccatggatggtattggaagccagtaagaaattagatttaatgaaatgcacaacaatggaatgtatctaatgaacttgacagtttcagtaattctgtacaagctgaaaaggttggggagagataaattgatggattaatggagaacttaaatgaaggggttataatatctacccttttttatcaggactatcatggattgtaaaattttctcaggtagatatgctgtagatttaaaattacttaggtgattttataaactaactgttatatacactataagaacattctaattggcagacctgagttaacagaataaaatgaaaattgcaaagatgggtgaactgaaatttttaaaatggccacgactcattaatcatcaatgctctgcattccaatgtctattaaccatatatgaagattttctttctgttagcattgaaaataataggcttgaggtgtaaaattagttcgtatatcttgcgatttcctaattttaatgcaaatctatttttaatcaattaatgtaacttaaacaaaatacccaaaggaatcaactcattataagatgttcatgtgaataaagtcactaacatgtggggagggggggatgaatatgaataagatgtaagtatgaaaaactagtggaaatattcaaaataatccctgaagaaatgggaaacatgaataaattaaactacagtggaaagaaaattgctgaagacttggaaaatgtccttcatttttttccaacggtaggtttttccaaaactgaagaaattagagtaacctaaatattcaaaaacacactacaggaaaatataaatcacatgtacagagacagtccagatcagatcttaggtctccatttacaaataagactattccatgaaatcaacctttcctcacttgaggagatgatgtccaggcagagcaaatgtactcacaggaacagcagaggccctgcttccccacgccaatcagcatgttcaggcaaaggttgcaataggcaggtttgttaaagtgcttcagtcgccacacgtgctgtccatcatccttcacgttctgcatgggacgtaagagaaacagatttcacttaatgaaataaacagtgaaagatgtaagtgccaatgaaattcagagctggactgaagcatgtgaagacaatctgttatttcatccctgactttctccaagatcaccgcagagcctttagaaaaacacatgtgctccagtgaaatgagatagtgctaacaaatcaccgatgctatagcaacccacaaatccttgtctaatattaacagctcaacagcgtaccccaagccatcgtcatgacctgccaaatggatcagggacgtgattgcctcttctttaaatactttatccttagcacaattccataaacaaataaataaataaagagaaagagaaaatacccttcagtggaacagcctgacaaagaaaaacctgcaaagacgtcattaacccttgcttactagtagtaatatacaaaattcatgatggtgatcaggtcatgtaaggtggcagaggaatgggatgggatggaaaactaatactaaaaggtaagttattggtgacatactagggcttcattcgaggagtccttatactatattccaatttatattaatacattgagtatgccacaaatagtatattttaaaaggcaaactttttaaaggatttcattatgttaccattttgtttacccccttataaaatataagtagttttaatctcacagaaagatggtaaaaatattaaaactgtattaatatttttatttataacaatcactatggttatttgccacaatacaaccttgggtttaaattaattcccactttagcaaaacactttatttttttctcttctcagtaaaactctctatatcataatagctactcctgtaggtatttaatcacagctgcattgttcaagattaaaataaaatgaaataatatgatgcttaggaatttcttgaactccttacaagaaggtcaagatattaaatgaaattattatatattattacttttgctaccatcattttctccattaacatgtactgtttgtagtctaatcatcaaattatatcaaacagattaacatttattggtattctattgaaaacattatttgccataactttccaggttgtccaagttgtcatatttcttggaacacattcacctaataatttctgagcatgttttaagtgcttgggcattaacgttactcctgtggtagtgaggcaatataaatatattcagatcatcttgtttctcttgataataaaatattaataataatgctcctaactacctttcctattcccagtcaagggataaaccaccagatttgtaatactagagaaaatctacagtaactaattcttacattagaaccagaaatgtcaaatttgcctcacaacatgaaacattaatgaaatgcttcctgggcgataattcttggtgggtctcttgaatttcttcatgttttgcaaacagaagcactgtcctttctttttctttctttcttttttttcttcttaagactatcttttcaaagatgtttgagtaacaaacagcctagccttggacaatagagacatgtctccctccagaggagagggccagtttgcttactatacttacagtataataaaaataatcactcccttgtaggcaaaggtgaaatgggcttgtttcctacacattataattcatttagttttcttaagtcagggtttccaaaacgtgatgctgtgcacaatcatcaattgggtcccactctgtcgttcccatgagattttggaggcaaggtgaactcaaacgtgaagctcctgttgctctctttgttgtgaataacaaagtctattgtctctgactcaggagtctcatgtcctctggcagcatccataaaactgtggcaagctaatacattaacttccaatagggtaaattttggaccctttacaattcttgacattgctcagatttacctttctgacaaggggctaacaaagtctcaacaaatacagctacgcaggtgtcatacagaaaacttcagaaaacacaggtgttttaattttctttcaaaacctaagaaataggctttgtattaatttctgaatttcctattttggtttcggtgagtcatagatttctagtagctttatcacgtgaatagaatactttatatatttaactttgctatattttcaaaactgcctacattttaaaatttatatcccctcaaataatatttaaacatccttatgtggaaaggttaaatatggggttgttaatttttaaaaaactaaattaatatttaaaaaattaaaagtagtagctaagtgcttaaaaacatttttaaataaaaaggacaaaaagctaattttcgtatatattactgttcttgtaattcttgtcgttttatttttaaatgattgtccattacatgtgaataagcttcatcctttgaagagcacatatggagtaagttagctggcattttccttatcaaaaaataaacaagtctgaacgtgggtgttctgtcaatcagaacacttagccgtgttacaggctgcaactgatgtacaaatccattacccaggcataaaatgctttaccaaaaaacaaattaaatggctttatagctcttagctggatacattgccaaaatatgcaagggatgaaatatgtatgtgacttctttaagagaagaaattgaaaccaggagccaattacttctcagcagtgcaaattatactccaactctctattttcatgtcttgtcttgtttatcttacttagatcgtaaacttaatgggggagggaaagaatctgtcccttctttctatcagccagtagagcacattcctattagtccttccactgcaaatatatatttattgtcaaaaaagggaatttattttttataaaacaaaaataagcagggcatccagaaaggcttgattcctagcctactatgaaaatgtgaataagccatttcacctttcttcctatttcttcctattttcctctcgaatgaaaggaaaatacccacttcccttttccaggccgtggtgtgaggtttcattatacaacacctgtgaagttaatttggtttctcagaagacgggtgttatataaacagcaaatattatcaccctcattgggttgtgttgtgtaacatcccaatttttcagtcaaaataattgagaaagatacctaaaatttcactttatttcattaaaatgtgctcttttttcatcaccagacataacactgtgtattgtaatgaagctgttcaggtccgtgtttatgacagataaatgcttaatgaatcctaggctactccatgctgagaaggaactttacattttccccaactcttagttgcctacaaggcaaagggatgtttcaaaggaaataatgctcttcagaacttttaaaacctattatcctagtgattctaaagttttagtttttccataaataaaaatcattatcctagtgattctaaagttttagtttttccataaataaaaatctttatcctagtgattctaaagttttagtttttccataaatacttccaagatcacataaaatgttcaagtgaactagggctactataaataattttttttcagaagacctcaaggagaaatttcattgatgtcctaacccacatgcttctctccccacacctagttatgtttcaactgacttaacttatatagagagagagaggagctaatgttacaaataattacttccaactcattaaataacaaagaacattaaattaccttactttttgtccaaggtctccaaaaaaaaaattatgacaatgtgacagaaactcctcttatttttttttttttttttttttttttgagaggagtctcgctctgtcgcccaggctggagggcagtggcgcgatctcggctcactgcaagctccgcctcccgggttcgtgccattctcctgccttcacccactgcgcccggctaattttttgtatttttagtagagacggggtttcaccgtgttagccaggatggtatcacctgacctcgtgatccgcccgcctcggcctcccaaagtgctgggattacaggcgtgagccaccgcgcccggccgaaacttctcttttagacaaaaagatgagctctattaggcctgggcaaagagaatgcagagaaaagttttaaaattctgagtggagctgtcatcaactgttcatctccagaccacacattgtaaggtcacctgtcattcctgaggctcaaatgcaaaatcaacagcaggttacaccacgtagtcatttttcttaaatgacacaatctggaatctcaagaatttttgcattcatctagttttgtaactgctttctacattgagcaaagtatagacagcagaacaaaaactcttaaccaaattaaaaacttttaaaaatcgatgtgctgaacatcagctcccaaaatataatacatagtcttctattctccatcactcaggaatttcatcagagaacacactgcatattactttactgagagtcaagaaaaaaatgtgtcttaaacaatctcagtcaaaggcaaagtttaaatgacctataagaattgaagaccaggatttttggcacacatatagtgagaccaaagtataaaccatccagaaaccatgcaggctagatgtgggtacaacaatccacaataacaagttaaggtatcgctatttcaagctagtctactgcttaaatgtacatttctcttttccctataatataaattcaggaattttccttgaaaaaattaaatgacgatccaaagttagagatttcagaaattgaagccttattaattatcttgttcatgcaggaaaaggaaatgttcaaactgaaagagtattaggaaacactaacttctcttcttggctaacttctcgtttttccggagacagcaactgcctggtataaaaatgacctagttagttaataacagagctaaggtctgttatctgatcaatttgatgacgttcactgctcctatgctttctgtctattagtcctcatgtcttgctgtggttgtccgattgtgccaagtaaaaggtattagattcctttcttccaaatgaattaaaataaattaaaactttttctgttttttaatctgagaaatgagtgatagaacagatcagcggttggcaaactatggcactgagtcaaacctggccagcaacctgtttttgcacatgcagttttattaaaacatagcttttgtggttcatttacataatttctgcgattgcatttgtgctggaacagcagagtttagcagttaaggcggagaccttatggccccatagccaaaattacttaatatctctccctctgcagacagtttccaatcactggaacagagtttacctctatataaagttattcaacaaaaaaagtgttttaattacattggatttttttaaaaaacaattctccaatgagatgaattctgaaggaagaatgaataagtctcaggtataaattttcattgtggtaatcagaatcacaaagccatccaaattctcaattttccttcaaatctaagagacactaacactctataccatttctgacccattcatcttgtattttgtaaagtttgtagagcctcttgtaagagaaaagatatggctcttgctctctgctatttggtatagaatctggtccccatcaactccatttctgattttggtaccaaaatagatattctttaaaatagactagtttttaaactgctgttgctggagaaaaataaattgcattgaaatcgtaaatgttgtgccttacattagaagtgaagattactctcccaggactacttccttttctgtgtaatttgactaggacaccacagtcactttcaaatacactgtggtattttacatgcaccatcaattagaacctactccccgagctcataattgacaatagacaataacatataggacaacctaacaagacaagcttcacaacaaatggccaacttcaaactgcagtatctagattttcaattaaataagcaaaggtgaggggatagattcatggatcaaattctctacaggtaataatgtaacacattaactgcctacagaaaggaaataaatctcaattgctaaaaaaggttctcatcactcagttgtcttggtgtcattcttgctttttaaaacaattaccatgccttagaattcaacagctctttctaacaaatagatgctgtattttgtgatcattacacatgattatatggcttatacattttattaaaagacagcttaaaatgtaggtggcttacttttttcacaaaaatgaaagaaaagggaaatttcttcttttaaagttgttctttacagagatggggtggggggcggaatttagtctcagatttaaggtggtctcttgagattaaataaggtgcctctgccatctagcggccgtcactggtaacacaactctggaacacagctctgatagctataataaaaccttagatttctcctatttagctccagacactcccttttactaaaaacataaaaaataagtttacaaatactattaaaaagtaaattatgtacagttaatagagtgcacattaaatgcatagaattgccttacaattgaaataatactacactagaaactaatgaggtattatattggtttaaaatactttgagttaaatcatatagatttgtggactctattacctgtgataatttttataacttcacaaatatctatatttataaattaaataataaataatatatcagcagtagtttccaaaaaaaatcatcatttcaaaaaatctcttgtgacatttaaaatacgggcaactgactgtccctttctgcacttttctatctcaccctcgactaccagatgatttacttgctcattcctgcatcttccctccttctctcatcctagaatttacatagatgcttagaatatacaaagtttagctttacaaacataaaatgtccttctcgggaatcattattattggaatttcctgactaaagttatctgacaatttttcaggataaagtatacattaaaccttaaaatgtcaacattttgtcaatttttcttttgttttctcccagtagtctgatttacataatggtttttgtcataaggtacatgaacaattaaataaatattgataatatagagctaaatatggtattataaaaaaatactcagttatgtgtagtataagaaattcaggtacaagaaaatactatttcacaaaatttttaagtgtagaactacatacttattaacaataatatatatattatattttgtttaaataaattagtttaagggtaactttccatatatcacttattagtattttattgttttccatcctctgaccatgtcttggatcccatgggcctcatgaaaggtaagcttcaactgagtttagaagaaatttgaagacccaggtaaaaaagaaaacaaatagtaatctcttgaaacctattattttttcctaaacttatacatattccttaaccctcagctcatttgtatattcctaaagcccatttatatattcctaaacccatatgtgccaacatatttttatatatactcatatgtttcacaaacacagacagtaagttatcttgagaaatgacttttaaaaatttggtgtcttgaataactatgatatagtcttgaatctgtaaaaatatttcagctggtaataagaagtatgaagagttttgggtttggcagcaaagtggtgaatactatggtcttacaccttaaaactctaaatattacaatttcattgttctttccacccctaatgttctttgaaattaagtagacatgttattctatacatagtatatctaattattgcataactattaatgctgaatttaaaaatctggcatacactatagatttcatcagatttttagaataaaaataactgaaatctgcttcaagtctgggtcagcaagatttgctttcaaagtcattattatattacattctcatcttaggttgatttattttattccttcacaatggtatttaattgcaactagaggaactactccaagaaaacttttgacaggcgatagaataagaacctggctcctgctgatacaggaaaaacttacgtttatttaagttggtgcaaaagtcattgcgttttctgccattaaaggtaatggcagaaaacgcaatgacttttggcaccactaatctttaaaccactggagatatttaactgcctcctccaagtatcagttttcaataaaatagattacctttataggtaggaggaacattgaaataatgaagcaccaaaagaactgcaaaatacaataatactggagagcctcttgctttagataatatgaggaggtcagtaacttaaaaacactagattgcaccttcaacagaggaaaacaaaagagagagaatatatttttaatcctgaagtaatacctggagtgaatcaatatgtgtgtggcaagtattactacacaaggagttactgtcaaattgcaccgtggcatacttattaaaagttccaggcactcactgcatgcttaatggtagaaaatggtcacatcaatctgtaatcaaaatgtgtaatagagagccccactgactcaccaccaggccaccctcctctgtggaaatgcttacattttctaagcccaggagcacaagaagtggaatcgttgtcattcctccttgaatccattcctccagagacacggttccatcatgatcatagtcaatttcttccatcatttcatggaggatctggagtagaggagataagggaaaattggtggtcaaccaataaaataaatttcataggctacaacatatgaaattgtgactaacagctaagtggagagttgggataactgtcttgctaactcagtacaacattaattctattactgatgaagagcgactttgttagcatttctaaacctggccacttaacactgatcactttttagaaataagtgcttaacttttcaatatttttcccatgaacagcacagctaaaacaagaagaatctttaataagtgtgaaagtggtctttaattactttcttcatattattttttagattcatatatatgccagaaaatgtctgaacaaattaacttcatggcaaagagctcatataattctttgctaagtagtaaggggcgaaggaatttagttgcttttaattgcctatcagaatttaatagagtcgagaagttaaaggatcaaatcaagtttaattaaacttcgtttctaaagatgacttgcacgtaatgtcttaaaatgttctctgcagtgtttgtttgcaatacatttacctctctgtggtatggtggcaatatcagtacttacctagaagggctgttgtgaggattaaataagctaacgtattataagcagacgagcccctggcatacagagtcagagtcatatagtgttgtttgtgctattattaatggaaattatatataagttccaaacatattacccttggttgctgggaaagcaaagtacttcccatctaatggcgtcaagatggcaaacatggtaagaattctaatgaagaaaggaactcacgtctttatataatacaaaaatgttaatcaatttggaaaaaagagaaatgcagagagcattggaacagagattggaaaagatgcaatgcatgaaatatttgatttgttggtagaagtattgtctgcctagacactcttgtgcttggtgtcttcactcaggaagtattgtatttgaaaattagattatttttctcctcttgcctctcaagagcttgctgatgaattagtagaaatgtatcaatcataagagaaataaaacaatgacatttgtttcagatgggtgatgctttcctttttgtacctaataaatctcatgttaaagccatcctctgaccgtgtctcaaatcccatgggcctcataaaaaaataagattgaactgagtgtagagcctgagttaatttgataaaaacttctagggacgctccagtcttccctactactattgtaatcaacctcaaatgttcatttctctctctctctctctttttttttttttttttttttttgagatggagtctcactctgtcgcccaggctggagtgctgtggcgcaatctgggctcatagcaagctccgcctcctgggttcacgccattctcctgcctcagcctcccgagtagctgggactacaggcgtccgccactacgcccggctgattttttttgtgtgtgtatttttagtagacacagggtttcaccatgttagccaggttggcctcaatctcctgacctcatgatccacctgcctcggcctcccaaagtgctcggattacaggcttgagccaccgagcccggcccatttctctttatttatatatgcaaacctatgagaagcctgctgatgtgtacatttgtttacaatgagaactactgaagccttaggcaagatgacaaggcagttcccatgacagcagacataatgtacaactttgtaccatttcagctccctggaatagtagcagacttatcagtaacacacatgtcaaataatgctatagtttattacttgtattctccattcaataatctgacaaatacactaggtatttgttgtagaaagactactcagccaccagctttccccttcctcctagcatcctgatgtcctttttctcaaatctacaaacacaccccccaacacacacaccaaaaatgcttttgttgagaagtgttagtgcccgctgtttagaaacctgaatggaggccgggcgcggtggctcacgcctgtaatcccagcactttgggaggccgaggcgggtggatcaggaggtcaggagatcgagaccatcctggctaacacggtgaaaccccgtctctactaaaaatacaaaaaaaattagccgggcgcggtggcgggcgcctgtagtcccagctactcgggaggctgaggcaggagaatggagtgaacccgggaggcggagcttgcagtgagccgagattgcgccactgcagtccgcagtccggcctgggcgacagagcgagactccgtctcaaaaaaaaaaaaaaaaaaaaaaaaaaaaaaaagaaacctgaatggaaaaacaaatccccctcccactctccatctaataacaagctggcttgattgacagatgactaatctgcacaggtagaaaggtgagtaggagaggagaaagctgttgtcgattacaagggcaacagaaataatcagaaattcctggctttcagtgaaaatattaaggtgagtcaaacaataaattaaatacatgttaccatctactttattattccacatacaaatgacaacctgttaatgacatctgccactcactagaagcacagcatatgcatttcccaatagctgctttaaaactggaaaaatcctaatcccagtaagacaggaaaatgctatcagagttcttgcagcatatactcatgccattatcctgttgtttaccgcatagatgtgaacagaggttaaatatacacttcttgaatttgcataaaatgtaaaatcatttaaataaaatttatttgcattgctttattcatatacactttgctaaaggttttaaaaataatataaactcaatatctcttatcaactttccccaaaatattttttgtggccaaagttatggtttcaagtcaagtatattttaatatgtattttaataatgttgaaattttgatgtttattcaaaataagaattctatattcttaaaagcatttttagatactctttctctaaacaatttaattaaaaattcctgactagctgaagagctttgggcaagtaattttaacatatttgggtctcaatttacttctctgcaaaagggaaaaaaaatagtgtatctacctcagagagttgaaagcaatatataacatatacacaaggtaacatgatgcactgtgcatggaaaactaccatcttcttttatggcatggcatggccttggcagtgtctatcaggaccttctgcttatccacatgtatgtaagaccaccattcaaaataacttccacgaggaagaaagcaaaagttactgttaacagcttcagaaccccacatataccttgttatcttattcagaatccactttgacttctgattagaaatagtaacttagttatcaaaagataaaatgaaatgacaggaatatatcagggtcccagacaagagaaaaaaaaagaaaaagaaagaaaagaaaaggaaggaaggaaggaaggaaggaaagaaagaaaaggaaggaaggaaagaaagaaggaggaaagaaagaaagaaagaaagaaagaaacaaagagaaagaaagaaaggaaggaaggaagaaagagaaagaaaggaaaggagagagagagaaggaaggaagggagagagagaaggaaggaaggaaggtaggagggagggaggggagaaagaaagagaaagagagaaggaaggaagagagagaaagaaagagggagagaaacagaaagggagatagaaggaaggaaagaaagaaagaaagagagagagaaagaaaaaaagaaagaaagaaagaaagagaaagaaagaaagaaagaaaagaaagaaagaggccttccagaatttagccaatagtgaaatcattcatatacctactggattaagttcagtgacatcccactcaaggtattctgcaacatgcatcatctgactgatgatattttctagctcctggaagagaaagagagataaaaaatatgaatacaagatcttagtgagttttaaatctttcacttgcagaaattgttttgttcaatgtgtagctaaaaaagttaaatgagttctatgggaatatatatatgtacataatcctttttaaaggtctaattaactatataaagaaaaaagaatcctgaatataaatttatcttgtacattgtctagaaattttcaccaggagagggcacaactttacaaaaaatacattttcttctactaaaagagagtgtctgaagaaagcaggaccaaatacatactgtcacatgtgatttttaagacactgaattccctgaacctttggcttgaaaatagatgtgaaagggtggacaaatcatttgaggacaactgagaagtctatttttatcttgatacactgagaatatacattgactgttttagtcatgtattgaataatttgctcttgaaagaagagtgttcagggccaaggtttgcaggacaagtatatgcagcatttattttgtgagaggatgaaattttagtttgaatttccatattattctgctcaattatcaactctttgaagaattgcaagttaatacagatgacctggctaaattaattaaaacattttcctgcctatttatctaatgttttaatttttctctacctacagaaaagattaaacatggctttgtgaaatgcttgtaatttcacatgaaaacattacataatttgaaaagtggtgttttaccgtatgatttaaaatgtaagaagtataaaagaataaagcttgaaagtgcaatagtcaaagagtattctactcaaatctctaatctaatatatgtagtcgatgttcatggaatagagaagaaatacgataaaacagattctcttttgggaagccgtgtttccctccgaggaactaatgaaagctatactccctctctccagaaaaaaaaaatataattatgaatatgttacttaagtaagacaggctgccccagaagtaatacaaagataaatgtatttattacagattaacaaattttaaaacataaatccctttgaattataggttaaaagtgtgcatgtgtatgcacacatgcattactaatctctcacctactccatctttgcttacatatgccttaatggtttggaagtgttaaagttcccggatatcttttaagaacagaaactatttttggtggactgttacgtaggcatgtgatattaggtaagccaccccacctaagactcagttttctcgttggtaaaatagctactctaactttacctccttcatagaattgcttcaaaggttaaacatgttattatacaaaaggcatttattttgttgtttgccgtattgcaaatgatcaacaaatcttaactattattattagaaatagtggacaattttcaaattatcattttctttctgttttgcctccagtaggtgaactgctacaccttaaaggtaccaagacacatgatgtcagaaggtacaatttaaacctgacagcgaaggaaaaatattggagtagtagctattgtggagaaaaccctagaaatgaaatccaggcctttaattacaaaaaaatagagactagtttaatcaaaactaaatatatttatccccaactcattgtttaatattgggactatagttctaaatattgctagtagtctactgtatatgctaacaaaaaatgggcagagacaaaaaaaaaaaggactatttgactgaattttcaaatcaactgccaacccatggctaaagcctagtaaagaatcatcattttaatttaattaaaaaagaaacattaaataaaacaactctccttgaaaatagaatttgcattagtgtagtcacaagtgctatactaagcatattaaagtatctagaagaaattaaaatttctagtcgtgaaatggcaccataaaatgagcaaatttattatgtagcttggtatttctaatgggaaactgaagaccactaggcacttaaaaataatagcatttgaaaaaaaatttttttttttttttttttgagatggagtcttgctctctcgcccaggctggagtgcagtggcacgatctcggctcactgcaacctccgcctcccgggttcaagcggttctcctgcctcagcctcccaagtagctgggattacaggtgcccactaccacgcctcgataatttttgtatttttagtagagacggggtttcaccatgttggccagctggtctcaaactcctgacttcaggtgatcgcctgcccgtcttggcatcccaaaatgctgggattacaggcataagccaccacacccagccagcatttgaaaaattactgagacttacagataataaatcccacaatcacagcatcaattcagagtgatggtcatttcctagagtaggagttatatattttaatctctctctggagaagctaatgtaccattatcctactcaaagttacataaataggcttccaacctcattgctttgcttttaaaagtctattttagctgccatagggtggtctatcagatgacgagaaaaactcactcattttcagagatcatgtctatttcagtcattattaaatatatcaaaacatttgtttttaataatattaaatacattaaaaatggtacacttcaaaatttccaaatgacacttattctattaatattcttatatttccttgatagaacaagaaataatataatatgcaaaatatgttaccaaacataaggtagattattggatagaacctgagatggaatttcatgcatggtactgatctgtgcactaagactaagaactactttctatttctctgaaagctagcaatgatttccatatattacaaataaacgtttaattattcccttcagttaatcatataaagatggtattttcttattttttatgactataactatacaatgtaaaatgaatattaaactggatgagatattttaaaagcaaagtttgtgaaagcaatctgtaaatacatttacctatttcagccgcatataggacaaaagataccatgtaaaactgggaaaataatgagataattaaactgactttatacatccttaaaattctacttatagtctcaagtttccttaatgccaaatgttacagatagtttttccctcattctaaatcaatggtttcaacttaatcttatgttttattcagacaaggctggtgcctttcttttttttacctaacttcagtgcaggaaaaataaaattaaaaaagtcatgctgtggtatgcaaaactattcagtagaacaattgtaatcccaacagtttcctcagatcactctctcgcaaaaagtcaaaaagataaaaatgccatatgagtggatgtaaattacattaagtgtgccttctgtggtaataactacaaatttattcattgcattcttcagaagaaaatctttgaagttttcacagaaactttgaagaaaaaaattaccgagctgtccaggaagccattcccatccgtgtcataaaggcgaaacataactagaatgaaagaggtgttgaaaacaagattataggcaaataagatcaatgttagtttaaagtatattcattaaaatttagtttgtgttgaaaacaaatactaaattcctctcctgctccaaacaattaatttgtgggattatttctcaaactaaattgaaaatgaattaattagttaatagaaatactggatagcataaagtctatcaaattttgtttgtttctagaagacactaaaaagtactattatttgtttaaactctttattacaagatcattaaatgtcaactcaaaactaaaagagaagaagttgaaatattcaaagcctgggtattaaagagcagagtgcataaggaaaaacaacaaatgtgaaatttagaaatcaactataatttgaaatccactattcacaattataagagcttggtcaaaaacttttctttatctgtaaagtgagaataatcattctaccataacacatattaactgtgaaagttaagggaggtgatagacacaaaagtgaatgtaagccatagatcatgatacaaatagatgccattgttaggattgatccccaagcagtatgggcgaggaaggcggagtgcaaaataacaggttctttctgatggaggaagccagcacagaaaaactgcattatgatcatggctctcatggtttatttgtttaaatctgaggtggagcttcagagggtaactgatgtttgaactaatcaagtaagggaaaggagaacattgggtctctgttagggggttcaggaaagcagatgacagaggtccctgatgggcctgaggattcccttgtataattcacacatccccaggaggctgtggaggaggccacaggtgccattttgagataaatagagaagacagacacagctgtaaaaatagaagaatggaagtacgggtttgtcttgggtttgtataatttcctgaatgatcttgatgtctgaagtctataatattaataaagatgttgattactaagcagcataattatataatgaccctgatggtctatttgtaggtgattatttttgtatttaatggttactgcatttcaccaattctaacatattattattaataagatgcataattagtctatatattgctaaaaagaaaaaaagttagccatgtcactataatattatatttattgtaagaggcaaacaaatgttaaagatgttaaagtgtaagaaaacaaatgtctgtctattgacttaagggcaataatactaaactggctaaaagacttaaatatctgtattgtaaatcatggtaatgattccttctcatacagtcaataaataaaatgcagaaggaaacagcaacttacaacattgtggatactaggcatttcaagagattgtagtgcagcagcaaatagtgaaaaatatctttgtaagtggcaagaattgacggactactcagagaaatgattaactaccaggaataaggcaaatatctagaaaagcctaaatatatttcagattgagggacatttataactctgttaacccttactggagtaaatgactgcaaaatgaccatttcacgtcgctcaaatttgtggaaaccctgttctgatttgttgaccttaatgggaacatgaactcaaagaaacacacatgggtaggatatatatagataatgggcattcattactgacagtgtctgaaacttcttcctattttctgaaaatcacactttatgaagagcattagaaaatgaaaactctagataccttttctttactagcctgacttgaagctagactgtgtgcatggcccaggctccaccacacagaagcacagtcccaggttatcaatcagatgctagtgacctaagcaaaagaagcttgcacagaatcccttctggtgatgggaggcggcagtgatttcagagagaatatccagggttctggatgagtcaggggtgtttcgaggcaaccatcccagcccaatttaatacttcatttggtcatcgttcctgaaaaggcagcctctagaatttgttctctacctctcccagtgattctgcatgctcctaaatatcgcttaaaaataataacatgctttattaaaaacaaccagttgaaataaacccgtttctatgtctttcccaaggatagtgtgtacttaacgttggttttaaaaatgaacttactattgtaatattacacttacagataaacgtattatttaacaccttattaaagtgtacacaccaatgtaactattacctctaaatcgaaaaatagaattcttactaacaaatcagaacccctttcatcctcccccatcattattttttcttctctctccaaagacacccattatcttgacttctacatcttttcttttgaattgaattgaatataacatttagaaaatgtttgccggccgggcgcggtggcttatgcctgtaatcccaccactttgggaagccgaggcaggtggatcacgaggtcaggagatcgagaccatcctgtctaacacggtgaaaccccgtctctactaaaaatacaaaaaaaaaaaaaaaaaaattagccgggtgtggtggcaggtgcctgtagtcccagctacgcgggaggctgaggcaggagaatggcgcgaaccagggaggcggagcttgcagtgagccgagatcacgccactgcactccagcctgggcgacagagcgagactccatctcaaaaaaaaaaaaaaaaagaaaaaagaaaaaaagggggaggagccaagatggccgaataggaacagctccggtctacagctcccagcgagaccgacgcagaagacgggtgatttctgcatttccatctgagctttgaagggagcagtggttctcccagcacgcagctgaagatctgagaaccggcagactgcctcttcaagtgggtccctaacccctgacccctgagcagcctaactgggaggcaccctccagcaggggcacactgacacctcacacggcagggtattccaatagacctgcagctgagggtcctgtctgttagaaggaaaactaacaaacagaaaggacatccacaccaaaaacccatctgtacatcaccatcatcaaacaccaaaagtagataaaaccacaaagatggggaaaaaacagaacagaaaaactggaagctctaaaaatcagagcgcctctcctcctccaaaggaacgcagctcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagagctacgtgaagaatgcagaagcctcaggagccgatgcgatcaactggaaaaagggtgtcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcgagaagagcaactccaagacacataattgtcagattcaccaaagttgaaatgaaggaaaaaatgttaagggcagccagagagaaaggtcgggttcccctcaaagggaagcccatcagactaacagcggatctctcggcagaaaccccacaagccagaagagagtgggggccaatattcaacattcttaaagaaaagaattttcaacccagaatttcatatccagccaaactaagcttcataagtgaaggagaaataaaatactttacagacaagcaaatgctaagagattttgtcaccaccagacctgccctaaaagagctcctgaaggaagcgctaaatatggaaaggaacaaccagtaccagccactgcaaaatcatgccaaaatgtaaagaccatcgagactaggaagaaactgcatcaaataacgagcaaaatcaccagctaacatcatgatgacaggatcaaattcacacataacaatattaactttaaatgtaaacggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatacatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagaggacctaatacacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacagcctaacatcacaattaaaagaactagaaaagcaagagcaaacacattcaaaagctagcagaaggcaagaaataactaaaatcagagcagaactgaaggaaatagagacacaaaaaacccttcaaaaagtcaatgaatccaggagctggttttttgaaaggatcaacaaaattgacagaccgctagcaagactaataaagaaaaaaagagagaagaatcaaatagacgcaataaaaaatgataaaggggatatcaccaccgattccacagaaatacaaactaccatcagagaatactacaaacacctctatgcaaataaactagaaaatctagaagaaatggataaattcctcgacacatacactctcccaagactaaaccaggaagaagttgaatctcttaatagaccaataacaggagctgaaattgtggcaataatcaatagtttaccaaccaaaaagagtccagggccagatggattcacagccgaattctaccagaggtacaaggaggaactggtaccattccttctgaaactattccaatcaatagaaaaagagggaatcctccctaactcatttgatgaggccagcatcattctgataccaaagccgggcagagacacaaccaaacaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtatcgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacagagagccaaatcatgagtgaactcccattcacaactgcttcaaagagaataaaatacctaggaatccaccttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaagagagacggcatcgccaagtgaatcctaagccaaaagaacaaagctggaggcatcacactacctgacttcaaactatactacaaggctacagtaaccaaaacagcatggtactggtaccaaaacagagatataaatcaatggaacagaacagagccctcagaaataacgccgcatacctacaactgtctgatctttgacaaacctgagaaaaacaagaaatggggaaaggattccctatttaataaatggtgctgggaaaactggctagccatacgtagaaagctgaaactggatcccttccttacaccttatacaaaaatcaattcaagatggattaaagatttaaacgttagacctaaaaccataaaaaccctaaaagaaaacctaggctttaccattcgggacataggcatgggcaaggacttcatgtccaaaacaccaaaagcaatggcaacaaaagccaaaattgacaaatcggatctaattaaactaaagagcttctgcacagcaaaagaaactaccatcagagtgaacaggcaacctacaaaatgggagaagattttcgcaacctactcatctgacaaagggctaatatccagaatctacaatgaactcaaacaaatttacaagaaaaaatcaaacaaccccatcaaaaagtgggcgaaggacatgaacagacacttctcaaaagaagacatttatgcagccaacaggcacatgaaaaaatgctcatcatcactggccatcagagaaatgcaaatcaaaaccactatgagataccatctcacaccagttagaatggcagtcattaaaaagtcaggaaacaacaggtgctggagaggatgtggagaaataggaacacttttacactgttggtgggactgtgaactagttcaaccattgtggaagtcagtgtggcgattcctcagggatctagaactggaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaacactatgcagccataaaaaatgatgagttcatgtcctttgtagggacatggatgaaattggaaatcatcattctcagtaaactatcgcaagaacaaaaaaccaaacaccgcatattctcactcagaggtgggaattgaacaatgagatcacatggacacaggaaggggaatatcacactctggggactgtggtggggtggggggaggggagagggatagcattgggagatatacctaatgctagatgaggagttagtgggtgcagcgcaccagcatggcacatgtatacatatgtaactaacctgcacaatgtgcacatgtaccctaaaacttaaagtataattaaaaaaaaaaaagaaaagaaaagaaaaaaaaaagaaaatgtttgccaatcttttcttctcctattacaaaacaaaatgaaaaacaaaccaaaataacactgctggatttctaatgagattgtactgaacctatagatctgtttgggggagaatctttaaaatgctgagtcttgaaatctacaaccatattatattcttctttatttagagctttaatttctctcaataatatttcatattgttctgtatagagacctttcaaatagtttttaaagatttatttccaggtatttaaaaattttgatttgataaatggtaaaatttcttaaattttatttacctattattagttgatgtcatacagaaatacaagtgatttttatttctaccttgtaggcatagatcttgctaaacacacttattaattcaagtacttgatctatctatagattactgggtagtctataataaacaatgaatttcaatttcttctttcccattctcataaacttcatggatttttcttgccttattgccatgagcaatgatctccaacagaaagttgaactatacttagagtagtggccattcttgtcttgttcccaatatcaatgagagaaacttcaatatttcactcttaaatataaagtttgatgggtgtttcttatatatacacattattagattaatggagttctatactacttttatttcgctaagaatttttgctattacagttgttttgtttttaatcatgaatagaatgcatatggaatgtgataaaatacttttatgattttcttctttattctcttaatgtggcataatacattgtttcattttctaaagttaagtcaaatttaaatgcctgtaataatcccaaattgaacctggacatgttattttagctactttacatatataactgtacttgattgctaatatcttgtttcctttctgcttgttatctggaaaaatatatgaatggcttgtactttaatttctttaattaaatggaaaaagccatgcttccttctcccaaatatttgccctaaaaatccaagttgctttgatacttccctgaaaattttgaacaggtttttaaaatacacattcgttccaaattttccagttgattccagtaggaaggttggtctgaaaatccctacttcactagtgactgaagaaactaatattttaaataatttattcctaaacacattaacaagagttaatgctctataaatcctgtctaattcatcaaggaagaaagtttggagagttttaagctctagttaatataataacaataataaaaatatcatacatatattgagtaccaagtaccatatactctaaatattaccaagtcaaggtcaaggatagaacttttctttcatccagaagaagaaagagaaattcaaggactttaattttcagtgataagtctacttttctaatttaaaattgtagctaggtaatgcaaaacatgaagtattgaacacacatatttaccttggttttctattgaagtaccactatagtaacagtaagagatgaaataggtataaatctataagcagaaataaaatatgagaggagaaaacactaacacaattttcaggagctggagaaaatatgtacacatgtatattgacttagaggtcttagaaatataaatgtaagctggcagaggagaagaagcatagatttgcttagaaagggtggtgagttggaaaattaacagattatcttcacaggatgatctctggggagtatgtaagctctcttccccaacagaagactagatctttgagttctgcaaaagtgaaatgaaaggaattctgggctaaaggtactcaggaattctgagtataaggatacaataccaaaacaaggtaattatgtgaaagcgaatataccgaatattgagagaataagtccttttccttatccccagtaagtcaataccatccgtatggatactcacctatacaactactaccatcagaaaagttctttcaacacaagtagtttggaagaaaacaacaaagcagggaggaggggaaaccttataactaaaaggaaagtttcaatccatgaaatacaaataggaacacataaggatcaagctgagaataaaatggattctctgtgaagttaaatgtaaggaaaaagtgggaaaaatctcatcaccaggtataaaagatgtcccagatatggagtgaaaaacataagaagaaagaaaagaagatggaaaatagaaaaagcaagaaaaaatagtaattcagagttctgtcttggatgttcagcatccaaataatattggttctagaaagagaacaactaaaataaagggtgaaagtgattatcaatgaaaatattcaagaacaaatgaagaacgcaagtttatgaacataaatttatggtggagaatttgggaattgattagttatagaaatagagaaaatgaggcgggcggatatttgaggtcaggagttcaagagcagcctgaccaacatggtgaaaccccatctctactaaaatacaaaaattagccaggcatagtgacacatgcctgtaatcccagctactagggaggctgaggcaggagaatcacttgaacccaggaggcagaggttgcagggagccaagactgtgccactgcactccagcctgggaaacagagtgagactgtgtctcaaaataaataaataaataaatagaaagaaaaataattaagtaagaaaaaaggcaattattaactccatggaaaataaaagttgtttggcctggtgagcctataaaacctttctcttttaaaactatatttaaaaataatatagacattattaatattgaattttcaaattatatagtaagactatttcttagtattcaaaagtaaagtcaggcccaaaggtcaagggaatcactgaacaaaaggatcatatttttaaaaacaaaataaatatatagctgtttggctgcaaaaatttaaaaagcccaatgttaaaattattctgacaacacgacagcttccaaatatgggtatacctgcttcaatgttataaactagtttaacccacattttttcctatttttatgctcatgtcatttcactttatatagaaacaattatgcccacacacgtatttagttaaaagatcagagcaaaggcatattatgcaagataattttttatatccaaattttttttccttccaaaagatttgcaagtttctatctgttttcataatgaatatatcctactatacacactctggtgttttgcacttgccattatgtgttgttgatatgagcattatatgatatatgttattaatataaacaatgtaaaatatatttagaaaaggcacttaagctggaatttctttaattcacttttttccactcttgtatattttgatactgatttaataaactttaaaagcagaggtgaaaaaaatcagctgcttaggtgtgtttgacatccagtttaatggagagagattttcgccttttattcataagagaaacaacaataagaacaacaaaagacagcttttcaaaataaaaagagccctataaagtagctcagaaattatggattttagtaatagctagataaactggtggtgtaattaataaccaccctctcttggtctttttttttttttcattgtcaaactataggaaagttgactagatggtctttaaggtctcttcattattaaatctcatagtttctaaggttaatactgcacagggaagtaacttttaacatgtagcttactattcagtctccatatgtcagttatctactttctgaatattgattccctattgattttctctttagtgatacattttaaggaaatgtaagataatataaaaaattcttgttaaataattgataacttgataagcacaaattcaaaagtgaatatcatgtattttaaagtcaaaaatataaagttagtattattcaatatcttaaatagttgatgttatttttatattttcaagcactcattgactttatttttacccattgactttaatacacttccatttaactatcatttattgagcatatacctgttgaaacacacacacacacacacacacacacacacacactgatgtaggtgcaagggtacaaaagagagcaaaataaatccaattaggagatggcaagaagattcatgatgcagggtaagcctcaaatgtggactagactcaatcaaatatacactgtggggaggcagggggttgaaacccagcaattgcacattgtaatcaaagggatcaaagtggaaaagttcagggtttgtctgatgatagaaaagttaacccttgtgactaggacatggtttgtgcatatgtgtgcaggtcacagccaaagcaagcctggcagagtaggttggggtcaaactgtggagtcagatcggtgtatgcacgccaagttaagggtttcaattttacgcattatgaaatcaggaactatcaaaggggatttttcactctgaatcagaagagaaacagaaaaaaaataagtatgttagttgataaggttttaagtaagatgaaaggaagttgcaagaacatacacttaatgagtaagatgatgattaaataggtaggtgtttggaaaaaaaaacattatctggattaatttttaactagaaaactagacaagagaaacactgagcactgaaggccagctgaggttttgagtagagctataacccaaagaattatatttttatttcactaagtctctgccactcagtatagtataggagcaaataagttgaatgtctgaaattaagtgtgaaaaactaattgacatcatggattatgagatcagtttaaatttgaaaggatgggcaaccaaaagtcagcaagcaaattcaagagggagtaaagtgggcaagagtaaaacagttttaatttacttttatttcacctaacatgcatttatgggaagtaataagtgtgaaggaatgtatgtgaacaaatactagtttaatctaatcctcatagttatcccatgggacagagactatttaatgatctcaattttacagttgagaaaactgagtcctgaggaagttttaaaaatgaactcagatcactgagacagtgaattctcaacctagggtttgcattcaatcattataaatcaagagtcaaggtttttaattattgtactatgcaataattaaattaaaagtaggaaagtgagaagttaagtgaacataggctgggatcaaagtaaaattgacagtttagttttggaataatagcagttctcgacagttacaaggcttggagtattgtaacagaagtgaatggctgaaagaaaatggaggcaaagccacaggatttgagggtaaaagagaggttgttgactttccctaaagtactatggagcacttgaagttagaagggcaaatcagccctgagaccatgtccttgttcattcacagaggctgttggtaattggtaccaacaaggagagataaaaatggaattccccacaaccccaacacacacaggcacacatgcacgtatgcatgcatgcaaaagcacacatccaagggtaacaaacaccttctacctgatagagccttgggacgggaaggtcctcagagagaagaattaggattgcataaaggaaataaagctgaagacatggcttatatggtaagtcctcaatatgattgctagatactgggaaactgtgacttcaagcaaaacaatgtacagagggttctcgaataacaccctttccttctatgacattttgttataacattgataagcaaaaagtggttttgttatatacatttctcaacttcaagtcacagcttccaaaaccctattgaggatgttaagtgaggacttcctgtaatcagtaaaacatttgggaacttttgtttgttattctttaacggaataagctttataataaacatggtgtaaatacctggcagaaaagacaggcaatggaaagtggcgggaggcactgaatagattttaaaaatatttggggaaacaaagtattacttatataaacattgacaacagtgtaattcgtttatctaataacccaggtaaaatacctaacaaatactgccactattcatcaactccaggaaaaacaactgttgtgtcaggtgaattccttgtgtatatgtgttttcactggacagaaggaattgcataagccagtgcttctcaaaatgtgatccctagaacaatagcatccgcatcacctggaaacttgttagaaatgcacattttcagatcccaccccaggccagctgaatcagatataccagtcctgcaggtgactctgatgtgtgataaagtttgagaacctctaacctaaatcaaatttctttctgcttagctaccctggaagtatgagccaaattcaacattgacctgcaaaagttaattttaggtacttgttcacatctgtttctgtgttaattataattgctttttcttattttcattcttctggtctatattgtatttagtaaattgtaatccttttggagtatttattaaactaacaatcaacacaaatttttgaagtcttactgacaatttgtttttaaaaatctgtaactgtaaaataatacatgttagtaacttttacatatgcaattttagaagggtaaacatatgtggtaaattgttaagaaagtggatgaggaagattgattgttatttaattgacacaggaaagagccaggcattggcattaaaaaagaaaaagaaagaaaaccaaacttcggatgattctgatgtatagccagggtaagaatcaccagattagaagataggagaaaagagacctacggcatcatgtattttgaagagtttggtgaaaatgatagtgataattctgggccataacaagactgcctataagaagagtctgaagaaatggtttaaaacaaaaggaaaaggcaatgcatctagtgtaagcttgaaaaaaagctgggaaactcaaagaaaaaaacagagagaagggggttgagaacactaaagaaaagtaaatggcaggtcagtggatgagattcatcatgtctttttgaatagtgtggtgagtcaacattctatctgcaactgtagacaaaatctatgtgggttcaaggatgcacatggaaaactcaaaagcattcttcttaggaattccacctaaaaagcaatatacatccagctgacctagaaatagttaaacagcaagactaaataccatcttggggaggatggatggggcctttattcattttcagatgtggaaaaaatgtttgtctttatatgtttataatcatcccaaatgtgctcctgataacacctgagcaaactttctctctggctgtcacttcaatagaaattcactgaacattaatatttactttggaatgagacagatttctgtaagttcttaggaatacaaaataaatcttgaaatgcaaatattgaacatttatgaataataaatatatatttaaagatgatattcatatggtttattcataacctaagcatgtgtgactcttaaataatcacattacagtaaatcctttatgggaagaagaaatattatcaaaaagttactactaaatttaactaaaaatgccccccaataataattctgagacgtcatgattatttacatttgcttcagaagtgttaaagtttagatttgttatcttcactatcattctagtagcaagcatttttcattaaatttaccatatcttatataatcaaatttatcaggttattgagtaagctgccaggactatatttagaaagaacctcagagatagaatagatgatcaaatgatcaggtttagagtaaatgcttgaaaaatattttcttatattgcaatgagtatagttagccaccagagagagctcagtcactatgttttattaaagacagtaattatttactttcaactgaatagaaattctctatccgccatgtcctaaatttaagaaacaaagctattgtttaatgatttataatatccagaatcaaatactataaatgacactttcaggtttagcatttgaggaataatgtgtctctgccaacaagagtgttagtgctgaagattgcaagggagatttccactggggaaaaggtgcaggttgcatatttacaggcaattttcttactcactaatgggaaggtttcttcacacactagaaatacatgctttatgaaaacaacacaaaggctattttctaatagcatcttgttaactccagagaactgaggaacagctttttaaagtcatatgacaaacataggaaataatcagtagtaaatggaacttgataaataagaacctgaaattaatagatcttaatatcttttgtctgatcctcagcaggaggaaatttttactattaagcaggatcactttattcaacaaaaattatacaactatactaatgcaattttaagttaatcaatatccagtcctttctcctgcccccaatcacgataagtaaacaaaatgaagaaacacatacactcaagcttatcctcaggtcttcctctttcaagcagagacaggtaacagacaatgtccttcagatggattacttctggggaacacgtatttgcaggagaagtagtccggggaggggtgatggcacctttattcattctcagacctggaaaaaaaattgtctttatattttgttaattatttacagtgatctcaaacagaaaacaaattaagaaaatagagaacacacaggctacatagaaatttatattttttaggcatagaataaccaaattctctgtaagatcggtacagcagctagacatagcctacgactgttgtagatgaaggagagttctttgggatccacagacatggcactgccctatcagccacggatggtatttgggtcagaataatattaccctaggtgagttggtacacatttgaatgcttgaagacccacttccctattccacttttctgtgctttaggtagtgacagctataaatcatttgggaagatatttaaaatggactttttcacaaaatactaaagaaaaaaatgtcagtctttcacaatataatttctctattcataataagtaatcatccattcataaagtcatatatttgtttcaaatatttgccaataccatgaagaagacatccttttttaccatcaagggacttgcccaggagtaagaataaagagaacataagcaaaactctggataaacatgatggatattagagaggtaaaaacatatgagtggtttggtttttaaatggttctgactttatttctgaaacccattatctgtgtctgttctatcacaaggatataggttgcttattacctgtctggtgataatctaaccgaaatatgttcacagtaacttgttagttctgtcttacccagaagccactgaagtcagattgtgtgtatctgacaaggcctgaagataaaccgcaattatcccttgagggatatatggcatttttagaggtatttgggagaaataactaatgggttgagtggctactagattcctaatcaaccaggagctactgtaaggaataatttgaaccaaacacagttctagaaccctgttcttagcacagatctacctgactgcgtatgtctcactctactttagtttttcaatttgtaactttccatgaatacctatcacctcgtcaagccatctcaagattcccaggcatataattcaatgtgttgtgatatgtcccaagttagttttatcattggtgatgttgtcactaataaagggaactatttactgagtgcctaatatgtggctgaaatcatggtagtagctttaacacatattatctcacattattcttacgtgaacgctgtgaggtagagtgcattttccccactttacagattagggaccgtcttacagattttaacttcccagagtttcataaccagcaagacaaatccatcttcctgtttctacagtggtagcttacaaactatttttgttcaaggccaatcataaaagtgtaagaaaaataatttacatcttaacacagcacacacacacgcacgcacgcacacacacgcacacacacattagtgggattcataattgcccaaatattttcttttctatattaacctactcatattctatcctattctgaaaatttttctcaaacaccatctaaattgagtttactagccaccaatggatcaaaaatcacagtctgaaaaaacacggctttgggtctttccatccttttttatttttaattttttttatttttttgagatggagtctcgctctgtaacccaggggctggagtgcaatggtgcgatcttggctcactgcaacctctgcctcctgggttcaagtgattctcctgcctcagcctcctgagtagctgggattactggtgcgggacaccacgcccggctgatttgtgtgtgtgtgtgtgtgtgtgtgtgtgtgtgtgtgtgtgtgtgtatgtttagtagagatggtgtttcaccatgttggtcaggctggtctcgaattcctgacctcatgatccatccacgtcggcctcccaaagtgctgggattacaggcgtgagccaccatgcccggcccctttctttttaaaatgaagtcttatttatttcaaatgtggctttatgttttacattaattctacttctgtttataaagttatcaacagagacatatattgtaaacggaatttcctttttaatagaagtatcagtgtatgtctaatacaaactaatagttatttatgaaccaaagaaggcagggaattgaagacaatcctgagctttaaaaaaaaaaaaaaaaagaccggaataattgaaactagccaactaaagcttagccagctgcaggaataagcagttccaacttatgataaaaaacattttggcgctgacccttgacatgaccataactttcagacttggagaacacagcacttgaattatggtcggataagctatgacctaactcatcctgctgatgagctaatcctcttttccaatgtttccccctgtggtactgaaatgatttaatcagcttgatttaactcctttatagaaaaattcagaacaaaacaaaaaagaaagaaaagaatatgctctgacatttatttgaaagaaagccaaatatattatagatcttcacttatttagaacatggcatgaccatttgtacttatacaactaaggtagatggtgtttaattatcagctttcaccatactgaacacaaacaattgagaacgtaaggatcacataattttgtcttttctgtatgtaatgtataaatcgagtatgaatgtacacatataatttgtatttagcatcacgtttttgaaggaatatgctactgtactaaaattatttttgtttggaaaaatgagtaatattttccattttcttttcatgaaatattgttaactgaacacttaaagctgtatcatgtatttatcacatggaatacggttaaatgaatatttaaagctgtatcatgtatttatttccatgaaatattattaactgaatattaaagctgtatcacatatttaattgtgtcacagttttacatttaaatagcttaaagcttatataaaagaaatatgggcatatattcaatctatacattgaagaactaatcaactcttccttaagtccaatagcagccaaatttgagaggtaaaatatatatttttggaatgatttatagagtgcactgaagaagaagataaaatgtcaaagaccttttattattattacttgataaaaagaaaattgtagaacaggacttaattctttaaaactattcttttttaaaaagtttgaggctcacaacaaaattgagactgtacagagattgaacactgctttatatctttccttcattttcttcactcaagtcttgcttacttcaaatatctctctgtgtttcacattaattctacttctgtttataaagttattacccactacacatgcatattcctccccactaccaacattctccaccaaagtagtacgttagttacaactggttaaactacattgacacctcattactatccaatctctataatatacattagggttctctttttgttgtatattctatgagtttggacaggtgtataatgaagtgtctaccattatagtgtctttcagagaagtttcactgccctaaaatatttctactctgtttatttatctctgccctcccaacaatctctgaacctttcattttctcccggattttgcctttcccatagtgtcatagagctgaaatcatacagactggctatttagactggcttttttctgttattaatatgcatttacatttcctccatgtcttcttatggcctgatagctcatttctttttatcactgaataacattgcattgtctggatgtactacagtttatgcattcatcaacttgattaaattttgaggtgtttaattaataaaaaagcttggccaggcaccggaactcatgcctgcaatcccagcactttgggaagccgaggtgggaggatcacaaggtgaagagatcgagaacatcctggccaacatggtgaaacctcgtctctactaaaaatacaaaaattagctgggcgcggtggtacatgcttgtagtcccagatacttgggaggttgaggcaggagaatcgctggaacccaggaggtggaggttgcagtgagccaagatcatgccactgcactccagcctgggcggcagagtgaaactgtctcaaaaataaataaataaataaataaaaataaaaaaactcacagatttattcctgctcctaccacctccccaagatcagcccactttttttaaatgtttctttatattatattttcatttagttttctgaaagcagaccctggtcctcaatctatctccacaggagttatttttacaccctactctaccctttatttatttatttatttatttattcatttttttttcttttgccctttccctaaatctggctgaagctcactacttatcttcctcgattgcagttcactaccctgaaaaaagtcctttttccttttaagaagtttgcactaatctaatggttattcagaagcttaggagacaacatgtacggcaaccaaaaagttgcaagcctgacttcttgactacagctgagatggtaaaatgataacatgaaatagtaagtgagatcctttctagcagcaatagcctctggtgaggaagctcaaaattctatttttaattaacaaaggccaattttacacacccagtcatcagtgaaattctctctttacaactaaaatgaaacataaagctgggcaaaacaaaagggtttgtttgttttttggcctcaagtgatcagagctaaatattgcttcagagtaaatattgcaattgacacttaaagtagtataatctgcagattcttctacttgccctaggctatactactttaaatatttcatcacaaaagtgaagcaaatgtgtgtgtgtgtatatatatgtgtgtgtgtgtgtatatacacatacacacacatatatatgtgtatgtatatactacaatagtacaaaataaagtgaaaagtaagcattgtaattagagcgtattagtcttttaggaataattatcttgtacttagcatttatttctgttaaaataagttcattatatatacacatacatacatacacacatacacattcttttcttcaaagctttagttataaaaagtagttagcattagtcatatcgaatgttgcctatgattatcacatttctaagcacatgattttcattatactccaatctagacacttcatttcttgaaacaataacctcaaaagttgtatttaatagataattttaattccagcttcaggttcaattattagcagataagttttgggtagctgttaaattagtgcctctggtccagtttgtttcattttcaaacacttgcatttcatataatgtaaacagtgacattttctctatttcttaatgaaatagtcaaaaacaataacatggatcacatttctaaatttataaggcaatacaacactggcaatttagctttttcttttaaaatattggttcaatttacagaaacgtatcagatttatttatcacatagtataattatatttccaacatccatactattggtcataatgagtagcatagataatcagaataaaaatagttgatattagtattgtcatatatttcatgatttttacacttaatctttcaactatgcttgttgtagtatattataattatctttcattctttatgtttacccaaaccggcagcaaaattaggtagatggcattttcagtgaataagaaatgtaatagagatggtgattccttataaagagaagacagactgtgagatacagtccctgatatgaaactgggatcagacaaacctctctgagaacatactctggttttcatctgtttggacattggcaaaaaccccaaacaagcaattacagggagaaggacttaaagtataggtctttggggataacgttttaagagcagagtaacctctgtgaaggaacaacattaataacagctctggttgtgtgcaaacaatacttttgtacagtggtcttatttgaccctacaattctgttttaaagatgagaaagtggaaagtcagtaagtaaactgttcgtgatcatataccagtcagtcaacggagcaaaaaggtgaagacaaatcatctcattccaaactttggactctttttaaaagcagtaaaaatgagatctgtctacaccagtgttatccaataaaattttctgaaggctgagttcagtggttcacacctgtaatcctagtgttttgggaggccaaggcaaaaagatcatttgagtccaggagtttgagcccaacctgggcaaaatagggaaacttcatctctataaaaaaaaatttttaattacccatttggggtggcatgcatttgtagtcccagctacctagggggctgagcaagaggatcacttgagcccagcaattcaaagttacagtaagctatgatcacaccactgcagtctgggcaacaaacagagcaagattctgtctcttgaaaacaaaaaacagaaaacaaaaaacaaaaaaactttctgcactcttcaatacaataaaattaactacctatgtctatttgaccaaaattattaatgaatttaaatttaaatagcagtggatagctagtggctaccatatcaggttgtgcaggctctatactgtatgcagatggataattgaaagttatttaaattattctcagtaatttgaatatatataagtatgggacaaaaataattaaaccaccacatattaaaagagcccatgatgccaaattttctgtatttatcacatgaaaagaaattccaataatctccttaaatttcactgtacagatattgttcagaatgtataatatctttaaaacaaaaaggatatgttgatttttttttttttgagatagggtctcactctctgatgcccaggctggagtgcagtggcatgttcactacaacctccacctccagggttcaagagattctcccacctcagcctccaagaagctggaattacaggtgtcagccaccacatccagctaatttttgtattttttggtagagacggagtttcaccatgttggccaggctggtctcaaactcccgacctcaagtgatctctgtacctcagcctcccaaagtgctgggattacaggggtgagcaaccacgcgcaaccaatatgttgaaattgaactttatgctatgtatgcacaccaaaacattgaaacataatttatttaatgaataatggtaatgactggcatttattaagcatttataatgtacacaatactatttcaaatgaagtacatgtatcctgtttttcttcagtctcacaatagttaataaaatacatacacatattatccccattttacatctaagaaaacagaggagagaacaagttgcacaggtacgactcaaaatgcagtctgaattggagttttattatttatttatttttatttatttatttatttatttttgagatggagtctcactctgtcgcccagactggagtgcagtggcgcaatctgggctcatggcaacctctgcctcccaggttcaagcgattctcctgcctcagcctcccaggtagctgggattataggcacctgccaccacacccagctaatttttgtatttttagtagagacggggtttttttatgttggccaggctggtttctaactcctgacctcaggtgatccatggcctcccaaagtgctgggattacagacgtgagccaccgtgcccggccagaatcggagttttatactctaagcatgattctgtgaggctggacagagaaaaataaatcagaggaaactgtcttctgcctctcaataaaagacctttgttttaagagtctggttttcaagactcttaagggtggatacattgattaaatcataaacatttgaaagaaaattagaaaccatagccagagctaagaactctaaattttcatcttccatttggcccatgtcttgggccatccatcataatatgtttgtgaacatgtatttatatgtgtgcttgcatgtgtaaacatgcacatatatttgccaaatctttacgtatgatttttcttattgctcatctgtgtttttgatagatatacaactagccctttataatcataaacacaataaatattcaggacccttaagattagtcatgtaaaaccagaccccaggtactgaggataaagcatggaacaaagcaggaaaatcccatttccacagagctttcattccaggggatcaaagcaagtgtccaacaccattgcatattttctagctatgactaggtgtttttatgagtgaaataatgttatgatggatttgggcctctgcagggtattaaatctcttatttccttttgctagaatattacaaactgtaaataaatatttttgaacatgaaagtacaaaaatgttaagacaacactattatttagtatgcaaccattaagatgaaaatgaaaatacagaaactcctgtgtgttgggtgaataaatctaataataaagtaaaggtggaaaatttgaggaccaaattttacttggaatattcagatggaagaaaaaagaaacctgattattcaagtctaacatattaaaaaccatttaatgattaaaggagagacttgaagagaaatcatcccttactggcagtaattatgttaaaaacaggaccacaaaattattgcaaggaagaggttggcaggataaaatattttttgaagtaaaataatctgtggatcattacttctaatgacaataattagaagtatgaattcaatactacagaggtacatcaaatgtaaaggttgatataaataaatatgaattggccagtagacagaatttatttcatctgtattcctggagcatttctgtgtcagtaagtttattacctcaacagtaataagtatatcgacattaagaaatacaccaatatattttaaatatctactatgtgtcaggaattcccctatctcatagtcacacaagctatgtagtctgttcagtttgtgttttggggaccctgactttccttgtttgcattgtggaaactgaaataactgatcagttataaaagacctgttaaggtacagcacagtaataaaaaatacacatacacacatatatatttaatatcctcaagacagtcctaataagagaaatatcttctcagcacaattaatgaagtatacctttcagcaagaacattcagtaagtctatttggtgaaagaacatttctcccaaggttcaagtatctcattctcattgtacaattttctgttcttaattgattaacttcctgacagacattttccttttctatctaaaataagtacttggggcgtgactcaaatgcacagaaaacataaaatgacataatcctcctattgatattatagcttattgatatgtgtagcatcacagtgcaaattaaccattgcctcatcaaacaagcaatgggagagttggggaccaatgataaggcatctaatttttttcagagatagctgttactactctcaatctgaaatatcttctggacccttttataccgtcagcctcattctccttcatgatagctgccacctcactagcagtgtaattattttctggcttaaaatctcataatggctttccgatttcttctggataaaattcacaacttagcatgacaggcaaaactcttccccacctggccttggctacctctctcgcctcttctgcagaagcacaactggagtccaggccagatccagacctctcagtgctcctaacaagtctatcttcctccagtctcctaaggtccttggggctttgaccttgccaggccctctttcctcattccactccaggccatgcccgatacttacaaggtcatgagcatcatctgctctgggatgaacagaaatgacctttttgaactcctatcttagtttaagtgaatcatgaggatcccacattcccagtcatcttcagcctcaagctgcactttccagcctcctttttttttttttttctctgagatggagtctcgctctgtcgtgcaggctggagtgcagtggcgccatctcagctcactgcaactctgcctcccaggctcaagcaattctcctgcctcagcctcccgagtaactaggattacaggtgtgcaccaccacgcccagctgatttttgtatttttagtaaagacgggtttcactatgttggccaggctggtctcaaactcctgaccttgtgatccccccacctcagcctcccaaagtgctaggattacaagcatgaaccactgtgccaaggctccagcctctttttgtatacatttttgccaatactacttactaccatctgatatggtacacgtatttacttttctgtatgtctgcctctccccactagaatggaaacgggtttcattttctttctttttttttttttttttttgatggagtctcactctgttgcccaggctggagtgcagtggcgccatctcggctcactgcaagctccgcctcctgggttcacgccattctcccgcctcagcctcccgagtagctgggactacaggcgcctgccaccacatccggctaattttttgtatttttagtagagaccaggtttcaccgtgttagccaggatggtctcgatctcctgaccttgtgattcgcccaccttggcctcccaaagtgctgggattacaggcacgagccatcattttgctcactgatgtatccctaacaacttgaacagtaaatatcaatttataagtgatgaattttgaatctatgaatactgaatgtcttacagttcatacattgccctttgatgggacattaaaaaatttttgaatagaaatgtgtatgttgatttctctccttggaactcctttcacatcctttcccacccttacttactcccctctccaactttacctggataactccaatttacactggatgactcctgcaacggttcacctcctcttttcctctagttttatttgggctcctgtaggcacctcactcttttctccacatagtcagttcaaaagtggtttacaatatttattttattataatataactgaacacataattgttcatctttttgcttgactttaaaggatcctcagctttcctgtggaagttctagcatataatgagtttaaataaatagataggatgcatgaattaatgaatgaataaaataaattactaaatggcacacctatcaattgagtgcctattattatttaaagggggctaggaaaatcttctctttctttcttataaaacaattaggaagaaacaacaacaaaaactgttacgctgacctgcaacaagtaccagacattttctattacagatgcaacattttggacattgtgtagtccaacagaaacaaacagtatgagtgtttaaatgagttaatatactatattacgtcctattttaattactatattattaaagaaactaacagttactaataattgctgttgattgctatcttatatgtaaagaaaggtaatttctctgaaggcagttaattcagttaatgaatactaaatggttggagttggcatgggtggcgatggagaagggacagggatgctacaagggacaaatggtgtcttgtaaaagtaccagagtgccagggtttcttcccagttgcacactccaggtgtgccatcttattaatcattgaattcctagtatggaacacaccgcgtgctatttaattaagactgacactttagctgaggctttaaggaagcattgggttttcatgcgataagggcaaagaaacattatgtaagaaaactcagtcctgagtgagaaaagcaggtttaagtcacagcaaatagttggatatggggtgcatagggcagggagatggagcgaatagggctgtaggcagatgctatagcctacgtgacatggtgcttcatggccatggaactctgattttatcaccttcttcactgtgactctggatcctggagtctcataaaggttacttcaggtgggaatgaatgtctcaaaaggtggggatgactgcaactccatgtactcatgtatctccagcacccatgcccttcactaaagcaactctgctttagctagctttacatattgaggatttaagtttgcttgaaaaataagtttaattaaaaaatgctctgacagttgacagtgaaggcctgaaatttagaaacccaggagtaatataatcaggcttctgtttgaaagaacgttttggagatgggaagtcagggcctgctctgagagcctgctaattgatagtttatgatgaattaaactatgacactggcagaacgtttgggaagaagcagttacaatgagtactagagagtattttgtgattaactaaatatgggaagtgacgcagcggaaggtgggaggattccagtattttaggactgggaagtggatagattcttggatgctattcaccaaaatagaaggtaggaatagtagcaggtttgtgcagaatctaattaatgaactttcaaacacagttagtttggtatctaactgtttgaaagatttggacatccagacaaagtgttccatctaaaatacagtacgtaaatattatttgtgagctgtgtaggttgtgtggggagtaattgaggtacgttatgtctgacagtgccaatttgttatatgatgcaaaaaaagtcatgtgttgaaatgagaagacatttagataaactttaaaaagtttaaaaaatcaacataattgatctcggatacagtgccaataataaataatttttacattgttttaaaaaaactgaagaagtgttaaggtcatataaacatcgggtagtaggaatttatagtgacagatatctgcatatttattaaatttctcttaggttatgttgagtgttcaagttgtagggactgatatgggagatgacaattttgattgacggttgaggttgtgagcctcaaccatctttctgcaaccatgttgtagaaaaagaaagattccaactgattttaaaagtgtataaagaaggaaattaacaaatggtgggccccaaggatggaagcaatatcagaaattggtcattgaactggcagagacgagagattagagacctgacatttgcaatgacacagaagtggtatgaaaaagctggagagataatgcattagcgatatcttcaaaaatcaaaagtcaaatatggaaacagtagtagtgacatcatttttaaataggtgataagaggcacttatattacaacaaattatattacaaaaataagtcatcttcttcatgaaatgccaaatggatcattacatattacagtcaaacaaaacccagctatacatatgcatatgtataaatacatacaacctttatgcctatttataattatttttaaatttttattctataaaaactaaatgttttgcttttactatgtatcctgtaattgattatcattcagtagtgagcataattttttttccttttcagttttgttttttcttgagaagcccttattttttagttgctgtatagagtaaaagactacctactctattcctgctggaactgtggtaatgaaatatggtgaactataacagcataaaccaaaccagattgtagcccctctctgttcaaaagtctgttatttttcagccacaaaaacacctcgttatacattagataacagattattgcaaagcaagattctatgaatggaaaggcatttcttttgtcagtttctgagtcaaggctacttcagccttgaaaattttattgttgtctattgttccttcttcctcaggaaaaaaaaaaataactatcaaaggtgggtctgaaaaaaaaatagggttagatatagtcctggacaagacactatgtacttagttgtaaaatgtggaggccaagctttgaaaaggaatcagagtttaattaatcattgctgcatgaggactacatagcccatattcctttcatgtagtctgtgtagaatgcgtaattttcccaaattcaagtacaatctgtttttcctttttttttccattttgaaacctgatttgatttttacccctaataaatctggcatcttctattcagtagataatataggctattagaagaaaaggaagttttaggtttgaatttcttacaaaatcacctaatttatcagaattgttctctttcttccatatgtgatacagttatttagacagacaacattatccagaaatattttctcttctttctcaaaactcaaggacaatattgtatcttatagaattaaatacaggacaactttcttatttaattcaatttaaggtatgtgtgtgatacatttatagcatgcagcagagaacaaggaagttttaatttctagaatcattttaaaatgtccaacccaaaacactattaaactgtaatactacacattaagaatagatccactgaaactcattccgagaaaaacagcaagtgcggtgaggcctctcaattcatgattgaaagagaattatttaagaatctaaaaatattttctaagaagagaaaaatgatgataaacatattagtcaccatacatcttaaagggctatcatgtggaatatgtacacttgctttaaaaaagcttctatcaacatgtgattactttatgaaaaataagttacatcattaatagatgggaaggccagacgccatggctcatgcctgtaatctcagcacttcgggaggctgaggcgggcagattgcttgaggccaggcattcgagaccagcctggtcaacatggtaaaaccctatctctactaaaaatacaaaaattggctgggcattttggcatgctcctgtagttcccaactacttgggaggttggggcaggaggatctcttgaatccagaaggcagaggttgcagtgagccaagatcatgccactgcactcaagcctgagaccctgtgtcagaaagaaagaaagaacaaaagaacgaaagaatgaaagagagaaagagaaagaaataaagaagaaagaaataaagaagaaagaaagaaagaaagaaagaaaggaagaaagaaagaagggagagagggagggaaggagggaaggaaggaaggagggaaggaagaaaggaaggaaagaaggaaggaagaaaggaagggaagcagtacaacataaggcttaatattatggactcttcatcatattgtctaagtttcatttatggctcaaccatctatttcttaattacatgttcttgcatttttatttatcagaatgtccattattgaacttatctctataccaacacgtgtgtgtgtgtgtgtgtgtgtgtgtggtgtgtgaaatggagtctcgctctgttgccagcctggagtgcagtgatgcgatctcggcttactgcaacctctgcttcctgggttcaagtgattctcctgtttcagcctcccaagtagctgggattacaggcgcctgccaccatgcccggctaatttttttttttgtatttttagtagagacggggtttcaccatgttggccaggctggtctcaaactcctgaccttgtgatctgtccacctcagcctccgaaagtgctgggattacaggcatgatccaccgtgtccggcctctataccaacaattctatattctactttgtgatactagagctgggactcgctagacttgtggctctcctgggatccctgagctccttgcaggagatttttaaggtcaaaataattttcataacggtattaagatattatttgcttttcttactcttattctcttttgaatgtacagtgaagttttcaagaggctatatgacatatgatccagtaacagaaacatagcaccagatgtaatttacccagctgtcttccatgaagccaggcattaaagagatttgcaattatgcaaaacaatgctacccttcttactattttttgtttgtttttgaaaatagttatttttcataataatgggttattttttgttaacaggtagtggtttgattcttgttatttttggaatgtcccatctttaatatggcaaatatcaatagatatcatccacataaacataagttccttcaggtcttcaatttttaagagttcacagagtcctgtgatcaaagagtgagaaacactgctgaagacatttcttcattgccagtggattcctgttctatccatagagggcgctagagagagacgagaaggcacaggggttggggcggtggggtggggagtcgcgggagaaggggctggacccagcaagagaacctgctgctcctgttgaatctctgcagcgtttcagcccggtggcggtagcatgttgtctctacctgcagactctaaagcagtgtaggctctagtctctagctcatgtccacaccaacaaaagcacaatgagctccctgctaagcaatctgggacaggccacggtgatgcaccctcctcagaggtctgagttcctgggctatagactagtcttgaattccccagttaccagaggcagccaggaagtatcacttccacaaaagtccaagggctaggtttgctaggcaacccctcacctcagaatttcatcctagctccaaggaatcctttcctcagggcttctaggtggtgattactgccatctaagggcagcacatgtttccttgagtctatctacatcacctgtcttctctttttgctttttcaatcctttgaaacagcttaaccaattacactgttttacattgggtaatacagtgaaatctctgttttcttgactggagggagattgatacaacaggtattaatgtaagtatgcatctctaaaaagctacccataatgagagaatcaccatctctacggtgacacaaatttacagtatctaaaagaaaaatcaaatctctgttctgagcttacaaatctaaacatgtgaaagtatattggcaattagcaaaatagatattaaatattatacctttttagatatagttgctttgtgaccacattttcaaatactcagcaatctatacgtatctagttatttaacaagagcagttttccaaatttgatggaaatatgtcttcaaattattacctatacatagaattctaaagcaagtgatagataaggataaattatattttctctaattagctataattttactggaaacattttaaatgagtcacacaatcttattgtaaaagtctaaaccctgtaacaaaacaatttttatgcaaatcatcattcatcttttatgataactagatatttatttagcctttgaaatttgtactatataaatgtttaaagtaagtaaacttaccgcctgataggagagcaggcttactttttaccattggactagaatgaggaaacttgttgctaaatgacatgaaaaggtgtgcagtgaaatcatcaggaagctcggcttccaggaatgtcttcatgaatagtttgaaaccttcaaaatctattgtctggaaaaaaaaaatgtaaacatgtattttaagatccaaccaaatgttaaaattctgtgctgtgttcaaaatcattagaagtagaaatgacctcaaaccatttttatatccaagtttaacaaatggaaagtgcctatttgagaaatagggtgggccgtcctgggctaacactggcaatgggatatgtttgtcttacctgtgatggcatagcaggaagaggaagaagtttctagttagatatttctatttccacagtatctgtaatgccttgaaaaatgtactgtttgaaacttagtttgctcctctctaaactgggaataataatcccaccccacatagttgttgcagtgattaaatcaggcgatcactgtgaacaagccaatacagagtcatataaacacagcaggcactcagagagaaaggaattttccatattttttgcttgtcactaatggtgattatcgcttttgacaatgtaaaaagaggttaaccttaatgtttcaactaaatgccaagctctattgataaacctaaaacttcatacgcagactttccaaagaaacatattttaagatcttactctctgatactcattgcagaactatataaatgattagacatttatttggagagaattgtggtggtgttaaggttctccatgcccattagcggaaatggtgatggaagacaacttccaacctcaagcttaatgagagcgtttcacaggagccatagtgaagagcttggtttctccttgcagatgaaggcagtgcaccaggatttgactctgcctaggaaattgaggacaagcacatgggtgctttggggacaaaggcaagaaaatggtactattttaagttggccaaaactcctcgttttggactgcaggaacaatggtgcatgagtattttctgggaaacagatgtagaccacatggaggagaaggccagtggagtggtcttgggttctatccagtagggcatttgaaaggactagaagacctacagagaagaggctggaataaagccacatatgtccagatcaagagagtgcaagggatgggctttataggtagcccttgaaggccaatttttttttttttttttttttttttttttacccagtttaatgtgctgagatgcaagaggaaatttggctggctgatgctcttagttttgttcacattgctggcaggtaagaataaaattaactttggaatagaaagtttgtttttcctatgtaataatactgggggaaagacatggagattgaccgaatttattattgtattatttgggacaaacctaatattaaatgtgacattcaggaatatcattagacatagtaaatttttatagatttgatcatgtgccaattaagtttacatacgatgtttgctttttacctaatagaatctcaggcaataaaaccaaacactttatttatcaatagtcccaagattctgcctataccttaatctaacttttttatttagtttcactttgcttattgattctcacaaggacacttcagatatttattttgctggcagtaaaaagacttcattttcttctatatttcataaattactaccaccaccatagaatattgtcaattctagcccgggaggtggaggttgcagtcagctgagattgtgccactacactccggcctggcgatagagtgagactccgtctcaaaaaaaaaaaaaaaaagaatattgtcaattctagtagtagagtgaactatataactaaaaactctgagtaatataaaaaatgtgaagaatagcctcaggtaggagaagtacttccaaaaaagcaatttgctacaatgaattcagccaacacttaaaaacatggcgattaggccaacagtcagacatgggatccaaatagtttccttgaaaaggaacacctactcttactaagagagctccttagagatgacctattaaagagaagtattccacattcatttgggtgagtgaccaaaattgatagctaatcttcaacatgtatgaaggcccatgaggaaccaggagttgattttattgcaaagttgcaggaagtctgtgggatgaaaatattcacaagcattgtggttagaagcaaagttacttatggtagcgcttccttctgttcctaggtcttccataatcagtattttgtttagcaacataacagatgataaggggcatggtctttgaagtcagactacctggatcaactcttgaatccaacacaagctgtgtcactgtggacaatttaagctctctgtgcctcaatttcttcatctataaaattagaataatagcacctacttcttgatttgttaggaggaacatattatttactatttttaaagcatctgaatgacatctggcacatagtaaacattgtatgtaattaaataaatttttgtgtaaagaatatccattttaaaaattcataatttgaaacaatatttgaagaagaagcctcaaagccacattacttcacatgttttcatatgcatttaacaaaccatgcatggttcattgttgtccttgttgctgctttaaaagctggtaataaaatgtgaacttccagaagtagtaaaggactagaaattggtgaaagtttttctctggatctgcttttggaccataattataccttaaaacagctctttcaagccaagactttaacttggtaacataacaaacaaacaaaacaaacaaaaacaaagagttcagaataaagcaattgtgtttcaaattctaatacttccactcaccacctaactgataaggggcaaagaatttatctgctcttttgaaggaaaaatatgccaagtcccaagtgtatgctctttacagagcctttcagaacccatgtcgatgctcattaaaatcgctgcctgtaatttaacgatgaaagccagaaaaataaccaaccaaaaggaaaaatgaactttaatatctaacgatagaggcaggacacagacaaatgtctaggcaggtaagggaaggtccccggagaacctccaacctgcccaggtcactgtgcacaggaggcctgtctaaacacgcccatggtgaaaaattctgtcccataacacatgctcagtaagggaaataaatcagtgtggggtggctcagactaagggctcacatgtgcactggaaaaatggggtggagctaccagaaattcatgctctatgcaggggagaatcttggcctcttcagctcatgtgtggtggcctggtattcaatttgtgaggtggaaacccgaatgcaggaccctctctttgttgagagctttcctttctcttaataacttccaccctctttacccttcaatgtgtccgcatgtttaatttttcctgatcatgagacaagcacccagatttagctgaattaagaagcaaaaattcctgcatcatttgatggcctatatggggatatgaggaagagcgagtaaaatgcgaacccaagaatctctttcactttcgtttctgggccttccagtcctcagactttttctgaaggcagaggaaactgcaccccttgcgtcactcttgggtttgggaatgtcggcctcagtccaacccagtctttgctatggcatttttcttcttttttttcccaggactgtaatggcacctatcttttcttttacaatatcaggagtgttccaccccaaccccaactgctgccacataggatagatgcggaagtggtggctccctgccctcccccacgttcccgccgtgctggggcacatggccgtgtgtctgcgtgtctgctgtatgtactttcggcatccaacagccatgcagggcgggactgagccgcagctgctgcccaggccccagggcaatcttgggggctagaggccccgtgcagacagctggccagcgttccccgccatgcatccatacagtcttcccctcccttggccaaggagtccagctcagtgggacaacaattaagtttctctctgtttgcataagaacaagaggtttcttccccaggcatttccctgccctacgcttaagccttttttttttttttttctccacaaggtcaggagttgatggattggtgtgaaggtagttacagtttttgctattacctagattggcagggaccacagttgattttgcaccaacctagtaacacagccctgtgagtacagggggcttctcaatgccagaggatttttcttgaaaagtgttttattaggccaggactccaattcacaggacacccttttctctcccttgtttgagaggacccaattttagagcttcaccttagcatttggcttatgacaaggaggcaattcttttgtcccaaactcaattccaagctttgggttgaagccctaggaaagaaaactggatcttagggatccagaggcagacaacaatggaagttaaaaggcaaacaccacagatgagcatgactaattcctgctgattaagccaagcctcccatatcatggatagaggtcatactagtatccatggcataaattaggtgtagggaactcaaaggctacttatagcagggggaaaggcagtgagtgcacggggaagtgcggataatcccaccccctaggcccaactgttaacatgagtgaaagctgcattgacacccatgggtggcaccctgttgtggtcaccaggcctcagggatataaggataaaagaaggaaagaggaagctttttccttctctctctcatgtaccctgggcattcgataggaagagaaaggaaccagggatgccttgctcctctttctagatgagtagccattcgtcttcagtctgtgcaccttacagatgcattctgagctggggggctcctttgaaaaaaatgccttctttgtcccccttggtcctctcttcacagatggttaatcctgtctccatactacaggacactcctctcggatgcatccttcaaactgtgaaaagtttatttctcaacccttaaactggttggcttagaattgagctcaggggaggggaacccagaaggctgacatgctggcaaagagataaaatattttttaacagtcagacttttggcctccctctccctgtgcaaaccagtaaaaggaatggtagggatatattctccgtaaagttttgattaatcaaaaagtatttatgaggttggtctcaagctgtagccaatctgttgtgctctgcatgtctttctatatggttctgtcagaaagaggagtaccttaggatgggataaggacctaggaccccatagcccactattcaagtcagcctggcaaactgcctagtatgttgtttttgtctccgctattttacggtggcagcctgggatcaatcctggcttagggaatgagtagtttctggcaaatacctgtgtgacttctaccatttgctgattctctcctgctccatgaacagcttctagctttcttttgtgaatcttcctttctctgagctacacttagacgttctagtttttgtaaaaactgcttaccacccctttgaaaataccttgtatactcgcagttaaatcataactttttggggcttgttggtttcacctgtaaggttactgttggtaaagttcaaaagccagaaatatgagtcatctggcatggctaaagttgggtagctagggatttaaaaggattttcttaaagaacgctcaagttaattaaaagtggatatccaagctataggtatatttaaaagacctttatgtttttttcttcatggatcttgtttttctgagaaaggttttttccccagtcaactgaattgtcttcctccattttatcttgccactcttaatgaactcatgagagaccctaagataatttctgatgaacagagactacttgggaaaaatggaaaagatataatgtattccatttttggagaaacctctgttttcctcatggaaccccagtaattagaggcagatagatccctttcaaaatctgtttttgtcttccacctgtatctgcttattaggtactgttacctctgtttcttgaagggctccaccctcaggccaattatccaattaggagattggcaaatgaaaaatcttacaactactggatcttcttctgtctgtctatgtagttatatatgtgatttttatataaaagcactctaattaattggcctaaagaaaaataagcattagatcaaatattttttcaaggaaaatacaagctgtagtaacttttagttcatgtagctttaatctttgagaaataaaaagtcttaaagattattggtaaaattcaaatgtcattaaaatttaaataggtggtctacattatggaagtcagatactaggttcgctaaatgttttaaggttgtaaactgcttctttggccttagagaactgttcaacttgcctgctttacaacttggtaaggcctgaggacatactgaattaaccaagcccttgaacaggctagaaggaatcaaactttattggtgcctagtacataattaaaacaacttatcagattttacattaaagtttaaaattgctaagagttaccattataacatgtaattgagaccaccactgaaaatagattgacatgcaaggtgtgtaagaagagtaaaatgtgttttcaggaaaagattgtaagaaggcatggaaatccaagtaactttttgcctagggttaaaggattgttttaaattagataaggtcaagctaaaggtttaaatagttgtggaaggtttctaaatttaatattgcaaaagaaatcctgtgtatgaacattgactaaactcaaaggatattatatgtttttttctgtaaactgagcaatgaaataaaagcacaacaaggttttcttaaggtactaatctgttctttagcaaaatgtgtaaagggttataaaaggtttttaagaatcttacctcatggtccaactggcttagattggatagaattgtctataaggtttcattagaaaattgggattaatagtaaactaatgtaagggtaaaatttggctctctctctcccttgttgaagatttctatgtaatattaatgaataatgaaagattttcatgtgccttgtaaatagactgccaaggaaaagaaagagaagacaggagacaaactgtttggaaagctaagtccttcctcttgatgagtaaaggttttccctattttaaaatttttgagtcatcattttaacaaaataaccaactgggattgtatttcaaattatcaagtgttttaaacctctaacatttaacaggcttccccaaatcaaatttcagcttcaaggttgtctttcctgacccctagcttttggatgctacagagggtccctagagcatctagaagaagagaggtaaacagaataatttaacatggttaggtacatgggatctccaaaatgatgtttaattttcttcaggttatattttagtgaataatgctaacatatgttccagaattttatgggatttctaaaattctaatgtttgagtgtatgctatcaatcacaattaaggttgttatattaagttattgtaagccacagagataaccacattttgtcaatcacatttctgactgtaactaccctggtcattttgttattcataaacaattgtcttcttttgatccccttcaaaagatggttaataatcagctataaaagtttgatgggtgttctccaatacaagtttctgataactttggagactctaacactggactaaagggaaaacgtacaggactcatgaaagagctgaaacattcacgaatatcaagcagagcatgagttaactgaatggactgaactaatagaaaactgaagtaatctttttttaaaaccttttgcttgaaacattgctggtccttgttttgttattcagagtcaagaaaacttttattttgagctatttacagtctttaataattgagtaagctatactcatgtgaacaaaatttggagcatacttctttctctttgcctggttcttctagaatttggaaactatctgtgagtattcttaacttatggcaatatggttatttgcatcagtgcaataggaattcattttctctggcaacagtacacagttggagagatgggttgttttaccaaggctttgactggagaggtgtacttccttttaaggaatcaagcttgagttgcagagtcaataaaagccccttgggaaaactggcctcataccttgtctacacagtcctcatacagggttcctaatctgtaatgagtaaagaatgtcactttctaatgggcccaggaactctatattctaggaacctcaagaagagaggaattcacccaattcataggtatttgagggtgctaacccatggctgggctgggctttccaaagtcctatctgagattccttatggaacagaattccatcaaaagcaattttaaaagtgtatgtaagaataattattcttgctgcactttatgcaaactgtcaggccaagtataagactgaagtctattttgcaaacaactcagtcctatcatgaattgtttttaacaaaaatgaggactggggagataaaaattatgtttcaaaacttaccacacatttgtcattaaattctagtctcattagttgttttgaatttttttttgcctacattttacattaaccctcttattcctgtgaaccaaccagcaatttctggctacaactcagaagaaacaaaaggcatgggtaatgtaataatctggatcaatattttaattctgagcagttatcctgctaatcctgacatctgataggagtaaatagggtgcccataacccagaggttcctctgggaaaataagaccaaaggagcaaaccaaagccaagccccatgcaaccaatcttagcaggcataattatagccaccagttatctgggcatgctgacagccttgggatttttcagctgcccttacccatccctctttgtttggttttaatatatgtcttctaataactccgtttgtctcttctcaccttcaggccatcaaactccaagcgatcatgcaaccagagtctcaaacaatggccccttttaacagagacccttaaataggctttcgagagagttatgactgccatatttccaaaacagtgccccctaagagcaggaagcagttaagatcagtcttcgtccctattctaactgcagtacctcttgtgtaccactttagagggaagaataatagaagtaggaggcaaatgcctaggcagataaaggagggtccacagagaacctctgacccactcaggttattgagcacaggggggcttgcctaagcatggtcacagagaaaaattctgtcccttaacacatgctcagtagggaaataaatcaatgtgtagtggctcagactaagggcccacatgtgcactggaatgattgggcagagccaccaaaaatttgtgctttatgcaggggaggagcctgacctcttcagctcatgtgtggtggcctggtattcaatttgtgaggtgaaaacctgtgtgcaggacccctctcttttctgagcactttcctttcacttaataaattctgccctcctcagccttcaatgtgtcgcatgcttaatttttcctggtcatgagacaagaacctggatttagctgaactaaggagcaaaaattcctgcatcactggcatttctcctaataagcaacacatttcttcttgactcttcttttttcagcatgcaggaaaactttctgaaatttctaaagtatagttctctctggctcagcaagcaaaatactgttttattttctgacagctctaagccttaattccctctatataaagtggtatatgaaatcattcattcaggctgggcatgctagctcatgcctggcactttgggaggctgaggcaggcagatcacctgaggtcaggagttcaagaccagcctggccaatgtggcaaaaccccgtctctactaaaaataaaaaaattagcatggtggcatgtgcctattgtcacagctacttgggtggttgagacaggagaatcacttgaaccttggaggcagaggttgcagtgagctgagatcacaccactgcactctagcctgggtgtcagagtgagactccatatacaaaaaaaaggaatcaatcattcagagttgtcccaatatgataaaaattgatgtaaagcacttagcatacacttgggcacataatatataaaataaataaaaggattaggttaaaggaagaactgtcctcagcttagatacatttttaagttactttaattttcctttttttatttttttgagacaaagtcttgctcttccccaccccatgctggagtgcaatggcgtgatcttggctcactgcaacttccgcctcctgggttcaagcaattctactgcctcagcctcccgaatagttgggatcataggtgctcacaaccacgcccagctaatttttgtatttttagtagagacagggtttcaccatgtgggccaggctggtcatgaactcctaacctcaggtgatccatctgcctcggcctcccaaaatactgggattacaggtgtgagccaccatgcccagccaatttgcctttttattggtacagaaaactgtaaaattcattgcatctttctgaataaaaacttcaggttttgtgtgtctcaaatactttgctataacatttctgtgtcagataacagagacaaataacaacttttataaggcaataattctaaaaaaaaaatcttcctttgaaaaataaaagcctattacagatataagaatggagtaaaaatttcctcaattcttaaattatttctacaagatgacatcacattatttattgctgaagtgttactgacaatgtaagcttgtttctcaaacttcttcactgtgttctttggagcaaaattaatttatctcacattttctggcattagatagggcttgcaatgtgggaaaacacaaacctctttttttttttttttttttcctaagagaaggtctctctctgttgctcagattggagtactgtggcccaatcatagctcactgcagcctcaatctcccagactcaagcaatccttccacctcatcctccccagtatctgggaccacaggattgtgccaccatgcctggctaatagtttttttttttaattttctaactcagagttttcaattcattgagaaatgtttcttcaatgtgtttcctggttaacccgtcccttttcttctcttgttagtaaaatcttttcaaatatctcctaaaattctatgttgtccacattattagacatttctgataaatggatgatatcttcatctgtacattttccttagatcatgacttacaagaaaatttccaaatttaggcatcagagtttctattgctgtcatgtaacagcattagaattgctttttgaagactgtgacctttaaatagaatgagatcatttatatgcatatcaatgaagccattaatgatacaaattgggtcagacttaactgaatgactattcaaaaattgaattgctgtgggctcaaacacatccacgcgcacgcacacacacacacacacacacaaatgttcaaaattttaaaaactgctttctcatttttttccttaaggaacagccacagactatttagggagataacagagaatttgtaaagaagactgactgagggagctgctcagatgtcgctgccaaattggcacagattcaaggcacatttctatatgcctttcattattatttctgaccatctggatcctttgtttttaaatccctgttaatactaaagagaagacactagtattcatccatgcagattcaaagtgaatgaaaataaatgtcatcactctatccttaatttcttttggtagttttgggttgtagattttctcatattcagaaagtgttctttgagcacccactctgcaccaggctctgttctaggtgtttgggtaaagatgttactagaacacacaaaattccttccatgagggagcttatcttctaatgaaaggaataagaacaacattaatgtgctcaatctacaatgtctaatggtattaaatgctatagaaaaaaaataaagaagaaaaagatttcttgggggaatgtgcttgcagttttttaaatccaattatcaggaaatgagaagctattctttgagtaaagatttaaaggtgatgaggcacatatttgcacatatttggagaaagcacatttcaggcagagaagacagctagtacaatggccctgaggtataatgatgcccctgtgctagagaaatttccactggagccagtgaggaggagcaggaaattggagcaggagtgagggaggaccagagtagtagaatacaaggtcaaagactcaagctgtggcaatgtgtggactgggcagagcatacaggatattagatcatcaaaagagagttatagctttaatgtggagtgagtttttagtaggaaattccatgatctgactcatattttaacagaaccatgtgaccattataacacttatttgtatcagacaaaagatagcctatcatcagtttttatgtttttctaactagctcaccactaattaataagtgactcctaaaacacaaaaatgaatcattcaactattatagataaagcaactgtttgaaaccacaaagaaatcactttatctatcaaccaatgttgactgagtacctatatgtgtaaaatactatgcgcttactgggcaaagaactctgatgaaattaactagataataatttaaattaatcagagttttttttacagttccatttctatttcgcattctaatttatatcattaactaattatatcaaactcaaaaattgatatgaaggtcactgagcaaaagtatattgattaaatatgcagcatggctatcttactgagatttcaaaatacaattttttatgttaaaattcacttagaaaaatttatattttaaatattgcatttcttatgcttatcttgcactgcaattgactattcattatttcaaatttcagagagttccttgatagtcccctaaagctgtcatatagatagttcctttgaagagaaagagtacaaagtgtgaaaaccttgaattttaatttttaaattagttttggcaaatgaaaactattttagcacttcagagtcacatactccattaactctacctttacctaagactagaattatgaagactcagtagaaagacaattagaaatatattattttagtaaaaaataggaaatggccgaaagataatgctactacattctactaattacaaaaagcaaataatggattcgaaaaagtttaagcagaatatttttactatgatttcagtatgtcttttaatcaaggatctatagctaactgttttattcttcagctgaaatctattttaatctggtgtgacactgtcttgtcacaccaaacattttttggtgttgtcactaggacaggagtgagtgttactgaaacacacacataaatcctctaacattttctccttgaaaaataaaacccaataaaaatgtcttggaaacctttgtatatataatttcaattaataagatcagtttttaattattccttacttgtatgttcacttttaaagaaaatctccacagggggtttttataatgcacatatgagcagacagattccatgcaaaacttctctttcctgaagggctatatgatccaacacgactttgcatcactaagtgtatgacacagtcttttaccttacaggtcctcattatgtaacactatccaaatgttactatgttttaggaactgcactaaatatgttatatgtgtgctatcatttagtcatcacaaaacctatggacaaagaaactaaggctcagaaaagttccttaaattgcccaacaccacaagcttctaattgacactgaagacataaatatttctagcttcaatgcacattatgttatagttaaagcataattttctaaacagattttgcaatattaacacatggtataaggtaatttcccactggtttatcagtattagatgcatttgctgctgtgtcaaattggtctgccgtttgagaaaaaaaagatatacacaaataaggtataacaattaaaagtaatggtacgattattcagtttcccactcttgaaaacgttgtgttgactgtaactgtttttgtaaccttcgatgttcaaagtacaacctattactttgggtcgtatacctgaaatgtgttcaaatctgcccgcctccatctccattctgatgcccattgtcatctagtgttcttacttgattggactgcttccataactcatatctagtcttctcttctacccaagtccatgccccacattgctactggaggtatttttctaaatagagaatttaacttgttcacctaaaaatatgatttataatttctttcacctataaaacttaaaattcgtagacattctaagcctttttaccaaaatgtctagatttatattcctttagtaccctgcagtgttctttcccttgaaaaagctatttctatttctttttttttttttttttttttttctgagacagagtctcactctgttgttgcccaggctggagtgcaatggcgcgatctcggttcactgcaacctccacctcctgggttcaagtgattctcctgcctcagcctcccaagtatctgagactacaggcgctcactccctcacccagctaatttttgtatttttagtggagtcagtattttaccatgttggccaggctggcaggctggtttcaaactcctgacccccaaatgactggcccacgttggcctcccaaagtgctgggattacaggtgtgagccaccatacctggccaaaaaagccatttctaatgatgaaaaagcacaagtaaaaacaacagataaaccctaaaaataaaacttagatgtgacagagtaatgttggttttaacttatacttggaaaagtacaaaaagatcacctaaaaaccccagcattagtttttaacttctatatcaattgtttaataaatgttattaaagaaatgaaagaacaaacattctacagtgtgaatttaaataccacttttcaaagttggaatttatcattaaactaaggagagttacttgtttatttatttcccaaatgtatttatgcttgatttcaaaacttgtttgtaaagaaagcaattgatcacaattggtataattgtattttataattgtaggtagatttgataagaagaggaacatcactgaaactatattgatggtaatagtgaagagaagcagaaatactggttaacatactatttctgttccttgctaactaactgtgctagcaccatgcagttgtaggaagtgaagcaatacaacagacaatagctctgctatcagaacagcactcaggattgtggccaggtttgggaggggaagcaaattacacgtcatgttccccactcctaccacatggtggaaggaaattacttttgaatgcagaagacatcagagttatagttcctcaatttaaaatgagaaaatgaggtcctgagaaaataaaggaaatagaatttgttggtggtatatctccaatattctcactttcatctttggcatgttctctagaacttttctatgaaatcacattggtcattaaagtatgaccacagccactgtctctaaacattagtggaacaccttttatgtgcaagacacagagctatttattatacatacattttagaacctaacccttttaacagtccaataaggctgatgctctcttccttttataagtgaacaaactaaagatagaaaacttgtccaagatccgttaagatgaattcggttcagtcagactcctcagaccatattttctctgttatactttccttatcctttccataatggaaagggttgaatttggttctagaaggataattatagattacagtaaaaaggtttttatatcattgttaataattatatcagtgtcattatccttgttaaagacatttaaaatattactttaggcagcagcactacaaaaggtaggttttgaatccccaggttccttattaagggtaaaagcatattgtctgaatgcaaagggtatacacattaaaagaaactacaatacagagtacaaagtgcgaaaataaagcaagcccctgtggagttatgaaagcgtaactcagcctcaggccaaggaacatctactgacaggaaacatgtacggaggaaatcctacactcagagaacactgatagacaaagagcacacatagagcagtaatatgtgcaggctgtcattcttctccccttgaacaccctcagttttgtcaattctttctattctgtaactgcaattgcttgcctactaagccactgcacatgaaacaaagactgggcaaggaaaaggaaggaagaaactcactctgctgactctccaaaaagctagagcttattttgacatgaattttcagacagcctctagtaaggatgtaggttgtggagaaaggtgtgtttgttgggtgctcaacaaaagtcatttaatagccgagtcctgaaaatgtagacattcttgaatgactacattagagtaaatgaaaacaaatcatttactccaagggattgcctcttaagtgtcataaagcctatttagtccatatttggggaaacaagtttccagaaaagtcagagatgaaatcaggaaaaggccatgctctgaaatggaggctagtaaatctcgccacagtcaatgagttgccatgttaccaatgtctctttatagaatattgtaagatgtaggatctgtatctaagtccaccagtatcattctgatgttataattgtactttacgtgttggacatgaaattacagtggctgttgtcattaaaagcatcaaacaatttaagaataagaagaagctagtacatatccaagattgcccaaaggagacaatattacggttttagataactcatacattttagcaagaaatatttctacagtggcgaagacaattgatatagctactctagtgtgattaaaaatgtccatttagagcacctgaaaatgtgttgtaattctgtgcacccaactgaactactgttctaaaacttaatttacaaaacagattttcagggagagtggttgaagcaacagattgaataatcttcccaggagggcaaaatcaacaactctttgcttatgtttcccccacatattctatcacagcactgtagacaaaacaaaacaaaacaaaacaaaacaaagccttatcattgcattttaaatgcaattttaaaatttcccatggtaaattaataaattaagacttttactaaataaaatataatagcacagccttatatatcttcatgaaattagaaaaataaattccagagtctacaaaactgaaggccacacttgagaccctttttgtctattaaggtaccagctcctattaaggcacgaaatcctttgatggattaaaaattttgtcacatccagcttagttataacctatgagtattataggcaaccttgtatactatagaaatcatattggtacagaagtatagttcagtgatatggatgagaaattcatagatcatatcagaataaagaaagaaaagacagactttaatagaaaagaaaatgtcttacttggttaagaatgtcttgtttctgtgcatgcaaggaaagaaagaatacatgtgttaatgtaagatactttatactcattatctcatatctctgattatttagctaaaagttcaagtttacaggttgattttaaaacacaccctagatccataggcctcaaaaggtggttccgaaacagtggcatcagcataagttagaaaactgatagaaatgcaaattcttgacccccacctcagaaacactgaatctaaaactgcgtggggtcggggggaggcaggcagcaatccatgttttgacaagccccccggttgattctgaggtacactaaaatttcagaatcaatgactagatcaatctttgtatataataagcaaactgttctgacattagataaatataatatgtaacacatacagtgtgattaaaatattttagaggattaacagaaatataaccatctatataaaggtatattagattttgaatatgtatttcccattcctaagatatccttctattagcgtcacgcctagcatctctccatactcttaaagattaaaatatatttctatacacatctgccactttcttcccatatctcagctgtgagtggaacaatttggaattgaacttgaagtccaagatcaaaagaaaaaaaaaatgtgtggaatgctaaactggtttcccctcatactaccaaattctactgctctcaggagactatttacatggcctgactatgttttactgagaataacctcactgaaactggatctctgctacaaactagctgtaataacgttcttaacattatattatttacacaagagtaggtggaggctaataagactctctccccttgtcaggcatgagtcattaatatgtatgtgtactgggaagtgccacactcactacaaaagcaatgtcttcccatgccttcccctaacctttctccttcctatctaagaggatgttcctctcccctatggcttggtcaatgaagtgaagagcacagggcattagccttaaactgggattctagtcaattaggtttttgttgtggttactgtcacaagctagctggtgaatcttggacaaatcatttcacttttcttaaaatagtttctttatttaaaaactttgtaattttattaatttgggaatctcaagacctttgaatggtttttattcctacagaatctttaaggctattgtttagatttctcttattcatttcttcaaggaatgattatcaaatgatctttaaaagatgggaattaaaagtaaatgattcattcacatattatacttaatattttttctctattaaaatagacttcaacaggtcatatctttttgggttaaatttttatccccagcactttaaaacttcagtaattcaagtgaattataagcaaaatagtacatctacgatttaaacagctttatgttgtaggaggataagcaatttaatttttgcaaatacattttatgtaaatgatacaagctatgttccttttagaaaacgatgaattaattattcattccaaattcaggttgcattactcaattgtccattttttcttgtataattcagcatcattaactagtcatcagtgcaaacaactttggggtcaacttgaccagccaatgcagagtgataacttcacatgtgaattgacattaggaattctgccatattgtaagagtaattttttataaattggatgaggtcatgtattgaagagaactttaagggcataaagatttatttctcatcattagatattcttaattattttcaattggcttttagaagatacatactagttttttaaatggttatataagccttaaaattttcttccgaaggaaaaattttatgaaaattaactaagatcagagagtggttttgctcttaatttagaattgttcttgggttgtaatgagatctaactttttgtttttcaactgttcgttattttaataacatgtttcaacaatagatctgtacatttatgaaatgtattacattgttgaaaagggtgatatgtgtgtctaataatgatctaataactacctcaaaaaatgcagcatatggtgactgataattctcatgaaatatataattacagtaagactaagtcttgagagtcctataaataaaaaataattgaagcaaaaaggctgctttgcaaacaagatcacttaactgagtttgtagccagcagctatcattatggagaaaaacaggttttatctctgtatatagattagataagcatgtaagttttcaaatattgttgtgaatataaatattaatgacaatttttgtgtcttatagcaattcagtgctataattcatctttacgtttcccaccctgctttcttaggctttgagattctcagttttgtaagtttagctgctaatttttttttcctcctcctctatggcatctagaaaaatacaagggaaatgtaggtcaaacatctattttttttctaatacagaaaaagggaacggctttaaatagcctttattttctccatcatttataggcaccaaatattaattttattttttaagaagaaaataaattccaggctaaagagttttaaaagttacagtaatgtaccagaatgtagagagaataagaaaatatgacatgaaaaatagctaactacgagaaatactgataggaaatttcaaaacaatttgaatatcttgagggttatgataactaaaattaagttctagaaatcccagggaagtacaatattgaaagataactaagaagtgtgctcttgcaaacatacaaaaaaaaaacaataatagcaaaaaataagtcacattttagtcagcaaacaaatctatctagttaatacatcctgacaaaagggtcttttgcaaagagaagtatgaagcaacgtaaatgttgccttctgaagctgcaaatgaactaacagtaatgatgatcgaacatttaaaatgtaacatctctcaactaatattaaataggttatttaacaagcaattaggaaggaaaaggcattcattccagcatggtattcaaaagcaattgacaagacatgcaaagttttcataagaaaatcttaaagaaatcttaagcttactggtaaaaggtaaaatagaagattaaaaaaattcctccctttttgtacaagttggttccttaaggtgacggaccaggtataagcaacacaaaatccttctttggtcaaggaaataattgcctgaaaggggtaactccctacccctacaccaatatccattttggattgaaattcgtgggtcatagactgagagccaagcatactccttctctattttatccaatgctgtttcctgacttctaggaaaagaaccaacgctacacttaaatgattcatattctttcaagcatacaatatagaagagttatttgaacgaaaaatgtacaacatttaatatatcttctagaatagcactgcattatgaacttcattttgtttatgttatgatacatggtaaatggtttatggtgtgcatatatatatatatacacacacatacacatatacatacatctgtatcatacatatataatgtatatgtgtacatatacatacacacacacacacatacatttttccaagaattgtttattaagaaataccctcttccaagcatatatacgaaactgatataaagaaaaagaagttttaccccttcaggattatactttgcaagcacaccattaccatggaattcttcaagaacatcctttaatttctttgtagaatctataaaaaacagaaaacacaaaaattgtttatatgcacatactgtggttgtgtagcccagtccagaaacagagaccacttaaaatgtaaataagcatcagcagaaactaaatttaaaaaccaacacataaaatatctcttgccatttttgaaaggctatttaattggaaaagaaattgcaaaggagcaaaaagatcactgcattaaataaaaacaatacagctggataagaaaaatatgggtagctaagcctcaatggtgaatccatttagagggacgctatagattttagtatctgtagatatttttaaggagaattttctctgtatacataacacaactaaactaaagcctactttagtaattaaagttttagtaagtaagctttaatttagttgtgtcacatattttaccctatatatgcattacgaataacattttagttttgttatgtataaattaaagcttaccctattcaatgaagaaacaaagcttagacatattaccaaaagaattataaattattttcttcaaaagtactattatttttaaacctttcatcttattagttggtgacaagaaattttaagttaataaaataatgtcataaaagaattatcagtattacaattaaagttaaatacattaatatgatatagatatatacattcagtctactaaaatatgctcattatacttattgaaatataatttttgatttagaaatctcagaattacaacgcatttttaagttagaaggaaataatagctaacaaatatgggtaagtcatctaaatatttaatcaagtttgaataataatgaaaaaacctcaaaattaaaatgtaggaaatacatggatttcccagttttcttttatggaacagagcatggaaaattattggctaccaattgaatataattcttgttgaccttccctaagagtcagtgatacttggactaccacaaaatatttcccagttccagaaaactaattcacaaattagcttttgaaacatcctgctagaaaactctctcatagatgcccattgaatatataatgcctatattttgtgaattgtacttttacttggaatgtaccatttcctttctttatattgtaaattctgtgggtttgtgtatgtgtgtgaaacaatagatagatagatagatagatagatagatagatagatagatagatagatacatagatagatagagtttcgctcttgttacccaggctggagtgcaatggcacagtcttggctcactgcaacctccatctcctgggttcaaccggttctcctgcctcagcctcccaagtagctgggattacaggggcttaccaccatgcctggctaatttttataattttagtagagacagggtttcaccacgttggccaggctggtgtcgaacccctgacctcaggtgatccactcaccttagccacccaaagaactgggattacaggcatgagccaccgtgctcagcctgtgaaacagtacttttaagtgagataaaattcgtgtcacataaaattgacattaacaatttcaaagtgtacaattcagtaatttttagcatattcatgatgttgtgcaatcattacctctgattaatcccataacattttcatcaccctgtaaagaaaccttatgcccattaaacagtcactccctgtattttctcccctctaacctctggctatcattagcctattttctgtgtctatggatttgcctattctggatatttcatgtaaattgaatcatataatatgtttcctttgtgtctggcttctttcacttagcttagtgttttcaaggtttttccatgttataacatgtatcagtacttcactcctttttatagctgaataatattccattataatgaatatactccatttaataaatctatttatcagctgatgtacattcaacttgtttccaggttttggctgttaggaattctgctatgaacattcaagtgtacacgtttttgtataaacatataattcaattctcttggctatatacctgatagtaaaattgccagatcatacagtaactctatgtttagtgttttgaggaactgccaaattgattttcacaacagctacaccattttacactcccaccagtaaggtgtaaggattccagtctctctatatccttgccaaaacttgttattttctaaccctttttttgttacagccatcctagtggatgtgaaatgattcgactcacatctgattagtcattcgctaatgactaataatgctgagcatctttttatatgcctattggtcgtttgtatattctttggcaaaatgtctattcaagttctttgaccattttttaattggacggtttgtctttttgttgtggacatcctctggggggtgtgtgtgtacgcacatttgcttgatgcctatacagcttcctatgtatttcctttttggtgtataatttgctggcattttccatattgtgatcagagttaattttttatgtcatgtcccttgctagattggaggttgttctcgggcagaaaatgtgtgttttcattttagcacaactttcaacttcatcacaaagttgaaacaatagcattgcaataaatattgagattaaattaatcagagctattcctaaatggcaaaaaattacaataattgcttctatatgtactttgttagacacttacactgcagagagagaccaaactgcatatcaaaaagagacatgaagctgaccccttattctcaaattcttctttgtgggtaataaggcactattctaagttagcagaactgcttttacttctttttatccataatcgtagatgcaacccatactgtgcagacccacagagacacacacatacacagatgcatacattctggaatatcatatctcgagagactatgtttattttaaccatatcttaggccaatgataaaatggaaggcggagaaaacaattttggtttctcccacataggcctgccccacaactttagagacactgcttagatggccttttcgtttcaggtttctatgagagtaaaaaacatattcagtaattatttataaatgactcagagaaggggaaagctcataaaattattcctacaatattttattagtgtactggtcatagtttatactgaatattcttagtagagaaatcatgagctaaattaacagccaaaaacctctagatatatgactgccctttccatgaactagggctcaacaatgacttggtctgagacaatttaaagtgctctagttgatattcagatgaatcactatcaattcaactcactgcctctccaattctcaagttccagttctaatatcttaatatttgaagtttaactatgacctgatctccactttacaatctagtttggaaactggagcattatcttgtttttgtattcctgtctcaataacatttcttgggcccagtttctctaaggctgaggccctgatttgaccggtcaatcttctaaagataaggatttgcgcatggaacaccagagagttcaggatatccataacctttcaacagcattgtttttacatgaattatctacatgtcttcttggacacccaaattgcactaggttgtgaaaatcctactgctatgttttaccttcttttggggggaacacacatttatcttatttgtaagttaactgcttgtccaaatttcttcctatggcctatcaccataaacattcctatcttttttattgtgccaactctgagttacattctgtccaaaactacactggggcagtggagaggggaaaggatctataactaggcctgacctgccttctaggacaaaataaacagaggaagttatacctggatgaacagatagtaagacgtggcctcagtcataattcagctaataatagagcttcgggaaagagcacagtgacagatactaggctgagcaatgctgagaaatccaggcaagcagccagccaggcaggcagctgtgagcttggagatcagtttagtaaatacatgtctgtaatgggagaaagaacctggaagattggccagtgaagtgctaggcagcccagtgctgagcagccaggttgaaaacagcaggtttagttcttgggataagggagctggacagatgcgcagcacaaaagattgggtctcctggaaagcaaaggaggggtatgacttggggaaattctgaaacatggggctaatttcagaggttcctatgcttggcttgactggcagggcaggatacttggaaaacaacagtgaatacaaattactgccctttgactaacatatccattttcccagcaagtaatttaatactataccaataactacagctgagacaatgggctgtctttttcatcactgtcagaatcaacttagagctgaaaatggtactgagcatgaaagcgggaggtgttttattaagcaaacattcttggaatgagctgggaaagaacaaagaaaatgtttatggggagatgagttgactttctcctatactttacctttctatcacctgctctggtacttgagtaattccaggggccccccaaaatgcacacaccctgtcaatcttctcatttcggctgagtcatgtaataaacaatgccatgagagttaaatgaactacattttagggatcaacgttaaatttttatttacttttaaaatgttcagaatttttaacgattttcaagaaaaattaaagaccctttacattagtctgaattgaaaataaataaatgactaatagcatttggtaacgtttagaaaatgcaaatagatcataaaaagtactacatgaaaaatgaaacacttagttcctctcacatctctttaggcatctgttacatcttgagtgagtctcctttgtgattttcctgcctctttgtctctttattccaaaaaactcaacacatacttgtcagattaatctcaaaggccccatgaagtaacggagagatttaaagccagctagatttagatttgaatcttggctccagaatgcttggctgaatgtccctgggcatatttttaacctctctatggttcagttttctaatatttaaaattagaataatgatagggatctggcaatactgtgtctagcaaagtgtctggtgcccaataaatccttgttcctttatttcatcctaaatgtgactttaaacaaatcatcacccttcaactgtttcctgttgcttttggattgaagcacaaactcctcctcttggcaccataggtgtgtcaaaatatgatccaaatctatcttccaacagttattttctgtatcttccatatttactattcaatatccattcatccaattgtgaaggcatcccatcatcccatgattttagagctcttcttttgctgatgatttttttttcctcaggaatcccgccaatgttgagtgaagttcaacataatgtatggcatggtttatctgtcaacttatccacaaaatctctcaggacctcctcaaacacagtaggttgtaactcatcctccatgggacaccccataataactctctcagaatctacatctcatttgtgcattgggcactagtaacactattaattatagcttgaatgcatgagcattttagagtttgcaaagtgttctattatctcatttaaaattcacaataatgttaacaaatattcactccacttaacacatgaagaaatcaaagttaaggaaattattacctacttaggatcacacagctaaaaagtttcacataatgattcaagctattgtatatgacccaaacccattctcgtcactttggaaaaagaacaaatacaagtttataatttggcttaggaacctcattattacaacagctaaaatcacacagccaaaagaatgtacagtagtgattcaaactcctatacagtaaatatattttaaagatcaaggccaataattttgccacctaaatagtagtcatagctgctgtgagaagactatcatatattctactgttaaagctaagacccaacttacaaaatgcatttgtcatttttgtaaataatgtgtttttagtggactgactgtaagttcattatctggtgtttttgtttttaaccaaaatagtgccatgtttcccacgttcagtagagatattggttttccaggctaatatgatagtttttacaaagtgagagaggctcaatgggaccatggaaaagtcatctttcgggtctctcaattcagtgctttcaaaagtttcctttaaaatctaagcctccccacatagctttttcctcttatcacaaaagatattcgtggtatagaagacttttcctgtgctcagcaaaaaagcattttttcaggaactatattaaccctgtagtagagagggctctgcaacttcaactgtttaaagagaagatttttctaatttaaatacttagctagcattaatgtgcagacgcattaatgctaagtatttaaattagaaaaatctttatcaattatgtcaatgttaaagttataattaatttatataatttaattgtataattgtatagttaaattgtattaattgttgtgcagacaacatagtagcattcagtccaatgttacatttcataaagtttcccttagctacatagtacttaaaagtagtgaaatagtgctttatcttcatttaacccagtaatactcaaacctggatccatatcaggatcatccggggatcttttaatatacactgatgtttgcactcaaaacacagtgaggcagatttaattagcctacatctccatgactggctagtcatgaggacctttaaaaaaggctctcagttgagtcttatatgcagctgagatggaattaatcactgctctgatccttaaatacatgcataaagaaagtgagagttaatcagcaatttttatcctgctaaattttcctatgtatgaatatatattttgtctgattgctacacggggaacttcttttagggaagaaaaaaaaaacctcatgagaacattttatttaaagatttatttactctcaccttaggtcacaatagcaaaaatagcattttggaatccagcagagagatccagaaaataatattgtcattaaatgaaattccccagatgatataaaagaagttctacttagagccagcagcagaaaataaatacctacaggactatagaataagagatttagagaactagtcaataagaaacagaagtttttatctacttgtgtgagaattttcataaaagtacaaagagattgaaaaagaaatatggaactattgttaaaaataataacagccatattgtagcagtttatatgctatttgaaatctatacacttggattttttaaaatcctaaaaataatattctaatgatactgctacagtgggaaaagctgtacaaaaaccaaaccctctattcaggtctttgctccaggctcaccacaggattctgggaaaatcctttaagctgctctgagtgcaagtcactctctacttgttcctgctaagcatttgggatcatcgttagcttaaaaagataatgggcataatatctttgagcaacctgttacacatatagcaataagtatttctacttagcaaaaataaaaactagttaattccaaaatgactacagatttgagaacatgaagaaaatttcctttctccttttcatatttattatcgttgttaatcctcttaaacatcagtttttattaactctttcttgtatttgctggtaatttttactccttcatctatctacatctaatgttttgatgtatgaatctaatccaatgccttgcacaaaatatttgtaagagtcatttgttttgatagacaaatatctgctaatttagccagcaaccctatccagacactaggaacctatgaaataatttccacctttatacgtattttattgtgtagaaaatacattaagaaaaagagtatacttgccttcgagccactcatctatactataactaaaaacttctattgaaaacataattgctaattaagagatactattagggacagaattgactggtgtggaccaatagtgtgctggtaaatgtttaacaactctttgggatgtgaagggtgcctactgtagtgtttgccaattgctgtcttgtaaatatttccaccatgacaatttcaagcctcccacatgacatcattaatgtggagttgggaaagaatgctaacattcagctctgataagcaataattaatgaatcaatctatatgtgattatttgtactttagaaacaataaataggtctttaaagacaaatctggagataaagaacggaaataaaaagcctgcagctatgacttcttaatcattctttcaaatattctcaagccacctattgagtttagaacaagtactgttccaactattggaatatatcattgaacaaaacagaaaatatgcctaatcctatagtttgtattctagtgcaagaagatagattacaaacataatacattattaagacaatcttatatcaatgcagtatagagatgtgatggcatggaggtgttagtggtggagtaggaaagatgaattattttgaaagtagagccaaaagaatttccttattgattggatatgggttgtgacagtaatgtgtcaagagtcccagagttgtagatttgagcaattggagggataaacttgccaataagtaaaatgaggaacactgcagatgaagcatgtttggaatgaggagtcttcaattttagttttaggcattttatatttcataaatatattagatatccaagtgtagccattaggaaagcaattatttatgagtgtggaacccaatagagaagcctgggctgaagaacgaaatttgagtataatttctatataaacagtatttaactggatgacatcacatgtatagtgattgtagatagataagatagcaaggactgagttttgagtctcagttcactctgcagttcaagtaccaggaaaagagatgcaatctgctaggaaactaagaatgaatgcctagtgaaatagcaagaataccaggaaaaataatgtatcccaaaagcaaagtgtcatgtaatatcaagttaaatgaggagcagatttagcaagacttttaagtttagccagaaggaaatcatttgtgtccctttcaagggctgtttcaattcagtagctgggaaaaaaaaaataaacccagagtgagtttaagagaaaatatgatgagaggaatgggaggcagcaaatataggcaactcattcaaaaacaattttttgccatagaaggaaagaatttgggcagtagctggactgcaagaagtgaaggcaagataaatttttttaaaaaaagagaaaaaaaacagcattctaatagaaattattcagtcgagagagaaaaaaataaaaaattaaaaaaaaaatttttaaacacccactagaatgttgtcctttagtgggtaagagagaatgcaatcttcttcatagcagaaggtctggcttagagtggaggcatggacagtttacctaagtaggaaggcagattgacaagtgctgcttaattaccattcactatttgtcatgacatcattactattggtaagtggatataataataatgttttctttgtccttaggctgggattagtagctggtgcatagtatatattcattgacagtgagcccttatcatcatcatctgtgccatcaggcttaagctaagctccggggatttcatttttctataaccttaatttcagattattcacaattttcttaattttcttttacattttcactagatgcttttaacttcctctctttaaccaacaacttgaatacaatataagatgtcttaaagttatatgtaaaatagaaattgtatatttttttgtgttgtaaaattcacttttgtgggcaatagaattaaatgcagacattttatgtgtgtaaatcaaaatgtttaaggaaatgcaagtatgagttacatttttgaatgtgtacattaaaaatatttaaacccacgctagttcagaagatgacaacttcattttattttttttaagttcttatgtgggttgcaaaacacttactggcaaaccaaacattctggcaacaattctgtattctctagtcacaacactaataacatcctgttttaagacaatacaaaatcattaaagttgacaattagtttctgaacataaaaagattcagctctctgtacacttaccaacaaacacaatattaggcaatgtggagaaaccaaagtctatttatcctgtgagcatatacattttaaggaatattatttgctcacatacatattttaaagaacataaaactccaaaatattgttcccaaatcttacattgagaacaaaactcaggaatgtgtcatatttaccttgtgactttatgcatccactcatctttatggtatgtccggaggcatgaagctttaatgtgagaaggaggctataactaactggacacataattaaatgtagttgaagaatttgcttccagatcttggctcttagatgatctataggatattcttctcacaaagtagaccttcattttctctttctaatacttcaaagaaacaatacttaaggactcttccaggtacagcattctctgattctatgatagtgcatatctccacatacttactagaacttgcagccccacatctcctaaacattcccttcccaattcagaaagagataattttctagcacatcaaattccccaatggtatcagtacctccagtgatatttgcactggtgttataattcaggaatatcttcagaattacagttattactctaaaaataatcatttgatcaagctctctaaaagtttatgttgactgtattaagctgtgaacattgcctacaatgtgacaatcaatctttacattttttaaaaaatttaggggaggagaactgactggaatcaaaacactgcaagtatgcatattgtttcttagttctgaaaatccctgtgaaatagtatttagaagggaaatctataatcttgatttgtacaaaatggcacctttcacaatctatgttcttacattggaacatttgttataacaaactttgtcataatttgctatcaaattaaaaaatacctgttcaaatactagctaaatgtgtagggtattttaaacgagatgatttatgatgtatcttagccgtatttcagacattcatctggtaaaaacaaagctacccctacactgtgtaaacatttttaaagataagaaagaaagaaagaaagaaagaaagaaagaaagaaagaaagaaagaaagaaagagagagagagaaagaaagaaagaaagagggagggagggaagggaaggaaagagaaaggaaagaaagaaagaaaggaagaaaggaaagaaagagaaagagagagagaaagaaagaaagaaagaaagaaagaaagaaagaaagaaagaaagaaagaaagattttgtaaaggagtttagttacaaagccagtttgatatggttttagagatttatagtccatgcaacattgcactatctgaaaatcaaagaagagcagttgcaatgtgtaaggctaaagcagtcttcaaagtgaattgtagaattcctttgaccgatgtgcttatattacaaagaacattctcagtcatgttgatattgggatttttttttaacaagcaccatctcataaatttatttagtaatgaaaaaaaaaactgccaagaacatcaaacataaaatctgccaaaggaaagcgaacactatttatttgtttcctagggctgctataaaaagttaccacaaacctggtgatttaaaactgcagaaatttactttttcataattctggaggccagaggtctgaaatcaaggtgtcagcagggttgtttttttctgaaggctctcataggaattagtttcacacctctcctctagtttctggtggctgctggaaatccctggcaacctttggcttgcaaactcatccctccaatctctgccctgtcgtcacatgatcttctccctttctgtctttcacattaggcttagagcctatcagaaatccaggataatctcatcgtgatatatttaatttgattatacttacaaatcacatcaaatgtaattacaaaataatttacattacttttcccaaatataaagccaccttaacagtatccagggcttaggatttggacatatctattttaaagtggaaactaattgaactcagtaggcaaaactttaaaggtgatgttcaaacaaaccttctctgatgcatagccctaaaatcctaatggaattttgtaaaattgttatgtggtatgttcatttagggcctctgagaagccttaagttgcaagaagctggtaggaacacctgtgaaggataaagaggagcaggagtaggcaaggagcgccttcagactatgacactggtctaacagcagcgagaggggacaagaaggtcaagaatcgggttgcaaggcttcatactgtggtatagctctgagaatgtctccactaggccaggaaggagttctccagcaacatcatccattgttgggattctctgttataaagaaatgtcctggattcaccatcacaactgcatttggtcattgcctgggagcagtccagggagagcatgcctccatgtcagaactgtagcaaatctaaagtgtcatgcctaaatgaagaatagatagtcaaagctcatgagagaagttttctgtaaccattcatcaaaattccaagaaaaattgaagaaggaaaattttgcaaatatagttcctttgatatctctagggaattctagaacatcccaggacatcattctaggattggtgattgtgagacaatatccaagagatctttatgcctcctagcaccactgttatgattagagccaagaggtattggcaaccttgaaggcatattgtggcaggccagttttcactaacagctgaacagacaggcctccatgacaactgttttagcactgactgagttgttaatttaaatattaaaagcggatagagccagtgctcttatacaaagggtggaatgtaacaaaagcccaccaagagttttgcctagaccattcctgggccttgaagcgtaagaagataatgaaggaattcttcacaggatatgtttagaattaaataagttttattgggggtatctgaaggaactcctcacacctccactaacaagttttattggggtctaaatgaactccccaaatctctttgatttagcatgagcaaaataagggtagccacccctggcacctggacccatctggttaaagtaaatttactgaggctccagaggaaggtcttcaggactctcagaccttagttatagattagaggttaatcacatatgtctttaggtaaatacaaacttacatgtagacatatagctaagaaggtatacaagctctgggaaactgtaattttcagttggtctggtgatattttcccagcattctccctgtacccggtaacagaaataaactctcttctttcccagtttgtctgcatctcgttattgggcggcaagaataagcagcctgaccctcactttagtctgggaacaatattacccaatgctggtgatgtagtatctaaagggggtgcttatatagatgactttgctttgatgaaggattaattaaatggtcttgatagcaatgaggacaaagctctgattttttttcttgcccaaattcttttctatggggtctagggaattgggccttacaaatcataaattctcatcatcagatgggttttatttaaccctgtatattgtgacttactttccagtctgattctggcataactagggaaaaaatcaaaatatattttccccaaaatatatttccctgccataccttgaaaatgccctgcaaagtctcttttgggaaaaatccacattcaatagagaatccccttccccctttgttttccttcctttctttccagatccaggagataatcaactaagcgccaggcacccttttaggtctgataagaaacattttacaacctgctgtctccctgaagtctgatatctgagagatttctctgcacagtaatacttgatctccacaattctttatcttaacctgaacactcctttccattgatcccaggtctccagataaactcaaccaattgtcaaccagaaaatgtttaaatttacctagagcctagaagcccccggctttgagctgtcccgcctttctgaaccaaaccaatgtatttcttaaatgtatttgattgatgtctcatgcctccctaaaaatatataaaaccaagctgtaccccaaccaccttaggcatatgttctcagaacctcctgagggctgtgtcaagggccatggtcattcatatttagcttagaataaatctcttaaaacattttacagagtttgactcttttcattgacagcaagtaggtactcaaattggtcaactgggctatgaaaagaatctcatgcctaacaataaataaagtatgaaaaaagaactggttctacagtttgtcgctaaacttccaaaatttttttgaagagaactacacaaaacagatatgttaatctggtgtggaggactgtcttaccacattggatagtaaaaatgttgaagaatttttatgaaatacacttacagaaaagaattactaaacttaattcttatgaattagaagagaaagcatgcatatttgatgaaaatctttaaagtttagatcacatagataaaataatgtagctattggatatgattatgacatgaatgcatcacacactcttcctatcatctgttacactgacaccaagaaagtgaatggaaagagatatccaatgtgaattttaatcctcccattgttgctgtctatggcatcagctgatagttgaggatggacagccatccatttccagagtcaaaaccaccaggaggaaatcatccattgttttcttgtacttggacatagccagacctcaggcatttactttctgcctttctcacccctcaccagttccctcctgctcatccttccccttcagcaagcagcagcactgactacatcttccagctttctcttttcaccgctgtacctcaattgggttatcttcaatgctttaatcttcaaaagaaacaaaacatgccttgtctcctatgttgctttgttaagagttaattctattccttgtgtttttaacatattatttattcttcaagcttctgcttagaagaaaaatgtaatttgtatctaatactttacaagacagcatcattgtatatagaatggatatgtactaataagcacataaagtgctaaataattaggtgttaaatgattaaataattgatactttagtgctttatattacgaaaaagtctttgttgagttttatatacatgtttcagtatttattattacttgggaaaatttggttgggtgttttcataggttgagaatgcattcttattttccctactaaaaataacagcatacaggcccctactattaaaaaaatcaatgtttaacatgtttacaataatgtgttcgattcagataatgaaggatatatgcattacacttattatgtagaactaaaaggtacagagtcagtgaatttaaagtaaatgaagaatgacagagaaggtaatgaagagaccacaagagtgagaaaagcaaaaaatagcattgtaagttaaccaagcagatgggacagtccaactaaactggaacagtgtagtcccctttgttagctgctctaaataaggggttctatcttcacatatatagtaatataatcaacaatgaggggcacaaaaacacatgatcaaaaccctctaccttagaaaaagttccagaaagaagaatgggatggcttttgctgtgggcaaaagctgagatcaccaggacatgtagatgggtcataaataaatatatatatatacttggcctacattttgtgggaaattcttttacattacatcctgtgttgttagtgctaaacagttacatttccatgaacccacattgccttttaagtgttttgtagtctctcggcaaagggggaaaaaggctcctacacaataagctcattttcctgagggtgtggcttttgcaaatggacttaaattactagaatttgtgacagccagctgccttggtttttgtttgattgtttgtttgtttttgccctgacactccattagtgttatttattctcactcataggcttgggaggagtgcaaggacaagttaaaaatctgtctgaatgactgggcagaaaagattttcaagccatagagaaatgtcttaggcattgttgtttctctaatgggaagagcctgagaaaacacttggaaagtatctcctccaaagttacagtcgatttggagaaaagctatctaaataaagaatatttcaagaaattacataaactttgattgttaccttgcaagaactttgcctaaggcacattgtccaagcactacagaagtataaagaagattctaacttgattggatatttgttccacttgaaatctgaagttacggaaaagccaaatagaggctgtatgaaatggaaaatgtcaaaaatcttaggtctcctcttattcacatattattatcactattactttgctatagcatactgatgattttacttgaatgttgctatgaatgagggtatctcattgatgacttaaaccactggtgctttgaaaatgttatttaaaacttggatcataattgaatatcaattattcttttctcaaccttagaatatatatagtcatatgcaacagtcttctccaaattattcgattttctcaggaaatccaagttaataaagacagatggtgaattaagtgaaattggcagcaaatttatctcaatttttgagatttttaaaaaacaatgtgttattgttttagaattctctaatttctttcctccctgtcttaaatcttctttccatcacagatttctttgcatgccttggctgtattgtccagattgacatcatattaagtggcatgtgtttctttgctattaagctgaagtggcttttatgtttacaggcaagatcattgcattttttatgattgtgtaattaaaaatgcccatttcataaaaactaaaagcacttaaatataagaatatataaccttccatgatttttctacctggaaatgactactattatcactgcagtgatatccttctagaatattttgaattcgtgagcataaatacatatttagaaaattgggatccaaaattacgaaaatggaattagggattacatggcattttgaagctactttttaatttaatatatttaaatttattttcatgttaatatatatatattcatactatcaacagtattgcttgaatggtaattcttttatagctgtaccacaatttcatttttcaagcagcctcttattttgagcatttaaataactgttaaatttgtattcatgttaacagtaaaataaatgtgatatacatacgttgatatggtttggctgtgtccccaccgaaatctcatcttgaattatattaggttggtgcaaaagtaattgcggtttttgccattgaaagtgaaggccaaaactgcaattacttttgcaccaacctaataattcccataatctccacatgttgtgggagcgacctagtgggagataattgaatcatcgagatggttacttccatgctgtttttgtgatagtgggtgagttctcatgagacctggtggttttataaggagcttcttcccaatttcgttctgcatttcttgctgccaccatgtgaagaaggatgtgtttgattctttttctgccatgattgtaagtttcctgaggcctccccagccctgctgaattttgagtcagttaaacctctttcctttataatttgcccattttcaggtatgtttctattagtagtgtgagaatggactaaaacagtaaattggtcatgggaggagtggggtgctgctgtaaagatatccgaaaatgtggaagtgactttggaactgggtaacaggaagaggctggaagaatttggagggctcagagaagtcagaagaatgtgagaaagtttggaactttccagagacttgtggaatggctttgaccaaattgctaatagtgatatggacaatgaagtccaagctgaggtggtctcagacggagatgaggaactgttgggaactggagcaaagattactcttgctagccaaagagactggcagcattttgcccctgctgtagatacctgtggaaatttgaacttgagagaaatgatttaatgtatctgatggaaaaaatttctaagcagcaaaacattcaagaggaagcagagaatgaaagtttgaaaaatttgcagcctgatgatgcgataaaaaaataaaaatccattttttggggagaaatacaagccagcagcagaaatttgtataagtaacaaggagctgaatgttaatcaccaagacaatggggaaaatgactccagggtatgtcacagaccttcacagcaggccctaccatcacaggccaggaggccttggaggaaaaaatggtttcctggactgggcccagggcccacctgctgtgtgcagcctagggacttggggccttgcattccagctgctccagctatggctaaaaggggccaaggtatgactcgggccttggcttcagagggtgcaagcccgaagccttgttagcttccatgtggtgttggtcctgtgggtacacagaagtcaagaattgagatttggaaacctctgcctgaatttcagagaatgtatggaaatgcctggatgtccaggcagaagtctgctgcagagccagagccctcatggagaacctctgctagggcagtggagaagggaaaagtggggttagagcccttatacagcacagagtccctactgtggcacaacctagtggagctgcgagaagtgtgccaccatcctccagaccccagaatggtaggtccatcaacagcttgcatcatgtgcctggaaaagccacagacactcaatgctagctatgaaatcagccaggagggaagctgtattctgcaagctacaggggtggagattcccaaggctctgtgagtccacctcttgcatcagtatgacctggatgtgagacatggagtcaaaggagatcatttttgaattttgaggtttaatgactgccctattggatacaaacttgcacgggccctgtagctcctttgttttggccaatttcttctatttggaagacgtgtttttacccaatgcctgtacccccgttgtatctaggaagtgactcagttgcttttgattttataggctcataagcaaaagggacttgccttgtctcagatgagactttggacttggacttttgagttaatgctggaatgagttaagactttgggggactgttgggaaggcatggttgtgttttgaaatgtgaggatatgagatttgggagagctgggggcagaatgacatggtttggctatgtcaccacccaaatctcatcttgaattgtagtttccataatccccacatgtcatgggagggacctggtgggaggtaactgaatcatggtggcaggtacctccatgctgttctcatgatagtgagttctcaaaagatctgatggtttaataaggggcttttcttcctctttgctctgcacttctccttactgctgccatgtgaagaagggcatgtttgcttctccttctgccatgattgtaagtttcctgagggttccctagccaggctgaactgtgagtccattaaatctctttcctttataaattacacagtctcaggtatgtctttattagtagtgtgacaatggactaatacatacacatttagaacatatttcatctgaaccttaccataaattcctaaaggtagtgtgaacgggtcaacgggctcacagaatttaaggtgttttttttcttttttaatatcctgcttaatttgcccttgagcaagtttgaactaatttaatttgtcatagcagtgtattagagggaagtgttggctcttgtgtatagaatctggaaataattctaatgtgaagcagatctatttaaatctagctacaataatcacatgcttcagtaaaaatgtcacattaattcagatttcatatcaccgtgaattaattaaagagacatcagtattagtaaattttctgacttacttgcattgtagtagagtgattactgaacaccctgttcttaaagataaaagactgacgaagaaaattgctttgaagcagaaagagaacaggattcagagttaaaagacctgtgcaagtggggcaaatacattccttggaacttattgttattttatctgtaaataaagatgacagattgagcaatctcaaggcttttccagttctaaaacattccctgtatgctatattgcagtctccattaagctaatacccacgacctgttttcttgtttttttttcatagaacctagtgcataaactaacttgcaaaacagtcatttttatgtgctacacgctccacattacaatatatttttaaatgagcatgctaggctgcttattaatcagatttcatttcataggattgtacaaataaaatgataattgattttccagtattaattactctgtagcccttggcagatggaatcattcttccagttgcttgattttttagaaggtaaagagaaactagaaggtaaaggtaaactagttaattgaggtctcatgcaaagtttactaacagaaaaacatacctaaactaagaaacgattggttttattcagttagaagggagaggtgaagagggagttgacttgtaaccttgacccttatagataaccaagcattttaaatgtagcttttagcacatttttgtgacttttaagtataagttacatagtagaaagagaaaatatttctttttatttttatgccaattgcttaaattaatcaaaataaattatgtgccaggcacagtggctcacacctgtaatcccagcattttgggaggctgaggtgggcagaaagcctgaggtcaggagttcgagatcaacctggccaacatggtgaaaccccacctctactaaaactacacaaattagctaggcgtggtggcacatgcctgtagtccaagctactcaggaggttgagtcaggagaattgcttgaacatgggagggagaggttgcagtgagccaagatcgtgccactgctctccagcctgggagacagagtgagactccatctcaaaaataaataaataaaatatgaaaagtttgtcatctttatttaagacacatagttgccctgttttaacattattctatttttaattgtaaaagcaggtggagaggggtggggttcatgcctgtaatcccagaactttgggaggccaaggctggcaaattgcttgagccgaggagttcaagaccagtctgggaaacatggtgaaacctggtctctataaaaaaatacaaaaattagctgggtctggtggcacatgcctatagtcccaactacgcaggaggttgaggctgaggatggcttgagcccaggagtttgaggctgcagtgaggcaagatcatgctactgtattctagcctgggcaacagaaaaaaaagaatatgattataaccatcaattaagattcagctagtttaagcaaaataatcaaaatattaaaaaataacaaaaggtataaaataaaaagtaaaggctcccacaaattccagaactgaatattttatccacttctgttttgtttaaccatctgtttcttgtcacaatatctatttatttcctgctataaaaggtgagaaatatacatccaacatacacagagagattcaaaattttactggttatatttctggttttagtcttctgattggcactttataactgtaaatattttactaagaactttatttgttaattcttcaactccagagtatctattgtctgttctctaccaactctgcaaaaaatggtttgacctagctttttctttctctcaccactctttttccaccttttcttaactatacctttatttttacatttgtattcctccatggagattcctcttcttctatatttaattttgttgctgggtgcatggccagttaagatgtagaaatggggcatggaaagtatggaagtgatctatgctgattctatgttgggacacttaaacagtgatgtgccttctgcatgctttctctgccctgcttttgccagctgggaaatgagcgggacctagacccagcctaaagcacatgatgaaagtaacatgagtctataaatgaccctgtgatggagagccacccacagatctggaaaattctccagctgactcttttgtgcaggaaggatataaatgtctttgttctttaaatctaggaatttttggtctctgtgctttagcatcttcgcccaccctaaaaaacacatttccgtattttgcctacttttttattctacagtttcaaaaccacttagcaccatttacaacaataggcatataatagtgttatttatttcttaaccaaatagtgtggctggcccctgagagagcagttgtgatgctaggttaattctatgccacttggagaatgttccaagcatcaggtaaattccattttcttattcttatattcaatcagtagctcaacccatgctgtattttagtttgcatagcattttgagcatgatgttccacagatttttttttcacactgcttatgtgcctttctttattcttactgaggtgcttactatatgaacactagaccttccatacttctcatattctgctctatgtgcaaaatagatccagggttttatatttagataattaagatcttattcacccatataagttgcctttttaacattctttatgctggcatcataacgtagtttctgagaaggcttgctattctttgttcccacctcagcatacacttacttgcctttttttatgatgtagctctaacaataatacatagaaatgcattctgcttcccaatggtttcttttccttgttgtcatgtgtttgttcagattcatttgtgtcacttcttattttgatgtttctcttcctggctgttcattttcttcaaatatcttgtgattcttgattaaacattccaacttgatggcaataagtacctatggttgatttctttcacagttttgtaagtctatttaaccataaaagcctggttctatcaaaaggtaacgtttcccttaagatgtgtggttgagcaaggggccgactaactcacagccttcaaaaataacaagggtggagggcaatatactggtataaagtgcttttgtgtatttcactcctacatgggatttgctttattctgcttatctttcaattcagtattcacattctgggtcctccataagtacactttgattttcaattagaaattagtattctttacaccagctgaatgcaaatactacacatccaacatctttgagtatattagaagagaagaaactgctgcaactcactcaccattatctcttctactaactattctggttgcctccccacagctctcctcacctgctaatattctgtctcaagccagtggtttctatattcattttctcttaatcacaatttttccttggttttcctttctttgctctgggctgtcaattaagtcacatttactttgcagttgtaatagaaattactcagagacttgttcttaatcaggaaatttgagcttgtctgtctttattcaaacaaactattctacttgaaaactatgtagttatttttacgcaccattcttatatgtaatatttgtattataacatataactctgggcttatcctcattactgtaccctaagataatatatttcacaagtttatatccttacaatccttttgaataatgcagtttttgtgtaaggccataaccagctaaatcagaaaatggtattttctttcctctctccatccttctttttcttctttccttccttccaggaagacacagagttttgccatctttaatccctagtatttagcacaatatctggccaaaagtagaaagcatttttttaaaaaaaataattgatggaattattttatttcatttgagacagaatcttgttgtctctcccaggctgaagtgcagtggtgagatctcggctcactgcaacctctccctctcaggctcaagcaattctcatgcctcagtctcctgactaactgggactataggcctgtgccaccaaactcaggcaattttttgtattttcagtacagaatgggttttgccttgttgtccaggctggtcttgaactcctggcctcaagtgatctgctctcctcagcctctcaaagtgctgggattacaggtgtgagccactgtgcccccggcctgaatttttaaatgaatgagttaagtaatgaatactatgattgcactatacttagactttaatattttgtttcttcaaccttggaaaaaaaactttcaccctctaactgggtatatctcatttgtgataattttatttttttcaagaatatttattcagtgcctactctgtcctttgctctaggcatgtggaataaaagcataagaaaccaaaagaaatattaacttcttggaaaaattcatggcgaagggatcagaggaaaaagaagacaaatattacaccaataatgataaaattgtaatagagaattacaggtgatgaaggagagagtgaattaaacaggagggttggagaatgtccttctgaagaagtgacaattcagcaaagatctagatgagaaagccccatagaagatgggaaagtctattcgaggttagtgtaaaggcaaagtggaagagtaaggaggctagtgtgattgtacctcagtttgctcacatgattatatatatatatatatttttaagacagatgcggtcttgttctgtggcccaggctggagtgcagtgatgatcatagctcccttctgcctcgaaattctgggctcaagaaatcccccagcctcagcctcccaagtcactgggattacagatgtgagcctgtctggctcacatatctggctatgtgaacatattattttatactattctctgtaagagtttatgaactttgcctttcttaactttccatttggctattatctaagtcttccataagttttttgaaggctcgatcatttcaatccttttcaccatccctggtaagtaataaacatatagtaacaagattaaatattacttgaaataatgaataaaagagctgattgtcaacctgatcaaattacgtgaattttaggcacatctacaggatatggttattcaaaatatggctcattcttataccaaagagaatacattaagcaagaatttcaaaactcggattcacttgtcacaccgcataaatgaaagaggaagaaatatgtactcctgaattactgatcacaagatatttcaaagatttttgaaggttttgaaacacttgcaagtatgaatgtggaataaagttaatttgccttcccactgcaacttgcccttatacctgaatttcctctcacttattgaagccatttcatcctgctttcgctgcctgattttgctgtttgacattaggcaattaatggagtggttatgtatggtcatttctatctcaataaattctgctcattataaaactccaatacaagaattattattgacattgacaagtgcaaatattttggccttccttttgtcatcattaaatttggcaattacctttctccacagactgtacatttataaagaaagggaaaaagtaaataccaaggatgtttagtgcaatttattttcagatgagagaacaggccttgatagattcaatgctttcctgatggcttctaaagtagagaatgaaagagatgggatctttttcatagtaagtaattacttttattatagagtatttcacacacataaaagaataagcacaaaaatgatcccttgttaaatttctgttaaatacttaaaattgatttgaggaaattttcttgttttcctggtttacaaagaattacaagaatcataaatattcaatattgaattttgaatcataaatataatgttgagttttactgaatgcttttaattttttaaacatgaatcttttaatgtaaattgtgattcttgcattcttgaagtaaatataattagattatgatatatattgcctttttttttactacaatctactgatgtatccttttcagctgaagctcttttttgttcttttactttactgctctgtgtgttctatcgtctaagcttttctttggttatactagagagaacaacatacattcttatgttattaaagtctagttttaatcatatcagaacaatataaacacctttttgaccatgttcaccatccgtccaaattatatgcttttttttttttttttttgagctggagtctcactctgtagcccaggctggaaggcagtggttcgatcttggctcaatgcagcctctgcctcccagtttcccaggttcaagcgattctcccacctcagcctccccagtagctgggtataggtgcacaccaccatgcccagttaattctatatttttagtagagatgtggttttgtttgttatgttggccagattagtctcgacctcctggcctcaagcaatctgcccacctcagcctcccaaagtgctgagattacaggtgtgagctgccgcacccagtttatatgctatttttgattaggatttttgttatctattttttagtcattgttagaaattattacaattacttatgcacctaagatctgtttaattttgtttgccccagggcaacctggcttcattattttacctcctgtgtcaactgctgtttttttttttaatgtttttttggcctttgggaattttttatacttcttgtgatccctacaatatattctatgtgtatttgttgctgaaatacttttcaatatgtctagtctgccacactactggtctctcattcttttatgatagcacagctattataaactaaggttatgtatgtatcacagtaacttgtccattatctctgtcaactgtgagatggaggtcacaacgtgctttctataaagaaagggcaataaagagtcaactaaatatcatgaacaattttatctgtatttttcatttccccttgacattttacacttattttatcacatgactttcaaagtctcggaaaaaatataaagaaaaagtaatgttatataaaatatggcactttaaaggtttataaataacaaataggcattttaaaattcttttcaagtatcttattataagtattttgtaaaaagtatagaaaacggcaggcaaactcactagctcattaaaatagcttcagtgtcattttctaatcttcttgccttgtcatttgatttactttggctcttaatatctattcacttatagattagttcatcaaaatcatatgtatacatgtatgtatatacatgtatatgtatataattttgtgcacacatggcataaacctcaaacgtcatgactaaattaaattaaattaaattatatccattcactgctgtacttttgtctgcagaactgaaagagacagaggattccttagaaccgaattaaaaattcaagaccacctgcatcaaaaacatgtgggagaaagcacataactggaaaagcatgtcacagagaactgtaagcctgctctgccaagctgaaattctaaaatagaaaattaaatattgaaacataaccttgaaatacacagccattgtacattcaaaagccatgagagccattatttctgaaacaccacgtgaaattaaccatttattttacactccacaatatagactacatcaaatttatctgaatactattagaaagtacaattttcagacattaaaggaagaagtttttctttttttttttttgcaagagctgtaagatctacggataaagaaagtcatctttcaagtttttattccataagcttaaagaattatttacaaaatagtttttatattccttggcagaaaatcctttttgaaagtcatccatctttcctttttttcgtcttcatgacatttgcaagcaattgtacagagatttcctgtgtcacaaacttcataggaatcaaagattagaaaaatttccaggaacatgtacacacacacacacacacacacacgcacacagccttaagatattatattctagtatgtagtggctagtttcctacgaacttggatatctacaaataactaatttctaactaatcctaactggttataatcggttgaatgtgtgcatgtttgtgtgtgtgtttatattttaccaatcaggttgtaatgtctttggaacatttttgccattcctccatatttaaactgaaaatacctaaagaccatgtcaattacttcccaaaacagactgatcaactcctgtaaaattgatggcagctgtggcccatctggagtggctgctgcaaaagagctggctgcagtggggaggcatggccagggctgtgtattccctggagccggggggaaccaggaacaggcggaaggcctgtccccttaagagttggtgggccaggagccctgcactcccaggcacagctgcggacactgtgctcagaagtacctgctctcactgcctggcttctcctcgctcctggcacccactgtgatttccgagcaaagttgtggctgagcctgtgtcacaacctggccagatgtgcatgcacttggggtgacactgacacatcagccccctgtcacctcagccccctccagattttgggtgccaatgagcacggcagggaagccaaggggccactgaggatggctcggcataggcccgcaggtgcccctttgcatgaacagctaaaaacccgagactcagtcagactcaggcagatgacggggtgactgcctgtggagaagaactacccactgtggatctcctctccactgagagctgcaaatatcaggatgatctgactgtggagaggagctatccactgtaagtctcttcttagctgagagttgagcagattttgggacaacctgccagtagataggagctaccccgtttgggtgtcctgagagctgtactgtcactcaatagagcacctcttcaccttactcaccctccagttatctgcacacctcattcttcccagatacgggccaagaactcaggaccagcttaagcaacaacagtaggacacaattttatagcggagtgtgggggcagaagatgtaccattttaattttttatatattagcaatttattaaaaattaattagcatttcacaagcaatgcaattatttagaaataaagctaagttcagagtcctacttattacacagaaatctgcaagagaatgtcacccctatcaaacagaataaaaagccttttaatctaaaacactatgtatcttttatgttaattccataagttagctgagacttcaaagcaatatggtgaaattaattccagagagtgacaagatccttgaaggacacatgcattgtttcaccactgacagaggccaagaagaaagggtgatagacgtagagatgcataaaaagaaaacaacagatacatttttaaaattcttaaaggtgaagtgtggtcggggtaacagtttagtctggagaactaagagtcaccagctcttctccacccctctctgaaggtgctgacaagaaataatgtgggcaggcaagtgattgagaggcctccctcctccaggtgacgtgagcatacccccagtgattggcttttgctgggaatcaaatacaaattttgcatagattcttcacacagagcaaagctgtctgttgctggagaagggacaggaaaacctctcctgcctgcatcctgcaatgaaacaaagcagttttctgctgctagcaaagaggaggaaactccctctcacccaagatccaccaccattacaggtcagcatttgactgcctttgaggcagaggcacatagggcctggccaagggcctggctaagactgaggttatgacaggagagtaaagacaaggcccgggccccttgcagcatcccattgagtaacaagccacagcaaggtggctgttgggaaagggtatcctctggtacctttatcccagacaaaaccttcttgctattgaaggatgggcacaaatagctctaatgcccatggcattgccctgatacaaaacagatctgtttgcgtctggagaaggatcaggaacacagaaagagccccatccctgaagctcaggtgtacagaatctttctaagcctgaggatgcagcagaagatctgaaagcttccaccaccacctcaaaatccaccaaagccttgtctattaactatgccttttattttctgtgttttcatgctttgacatcttggggtcttgctaatgctggaggaagtattcctctcaggttagctaattcctagggacagcaaaatagttgtctgtgagcattcctatcaaacacaaaccaatgaatccagtctacactccaacaccttttttaactgagctttcatactctgtgccactatccacttaccctaatcacctcagggccaggtaacagacaactatgggtagcccatatcactcagaacctgcagaaattatttaaactagcccatcccaagcctgatgagcctcttacttcccctggaaaacacaatcaagtttcttgcccaccttttcttctcaccctctctcctcctggtctcccctaatgcttccctgtgtactgcctgtcccatggtacagtgggttcctttctctcgggattcgtgagtgcaacaaactaccttcccaatggcagtcagttcctaatctgttggccttgtgatgcctaaataataaaacctgcttttaaaaaaaccgtatgcccaggaaaatacaatagcagtcttctccccaaaggtgggaggcagcacagataaagccccctctgtgtcacaggcactccaggcgtgccgaaggaaaacagtggagcagaaacacagaaaaattcagtactccagacccaaccttaagcacaaaaaagctgcagcttaccactggaggaattttttttttaattaaatgttgaaatttgagataactgcagattcacttgtagatataaggcatagagatctcgtgtgtcctttcctcattttctctaaatggtaatgtcttgcaaaattacagtacaatattacaagcagaatattgacattgatatgatcaataaacagaccaacactgtcaccacaaaggtccttcatgctgccctttagtaatcatacacaattccctctgtctctcacttcctcctcaacctctggcaaacattcatctgttcttcatttctataattgtgtcttttcaaaaatgctatgtgcatccatgttgttgcatttattattgatccatccattttttatcactgaatactattctgtggtatagggctaccacagtgtccttaagcattcaccagttgaagactatctgggttgttttcagttttgggctattatgaatgaagtgcttttaaagatttgtgtataggcctttttctctttttatgagacagtctcatcctgtctcattaaaaaagacacaatcttcgctcactgaagccttgacctcctggctcaagtgatgctcctacctcagccttcccagtagctgggacttacaggtgcatgttaccacatctggctaatttaaaaaaaaattttgcagagttatggtctcatacaggcttttatatgaacatattttcattcctcccagagtgcatttgcctaggaatgcatttgctgagttatatagtagtgccatgtttagttttttaagaaatggccaaaatgttttccagagtgctgaaaaaccattttgaattcccaccagcagaggatgactgatacagtgtctccacaccctttccagtagttgatgtcgttaccaatttttgtttagctattctaatagctgaataatgatatctctttttggttttgattgcatttccctaatgggtaatgatgtttaatagctttccatgtgcttatttaccatctgaatattctcttcaggacaatatctgttcatgcctttggctcattttctaattagattgtttgttttgtttttacttcgaattttgcgagttcattatatattttacatgctagtcctgtgatttatatgtgttttccaagtatgttctcccactgtctacctttttcttcatttctcttaacagaatctatagaagaccacgagttttttattttgatgaagtccaatttatttttccttttatggattgcactttcaatatcaagtctaagaaatgtttgcctagcgttagttcccaaagattttcttttatgttacatttttttcacccaaaaactgttcagttttatgttttaaatataagaccacatccattttgtttaatttttctgaggtgcacaatttaggctcattttttttgttgttgttggctggtttatttatttaatggatgttcaattactcaagcacatttgtttaaaagggcatctttctaatattgagctcttgtccttttgtcagaaattatttaggcatatttttatgggtttattttagggttctctctgtcattgttgatctatgctttaatcctgcaaatatcacaggcttcattaatgtagcttgtatatagtaaggtcttaaaattgggtagacaaattcctcccactttattcttatttttctaaataattttggccattctagttcttttgcctttttagcatacgctttaaataaacttgtctatatctgccaaaaaaaattcctggcattttgattacagttacattaaaatctttatattattttagggagaactgccatctttgctatgtttagactcccaaccatgaattgtatattgatcaatttatttagattttattatatttccttcatcagatttttaaaaatttttttctttttgtaaagaacggggtctcactatgttgcccaagctggtcttgaactcctatgctaaagcgatcctcctacctctgccgccttaaatgttgggattacaggcgtgagtcactgtgcctggcagaattttttagttttcaccacacaagtcttgtacatattttgttagacttacatctaagtattttggggagttgtaaatgatattgtattttgaatttcattgtcaatatatagaaatacaattggctttgggatgtttatcttctatcctgcaaactttctaaactcagtaattctaagaagctgtttttggagattgctggaggttttcaaaataatcatgtcatctgtaaacagtggtagttttatttctttatttctgatataatttttttattttctttacttgtcttattgcactggctagaaattcaagcactatgttgaattgaaaaagggataatggacatctttctcttcttcccaatgtttgcagaaaagccttcttttaccattatgtagatgttaagctgtgggtattgtatagatgctctttgtcaagttgaggaaattcccttctttttctgttttatcagagaagttttgtttcttgttattttacaaatgggtgttggattttgtcagatacattttctgtacttgttaatataattatgaaatttttattttcatcccattaatatgaaagatcacactgattgattttctaatattgaactaacctcatatccctgcactaaaccataattggacatgacgtatcattttatgtattcctgaattctacactagggattttattacatctttcaaaatccttttgaaagtcatccatctttcctttttttggtcttcattttttcattgtgttcatgagggatgctggtctgtggttttccatatttttactctttggttctggtatcagggtaatacaagctttataatatgaattgctgagtattcccttcccttctattaattggtagagactgtgtagaattggtattaattcttctgtaaatttttgataaaattcctcagtgaaaccatgtgtgcctagggatttcttttttggaagatattaaattatcaatttagtttgcttaattcaaaatctaccttttgtgttttctagctacatgacatctacaggttactcagcatctctgtgagcttcagctgtattatttgcagtaattatgctattgaattcaaaagaatgtaatgaaagttaaatataataatgaatgtaaggtatttggtatatattaagtgctttattcgtgttttaaaatagcctttattatcaccagcactcttatcctttattcataaattcaggtaatagaagtagaaagggaatagataatatctcttggaagccactcagggaaggcctgggactaggcaagtctcaactcaagtaggtggacagtgataggcagaagtaagaaaaggtactcatctgctttgggcaaaatgaatcttttttttctaatctttctgtaaatgacaaccctggttccctgaaatatcttcatacctacagtaaaaataagctggcagagaatcaagtgaaaagaggaacactaaaccaaacaaaaaaatatctgttgagcaaagtttgaagattattttgcaaacgtaagttaaaatatgttttgcttgcttaatatagttacacttcatctttttgcataatcttttaggaaaagacaccatatctacagtatgattattatcccctgacattttttctattcaaatacttccatttcaatccacttgaagaaatgtatctcataatactagtcccataaaaggaaattctataggaaattactgctacttttaattcattgaattcgtcaattaatgaacatacagattaactctataaaaatgctcttttggcagaaagactaatatttgagttaaatagagaagaaaaacacaggtatgtgaagatatacacagacaaaaaaagtcgtctgaggcaaaatcaccaaatgagatttttgcaaaaagactgcccctaccaaacatatgcgtatgtaatacacattttagaggaaagaaggtaaacacaggagccacagacttcttagaatgcttaatgggtttaataacaattctacataaatattataatgacacttaagaaaaatactgacattattctcatagaagactattagaaatgcattctgtaagatagaaatgtcatgtaaaattgtttagattcagaaaagacaatggttgaattgctcccccgccaatcctgcctgattgggtcatgcattcctaccacagctaccccaagaaaacattcctgtcttttcccctacgcatctcagttaggacactctaaatgccatattgctcctttctatttcctgaaaggattgaagatgctttgccttctgtctgctttgtattctatgcctaggctcctgagcctcaggatcttcagctgttagaaatcagggatgactacatactttttaaagtatcactcaaatattttctgtaattaatactcaacagtttttatgatgataatcaataatgcttgccaggaggagaaggatgtacataaacctctctgtgtttatgaagagtatatgcataagctgacagaaaaattgtgatgaaattaactatctctatgagaaattatcctattacatctgtgatggttggttttgtatgtcaacttggctggccatggaatacccagattaagcgttatttttgggtgtctctgtgggggagttttggtatgagattagcatctaaatctgtggactcaataaagtagattgccaccccactgtaagtgagcattacccaatccactgagggcctgagtaagacagaaggtacaggaagaaagaacttgcttctttttgcttcctgcctgcctgactgagctcatcttattttctccagccctcagataggaattcaccaactactccactagttcttagacattcagacttggactgaattactccatcagctttcctgggtcaacagcttgcagaaagcacattgtgagacttctcagcctctacaatcttgtaaatcattcttcacaataaatctgttctgtttctctgaagaaccctcactaacacagattttggaaccaagagtggttctagaggaacgtaattttaaagataagttttcaaaattggttctggagtttctagaattgattctgtatttgataatatttcaagacactaataactctattctcaggagtaaagggagcactgatagactagggcctaaaatttttatggagatatagaaaatatctgcattggatactcctaatcaactacttacaagaagtaaagagctagatacctctgtataaaatacttttgaagattttcagaaaactaactaataaaatgacactggttggttgttcctgatgttgctgatcaagtggtaaaagaaaaacataagctaaggatttgaattcccagctcaagtgctgcataaatgacttaggagcttccatgtatgccctgaagtatagccttatctcctagagctgcaggactgaaattgtcaaaaatccaaagcagagcattatcttgcaactggctgaattacaaagcaagttgagctttcggtctggcaggaggtctacagttaaaatgaaggcatttaattgaaaaagaatgggatcctctaagttggaaagggaacacgtgggatagatcctgatgaagctgtggacattgagcctctaagttctgatgagtcttcattaccagtaaaagagatctccccaacctccagcagaattggcctcctctacccacagtgacagcagtattcccacccatagtggtactggcatctctgcctctatagttataaaagattggccttacattgcctaaggaaactgtaatgacctcccccaaggcagatgccatacaagacaatgctgattctctgcagaaccgactctttgcttctagacctataattagactcaagtctcatcagtctcctaaaggtgaggtacaatgtgtgacccatgaggaggtatgttaaactcaaacaaactacttgagtttttaatttatacagacagaaatctggagaacatgtacgaaattgataactaaggatgtgggataatggtggaaggaacttaatgttggatcaggctgaatttggcatggactcattaagcaaaggttctgcattaaatgttgcagcttgtggagtttgattctaacaggttggttggttaactgctgagatatggaccaaaaggtagtccggcatgagaaagttgaaaatacttggcatgccttattgcaatgtagaagaaatacaaaggcttagggatatattgtaatgttagggtagatttgtcatttaaggcctacttacccatagtgggagagtccagaaggcatacctttcaccaatactgtgaataataaatttgtcagtggagccctgtcatccttaaagatctctgtgatcactgtctgtaggccagacctcagagtgggaactgtagtcactgcattgagaagcctaaaggcaattggagtaattggatcctggagtgggaggggccactcagtcaccacatacaaggtagagctggttacctggctactgtaatggacagtagagttaaagcagcaatcagaagagtctgatatgttgacctatggacctatggactaggcttactgattatggcatttctagacgtgaaatagaaaatctgtcaaattgttacttaatctgtacaaggggtcttttaaaagtttatttaaaagcatattatgaaaaactatgcatgaatttcaaaaatgtttgcaccaaaataaacttgtactaatgttatgacatgtcttaacaggatctaatttgaggcactaaggaggataagacatcagtttgaaaataacccttatctctaataggaattaattttgctctcaaaattaattctgctaaaatggaagtaagaacaaactccaaatttatggtaaagcttgggtggaagaatggtgaaatcactgatgctttacaaaaagttgatgggtgcaattcccagaataaaacagcagtttacaaacagataacttgctttaagaaggagcaagacaattttgacaacaaggcccacagtagaggaccatacacatcaatttttgatggaaaaatttatcttttgcattctctacttgaagaagatcaataattaacagcaaagacagtagccaacaccatagacacctcaattgtttcagcttacacaattctgcctaaaaaattaaagttgaacacactttccacttgattggtgccaaaactgttgtgcccagatcagctgcagaccagaccaaagctttcaatggaaattttaaacaagtgggatagagatactaaagcatctctttgaaaaattgtaatcagagatgaaacatggctttacccgcacaattctgaagacaaaagcataatcaaagcaatgaataccaagaggtggaagtggtccagtcaaagcaaaagtgaactgctcaaaagcaaagatcattgtaacagtctttggaatgctgaagatattttacttgtaaactttctagaaagtaaaaaaaaaaaaaaagtatttgcttattatgagaaatttttgagaaagttagccaaagcttttgcaaaaaatctcccagaaaagcttaaccagagagtccttctccaccatgacaatgttcctggtcattcctcttattaaataaaggcaattttgcaagaattttgataggaaatcattaatcatccaccttatagtcttgatttggctcctttgacatctttttgtttccaaaccttaaaaaaatctttaaaggcaaaattactcacttttctttaattaataatgcaaagagactatactgacatggctaaattctgaaaaccctcagtcttttaaggatggactaaatggttggtatcattgcttacaagtgcaacttgactggtggagtttatgttgaaaaataaagtcaatgtttttactttttactttttactttcatgtttttcatgatctttttgaagtcttcttgtgcaagcagcaaagttctaggtcaagtgaacaaaagtctcacctgagtcatggcccctcaatcatttcccatatttgagccagtttacaaacctagaactccttgaatgaaaggtagtccaggtcctcttgaggaaggaccccaatgcacttccaaaatattataatgttaatatttcttctagccttttcccaaaggacctatggcattttatcaggataattatactcaaggaaaccaaaataattcactcacaaatatacttctttgacatatttcaagatgcttatccagaagggctacaaatataaggataactgaaaagctgtctttcgtggaatatatttccacgaaatatatatccaaatctgcatggataaaatcaggctttttcagaggctctccttgtctggatctcagaaagttataacttagagtctgaaacctttaaaattctgaaaggaatatttaccatctatttattttttttttttcctgagggctgccatctgtgaggtttcatctacataataatgttggagcttgttctatcctgtagttcagtgagaggaagggagtagcatccagtggctttccttcttctctcccattgtttggtgagtgggagggagtggtgctcagtggctccttctcctgtttttcacagagcaggaaggagggttacagctattttactcccactgcccgcagcttggcaagttctgggttcttgtcccatgaccaagtggaataaggtacatggacaccggagagtgaataaggcagagtggaattttattgagcagcagaaagaaagctctcagcagggagaggggacccgaaatcaggttgctgtctgtgaggccgagtccacagttaaatgggcttagaatgggggaatgtgtgctgattggtccatgggtggtcttggaaagagcatcattcgattagttaaaagccataattcagaagggagcaatcaagagagagtgggtacgatggggatggaagttctcactctggtcttggactctatccggaactgtcagttgtgttttcaggatttaaactgtccttggcttgaagactgggtttttaccagggacctgtccctgtctgcctaggaatttgtctgtttcctatcgctatcaataagactacctttgttagtcaggcatcttctccctctcccataagctattttgcccgtataacctgtgttgccatgcttcaagctccacattattgctgtaaccacaagatgagtataaaagtgtccaccacctggccttttgagttcttatattttgtaaacctcctttacatgttgataaatttgtatactttccatcctgttaagctgacttttttcagttgatttttcagtgaatcattagagagcaaagggggagttttcccttggtccctacagtacactggggaaaagaaaataatcagacttttggggactgctggacactgactctaaattgacactaatcccaggacacccaaaacatcactttggcccaccagttataacaggacttatggttctcagtggaattttagctcaggttcatctcacagcaggtccagtgggtccccacacccatcctgtggttatttccccagttccagaatgcctaattgtaacagatatagtcagcagctccccacatttattccctgacctatggaatgagggctactattgtggcaaaggccaagtggaagacaatactaccgtcaatatctaggaaaatagtaaatcaaaagcaatactgcgtccctgagggattacagaaattagtgccatcatcaagaacttgcaaggtataagggtggcaattcccaccatatcctcattcaatttgtgtatctggctcatgcagaagacagatgaactttggagaatgatagtgcattattataaacttaatcaggtggttactccaattgaaacatcggtaccagatgtggttttaatgcttgagcaaattaaaacatctcctggtacctggtatagagctgttaatctgacaaaggcctttttctccatccctgtccataaagcccaccagaagctgtttgcatttagctggctaggccagaaatacattctcactgtcctacctcagggatagataaattccccactctgcctcataatttagttaacagggatcttgatcacctttcccttctagaagataccacagcattccattacattgatgacatcatgctaactggatgtaggaggcaagaattagcagctactctagatttattagtaaaacacttgtatttcagagggtaaaaagtaaatctgactaaaattcaagatcattctgtctcaatgggatttttagagctccagtggtgtggggaagttcaagatatcccttctaaggtgaagaaaaagttgttgcatttggctctccctacaactaagaaagcggtacctctaacgggcctatttggattttagaaggaacatagtcttcatttggatgtgttacctcagctcatttaatgaatgacctgaaaagctgctagttttaaatggggcccagaataacagaaggctttgcagcaagtacaggctgctgtgtgagctgccatgacaattgggccatatgaaccagcagattgggatggtgtgaggagcctttggtagaattctattggtgaagcacagtgtggacttttagtattttgatgcaagggcctgcatataattattctccttttcttttctttttttttttgacagagtctcactctgttgcccaggccagagtgcagtggcgccatcttggcttactatgacctacgcctcctgggttcaagtgattctcctgcctcagccttctgagtagctgggactacaggtgtacaccaccgcgcctggctaactttttgtgtttttagtagagatggggtttcaccattttagccaggatggtctcaatctcttgacctcatgatccgcccacctcggcctcccgaagtgctggaattacaggcgtgagccaccgcgctcggtctagtctccttttcaaaaacagctatggtcctgctactaggccccagtgtgatggttactaccgagtgtcaacttgattggattgaagggtacaaagtattaatcctgggtgtgtctgtgagggtgttgacaaaagaaattaacatttgagtcagtgtgctggggaaggtggatccacccttaatctggtgggtaaaatctaatcagctgtcagcaaatataaagcaggcagaaaaggagagactggcctagcttcccagacttgatctttctcccgtgctggatgctttctgccctcagacatcaggctccaagttcttcagatttggcactcaggctggctgtccttgctcctcagcttgcagacagcctattgtgggaccctgtgattgtataagttaatacttagtaaactcacctttttatatatgctatgcttgtctagaggtttggttctagagggagaaatgcttctatcaggagacccaatgtttctactgaactggaagttaagactgccaggccacttggacttttcatgcctttgaatcaacaggcaaagaattgagttacaatgttggcttagtattaccatggcccgtcaatggaaaactacaacaatcccaaccaggcagaaatagtaatggccccaatccttcaggaatggaggtgtgagtcaccccgccaggaaaagagccatgaccagttgaggtacatgttgaaagcaagagaatacagcatgagtagcagaagaaggtagctataaacaccacctaaaaccatgtgatcagctatagaaacaaggaaaaaaggactgtaatggtcataagtgtttcctccttactttgttatgaataagtgtatgtgcatgtgcatatatatatttgattccttcccttttttattcccttatcatgtggcataagacgtattaattctacatcataggacttaagttgcaggataccaaggagaagagtagacatcactccacgaactttacttccttttctgggaaaagaccagcgcattttcagttgtatgcaggatagttgcatcatgttaggcagaattatgatcttgttactgtctttgtttggagattaagaatggtttaaggggtgtgcatgggtgctcagctgacaaggagtggacatctgatggttagctttgtgtgtcaatttgactgggcatggggttcccaaattaaacatggtttctgagtgtgtctgtgaagatgtttccatatgagactagcatttgaattggtgaacttagtaaaatagattgccctccccaatgtgagtgggcatcatccagtctactcagagctttaatagaacaaaaggtgtaggatggaagaatttgtcccttttttttctgcctgcctgattgagctgggacatcttctctcattttctctagtcctgggactaacagttacactatcagttccccccgtctcaggattttgaactggatctgaattaattacaccaccatctttcctggatcgccagcttgtagaaggcacattgagggactttacaacctccataatcttattagcctattgctcataataaattagtttctctctctccccccgatatatgtatatgtgcatgtgtgtatctatatatacatgtatatatatacatatgtgtgtgtgtatatatatatacacacatatacacacatatatacatatacacacacacacacacacacacgcacacacatataccccacacatacacacacatacgtatatatgtttctggttttgttttcctggagagaaacacacaaatatatgctactggctcagtttttccagaagtccctgactaatatgtaatattacgattgctgtccaagtctgggaattgtcccacttatttatagtccttttaaattaagagtgggcttactttaacttttattacaaactataaagataattttaatcattgctaatcttgatttaatttccaatgattccaattattgccaccactaatactgatatcaaattttttaagtagtagttatgtctataattcacttttggctttctcatgttttcttttcttattaattttacaaaagcaatcatttttctggaaatgtccactgcaaacagtaggcaacagtgagtgttatagcatttaaattagtaggcccactaaaagctactcagcttaataaggtcagtagtatgttttctggcttctctcagactattttttgaagattttgcaagtattatttttaatttctgcaatgtctctgaagattttaaaaattttgttaacattcttgatataattcaatttataaaccaatgctgaattgaagtcttaccaaattatggtagatgaaattatcatcctattagaaatatttcaaatatacagaaaagtttagagaataaaaccatgaatagttgtgaacctaccacaaagatttaacaaatgttaaatgtttcattttcttcagttcatttataaaaatcaacataaaaatcacagatttactaaaatctgcacctacattcctcttaccttccctgaaaatagctacattcctgaaagtaaagtgtctcttcgccttgctaattttttatacgtttactgcatatttatatgttcacatagagaatgcttatttttctaatatttacataaatggttataaaagttttcaaaaacttatctcactcatacaattaaaaataattaaaaaatattagaaaacgatagtgctgtaataaacaaagcacgtaaggaaaatttggagtaggtgaactgggagtaggttgcagtttaaatagagatgtcaatgtaggccttttggtgtcatttgcacaaacttttttttttttccatttactcatttacttattttagagacaggatcttattatgttgtctaggctggtcttgaactcctggcctcaagcgatcctcctgcctcatcctctggagcagttgagcttataagtgtgagtcacagcaccagtcttgagcaaacaattaaaggagaagagagaaagtgatttattttcctcatctattattacattggtctgggtctccagatacaaggataaaaccctctttttccttagtgatgcttttatgttttaatccttgcatctaatactaatattattataccagttaattctatgtgagtgtgtttgtgtgtaagatgtaagaagtgtaaaaagtgattacaatgtaactaaacatctctcaccattattttacttttacctgtttatttttaattgtatgtttctcatttgtaaatttttggtcgattttaaagaatcaaatggctttctgtttcttcaacactgttagacactgtccctttcgggctgagttaggtatgtttgaatttattatgattgctttttaatgtaatttatttctgccacctgttgtgtatgcgttttggtctactaagatctttcctcgttcatttgattttcctctctggcttctgaggatagataaagctttctgtattttcttagtatttactatgggctttgaaaactgtgtataccatttttcaagttacttacccttatatgcttaatacaaataatcaatataattttcaacgaagtctaacgtagctcaatatctttattactgttctaaaagatacttagcatgctttattcaaaaatgaacatctcccttagtttctgtggaatcattatccagaattttagtactttcttttgaaacataaagaaattacttattattattatttataccactcaataactcatttcatttgtgagttatttcttcacattgacttcactttttgggtgtgtgtgtgtgtgtgtgtgtgtgtgtttagtaatttttttcattgagagcctatttgtactgaactttgtgactgcatgctttatttccctctattcctggactggttattatcaatttatagaattctattttacagttaatttgcttgacaattttggattatttttccattgtcttctgatgtctcttattgcatgggatatcttctatctttaaaaaacataggtaacatgttttttttctctagtcggttttaagatttttctccttatcctatatattttgcagtttcagcatgatagtctaagtatttattttctatgcttatatttttatctatttctccacaaacataaatacctatgtacgtatgtattattatttcgacctatttctgttaattcatccatccatcatttgtccatgcatgtctgtctttccaggtcagcactaggtgttcagttttaggtagaaaatgtgtgtcctctttcaattctagacaattcatggaaataatctttcaaatatcaactctcaacctccattctctttacttggcactcctaacagtcttattttgcctattttcaaactattgttggtatctgttaactgttcctttgttactttaacttcatctatgctacttttggggaataatcctctactctctttcaatccactaatctctttgattgtttccaatataggcatttttcccatctaatgaggttacagcacctcaatgactatattttcttagatttgtctcttttcaagtacacctgttatttttttcatttctgtttaattcattatttcttattgctgttatctatttatatgttttctttcctacctctcataatgtttagtcattatataattattaattctggtcttagagctgatttttattgtctgattttcattcaattggttttattagttattgtgctttgatgttttaggcacattttgagtagaagatgttcttctccttgtattattctcacttcttcctttatagaaattttttagttgtctccattcaatcctaaatccaactgccaaaaaacaaaatttatgttagtgaattgctatttccaggagtgcagcatagcgctatcactacacaactccaatggacccatttcattggactccaaagtgagtgatagcccagagaattgtgcaatatgccatctacacattgcaggctgctgccttaggggacaccattcaatagtgaaagtgggaataaacctgtgagtggattagtgtaagattctagctgcttctttctttttctctgtatatactgtcccaagcagcaggcacttcatttttaaagttcttttcattaactggttaaattcatcatagtacctggatctgacctttgaacctgcttctggtgtctcacttttcatggtttttttcagttgccatggatttaaagcaactgaagcttcagcctcttttatttgaacaaaaagcaaagtccaacatgtgtgcgtatttggctacatatattactttttattcctcccaatttttagtccatggagaagtctatcttaatctttagagaattttttttcctttttaaaatatctagtttatcaacatagtaaatgtttataataaaatgatatgaacttgcaattctatcttggcaagaatcccaaggaaattatgcttatgcttctttctggttctcaaattttccaagccaaaacttccatatagagtaattttaccaaaaatttagagaatttgagtctaaagtatatttcctttaattaaaatatattttatatttataataatattttagaaaatatcctagaccagttcaaatggtttcagattattctaactttgattctttttctaaaaattttcaagtaataatttcacgaatatttatatatattctaggatattaagattacagttcctcatattttactcagaaagtagttgagatcttttcttttataaatttacattacaaaatggcataaaattctttgcttcccgcgtcgtaggtttgcagagaagcttagtttctattcttgttatgactctagcttaatttgcagtcttcatgaagacctaactttcactcaaagtgctatgttgtgatgtttataaagatcaaaatatattcttcatccaattgatatttgaatggtttcaattaatactttcatatatttgttaggattattacctcacattgtactatatatacattatatggctatagagtctacaataaaattggtaaaaataatctgggtcttgtatacgtataaattaaaatttagttaagctcataacatttaatacctagctctttactgctagtgatgtaaatatgtaatttcaaattgagaaaatagtaaacataaatgggcaattaataattattctctattttgtaaaaatgtgaatagcatcgatattgttttagattttaacgtgaaaatatttaaaataaggcattgtactcatgttcttaactcatgtggcacctcctttatggatatatagtgtgtcttttatatttttctgtagtaccttgtaacagtcacatcttctttttctagacaatgaatatctgttatatttgcctatttggtattcataagctgccctccttttcctgataacatataaatttcctttaagaatccctgatgctgctattctcagatcattttgctccagaagtctcctttattacagggcaacagggataaatataacctaggcccagaaaattagagccagggcatttgttgtagggataagcaagtgtgctgagatgccaatttcaggactttccctgaaaaattaaaaacatgatagcctattctgccaagtttgcaaactagttgggtattcatctatcactgctggagtaatcctgttgtcagaaggagagacaaggaagttcttggagaaaaaaaaaataaaaagctgagagatgaagacaaattcctgagggcatgaaactatgcctgaagctgtaacagttctggtatttttcagttaagtctataaattccctccgtgtctctttctatagtagtcaattagagttttgtttctctctaactgcaggagttctacctcacacatataattgtctggtctttcctctgtttcacctactatattttaggtttcttgagaactgagatgatttcttattatctgttttatgcacagttcttatcctaatgaccaacttaaatttttaataaataaagaatgaataaatacacaaatttccatagatatattactgtagttattaagtaaaattatcattagataattttttgtataattctcagctcaatatattaagttggcagaaaataaacatggtttttctcctactctgtcccatgggaaatcattatgaagaattagaattcaaattagaaaaatagttattaactatggtgtcaaatcatattgattaaataagatcagtattgttgtgtttcacaagtgatataaaacgacgtagaaagagatagatttgaacatatagtcctggaaatagctcaacatgcatcctctcttctctgccacagaagctcttgctttcgatgatgatgtcatcaaccagacattttatggtagaataattttgagtattattgctctttaaagcatctccttttggggctttttaaatttgtttttgttctaaaaaattgtgtattatgaaaagcatgtcctcaaaatagctttaacaattttaatattttgtcatatttgtttatatttcatttgtggtcatttatattttggtgttattttaaagccaggaatagatatcatgatgtctcatcataaattctttaatacataactcctaggaatagagatgttctcttacaaagctaagatgtcattataatgactaaaataattgtcaaccatttacaatgtaatatccaacccatattctaatatcttcaattgtcataagaatgctctttagaggttcctcttttagatagacagaagtactgcaaattgttgttttattatagactaacaagtcttttgtaagtgatgtttatatgaacaaatagattagatgatcatttcctgaatgttccccaaaatactaatcccaaaggtgacaatatttgctctacagaaaatagcattatgaagcaaataagtttttacagtagaaaatcctatacaaaactaataaatacttagaaatatgaaaagggtaaacaaacttgcacattgaggtagttgtagaaaatatcccaaactattcaaaaatcacacattaatgcttcctaaatgttcatcatccttcactataactacgaagagtccaaatgaaatgtaataagataagattaactagaaaaaaagagagatttcactgtaaagagtttcaaggatagaataaggacactgaacttgaatctgtctttagtgaagaagttttgcacaagataaagacttgatggaaataataattgggtaaaaaatgaatgcagcagaagagattgcaaaaaaagaattaaaacacaggctgttacagtaacccaggtggaaactgatgagaatagaatgtttgcttttaattcataggtgtcatttggccagcagacgccaagaggctcttgatgaaacagtggaatgaacacactagggtataggtactccaagtccttatcttagatctgtaatcagctgtgtgaccttgtgtaactcaagaagtaggtctattcctcaactgaaaatagaggaatgaaatagatgacaactaaggtacagctctaaattcctactaattccagaataaccttgccacatcagccatcctccattatacttggagctgcttgaattttgcaaatattgtagaaataaaagcatttatttttaacagaggttaaagagaactctagaaacaaatcatgagaaagtgataactttaatgtaggttgagttttctcttagtattatctttacagctactgcattataaaacaagtttaaaaaagcaacatgtgatcagaatatctcaaaagaaattctatcccgaaatttaagaattctaactatattatttatatcaggcacttaatagtattttatatgtacagactgtgatttaatttacgatagttttaactactcacctggtagcacttggactcctgctatagtcctagtgctcctcaatctctagcatttcaggtcaaatatgaatagaggccatgttttcaaggttatgaaacatgggagtgaaacatgaaggagggaggaagtcatgaagttaaagacttcaagttcaagtgaagctaggaccaaggagtgtacagattatgtaggagatgtcaccatccccaagaacatggaggtcatattttaatagcatccatgtaagaaatgcagggcttttccaagagacatgtaagaaatttggagtcccctactaagtttttatgagtaaagaacgcataacactgggacaatattttttttttgccaaagtatttttcttaagttttaatatctttggcataattaacttgaatctctgcctgacaaacatctcaatcaaatgtgtataataattcagtgccaatggtgtagcagtggcttagaccataaaagtgcaaggaatggggaacattaaaaatggtgaatgtagttgttacctcaagaaaattgtagtcttgttgctctaaactacatgtataaaagtgagcaataggtcctttattcagcatcccctagcaatttttaggaatatcagggtgtttgcacaaacaagaaaaatatatttctgttgattttcaatctgaaactttcaggattgcatttacttccctgttttccactaaatctgatgcacaagcaaatcactgttaaacatgttcggattctgcattaactccttcaaatcagattcttcatttagtcctttaatttatctaagtttttcctggagacttgaaagaattcgtgcacgttgcaaacacgaattactttttatatttgggaattggcctgaaactaggaaatatgatccttaaagactaggctcagaggtcaatgacacaagcacccatggtgccattctcaagatgctacaatgatttggaaacaagtgacctattgtctagtttctaccaatctagtgaaacctagtcactcatggcaattaatctatacccagactgattggatcttggtttaaacttgactctcattgttattctcagccatgtttagactacaacattatgggatagctctctgacatttaaatataatgcaagccacaaatgtgttctgcaaatgtcaagttaaagctttgtagtagccatatcagaaacataaaaacataatattaattttaataatttattttattcaatataccccatatattaacagttcaaaatgtcatttatatttttaaaacactaaggaataaatttttcttactaagcctttctttttttttcttgagacagagtctcacactgtcatgcagcctgctgaagtgcagtggcacaatcttggcacgatcttggctcactacagcctccatttcccaggctcaagcgattcgtgtgtcccagcctctcaagtagctgggactacaggcatgcgccaccatgccaggctaccatttgtatttttggtagagatgctgtttcgccatgttggccaggctgatttcgaactcctggactcaagtgatctgcctgccttggcctcccaaagtggtgggattacaagtgtgagtcacggcgcccggcctacttacaaagtctttgacatgtgatgttcattttatatttatgggacatttcaatttggagtagccacctttcacctctatagccatgtgtggctagtggctaccatttgagacaatgaagttacagtttcagatgttttaaacagtccaagcagagcaccatgagcttgaagattattaaaatgctctttgattttgatggtataactaaaaagtggcattctggaagctcagaatagatctcgctgaaatacgccagatttctcaatatttatgagcataatccctgtaaaaaattatctgtttatttattttagagatgtagtcttgctacgtcacctaggctggagtgcagtggtgtgattatagctcactgcagcttcaaacttccaggatcaagtgatcctcccacttcagtttcctgagtagccgggactacaggagaactccaccacacctggcctagtaacaggaagttttaataatactgaagttgctctcagttttaaattatttactcagaattacaaaataagaaagattacatgcttttaaacattggcttttctagatgaaaacccatgcttctcatgaaattcttattattcaaacgtgaaattattcaagttattcaacgtgaaattcttttcatatgatttgtaattattccaaatacataatcatggaaatggaaaaatgagtatatcatatcaacttcaggtgaaggtgataattcaaattacttatgtaattaattaaaacaatattctaatgtcagaattccctgagctgatcatatttatcctgtcactagagttttaaaaattgggctatcccttattttgaggtaagtaaatatatatatgtaacataaatatatatatgtatatatacacacacacacaaccatttttaagggtacagttatgtgatattaagtatattcacattattgtctaaccatcagcactatgtatctttagaacttttttattttccccaactgaaacctctttactcatcaaactaactccctctcttccactccttctcagccctagcaaccaccattctacctgtgtttctgcgaatttgacgactctaggtatctcgtgtatgtggaatcatacatttgtattttcgagaactggcttgtttcacttagcataaggtcatcaagcttcattcatgttgtagtatgtgtcaaaatttccttcttttttaaggctaatatttctttacatgtataagctacattttgtttatcaaatcatgcttctatggacacgtgggttgcttttggagcttttagttattatgaataatgctgctttgaacataatttccaaatatctgtttgagtcatgggctttcacttttattacctgtctttagtttggggcccagttatttttcatgcttttgtctcattaaaatggtattgaagttttctttcactttagaatgaaataaaataaagccattttgtgtgtgtgtgtgtgtcttgatagtatttatagtccttcttcctaatagaacagatacattcactcacgtggacatttaaattttttctgccccttattttctagttctgattccaccatattttctaaagtcattcttctttaatattaaaccacttcacctgtagaaatatcagcatactgaattccaaaaattaaaaatgtctctagaatattctaagctacagctcccagggtcccagataaattatcccagtgtcacattttctgtcagaatttatcttgtcaaatatcccaggcttcaatctttcaaccctcttcactctattaattcttctcttagctcccacacgtgaactattcttggtattaaaaactcatttttaaagcaatacaatttcaacaactaaaataccatgtgtgcttgattagggtaaatttagccctatgaaactgcaccttagcaattttgcagcatcagttaagtgcttcctctatctccaattcccttttattcccaatccacaactcactttccattgtgattccttcccctctagtaaatatgactttgagaacacatgatccaaaccaaggaaaaacaaataaaaacagtgaagcaacaaatacgatctaaaaataggagagcaaagctcttaaaatcctgagaaaaagtagacttttctctaactttttcaatgccatatttggaatgttcaaagatgtgtgagaggaattcagtaattttattaataaccagaactattcaaaggaccttcaccacctgaatttctaacactcggcgttccttgctttaagctatttttatttgcaagtcttagaaaaaaaggaagagatatatagataagcagtagtaaataatgcaacatttaatttttacttcaacttcaataaataaactactctcctatttagtatacctatgaggattgctcttgggaatgtcaagcaaccacataaatgagtaccaatgagagagataacatggaaacaaagtaatctgcagcacaacctcaggctagcggagtgtgcctgagagccaccagaattgatggctgtggagccctttagcagccaccagatattttctccccagagaacatttctctcctctttcttatctaacctttttgcttcaccttgtattacctttgtctcttgtagactgtatatagctgtatgttatttttaactcaaaattaaactgtatgccatttaatagaaaaattacatatatttatatttattgtaataacttactcctgtcatcttgctttatgcttttaagctgttttgttttatatgttttgtgatatataatgttttctttcattgaatcttttactctagtgattttttaaaatccttcattaacttcagtagttatgatccatttgttatattatttacacattttcattggtgttatctgaaaactaagaaatgaaattatttgcttgtgtttttatattatgtgtttgcttttgatgaacaattttgaaaatttctattctatcgccatattttaaacaaatatttacaatgcattctatttatattcaattttagtaattgctattaatcttatattccatacgttttctcaattctgtattttagtttattttctagttgttggaagaccatagtgaacattacaattgattcctcaatatttattccacccaagatgggtaatccaagccaactagagactggttcaggcatggtgagtgacccaattctatttaatgggatataaaaggatatccttcagagagcttccagaaaaagtgtcttctctcttaagatataaccacaagaaaagttggctcttttctttctctggacattggctacgaccattacaaccactttattaccagagtgaggtcaaaccagtaccaagaacagcaaaataaagtgatggaaaaaaatgggatttttaaaatgataacactgagctgtttttatcaagcctgaagcctacattacctctcccttcttgctgtatgaaaaaacacagagatatgtattgtagtcactttgagtcaggaattctgttattgtggctgaaaacattctctacaataagaattttttaaattaattttttattaaaaatgagtaatcttcaagatcgaaagacttatataaatgtttgggtattggtatctgttacattcatttatgaatggaaatgtgattgagctaagaattctggactcatttcccactcaacattcaactgacaaacgttatttttctctgaaaattggttctgaagaggtaaattatgaaatctgaccaaatattcctcctttagattacttgcttaaggtgcttgtaaatgttttctttatccttcaaattctaaaatgttatgaacatactctaggtaactttattcatttaacccttttgatcaacagaattatgctcttcttcagctcagaaaagttttattctaatacataactaattaatatttgtgatctattccttttgctcttttattctggcattttaattacagcattttatagtttctctaacctccatatttcttcttttttctaatagttaatccttttcctgtcattctacattattacacatgaaatattacgaattgtgaatgaatacagaggggtataaacaggaaatggattgatatagaaagtaagaaaacatgttccactttgtttttatgtttattgaagtctccttgtttccatctttatagtggctgcttatctaactgtgagtgatggctgtcactattcactgtgggacaggtatcaaatgtcagcaatctcttctgtaagtaaagtctgcatccagcgcatcccattcacagaccctgatacggaaaatgtgtctccagctcatcctctcttgctcatcctaaattagtagagtccttgctcccaggtccccttacagcaggtctccctgttgattatggcacacacaaaatatctcaagtctggatatcttttggcaaatccatttaacctatggggaactcacacatccttgccatgccaaaagatgagatacaggttgccccatttctgccctctctttttgcagctattcattccacatgattatttttttctcttgcttacataggtgctatggcacattacctaagtctaaccagagatctgacaaagagttatgtgccttgttctcttctagccatcctgatctctaggagtggctctcttggtgaccccatcccctgggtttagtgttggggatagagaacttcaaaccacagaaccacccaccaagcgggttcagaactccctcttcctccctttgattatttccttattcaacagcagcacaaaaagaggtcatgaggaggtcacagactgtgtacaatcgtgataagaacacattgctgggaacacactgggggaaagcattccctggaccagatctgttgggtaccaggggatggataaaatataactgctcaggtgaaactgaaggaagaatatgcagcttttaaatgtaaatggctcacgctgcaagctgttataatactaggcattgctatattttatctctgtagagagtaaccacaaagtcctattctttcattaaaaattatctcaggtgggcacagtggctcacgtctgtaatcccagcactttgggaggacgaggcgggcagatcacttgaggtcaggagggcgagaccagcctggctaacatggtgaaatcccgtctctactaataaaaatacaaaaattagctggacatagtggcatggtcctgtagtcccagctactctggaggccgagacaggagaatcgcttgaatctttgaacctgggaggcagaggttgcagtgagcagagatcatgccactgcactccagcctgggtgacaagagtgaaactcagtctaaaaagaaaataaaaaagaaataaacctcatgttccttttcattctccacccagactgccaatttgctgtttgtttttctcaactcttctccatgttgaatcctggaagttattgaaacaatccttgatcattgcttttagtctctagttgttgttaggcaaaaggatttgcggctcctcatcagaatagcaagtgaataaagagcatggattatggaatcagaccagatttacacttctgactgcatgttataactgtgccacctctctaaatcttaattttcttggttgaaaaaaatagcaaaaacaatactatctcgtacatttgatgtaacgattaaatgagatgacgagagcaaaggatttaacatgattttttacatatgcacgaatttaattattccaataggatgatatctacattctgtcaacactttgtaatagcaaaaataaaaccacctgtgaaccaacatatgctgaaaataacattgactttctccaggtacccaacatatttatgtaatgttattcagggataagctggtgagtttgtgttctctgctgctagttggacacactaatataaaaacttgcagattattaacacagttttctgtatgtaagatgtttcttttcataatatgcattaatattttatctttttattttcctactttctaatcccttctaaagctcagatccagttccagtttttgagatttcaggaaatagtctacactatattatataagggctaatagtttcctgaagtccatctccaggttattttgattagaagatcatcttcctcggggatcttgactttcacttctgataatattgcgttatggttgcccctaacacatgcatatatctgactagatgttattgagatattttagttacttcttccactgagagtgcatcccattgtctgaggaatgttgtaaagttttaatttgtcaatcataatacatgtatagttacaccagaataagaattgattggcaagtgtctaggctcaaaatttggttttagtttgaaaacaacaaacaaaaaagatgaaatctagccagatgctatgatattttttaaaaaatcaaacaaaaccaaatagaaataaaaacataaaagcttctaaggtattgatgacgataaaaacaatcagaatggtaacaaagtaatttaaaaatgaagtaaacattgggttttgatttgtaaggttgtaaaaatttttctctttattgaggcatttcatatatatgcttctacagtaatttactcatttttagaatttgaataagagttaggtcttttaattaacatacatttttccttcttgccagggaaatgcatgttttcatctaaaataagcacaaatgacacaatgtttagattatattgtcaaaaccaattgtctacttagtgtctatttccatatccctgccacagatattgacaataatgatatagcgcaaagtgaagtctatttttaaatgcttcctattgaaacatattaaagcaaatgtacatgtgcatatagaagcacacaaattatggcatgatgctgacagcaagaatcaattctggtgacaaaaaaaaaaatcagtaggcgtttcatgtatctgccaagcctaattctgactttctctactaggtgctaatataagagaaagcaacccagataccaactgggaaaaactccagattttctcttgggtacacaaattatgacttttgctaggaaaccatgataataacaaaatcccagaagattataatgtgaattcttaagagccttatacctgtatatgctcactgaaggggtccccttaacaactaagatacatttatttcaaaaacatcaagggccattgaataatcctcctacaagtgaccattgaaagtagtttaaaggtattttccagaaatataaataaaatggctaagtcaagggaggtcgaatttctattctttattaattcagatacttaactctgcctcctctaatgcacacagttctagaatcttgaaccagcaggctctgatgggaatggcagcctgcaaacataaagggtgagtgataaatagccaggctgtgtggcccactgtgttccccagcggaaaggagaaacagcccactatacttctgcaggtaccctttcccttctgcttcctgccctattgccacagtatccaaaaattgggtaaaactctgagtagaggacatgaagaaaggaactatagaacagctacgacataatggaaacagaaatgaagcaatggctgtttggaaaagaaaaagaactgaagaatacaatcacctccagtcagattagtttatcagtcaggattctaaattcaacttttagttgtgaaatgcaagttttctagtgaggagaagggaatgaggataaaggcaataatatgttaattgtagctgaatctatatttggactgctgtatgctcaaaattctacatattaggggtggtaggatttgaggaggagagaaaaaacgatagagaggatggtgttatgtggaagcaccgaggtttgaagtctgatttaagtgtctactacacaaataggcatagctctgcaatctaagaatgaatatgatagcaaatatttagttattgattatggaactgagcgtatcaaatctttaggctatttgctctctcctctacacaactcctgtgtccaccttccacttcctgctggttttctcttagtctacgccctgtcctttccagatgccaatgattcattctcttttcatattctatttattttttccactctcttccattcatctaatacatacagagtacctagtgtgtataaccctgctggataattgggacatagggtccctgcatttaagatatatgtgttctttctggataaataaataactttccaagtatataacaatagtgagtaatgataataattgctggctgggtgtggtggctcacgactgtaatcccagcactttgggaggcagaggcgggtgaacgcttgagcccagaagttcaagaccagcctgggcaacaaagggaaaccccgtctttacaaaaaatacaaaaaaacattggccagtcatggtggcctatgcctgtggtcccagctattcgggaggctgaggtggaaggattacttgagcctgggaggcggaggttgcagtgagctgagatcacaccactgcactccagcatgggttacagagtgagacacagtctaaaaaatgtaaaaataaaataataataataattgctagtactacatccctatgacacacatatggtactataattacccacattttacgaatgaaaaatctgagacacagagatgaagaaacttgaacaaagttgtatggtttgtagagttaaaatttaaatctaggcagttaaattccaagcccatgttcttaatatctataccatatatctttaagagtcaaaaaaaagtatatgaagtaaacacactaggtaaaatattaaaactaatagaagggtcaaataaatggcatagccaagaaatgcaatgaattccagagaccaagattggaataggtataaatattcagagaggttttttaacagccaccctccgccccagcaaacacacaatccatattgtgttttgggttcttttagggagagagatttttgaataaaagagaaggtaaagaaaagagaggtagaaattacaatttttttatctctcttttttagtactggcatgagactagctcattgtagtaggaattacctagtaacattcaatcatctaatgatgctttatggctttaagccatacttggtcaccttttatataaataatatagatcctagatcaataaaaaaaccctctaaaccaaatttaaattcatgttttttaaaaacaccttttagaaaatactactcctttattattataataatatctaggcaatctcgtgttaaataaacttggaatttagtaatgttttttcattattttccaaattgcttgtgccatagtgtattgtttaaacgctatagtatggtgtgccaaatgctaaaatcctatgcaacccctggcaatggtattctgcagtgcctcttattacagtgcatgcaacaattttcttgggttgggcatttcaaatcattttaaactgcaaatataatcaggaaattgtgttttaccatttatagtttccaaataattaaagttttacattagctaggcttattgcaaacttcaaactatttcaaattaaatcaagaaaagtacaagaaaacagcaaatgctctaaatgtcattggatggatagttggggaatgtttcatgtaagcgtgttatatatgaaatgctatggaggataatgctccttccttgacatgtccattctgttgggtttaaggcaagaaactctgactatgttaacccaaaattaacatagtgtgttttctcagagacagaactttgaaaaattctgcagcacaatgtggctcggtaattaaatcaagctggacccagagaactgcattgggtccacagaagactttttgggccaaatttcatagttattatcttagaccaggctttttagaaacaacttaggtatatacagtaaatatactgaattgtctgtcctctctaggaacatgtttcaccagattccagaaaggtctatgctcctaccccataatcacttaatcacttagagataaaaaaaggtctattcacatttaagtcaataacatacctttgactaaaaagggtaaaatcttaaagttagaagagtttatttttgtatcgaagcatcttttatcccctaacaagtttctttctatatatgaagactatagctattttttctatttaccctaggtgacattgattcatttgacccatacttattgagtgcctattatatattaaatgccatgtttatacattggatacatatttgtgaataagtaaactatcttcagaaactaaagatgatgaacacaaataatttaaataggaaatacacaaatccaatcacattaactgtgttgaagaaaatgaacagggtattgatgtagataatatcagagaggaggaacttcaagtggccaagagaggtctcatagaggggctggcatttcagccgaaaactgaaaggtgaaaaggaagcttgggaaaaataaaaataaaaatatattcagaaaaagggagcagaatacgacaagactagtgtggctgatcgtagaaggcaaaagaaagtggttttcagatgggtttgaaaggtgggccagagaacatccacatacgtcttacaggacatgatagggattctgaatagtgctttatgtacatcaggacatcaagattttaggcaggggaatgacatagttggatttatatttttcaaggaatttattggcctctctgtgtggaggacatgttggagagagacatggagaagaggcaagaagaccaagaaggaggatcctgtggtagttcaggaaagactggtgactgagcttacagtgggaacagcataaattaagagaaatggtgaaattattttagatagttgacctgctggtagttggtatgttgagagtgaggacaagtcatcttggatgcattaaggttgagtcataactttattttcccccaaagttatggaatgatggtagcacaaattaaaaatgcaatagcctaagggagagacagagatgtatttaattttcagtttactttaatcgggcagaaagggattaaataatgcattttttaactgttaaatgtgtaattccagtgagccatccaattgaagatgtcaattagacagctgcttattcaaacctgaaattgagaggagaggtttgggttagaaatatacatttggaagtcattgtcacacatgtgatatttaaagctttggaacagatgatcacagaggaaatgaaagttaagttttaaaagggaacataatccaggaaccagccaagatttagaggtcaggtttagaaggaagactttaaaaaggagaatgaaaaggataatcagatatagggtaggaaagaagaaattatggatctagaagcgagacagttgaggatttgggggagaaatgattggttactaagtcaaataatttgaagagctcaggtaatgaagttaaaactattgaccattagaaccttagccttaatagttttagagattgttaagagcagaagccagacagctaagtagaacagggagtagatatgtttggtcaagctgttgttatatgacaggctattctacagtgtatttagaggttgatagaatcatagagaaaataagaattgtaggtgtgggtctacagaatagaggaaatccttgaaatcaatcaactttagagctagtgagttgatagaaggttaaatattaactacgaaataacagatcaaagtgttagtttcttccacaattgttctaacaaacacaaaattgcaaattaaagacttgaacttctgattatgacaatctatttctacttaccttgttctttcatctcagaaatcagagatgtcttcaaatatatttttctacataatatcttaattataattggataattcaatccattttcagctgaatttaccaagcatttaacccaatttacctattctattgtaaatagtacttttaaaaaaaatttaagaattacatatatgtctaattatctcatctcatacaattacaaagagtctcagatatctttgtatgttaaaagaaaattaagttaaaaaaactattcaaaatttgtaaagaaacagtgagatttctatataaaataaattaggtagggtatacaattaggcaaattaatggatacagtattgaaatatgtagataagctacaatatataattattaattgatttttaagacctatttctgcttaattactactttttatttctaaaaccagcagattaaaaatattttctcaatttaaaaatttgatctctgtggtaaaactaaacatagaatgtttttgctctgttagaaattagcctttggagagaaaacacagttattgtaacatattattcaaggtaaaaatcactaagacatagagaatttcagattttttttgctaatttctactgagagaactgtttgggaaaactgagagaactaattgaaagagttgactatccatgctttaaaatgtcagattttaaaatctatctctgcactaaagacatcattatttttgacactgggaaaaagaaaaaaacaatgtttagaatttgttaccccaaacaaaataacagcaattaaaaaacacagcaatgaaactgtgattgaaaacatcttagaagaaagtgaggctaaaggtattacatttttccctgcttctccatatactgcaggttacctaaaaggaattcatatagcttttaaaaataaaatgtaatttcatcagttgcccttgcctactaatctatattaacatgacctgtatcaccattgacttttcttttagctctatgtattcatctgttctcacggtgctaataaaaacatacctgagactggatcatttataaaagaaagaggtttaattgactcatagttccacatggctggggaagcctcacaatcatggcagaaggtgaatgagggtcaaagtcaagtcttacatggcagcaggcaagcgagcttgtgtaggggaactcccctttataaaaccatcagatctcatgagacttattcactattatgggaaagagcacaggaaagacccaccccccatgattcaattacctcacaccaggtccctcccaggacacatggtaactacggcagctacaattcaagatgagatttgggtggagacacagacaaaccatatcgctgcataaccttgttctcctcattttttttctctctaaacagtaattgataaattacgttttcacgttaaaaatataataattttgtttttgccttttagaatacttgttttgttctgtctggctttagaattgggtaaggacctagaacgtgtaagggagaaaaagtaggagagaaatagaaataagtgagaagacagactaagcaaaagagagagtgggagatagatcaaatttagatattttgtgaaatgaaattaccaagttatttttattcctaatcagcattcagaaagctacattatataatatagttgaaaaaataatcaagatcctgaaaaatgttttcattagcctagacttaaagaaatattggtaaagatttgctttgtcacagcacgtcacaacatattttctgagctgtgatccaaggtgagttacatgagaaattagaaaatgtgttgtttatgtacatttacccttttaaaaattattaagttgatctagtctttgtctttcaagatcatagtatatgaagttgtataaaatgtcatttagaggtctatttttattgattacaatgttacataattttagatttttttgattattgtaataatataatccatcccatattgaccagtaccaagaaaaatagctgatttgctggacacataaactgaagccaaactaacaaactaatatgtacctaaatccatatatacatatttatctcatatatgtgtgtatatatatatgtatgtgtatgtatatatatatatatatatatatatatatatatatatatatcacatgtactaggtaagcagagatatatagagcattaatttatcaatactgttgttctatatgtgttcctgagtggtgtgaaatgtctggcatgcaattggcttgaattgaggagctgcccttcagagcagggctgtcttctagatcactggtccccagactttttggcaccagggaccagtgtcatggaagataatttttccatggaccagggagtggggaaatggtttcggaataattcaagtgcattacgtttattgtgcactttattctattattatttcattgtaatatgtaatgaaataactatacaactcaccataatatagaatcagtgggagccctacgcttgttttcctgcaactggatggtcccattggggatgatgggagacagtgacagatatcggatattatattttcataaggagcacacaacctagtcccttgcatgtgcagtttacaatagggtttgtgctcccgtgacatctaataccaccctactctgacaggaggcgaggctcaggtggtaatgcaagcgatggcgagtggctgtaaatacagaggaaatttcactggctcacctgcctctcagcttttgctgtgcagcctggttcctaacaggccatggtaccagtacaggtcagtggcaggggtattgaggacccctgttttagatcaactaagctctccataaatacgttagaaaaagttcacaatttaagcaaatgatccaggcaatttttcccttccttaaaattaactctctatgcaaaacaaaactacaagtgagctcttacctctgtattatatcaacaaatgataaactattaggaggaggattgaaggaacacaaacacggaggtcccttgggctttctgactaattcttgtcatttttgtcaattgcattaactctccaaagttccctttgaccacttatgggattataacttcagcatttctccttactgctgctgcctgaggcagcctatttgattttgcctacatcgctctggggcttgcacgaagtagcagtgttaaacttgcagtgaaagtgagccaagcctttaagtgcctactcaaacaacttggctgacctcatcatccttcttcttactaacacctggaaatggattcggcctgggagaaatagatccttttcttcgtggaagcttctgcctataacttctaattattccgtgggactctcgatgctttcaaaatgagtccatattccccgtcaatcagaactatcttaaacctctcttaaaggaaacactttcaaaattatcctttcttggaccagttgattccaggaattaccatactttatattttgtcttagtcatatcaaacattttcacctttcatgaataatttgaacttaaagcagaatggggcttcctggtccctatattcattttctttctttctatttgcattcctgttggaaagcagttttgctagtttgtagtttgtttttattataatgatcacctaaaagataatatatcaagagccagtatagcagagtgactaagagcatggattctggaaacagtccatctgatttgaaccatgaccctgtagtttaagatccctttgaccttaggcaaataaattattgaacttctctgggctttaatttcctcatcggaaaaatggcaataataataataagtactggcttggtagagttgctatggagactaaatgtgttaacatagttaaaatttaggcataatgtgacctataataataagctctttataagtgttagatattatatttgccatctaagatatgctctgagtgatgataaatatcagcatgtaaacactgtttgtcttaaaaatgcactactgtgaatactctaaaatagcctagtgagccatcttttgctcttaggggtacatccatgaataatggctagccctgaaggtacgtgatgctaaaacaatggcattgccagttttaacattgtgggactcaggcagaatggagtcaaaagactaagaatggtctacaagaagaaagaaggaagggaaacagaagaaagaccacccaaccaataaacaagtgttttcacccatcctgtgtattctaggtgtatttttgattaccttctcatattatcatattatttgtggaatgtggactgtacagggactacctttaaaacattgtgtgaactaataaatagcatgagaacaactagataaggcattacccagaatttttgacctgtggaatggtcacacctgaatccaagtatgccactgaaagtttcagaagcctcttctgtggcatttaaactgaataatagagaggcctagagcatttgcggggcagaaagacagggagagagagagagagagacagacacagacagacagacagacagactaactacacggagaaatctcaacctctagcagtggacttgatggaagaaactactctttgaaaatgctgtttctactccaaagtcataactaacccatattatgtatgtttatcagatttatccctcaaagaaatttcttccaggaaatattgggtcaaggagactgttacagaataacttatcccttatttattgtgcattgtttatttttgaaatgtggagacgccttatggagaagaaagacttatggggggtatggtttagtttggtggtctacataatatctgggtaatctccacacagatcctgtgttgtagacaatgatgcataagtagcatagcttctgctacatgtcactaggcactgaaaactcaaaatatttgtcaggctattgagaaagttatagggaaagaaaatttgaacaagcagtagatagacaacagaaatatgaactccgaaatgaatgtgaaatgtgggaggctggaatgtcagcttcaaggtggcttatggaggaaaatctggagaaacttggggaaggtggcagcaccaatgttttgctgaggtctgtgtgatcagtagtttataaagtaaatcttcagtagtttagaaaatgccaagatacatatgcaagttcttaacaacctagacaagagcagataaaataaatgcaattttgtgatatactagaaagttttttaaaaggacattagagaggaaggcttaggaaaatggaaccaattgagactcagttaagagctggtgggagtaatatatagcctagtgccaagctctgcccgacaacataaatctctccaagatgtctgagcatccctgtgatttccattaattcaaagagaagcaagatgggaagtcagaggttactgacaaccaagaaaaaaaatgaaatagttgaagaggcaaagatcataaatcaactcatacgatgtgtcttattgaaagctgacatattggtagatgccttagacagttggaataagaatttccaatcctcaccttcacgggaaggggcgtaacaacatgggcaagctcatgaattcccctcaaaacgacaccccacctcctgctaccagtactatctgagagagtatttagtacatactagtaaattatacttctaaggaattacttcctagagttggacaaaatgtcatggtattggatttgcttgggttctggcagtaacatactactagagctcctatcttgcaatactctgagaaaagtgtaagcagtctaaagtttctgcattaacagatgaagacaaattctggacaaagactctcaagtcaccattattatttagtccatttctgggcatcagcgtccacattttcccacagtgattattgacataacactcagtagtctgaatgtaggacattatctgcatctgggcaaactgtgctgaagagcccctgaagttgccagaggagatcagagaagtgacacatgtggagccagaacttgcaaccagactaatgttgctaagcaagaatgtaagtcagaagtttatcaacaacctagaaaaaaaatagaaatggttcacgaggcaaagatcataaatcaactcagatgatgtgtcttattgaaagctgacaggtgggtggaagtgttagatggttggaatgagaatttccaatctttaccttcatgggtaggggtgcatcatgggcaagctcatgccattctcctcaaaaaggcgccccaccttctgctaccagtgctgtctgcaaattctaactactttttggtattgacccattattcattaccacttatggaagaaagtgtctgacatcttatcatgctccccttaaatgcctttgtgcctacttgtataatcagataaaagtcagaaagtaccatgagaaaattttcagatatctcagcctacaggctgtcgggaaaagaagtcacacacaaagtataagcttctttgacactggaaggttttagatacccaagcacttgaaagaatctgtgacagggaaactagaagggaggaggaaaagctctctcatgttttgcgaaatgtagactcaggaacagtggagcaatatgcaattctaggacacctggagttttatcagtgaacactttaggaatgtctgtttctccaagatggattctttgagggattgcgtgaagcaatccttatgttaatggtgttatttttaaattctgaactccatgcttgtttgatcatactgtagataaggtaacaagaggaaaattaacacagaactctatgattatggcagccaataggagaagaaaaaatccttcaagatgccttcactagaaagcagctttggaaaagacaaaacatattattaattgaggggtatcacagagtagtgcctcataagtggcttgtggctacagttattgctacttcggaaatacttcccagaaatgctgagagcaatgcctcatgtctttgaaaccaagggagggagaaggcactggatatcatctgatacctaggaagagagaaggctctagagatcactgggcagtatttctggccccagaaataaaaaatgtttaaggaccattatctttaattctggcacctgcaaagatgagtatggggaggagagtggaaagtaaaatgtgccctccaggaaggtttatgtaaaatgcatctgaccagtactttttaaaaaaaattgtatgtgttgatttttttcccattagaaacagctaatctgatattagtaagagagttttacagcagtcataccaaatcatatcctatgaataatcagaatctattctctctgttccatggatgctgtgggagtttgttcattacagacttcctctttgaattccttctaaccaaggcagagcttttaagagcccatttctagagaaataatttaataggcagaaatttcaaaaaaaataccatgactattctctaatatccatagtgaggctgtaaaccagaaatatttagcagaactttgtaaatatctggggaactctcctttcaaagtcaaagctgtagttactagcattttattcctttcctgatatcctaccccaaagctttcattttccactgacctcagttttggggtatgtttcaagagacaatggattgccttgattcagtaagaaactaacctgaaaaatattctagaagtttttcatcatttggcagctgcagtcactcaaaaagcaacacagcctgctctaaagacactatgacaccatgtgggatatcaatggcatgctggagtttcattcacttgcaagagttttcaaggcattttacaaaagaagttactgcagctagattagggccatttgacctcttgccccaaattatttatttttctatgttcattttataataaagtactgaaaataacttaatgataactaatatttgtaagaaaaactgtgtgcacacacatgcacatgtgtgtgcatgtgtgcatgtatgtgtgtgaatatctgtgtgttaagagacttagttttttaaaatgaaatggaagaattaagactatttttcatggctaggttctattaaacacagcaattacgtgaattccccttcattcttcctggataaatatagaaaagtgagtaaatctcctactttgaaaaagtagggcacaaataagatgtatctgagaacctagtcatagggcaaagggagaaaaataaacggtgagagaccaagacaaggagacttctgtgcacaaatctgaggatatatttacatggaccaaaaggcaacctgatggggaaatatgtattttgattaccttctggacactgataatgatgctaatggctactatatgctaatatttattgaaagataattctcaatgtttccttcatgtttctgtacatttcacaagcagaagcatctacagcctatgttccagactgtcattccaaggatgtttttgtagtggacaaccttgggagacagagattataactctcctttgagcaaaaagaagatgtgtttgttgtgctttataaaagactcagattccctaaatttggggatttcctcctgacacaactctctgcttgtgcagatgtgacctggcccttttcatgtttcccaataaaactaaagtagggggacagaaaaaaaacatgaggtacatgctgtttgctatgacataattaatacagttctttgtctcagagccaggagtctcatgtcttctcctagcatccgaggatctgcagcaggctatcttattacacagttattacagaaatatttcagaccttccacagtctgggcaatggtctttgttgtaaaatgcctttttgagtatcagaaaataatcattgctcctaacggatttgaagataaactacgcttatttacgttccaagaggtaaaagaagaaaatcagaccactataagcagaaggacatttctcacatagtctcaccaaagcaaattgcaaaattcaataaagaatatatctcggagaagccaagatatagaactatagaaaaagaaaagatagtagaacaataactcagtacatcctaataataacaacgaaagcaataattaacttacatatggtggtttgcagtttacaatgcatttccacacattattttatttgggtcttataacgacctttgaaatagtcttttttattttcttaattacaccgttgagaaaattaaagtttagaaaaggttacataagttgctgacggccaaaactaacaagttaaggaaataaacaattgatatagactcaagcaaactgaataaaaccaaaaacaaaaatcaagatttggccttaggatcacaatcttttgtcacaaattatttcctttctgttttaaatcttccacttgtcccctgtgaacatgtctttctctcctatgcagaagaacaaaatccctctatttacactgtttactttagttataatccttccactttgttttcatggtgaaattatataaagagtagcttacatgtgttctctctgtctttcctgttttccatccatttcatctattattgttttttaaaaaaatccatattaaaatcaccagtggcattctaaatgataaagactcgggatgcgttttggttattatctcaagttcaatctcattttttgaaaacatgtttcttctttggattgtggaatactttcaatcacttattctcttctttctttctggttacaatttctcagttgttttcatggagatctcatcttccaactgtcttataaataaatctttctagagtttcatctccatccttctctccttgctcaatctgcttccactaaaacatctcatctatgcccatgatttgataactactcacaatgcaaaggcacacccattctatatgtctggctctgatttctttcttgagctccagatatgtatttccaagtatcgaatttatatctcaatctgataacctgtgaacttaaggttcaatatgtccaaaatcaaaccactctactttccctctaaattatttctttttgttttcctttcctggattgggtgagccacactgacttacttctaaaagctgaaatgccccatccttcttccttagtctccatattcagttggtgattgaattcggttcattctgcctctagatactccctgtaacatgtgcttatctctctgttaacaatgccttaaccttcatggaaccccacatattcaataggctgccctagtaaaataatctcctaataggtttttagtctccttttcatcaaagatacaatttatttacttctttctgaaatttaaatcttacaattttgctatctccagaattaaaatcttcaatatcttcagatattttactacctccaaaattaatattgaagatattgatttatgtttatgtctttatgaagatttatgtttgtttttatgtttatgtttgtgtttttatgaagattgatttgttaataaataggttcttaatcatgtttcaggaataggaaaagctagactccaggatttggattttaacatctccacaaggaaaggggagaggggcttgacttcttctcaggagtgtattcatttcattgttaggcaatgttgatggataatattttatcaatggcatctaaagacccactttttgtgactattgctaaattcttcagccttaccttcagtgcttagactcatgcccatgtacacacatgcatgacatgcatgctcatacacaaatatgtctatacaccaacacacacatcaagttcttccctgatatgtaacagtcattcctgcttctccacatgctctgataactgcttggagtttcttttcttcccccacctctactcaatactttctattcaaattaaaaccccattccactctcaacttctatccatatgcgcagagttaaaatctctccaagaatcttgcatacgtaacattcagagaatgcatttcattgctttgtcatcatttgccactggatctgtctctccgaacaggctgctgaataatgaatacagttaagttcctctagcttgtgtactctatttattatttactgtggcacttcctataataatgtggaaagtggtaactaaggaaacttggaaaattctagtgaatcacaacctgtaaaccatcactgagttaaggataaagtatcaacttaagatacataagccttagtgataatttttgttataaattgttataataatattactaacaaaaataagagctatcattttataggtagggattattatcttcagtataaactgaggggatgaaatgaaagtataaagaaattgtgatgacttggctaatgtcccaaggtaaatggtaggttctattttactcctgtgataatggccaaattagtagttttcaccaaatagctcagttctcccctggcactgggcagatggaagaaatgctactcccttgaagttaaatatggtcatgtgaattgcttaggccaaagaaatattagcgtatcacttgcagggagaaggtatcagagccagcacacagtcacgagtgctctctctctctctctttctctctctgtcacagcaactgccaatttttaaagctcatggctgctccatctgactgggacttcactgtagacaatgtgagatgaaaccacttgctgactcagattggaaatgtaatatgagcaaaaaatgaacttctgttgtgttagcccactaagacttcgtacatttttcagacatggcatgatttggctcactttgaccaacattccacagatgccattacttcagtatcaatgtttgcttgaccataaattggactcaaatggattttttggggggaggtcaagtctgaaaagagcttacccaaagttttgcatctttagggtacgaaaattatgggagtttagacgttcatagttacttttttcttttactattgcaaaacttaggtattgaaagatttaagacatatggacacagagaagccaccaacaggaaattgtgtctgaagcagtacaacaaataggaaccagagccagagatgaggcaaaagaatatatgaagccaacatatattctagaaatataatctgggtcagagccaggaactgctgagttaatcagtgtgaatcagaagaaagagtcagaaatgagagacatgcactacctaaaacagttgcagattcaagtttcagaccaagtgtcagggtaaagtcaagacatttctggtaagtcaaaacatttcagataagtgttttaactgaaaaggcttaaatattttaaaagtccacatttcatattcaactgcctcagccaccactatcacaatcctaattataacagtaatatattaaattccaagcacttcacatacatttccatatttaatcagcaaggcaactccatgaggaaactgaagtatacatcacagcactagccttcaaacccagttttgtctgacatcaaattatgtgttctcagacactgcgaaatggccctgtgccatttatccttctgtctcatacaaagagggtaattatcaataagtggctgggcttcccaaaatagagccaatctaacacagggctcaggacagaagtaaaagctaatctcagcatgacaaacgggcaagagggctagcgtgtgatctaaatttgcctaaaaataaattgactacacacctgtgaggaggtcaagtctctctctctctcccctttcaggaccgagatatcgtattatctgaatcctggattctagcttttcctattttggaaacatgactaagaacctgtttattaacatatcaatcttcatgaaaaacataaacaaattattcctgttttgacctttgttatcacttattgtgccacagttctggtccagctactctgccataaacagcaataatttgtctccctctgaggcttactgcgaggattaaatgagttaacacttgtatactatttacagtaaggcactgaaaatccattatttagtatgacgctgattatagtctcattaaatcctacaacaagattttgaggtgggattctactttttcaagtgagaaagctgaggctcaggtagtttatgttacattacgaaggccataccactaataagtagaaaacagggctgggattccacaccgtcaaatatttgcctgcaaaaccaaagctctttccactaagtcacaccacatgcctcactgcaatggaagaaactgcacaccaggtccaaacattatgcacattcgtccttattgaaaagaacaaattcactgtaattttgcaactcctcacaatgccagctgctataaactgtatgaaatttatgaaagtttggaaaggttcccaccataataacatagtatttttcgaaaataatttgcatgctatataacacacattatatatagcaaataaaaagctaaccctaagtgacaatacgtgggcagataatgaatcatttggaaatatcacgtagatttcacatagaaaatattgttatccatgaaaagcccaggagtttcttaaccctttgctgtgacgtggaaccacagcagaaagcaccgacagaccaataatgtgataagcttaattctctaaagggcaggagtgagagctttctatcctataacaacagtttggatgactttatatcaagagtgaggaagaaaattatactcctctcccacatatcaagggaaatgcttcccatggagtgactcagcctgaaaccctaaaccggagcacggtcacagcatgctgtaggcagtcacagcaggctccgtatcagctgccttcggcatttgtagggacaacacagagcggaggctgccaattacaccagaagcttctaccttgtgagaagagtctaatctagtggaagaaaaacagacactgactcttcatgctccaaactgtggctcttttctacttgatcatcaacaatatgttcaaacagccagaagaacacactccctctctagtaagataataattgtaaacagtcatatcactagcaatttgccaggcacggctctcattacttcatatatactaattcatacttcatatatactgattcattcaacttaatacttatagcactggacatatttttttccatataaaacacagatatattaagttacccaaagtcagatatctgaagtatggtaggatcagtatttaaacacaagctgtctggtatgctagatacctatccaagaatactgtgccagtatcaccctacttatccttaattatttttaagaaaagcctagcatttaggagaacaatcatagttacagggtgcattctggcaattgtggaggaaatgtaaaatcagataacttgagacaattatctttatggtattctctaggtccaacattgaatgatttggttttgctggaattggtgtcccatgagctcactcatcttgcccaatagttccacagccccaccttattccaagaaagcaaataaaatacttatttgatatataccaaatataatcttagcatgttgcaaatttaactttaaatcaataacttgattttttatacttctttaatgtacataaagaaattcttattaaaagatacaaatcaaactcaagaaagtgaatgcattgtatcatttttctaatagagtatggaggaatgtcacttaccaatactgcattgcaacatgaaaaatctaatctttaaagcccccgataaactgatcatgcatattgaacagcatgaaaaatgaatgacttctataatcttcaggatgatgtttgtttcctgttatattttggcactggcaatttattacacaagaataggttctaatcatgatattctttgcttcctaattattcaggaaagtccttggagcaggaaatctagcacttttcatgttgtctttgttatttaaaaatagcgtaataatcatggaattggcactatttctttaaaagtcacagctaatctgttaatttgtcttctcatagaatccattttaataatgctcttacactcagtgtgacatttcatactaccaatttactgaacaaccattgatctttgtctcagtatattatggattttatatttatgataatttttattaccacttgttttaggaattttcacaaatttattactgatttgtgtattcttatgatataattaaatgtacctccatattcattagccaatgaaatacaagtagcagcctataatacactgaagaatttagtagaaatgtctttcttctaatcaattcaaatggaatttctatatctgagcaatagcaattatgaataaaacattagctatcatagcaataatttatatattttatagtaatgtttcatataatacaggaacttttcttataagtacttaaacactggaaaatatattttaataaacaagccaaattcaacataacctaagccaaactcaatgctttctttacttgacagatatcaccataatcccttcttttaaaactggaggaaaatttcagatcactctctctcttcccctctctctctctctctgtcagttgttgtattttattattttccaagatatcctctgttaatttcaatattataaaatctgaatccccacttttccagtcgtctttcatgatctacgttatgcagtctacaccaataccctactaactagtctctagtctctagcatctttccatcaccatataccatcttctcagtcgtcaaagtaaacttctcgaagcataacattgcttctgtcactctaccacttataactgtacaatgacttcattgtttgactcaagtacggcatattttgatatgcttgcattcttacagacttcactcactcccttcaattgtgatgggctaaatgtgcctcacctcccttcctcaaatttatgccaaattttcctttttatccatatcatttcctttgtcatttaccttaaacctaatttttaaatatttgtttcaaatcctccctcttgtacgaagacttccctttccgttcctatctccaatggaattgtaaaaccccatataaccttaaagtctgcttgtatcacatacaatattctggctagacatagaattatttatctattagtttctagccttctttaaactataaattccttgaatggaggacacatatctcttcatatttgcatctcctgcagcaccaagcagaaaactcactctgaagaagatgctcagaaatatttacttaatgattggattaccacagcagcaaagagcagagcatatggaaatttgaaatcataggcaaatcaatttttaaccaatttagaaagtattgagtataagactgcaagtgataaagaagaagtaggccattctgaactaaattttctttactcttcttcttctttttttttttttttttttgacagggtctggctgtcagccatggtagagtgcagtggcacaatggctcactgcagcctcagcctcctgggctccagcaatcctctcacctcagcctgccaagtagctgggactacatgtgcatgccagcctgctgggctaattttttttttttccatagagacagggtctcactgttttgcccagtctagtcatgaactgctgggctcaagcaatccttctgcctacacctccaaaacctaaatgtaaatattcgtaatatgataaatgcatatattgtacattcagaggctctacacagttttgagtgtgagaaccataagttatgtcaaaatttccaaatatcatatattttgtaatcatatttttattattattgactcagtcaatagtcatagactttttttagttttttaaaatgcctatgaaattatagatttggaacttccttacaaatacccagcagcattctcataccctcattcaatccacagactaggaagcttctagaatacctttgaaactggtcttttcagataatatacatgaagcatttattagtgttcctggctcataatatgtactctataattaatgtgagtgatagtattcgctattaccatcacatctatcttcatgttctaagtccctatatgtgtttaacccttttctctgcttctactttataatatcatccaactaattcctgatacacatctcttatatcccacaacatctttctgcataagttgaccagatgccttaatttttacctcgttcactatcacgtgctgtttggttctttttctcctttccacttcttgcattttattctccctgtcaccatgttattctttccattcttatcattcttattgcattctctatatattgctttttctgtactcatcattttccaagtcttttggtgcctgctattaattagttgtttctttttctctcttcaacacctgacccaactgctgttcatatttatagttgaaagtcactttatgaaatagacatattcctgaaaatctagaataaaaacaaatttcttataaataaaatcttactctacatatgcaaagaaacaatattttctttttaaaacttacagtgaagtgaatgatcatagcctatcacttgtatcaatgcacacactaaaagagttgtgcggtcctaacttgaggtcctgacacctctttcttttacaacctctgattctaattccataatgtatctatgactccctgcttcctactctcttttaacacacacacacacacacacacacacacacacacacacacacacacctctcccttttccctccctcttgatatctatgagtcagaccatactgtctcaagcacagcattgcttttttctcctctttttccttccttctcactctctgcgcccgtttgtccttctccctgtctgttacagtattaccactctccattttgccaggctgtctcatcctctgctttatttctattacagctagagtgttttccaagcctaattgtgcacctaacattttagttcctttccttcaagatgtaatacttgatttaatttaccttttcctttctcttgtgtcaaaaaggtagtctcaagtcaacctgacttgtaaacacaaaaggcagagctggatctatccccatgaagaacaggatctatgatccattcttataaataaatgatactttgtctagcacaaatgtcaaataatctcataatatcaatatgaatacttacactcagcatatttctgaagttgggaaaattccgaagggctgaggtgggcccatttttcctggtttgtcatggtggtggtgagaagctctgtcacataccaggtaaaagattctttattcaggtgttgcgcagaggtctatgcttcaaagattccacatggcatgtttcatgataaaatacctcaggctttcaaaatatgcaatctgtccacatgaaactgctttggatgcttgtaatttcaataatgtgttaaagaa

SEQ ID NO: 636 - DNA, 2172260 bp, Homo sapiens
tttgccataaagtataaaatgttttaatatttatatcttataataaaaccatgacatgtttataaacactctatcaggcatttttacaatggggccacccaccgctgacaactagaaacgcaataaatatgcacagacacactgagtatgaaatatacatcttgattttataatcgtgtgtgctttattttttacacaaatggaatggaagtgttgaatatttacacttaacaggagtgtaagctgtgcagtgtctctgtaaactccagcctaggcaaggagtattcccacctccctcccatcctgtgctacagctcggtggagaaacatcctgtcagagagaagcacaaaactgtcatattgaaaggatctaacgggtacagcctggtgcactcagaagttaagaaacacttaggaaacacaaactcaaaaaggagagaagaaaagtctgccatcccattgggagtcaaccttgccacttggttgtctgtcctcatgagttgctagggagatactatactctttagatgatctttgtctaaattgtccgcctgtcttagctttgtcctcagctgttacaagaaactgcacagctgtacaagaaatgatttccaaagcacaggtttcagtgaggaaggatatttacagacttgagtgtgtgtgtgtgtttccaaccacagtcattcatactcaatgtaacgtgtgtacatggtatacataccatatataccatacatacacagaagtaaaatgtatatcacagaattctgtagggagtcccctggcaagtcagctgtcacaggaggtactccacatgcttcaagggaattgatctttttccctctaggagtaacaaattaatgtgatcaacttaggaattagcctgagtccttggcttaaatatatttgtaggaatttaggcaggaccaagacaggaaagaagagatttcatttcaccagcaagtccattcagtctcaccagagcaatcaccagctgaaaagcagagggggcttcacataaaaatgggaaaaagaaagcttatgaatgggaaaaaaatgtctctctccaaaccaaggtgatggcatggcttcaatgaggaggaagaggtttgctatcagaataattggggccagagtctgcctttattgaaagaaaatgtcctcagagccatgcggtagtgctgggagtgggctcgcttaggagcagtgttcaggcagaggcactcaggcgccggcagggcccacagcacatgcatcatcgctgccagggcaacggtgcaggctggctccgggaggcgggctggagcaggctccaggtcagggcctcacgctcagctttactttctgggctgagtaggtgaaacggcgacctaaagtatttgtgtcattagtccagtgcatggacttgctgtctgaatcagccatgagccctttagaggacagaaaaatcaatacagggatgtacgggagaagatgatcagagatttgaggagaggagaaaggacagaagaggaataagaagggcagagaaacagagactaaaggagaggtggacaaaaagagaaagggaatagagaaggattataggagaaagtcaacaactcagagatggtgggaaggaggaataggaaaaggagaggaacaaaaaaaaaaagagatggaattagtcggaagtagaaggaggaggagagtaaggaaaagaatgagaaaaaaagtagagtctcgagccagaggttggagagttctttcctggctcggagtcctgaagggccggcagtaggatctaagacagcgcacagaggcacccgagtgcagctttgtgaagacaggctctttaagcagacagagccaacccaagaatttggggctgggaaaaaaggcctgcaaataaatagccaagaaatcccgcaaaaggcctgcaaataaatggccgacaattctgtgggaggagagcaaaaaacaaatgcctctgcacttagctgacaaatggaattttgattttggtaaagctgagacccccgtggtgctacacattgtaccagagcatgaaaaatagcaccagttacacgatctggcacttttctgaaagggcccagcatgtgtgaaggtgacattgcacccccagcaagccttcaggttggagagagctctggacaaagtttgcagtgttagcaccagtctggccccaggctccgagtgcatttgcaccagatgtaatctgggtaactttcatgccatttccatacaagtcatcagatttgctgcaaaatacaccagttcattggagccatagagacatcaacattgggaagtgcaagacaacacaacaaatggaggtgtaaattctattggaaaagaccctctcaccaatttgcttggtgattcttcaagcaaatatatatgtatctatatatttatataaatctacataaaaaaatcagtgcaaatgccaattctaatctgaaagcatctacactaggaaaataaatagttatattactacaaaaccaagggttggtggttcaatttgattgtacttagccacagcaacactagtaaatggaaagcacatcacacgacccgcgaaaacatctactcattaatgacagtcttttaaataaatggttgcatgctcagttgagaaaccaaagaagttatcgtggtggcctaaaaatagagctgggatcaggaatggcattctggtgtcagaaaacttctgggagcaatattgatgaaagtaggccttgacctgaaactggcgaattgcagacatggacatatctttaacattttgagcaatctaaggaagtctctggaaatttaactttcatgagagggagaatgcattgctagcccttccattggcaaaggaagcctcaggactatgggaagatgcataattttgcatttctgttttgttttggtgactgtagccaggcagacaatgatgtttagcgtaagatgaacaatgcctgtttttggaaagagactctcattctaagctccgatgttcttactgtgaagaagccccatcactctgatggctctatctcttgctctcctacccagcctacatgctggtttgctgcacagtgtggcagaatccctgccaggtctggatgtaccccagaaataaggcgatggggcttagtctgggcatgcacagaacccagagtagagtggttattatcactgaaaagtctctccccaaacaccatgggcaaaagcaatgctgatgtcgccatccactctaaagtgggaaaccaactcttctagttcagtttataggctttgggaggtttctttttttaaatcatcgttattataattgttaaaaaataaacttggtccaggtgcagctccaagaaaggcagttcagttggttgagctcaaagtcattaattgtctttccttgtgactctatctctttgctctgtacatagaaacaaaaaagtctgcaccccctcacccccaaccagacacttctcttctctctcttcctcaaagaaatagtgcatctaggaacagatctctcattggctctagtaccatctctggatgttacaaaactctcagttactctgtaaaacaaaaaggtactaatcctaattactcattgttggccaaaatgctaaatggtcctttaagaattgtatgtcagtaactaggaacaaagttattcaactatttgcatggcaggctcaggttatttaactagaggaaagcaaaaacttccctttagatcatttgcataagtttgtctctgaaaagccatcagcataaaaaaatgcattaaccaaatgtcttccaaaaatatccatgagggcaactcattaagggatgtgctgcatgagagtgtatcactaatgtggaagggaggtaagtgaggaagaagtctttgtcagacttaaaaggaactcagatgctcttaacagatcattggcaacaaaagggagagtgcaactttcaggtcttgaatttgatcatctgctgatgttgcatacatttagtctttcaatattagtctttacaaaatatttcacaaaacttttttaacctatagaaatttgtttctatacatttaatatatttttattgtataaattattctcatctttagtgccttctttcagtttataaatggcaaaataggcaatcaacaatcataaagctaatcccaggtggaatcccctcctgtcagtgaggttagtcctccatacacttgcaaattttatgaaattcttgtctttgcagatgccagtcaaaaaactacacacttatccttccctgatagtatgtcatctccaaagggattcctttcttttttccttctttctttcatttgcttgttaagaaatcaaaagatgtgcatagttataaaattcaaagtgtaccaattacagatgtgggtaatgggaaggctgatgaggttcgagtgctggcaatttttctttaaagcaaaagacacagagagctctgcagctaaatcagctctggacatctgctggggtgaggaggctctcatctcatctcttgggcagaaagcccgtcagaggttcatccctacacctggcactttgagcaaaccaaagccttccttcatactgcaatgtcttttctgtcccaccctttggcccctctgtttccttcatggcttcatacagtttgtgttgtacattcgtaagaattcacattgactgcaaaaacataaatgcaacaaaaacataaaagcctccaagtagtatgttatatatattttgttcttctaaatgctcttctgtcgttgtcagaggcgcagtagctaatttataacttttcctttgagggaatccagatgaaaggcccagattgctcttcaataacaagcttgcattggttatatatatcttctaaagtatctccttggacaatagctgtaacaaaagcaaacacacccagaattagaaataatttcctggatggtgaagaacaatcatcacttacacattggaggctcaaatcagtagcagatgactcatcaggaagcttcatatcatttttcattagtaagaagaagcagaaaattcatataagcaaagttacattcatgattttaagaaatgctttcaatggatatcctggatcagtaacaaatgattcacagtctttgcactttctacatgtctgtctgtagtactggacaatttatcactcatctatttaaccaatattttatgggtgcctactctgagccaggcactgagctgggcaatgatcaattttcagactgagagctccctatttagaaaagaaaactggccttacagtctgtatatttacttattttggcagcagcagaaattcagatattgtagacaccgaggaaataatgaagattttagagggaagtttagttagcctcccaaccctcaaagcccttaataggaaaacccattaattccccaaatctctggtaacttgagatttttaccatacagagctattcatattgagaataccataagtccactatttataagaaacataaacaggaagaaatataaacaaactgctcagttgtgtatctcctaaaacactaagtcacttggagtagatttaagtacattttattgtctcatttgaacaaaagttatcttgtagaaagatttccaaaacacatcagtattatccatatgacactaggtcttaaaaataaattactactgaaagatgatttagatatttaaaaacaatcctcagaatatattattgtattgtatacaaaatataaaccactgtcaaaatgtacacttttgtttctcctacctggatgttcttttaggatgaaacacagctcgtatcttggttactgacagaaagattacttaatattacctgattcaagatatttacaaactgctaaggcactgacactttctatattctgaataaggtaaaaaataaaacatctaacttcacatatggtaatccaggaagaaagttcttgggttttttttttttttttttttttttttgagacagaatttcacccttgttgcccaggctggagtgcagtagcacgatctcggctcactgcgacctccacctcctgggttcaagtgattctcctgtctcagcctccctagtagctgggattacaggtgcctgccaccacacccagctaattttttgtatttttagtagagacgggggtttcactatgttggccaggctggtctcgaactcctgacctcaggtgatccacccacctcagcctcccaaagtgctgggattagaggcataagcccagctcgaaagttcttgtttttaaacctccgggaaccaggtgtaaggcaaatttcacaaagtctgattactcagtgttctatgaaagtatataggaatacagaactcagaactcaggctctccagaagaaaacctctattccccttcatgtttccaaggaaacatttaaaaagaaaaaaaaagcagttttggttgagacttgacacagtgaactgaaacatgaggaagttttaagcatcttgttcaggtgctgctgatagggacactgatgaaagctcatggagctggggacggacgcctccaagcttcttctcaagagtaactgctttggacactgaccattttgagccctaaaattttgtttttcaagttttctgatgatatcagggagatagtttaatgaggtagcaatgcctcaaatccttttcatggtaggagatagctcaggggtatctcctgcccatggttttgggtagggctggtgggaacctgggagctggctgcagctgaactctcaggagaacccagggttttacatcaaaatgggtgaagcagagggatactccttgtatatgaaacagatattagggattctcaacaggaaggttttagggcacaagtacaccaggcccagaaccctctctgtgccaaatgtcagacaatttatcccctttctcacactaccagggtaaaagtgaacttacctgtaaaatattctccaaattcttgttctagcttaattgctcgatcataggttttcttggcttgttcctctgttagacgcttattcatctccctgggaaaatgagggtttgtattagaacataaagggaatattccaaatcctaaaaaattaaaatgtatggcaaaaataaatcctacagaaaacatagtgtaatcttagcaacaggtttttagtcttcattcaggactcctctgtgctggaataatttcagcaacaaggactcacggccagaaagctcattctctcaaagggcagtctcttggtcccacattggattgaagccaaatatgtctccttatgatttgtagtcactggtccctgttctgcagggacctaatatcctccatggtaggccctaggatatttaagtaaagtgcttaagtgtgtcttgaggcttctacttcttcagaataaactgtcctattgcttcatctatcccctcattggatgtgatttctaaatctgaactttcctgaccaccctttcttggagtttgttctagtgtatctcagactttctgaaatgtgagagtagaatggtagttatcagagactgggaagggaaggcaggaggggagatgaagagaagctggttaaggggtataaaatgcagttataggaatatttcaaaatagctagaagagaagaactgtaatgttcccaaaacatttctggtgatggatattccagttaccctgatttgatcattacacattgtatacaggtattaaaatatgacatatactccaaaaatttgtacaactattatatataaattttttttaaaaggctcaaggataaatcaaggtgggagagaaatgaaaaattcttgaattctctctaaaacctaatctattgattcttaactactggcagctttatctttccgggtcttccaggtgttaaaaaaaaaatgtcctgccaaatgcaatttggttggctgatcaggatgcatcacaggtgcatgtagaatttctgaaatcattaccgtcttgcatgctgcttaggaagccagagatttgggtctggaacatctggccttagtcaattcctttcgagagcaagtaacagaggcaagaagggatgtgcttaaggctgtgtatttaacgaagagtaatctggggtaagaactcaaggttttggttttttaaaccaattttcagttagacttcctattataccaagacttgatatctttcaaaagaggctatttggaaaaaaaaaaaacaatatattgacattagacattaatggctgaaatacaaagtagtgagaatttcctgaactcttgttgctaaactcatcttgtcctgaggggtgttatgtataatttttcttccaaacagtctcagctgtacatgctgtgaatggatgttactcgtgggtggagaagatgctgggctaaaccaagggacactcttcagagaaagataaatatttgctccagatgtcaagaaatcatgtgggccaggcacagtggttcacgtctgtaatcccaacaccttgggaggctgaggcaggtggatcacttgtgctcaggagttcaagaccagcctgggcaacagggtgaaaccctgtctccacaaaaaaaatacaaacattagctgggtatggtggcacatacctttagtcccagctacttgggaggctgaggtgggaacatggcttgagcccacgaggtcatgactgcagtgagccatgatggcaccactacactccagcttgggctggacagagcaagaccctgtctcaaagaaagaaatcacatagttctggatcatcttcgacctgccttccaagaattctgtcttctctgaattccctttttactgattacagcaatgacttagtttaggtttttattctctgacctgtgaatttattttgtctccttgactgatcagtaattctttgagggcgaagaccatggcttgtttgtcagcatgtggcatggagactgattcaacatttatttgttgaatgaatagatgagtaaatgaatgaatgaatgaacaaatggggagctagataaacataattataagatagttgaagacagaagtaaacacagagcatcatgggagcaggaaggtaaaagcagattggaagtggcagggtgaagggagattgccacatggaaagggaacagaagtcagatggtggcacaatataaaaagaacatccctttcatacacatctttgattttatgctcctctgaagagtcagctatgtatgtgctaataagctctgtgatttgatgtggatgatgcacttgagaaataatgtgtgtgatgatgtatcaatgtgtaaatgtgacagctgtcatgcttttgttccggctgacctagcattcactactctctggggaatgggcaattcatggcagctttgctcctggagtaaaagccttggaaaagagtgaactgtaaagtaaacatccaacctttagtaggtagattgcattggtctgaatgtcaccatcactgcacttgagacccatgaatatggctgcagcaaattatgtcagattcactgtccttattgtgaagtccagcctttagtacatttaactttccttggtgataagtggctgtgacagtgccctaaggcataactaaaataagtcatctcatagttgtggaaggcagtagaccttctcctatggaatgccagatgggactgtctcctaatattgcaccggaccaaatgtgccactgctgtcgttccctcaggcctcattcccctgggaagccatttatcccactgagtgtttacaatatgaagatttatttttctatttctgaaacaggcctttaagatggctgttcccaggaagtaaggactatttttcttctcattaatgttagcattacttatatttatgaggctcttgacagattataaatcaattttacatcatgaaatttgtacttgcttaattcactttgtgcaatgcccgacatagtatcctatacaaggagaaatttaatacatgctattggggatgataatattaagaatcattattttatcattagtacatatttttccatgtgccagccatgggaaaaactctttatattataatttaatacctaaattcatggggctgaaggtactgtcagtgacctcccgatcttactttttttatcctggtaagaatccttgtccattttttatatatgggactatattctgctttcaaggtacatctctggctatttccccagagctcaactatgtatttaacttaattctctcaggctgccactccagctgctgcagtttgctttgcttctttgtcttcagaggagacacagaacagttaatatcctctgtaagcaattgctttcaccactgggattaaataatttctgtttcttcggtccttccataaacattattttccagtactctgtggttcactcctgaaccctgtcaaacactatggtcttgaggcccagatgaaggcaaaatttgatcaaggccctcatgacagacacattggcattatctcttgcactgtcatggaagaggtactgtttatgtgttttataatgataaaatagttttattcctttataatgaagtaattttatatcttttacaataataataggtattatttattgagtacttaccatatgccaaagagtacatgaacagctttactaaattcctaatcttgttatttaacctttatactagctctatgaggtatttattagtatgcctcgtttcgaggtgaggagctaaatcttagaaaggtcaagcaatttgcccaaggttacttaactgatcagtggcaaagtaaagaaccaaatcttgcctgatcaattttcaggtccctgctggtagccccttttctggttacctctatctactgtagcttcacctttgtgaatgggagttgcctatactgactttacagtcagatcgtgaatgtctgcccactttgtttaatgattcttgaaagaagttatttcacaagtcctttggaggggaaaaaaaaagaaaaaaccctgagtgcacaggtatgaagctactggtttaagttacagatgttttactgccacgccactaagaaaactctattaagaacgatgttctatgtatgtaaagttttaattaaggaacatcagaattctattagagaaccaaggaaaatgccaatgaaaaaagtctcaaacgttgtctgctctctctataaaaaatctacacatttaaaaagatttacttatagacctgcctcagaagtatgagacaattaaaaaatgattgcttcctatcatttggaaaacaaaagcaaaccaaaaaaccaaatcaagccaagctatcctcaaaacaacaacaacaaaacctcaaaaactaacaaagaaaacaatccgtgaagtaaaacaataaaaatcaggaaacattattgaagatgttttaaggaattactattattgttaaaatgagggatgttaaaaaaagaaatcactgacattatgtttctagttgtttaaaagaactttgatatatcttcaaaaaaagagaatgctgaaaaatcaacaatggcatttcccatttgtaagcattcccagcaaaatcctgttagtaattttcagtataatacagaacagggagtcagttggatgaaggcctccaatgccctctactcacataagaggttccagagacctgggttttatgaagatggcaatgggatagagctgggcaacttgtaaccgcttgatagcatttcctgatacatcaagtatacagtgtttgccctggtagaaagagaagaaaaatatgaagttaatataggaagcatggccataatccaacaaaaggaaactaatgtatgtaggttttagaggaaggtaggggatgctggatttctaaagtcagaaaaagatcactgcaaagagtaaataaaaatcgatatatagggtcatcattgagtgtttacaataactaatactaactagccccttacaaagtgtctgctactggactggacattttacatatgttctctcagttaaatacctgatgtaacacacaaagatgacatgcagccgtatgttatgtgactgagtctgttctcatgaagtttaaaaaccatctctgaacacaattgtcagaagaaattcccaaatctctgaggtaggtattatcagctgcattttacagaagactcacactaactaacttgcccaatagtttagtgctaggagcatgcaaacccaagtctggagcactaacagaattgttggttggaaaaaatagacacctcattgtctcaccctgcccaacattcggtgtggaagattgagaataatgtgaatttttccaagtacttgtacatatcctgtctgcaaggtactcagtctagtggagggcagacacaaaaatggttaacttaaacatatggttggttgggtgcagtggctcatggctgtaatcctagcactctaggaggccgaggcgggtggatcacctgagatcaggagttcgagaccagcctgaccaaaatggtgagaccctgtctctgctaaaaatccaaaaagttcaccaggcatggtggtgggcacctgtaatcccagctacttgagaggctgaggcaggagaatcacttgaacccaggaggtggaggttgcagtgagctgagaccgtgccatggcattccagcctgggcaataagagtgaaatgccatctcaaaaaaaataaaaactatatgtatatatatatatatatatatatatatatatatatatatacacacacacatataaaatatataattaaaacatatatatatatatatatataaattaaatgcgggttaaatgccaagagagaaaggcttgcatgaggtatgtaaatttcttgtttgttaacaaataaaaatgctattacattatagcacacctcatttaacttggcttccaccacaatgagtgctcagagcaagcagctgctttataaagcatttctggatatgcagatacatttgccacatcatattctacctcctggagagaaatgtcctcattaccctgaggctagaataactttatgcaagaagagaaaaaaggcactttatgcagataggaacaatactaaatcaataataagggctaaaatctcatctataatgttcacatgaaaatgaatacagtccagtgaatacttgaagtcttcttatctgagaaacccactaagatggttcaagccgttattacttaggtaatagatttcaagttttctatctgtgaagtgcagcagccacataacatgtataaatgctggttgattattcaccagtcagaacatttcaagttaacaacatgaacaaagaggaaaataggtgcaattatccaggacagtttgactagaaccagtattcatttagttgatagaactgaacttttgagagggaggaaaatagatgcaacttcttagtgtattcttagatagacatcaaaattacttaattctttagcggtacattgagaaaggtcatggcaaatcaaatcaacccaacaaatatcttctcctatgatactggttctctgtgttcacaggaaataggatccctctgtaggcagattgtgtagccacacccaggtgccttcctatggtaccctctcttgaacattcttctcttttccatgcccctgaagttaccagcaaaaagataatagcagcatctacacctcctctaagctagaacttctgcgagcaaaaggctgggcagcccttctcatctatcttctcttctaccatgaggatgtcaagttttcagagagagagaaaaaaaataacttcctctaacaaaataattcaggaatgctatccccttggtttacaactaaagtagtaaacctgccttaataaaatcaaggttgtgtattggggcctcagatagtgagtcaaagacaaagccctcttcctactttttccaagtcagtgagaatactttattgaaattagaacaaagattaatgacattgctctaaggtgattctctgcttggatgttttaaattattaaatcaaaatttacaattgcaatcaagaaagagtaatgaccaaaaaaaaaaaaaaatgcagtttgcaacctagaaaccttcttcaggggaggtgtaagaagattggtgaacatactctttctgctacaaatctcacagactgcacactggttccatataaattgtcattgtactggccggcttctataaacttgtgctcttggatatctttctccatttgttctctggaaatgacaaagtgatagtctctgccatccacctcgtagtctcgctttggcctcgtagtatctttataaaacaaaaaatgataaaattaaggtgcatttatacccataaacttgctttacacctatattctccaccacatcctcaacattgatatgtagaaatatgtagtatgaagaaatatgacatagtaacaggtactagtcttaccctcccaccataagcaactaaaaaactggacaaaatatatgaaacaactgttttcagatatcagacaacaggaagtacagggctgtaatctttgagaaaagagaaacatatgagagagcattcaccccacctctctacctagaggccatttccaaatggagagtttagacatcacatggtgctagaagacacgggagttgagtcagaacccatggagatcccagaaaggccacattttaaaaggttactctagacttactctacacccatcttcacaaagtctaaaaccatgtcacaaatggaagaagctgctgtgtcagtaaattatcacctgtcagaacaaaaacttaacattctataaaggaccataaaattcagactctcaacatatataaaataagataatcacagttagataggactaaaaatcagcaactctaaccatttcacctaaattttttggtaagaagagaaggggaaagcaatctagcaatatgaataaaagctgttaaaatatttttaatctttgactcacttattttttcctagaaatatgtttttaaaaatgatcaaaacttcagatacagatttatccttaaagatattcattatattattttataagtaataattataacacaattacgatgatatttttgtcacaattcataatagtgaaaaatagggaaaaaccaaaatgttcataaagaatgattaattgggatataataatcatttgaaatagttatataaaattttaaataagcaaaaaaatcatcacagagaaaaaatgcatgcatagaaagaatagatggaaatgtacaaaaatattaacaatgatgttatctctgggtattgtgtgggattttgtatacttctaattttctcgtttaactttctttttagtgtttttgaagttttgtacaatgaacatctattgactatcacaaaatggttctattaattcaaaaaagagagaatatgcaaggtgaaagggaaagcagaaagaatgcttaagtaccttctgttttctttctctcaaaagtggaggagcaagctggaagcttgctgtaaacgacctggagtttcatttgctccttcctgtctgaagactttctcaggatatgttctatggcaggatctcttcccagagcccttgctgggaattgtttcatgagatacagcaatcatcctagtcttttggccatgtactggacacatacaattcctgctattcttaagtatctcatgtaaaatttgcagtactggaatgttagagacacttgaaagcatcaggcttaaaacacatagaatggaagagaaatatttgttggtatcagatgtaagagctccattatctaataaattaaaatttcctgatggacctgtctacatacgtagaaggtctgcatgcatttctgtttgacagagtcggggtgtagacggggtgaatgagtggagaaagtatggtaggggtggggaggggaagaggcagagcagttagaatctaataaggctacaatcagagggaccagaagcctgatgataatctataatgagaagaaagtagtttaaagtctgtaatggcctagaggtcaaattgaagtgttacacattttcttgtcttcaccctccctaaacctgggactgtcaacatgggaaagcctattgggttttgggattgacatatggccctaagtcatcctgagaggattttaatatatggctttgtttccgatctcttccatcctataaaaaataatgtttcagtggcattttgatcaatctatgaaaacatactgatgcctatcataaatcctatgctgttttaaatggttgggggccacaaaaattcatcctgccttttaaggggctacaatcagtttagagaaaacattattatttttattaaatacagaatgacacacggcagcataaatgaaaagtgttaggcaaataaattaaataaggcactcagctaatcggaaatggttggtatttgaattactggagagactactggaggatggaattacattttaccatctcataaagaaatccaagctctttttgtttttcctagaggaaagaaaaatgacacttacgaggcacacaggagccaaatttatcagggaattcagatatcaagtcgtcattgatccgatccttcatgggccccaggataatcaccggccgggtgtagtttactgcagaatgggaaaggaagatgtaggtaaagagaaagagttggaaacaactgcaaaactgtcctgcaagggtgattcttaattgccagacagtaagagatgctaagggcattacttcactggataaattactcatacagccttgcatagggaaattgatgtttaacactcaggagattggcagtgcctactttctggaatctactagcagggaaaggcaattgcagtatctgttgatgaaaagaaacatttggaggagttttgcttactctctggctctgcctacataatgtcaaaacaactgaatttagtcaactgagtgggagaaaaaagaatccaaaccagctgtttggctattgtttagatatgactataaaaagtaattgttagtagtaataacatcttatgttttcatgatttcttttccccagatcaaaatactctctatactttgctacagtttctagatttccttgtatctgggattagaaggaacctgagagttcattgggtacaagtccccatctgatgcttgaattctctctgcagtatccttgtcagtagcaattagcctctgtataaatgcctccaggaaaaagcagcagcttacagatagcctacatcttaggcagatctgctagaaagtcattctcaatactgagctgacatcagtctctcaggagaatttattcaccagtctcgtagctagtgctctttaggtaatttgaatgtgttccttcccattgaggaccactcatctggagggctgcatccttctcttaggtgctattagtgcccatactcagcaggaagttgtctgtttggtgatagggtcaaagagagagaaagtgagagacagcgtaagagtaaggtacggtctcaagacaacagagcattaagccgagtttattctccttagtccttcactctttccctccttcaatgatgtcacctcttatggcccagaaattaggaatgaaagcgtgctgggaaacttactttcctgccttgtaacaggctcataggaaagaatgaggtcttcttgtcctcctgagaagagaaggaaagaaaaccacagtgaactaacagtcatatattacagagacaagccctgctctgaaacacaggaaacagacacagctcagagttaattctccttgctctttctccttgaaccattcaaaaataacttcatcctcataaaactctttagcaccattttagtatcagattttcacagtcataactctaagtaataactggttgctagctatttgctgcagggcaatgacctgtgagacttctttctgtctggcattgagaatggaatgccatggcctctacaccaagcattactacttaaaaggaagccatttagttcaaggaaagggtccaattcaatagatggctgctacataatcagaattgctgtaccttttatttcatcttctattttatttccccaagaagcacactgttcaaaagcaagtatatgcttatttcatttatgatataaaaacttcatcaggacactcagggttttactctaatattaattcgtcaggaaaatgctgtgggtcaattaatgaagatcaaaaattgaggtgtgtcctacatcattggttataattgctgctaaactgtgcgttgaaacttcagatagagaactaaggaagacacagtagtaaaatgtcagcccctccaatgtcatctgctacaagccttctgactcagggtggacctcaagtcaacaaataaccatagaaagtaaattggtttttgccatttattttttcaatcatctattttatataattgatgaattaattggtcagaggattagctcaatttcacctgcaaacccggaagtgtctgcatttttttttgcattgactaacctttggaacagcaataggttagggctgttgaaaagaactttctgtctactagaagaaatagtggagcagaagtggaatatgaggtaacttctgaaaccaaagggcaattcacctttgctgtatatcctcaccacccacccctgaagcacattcatagtctatcaatgccaggttttcctccttcaacagccacagcaccacagaaagagaggtaatttcataagaagagttaatatgatcgactgttttgataatgagactgatttggggaaattgagcaatatgtgggtatagctgcgaagttggatgacttccttggaggctgggtagctggaatgggatggggataggagtgtcttactttttcaagtgtgagaaatggcctcaggctgaagtcatatcttatctcagtcccaaggagggcctgggctcagaatggcgccaccatgccaagctacttcttaagggtacagagagtggaccttgatgctcctcctaagtggtatgtacccatggccaccccagaagtgttcaggggactctgccacattggtcaggggtttggtcagtgaggagtcagattcactatttcttgtactcaggaaaagaatgattccctttgaataaactactgaaatgtacagagcctaggccaaaaaacatgaaggtgattgattactaacccccagttatctaaagcctgagcgatgtagagggtatacgcattcaaggttttagtttagtattacttcatcaggaaaatgctgtgggtcaattaaagaagtgtaaaaattcttggggagaaagtatagttttaatgatagaagcatcgtagactaacattgcaattttagactataactttacaggggaaatcttcaacaattaatgtgcaagggaagaattctgaccatgggataacaaaagctttaaatgtcaggtaactcttggacctccttattaggctgggagtttcataaaggcgagaactgagttttattcatcaccatgtctccagtgccccattgagtgcttaacataaagaaagatgtcaacaaatttgcattctgatttcagtcatgggaaacaggatgagtgatgaggccaacggtaggttctattttgtgtttctgtcaatatggtcatttaactttggaaagcatcgttttctctaaataaatagagcacatcaagttcccataaaaatctcttcccaatggctttgcaaatcattctgatggaacgttctaaaggcaaatctttaataagatatttgatgtcagtgtgtatgattgcgattcagacaactagggcaaagcatagctttgattaattttgttcaagagttctctatctctgtctatccatcacttcttggtttacttttctatgaaaggcactggttctggttctggttcagagcagtagtgttggtagacagcaatggcagcatcccttatgtccgggccaccccaattctcaagaccttgtggcaatcaggtactgtgtaatacccaggaagcctgtggggaaacccgtggaggtgggcatgacataattgctgtgaattcagcatcttaaactaatttttacttccatgtccaagaatgaaaagccctatgggtaatgaggaagagacaaagggaaagagaaaaagccactgtgatgaaggagagaaaattcatgtctttgtggcactttgcgggccttgaggggctttcatacccactggcttttatgtctcacaggcattgcttgaggtaggtactctgatgatccccattttacagatgaagaagctgaggctcagagatgttaatgagccctgattcctcagctagtaagtagtggagtcaagatttaatactgcacctttttcaactcttgtggagtatattgcactgtcttgaaacagtgagagaagcagaattctctgtggggcagggtgggtgggtgttgaggtaaagctaacaaatgaagaaaaaattgaagagagagataggggctgaaaccaggtcggggttattaagaggccatcagatactctgcctctaaacacaagttctctctcttttcttttctctcttctttttttcttttcttttcttttctctctctttctttctttgtttctttttcttttgctgttgtgtcatccccataaaatagtcatccttaagagtttttctattttctgctcaggaggggttggcacttcaaaataacagctgacaaaaaggtacaaactatttcttggttttgttttggcaactgtatggctgaaagtgggagagcagcacagagctgtgtgtggatgtcagcagctgccagagacttcgcagagggttttgtcacagtcgccacaaaacactatgtgtttaaactggaagccagtcacaatgagagaccctagtaacctttatgctagagaaaagcaaattgccattctttaggaattcctggaaactagaaaacagagatgatggagttgaagaccagtggcagtacgtttaatgctcaaaattttgtttttagtgcctgcatatgatgatttttaagaactaattaggttcttagagtcatagaatgctagtgctaagaaagggcttagggttcatgtgcttcatagatggcaagtacataccacacactattactctctgtgatcttgacaggcatcacaaactgatcattgccgggattactgctgagcctcaacatggccttagaatacttttcattacaactcttcaggcagctactgccaattggttcgagtttgaaccttgattaaaatttatttgccatttctattctaattcaagctactcattttacataggagagaactgagtctcaaagactttaagtaatttgtttaaggtcatatagtaaattcatggcaaattgtctccataggatgttcagaagatgaacttaatatacgtacagtccttaaaatcagacttggtgcataatgttatataaatgttgttgtttgtattaactttataggtagtatgaaatggttgaaagttactaggtaaaatgtcaggcttggattacaaactacagggaagagtgaaaaatgaatgggattcagaattaagaggtcttggttggatttgcagtgccactactttaataaggcaggcagcctcttggagcttcggcttcctcatatggaaatggggctattaatgtaaaacatgtctaataaatagttttgttgcagaaattaaatgagataatagatgtaatgaaaaactgctttataaagactaaaggagtaaagacatctaagggcaatagttgagaataatagagtaaggtgaagaatatgcaccattttgactgactccagtggagaagttttgggtctcctgatctcaacacgttagtttcactcagattagttcttcaagatccttgttttgaaaatcctacttaactggtgagcactaatgggttggaaggataattatcagcttgcacacatccatgatgatgtaaagagctttactgagctttgaggaaggcatgtcttcagctttagaagcttgcatagtcctcaatatacttgcctagtatttaccacctcctaatacatgggtgactgtaaggtattatacagaacagccaaaaatacaaggctgaattttactactttattgacataaatctagaattagcctataattaagatagttttgaggtggtgttttgcacaattagacaatgtacactttatcagctgcaattttagctggtgctaaatatagttggaaaacctattttataatgcttgagatgatgcagcaaagatctgaactatttattagaaattgatgtttgtgtgtatctatgtgtgtgtggcctacctcaggaaacatgtaagactttgaagtaaggttgccacgatgtgtaactccaggatacagtgtgaatggtgtactccagactgtgaaacacaatggattgtgaaacacaagggcctaggtctttgtttctaactctgaattattacaattatttagccattttgttcccagagtggatatggaatggtaaagtataacagtgaaatacaacacctggatattggtgaaaagaggggtttttttttgtatttgtttatactatttttagtcataattacagcaaaagccaggaatgcactagaaaaatgcagcctattttgacttcaaagttggtacctcctggaaaatatatttgttccaaacctgtgtgtcttttttcatggcagtgctctttctgggaagttccttcctcatcttgcctagctagcaagttcctcatctttccaaagctcagctcaaagctacttcctctctgaaactacctcttatgctcccactattcttgagccagacatcaatctatcttagtacctgtcacactttgtgcactttttcatttatttatatctctctcctactattatgtgtgctgagatctagagttagttgatattcacaatgggtctcatggtatccaagaagaggacctcatgtatagtaggtaccgaatgaataaataaacattcctctggaattcttcatatttccattctggaggaatacatgtcatttttctcctctgagctgtgataaagactcttcttacttttgttcatttgtaaagaaaacaaactgagtggctggccttctgtaaccttggatgagactcaagccaatagagataattagattccatatttgccctactaatgtcatagaatccagttccaactcttctctcttctcatagataatttgagatgcctgcaagtgtttcctttattcattcaataaacatttatgtgcaactagtatttagagtaaaaataattattgatgtcatcttagaacatcactctaaaaatctgccaagtagttgaaagtcttgggccagtttttataacttaataattctgggaaaaatattcccacctctgaaacagagaagagaagcctttaaaatactctataaaaatgtgatttttataagaaaaggtagttcttgtatagtatatattttccattaaaagaactgaaagataaagcatgatgctttctttttcgatacctgtgtctactggatggaagcacaacacttgaaaattgaaaactgaacatcaaggaaactagtgtcattggtcttcctggaacccagaaaataagttatatttttctacgtactaaattgagggcagcttaggtgttattaacacaagctttggtcaattcttcttggcttagtttcttggtttaaaataaaatgaaaaaggggagaggcaaattttttttctgaaattaggataataataaaattataaaagtataaagaatgtaaaaatgttgacatgttaccgtgttgataacaagaaccttctgaattcttccatcaacaagaattgatggaatttcttctatcaatcaatcaataaaactttcatcaataagaaaattaggtggttcctatatcaatctaacgtttgattgaccaagggtatctcattacaattttcttcattttattccttggtctacatcttccttctctgagcctacctccatctgccatctttccacttttgtgctgctgctcctacttgccacccctctgattttccaaagcctttcttaaaaatccaaattatgtgttgtaccactgtttggccttccacctcaaaaaggcatggttttgtaaagtaccatgctataacgggggggggaaaacctcaaacaattctagttttcaattaatacaatactcattcaaacaaaagacaacaccaatttctgccttagcatctgtgggtcacaggtattaggcgtgctttttgggtaacccatttcactaaggaatataaattaatctcatagaaatcataagaatcctagtaaaaatatgtatctatgttagtcaccaaaaaccagtaagtaagtaggtggtaaaaaaccatgaggactgatcaaaaggatgtgatcggtgtttggtggatagtttcatacactaagcaaatggcttgaggtgaccaaacaaagaccagaaataacttttaaatagttacctaccttttcagctaagttttctgatctaagaagacttggtcacatttaaaaaaattaagttccttcaacattagaggatgaaactcttccatcagttccccaattatcaaaaaagtaaagttagaaatgtcatagtatcctatcttaaaagattaatcaaagagaaagtgatgtaaaagattcaaacctgattttaaaggaacactttatttataaatgcttttcctataaaggggagccaagaacagaaaggaaatggcaaaataagaaggaaaacaataccatgatgattttccacctcctgctgagagtttcaattattttgggggttacaatgtaaaaatccaccacgttgaactttttacacaccttctctgtgagaattgaatcactgagtcacaaccaactgaggttggaattgtttattagcaagaccactactacttgcacaaatcacataagggtgcactgatggctctagtgtcttttttatctttccacatccagtgatttcatttcaagccatttgctttgaatacagatgataaaaggtagcaattgaaaaacaacaacagaaatctgaaatgaccaccacaggcaatggggcaattgcaaagaaaataaccgcaaaccaaagcagtaacttacggtagctactttcgctatcgctggcattagaagaaacatgttctgcaagaacagcacagcaaattaaagagataccaagcattgaagagcagccagaacggaaaggaatacactcatgcaaggctaccagaaatgtgagcgaaaggcaagtaaaagccgcagaggaggctgcattaagaaaactcagataagataaagaagatgaaaactttatctccattttacaggaacccgctgcttgattgctgtttcttctttttagcaaatgaagaaagtatctttaattacaaaaaatgcataatgtcaatttaggcgattagaaaaatactatgacccattcatatacctctgactttcaagatttatgtgacaatgactagtatgtcttgactgagtgttttcttgactataaattcagacgcttctggtgtgtaggcagtgttttcttgcaggcttttttatttctcaattttagcctttaagaattttgctggaacgctgctcaaattgctaattgatccctggaatcccttgaattttatttctatttaaatagttcctaaacacattctcaggatgaaaaggaattcttgaagatcttttctgcttcagtgagtgagttgaaaatctttgaggaagatgtgagtcactgaataatattttacgaatcagctcaatagttccttgtttttattttaggattcttgcttggatagctattgaatactagtggcatggaacaggcaggagataaatggcctgatacacggtacaggttctggctgaagtatgttttttttaaattcatgctgaatgacttgcttgcacagcaatactccaaattgttttttcatacatagttcacctaacttaacagggatgtgttggttatatgccagaatttgagctcttatttctaaaatcattttcgctcatccatactgcttgttaagttatagatgatacactcatcagtctatgaacttatttgtatattactttaattaaatgaagaacatgtgactatttgatttctgaagctcactataaataacatcagttttttaaaaagtgacaatagttatacatttttagaaagagaaaaataatatataaaattattctctaacaataaaaaagtgctttgatatcatacattcttgccaattggatagagtagttttaaagcatgaaactaatgaaaaccaaagcatgggttaaattcacacaaatcatttctctttgtgttggtctgtgatcagaactgcattactaatttgggcacatgttttgcaagtgcaaagaggcaatagggaaagaagtgtggatgaacctgtgcaaatctgttttctgttactaaaatgaaagtcaaggcacataatcaataatagtgcatttcatggagattattatcttaagtgccttgaattgggtaagacagggctttttgttgttgttgcgaagttttactttttaaatttgttcaatttttaaagagcaaacaaacatttgcatattctggattgaaatggtgtcctatttctgacactccaaaagccactactttttagtgatatttattattaacaatatattaagatgtttcttttccctctcaaattgaaagtttacaaattctctctggtggtgcttgatgctgtccagataatgctgaaatcaatatttaaacttcagccactaattcaggaaaaattttctatcatattccatatagtaactcaaaaataaagttttcatctttaagatcagtactcttgatcagatttttaaaaatataaatatcttttaaaaactctccaaatgaacaatttgaattatgaggagtatcaatactcagggttatagaaagagcccttgaaaacaaagtccagttcaatgcaattttgttttatacaaataaacagcttctaaaaatattgcccatagctgttaatttaaaacaacaaaacaaaaaaaattaaacatgtgatacagttgcaaaagacacaaaactctgttctcatttcattggtgcctacacaatggggttagttattaaagaggaaaaatcataatgtagtatattaagacacaggataattattttttagttgcttagtgcaatcagatacagactaaatacatgaacaattagaaaatgtaaaggcttaatatattttctttttcactctatgctataaagtgaagacctgattttataatgtagctaataaatcactgataggcatattattacatatccaaactttaaacatttcaagcaggatcaccgcaagtcagaaaaaaaaatcaaagttaataacaaataaataaatactcatggaatctccagtagcttaaaatttgcttttagagaatgcatgttccttttgactacgaaacagctcctttactaacagcaaagtgcaacccaattatgagatttgacaaggtcattaaatatttccatgtgaaaaggcagaagaaagaacataaagtacatttctgttttgctgttctagaacacttagctcaccctttctttcaacatggtttcttgctctatggaggtattaagcggcagagcaagtgatgctatggtgggcatcaggaccatgttgataatatcacatggtcagaaagggatggtgttaactgcaacagaagttagagtgcctgatacattttgcttttaaatgctgacatgcagaacaaaacgatcgaaagttactttgtaggagcattcacagctaggtaacaaataaaactcgtatcttgtgcatgctaggagtgaaaggccctcaggaaaaggaacaaaagccaaactcaaaaggaaaggaaaagaaaagaaaagttacagtgaccattcctggaaacttactcagagtctttgttccataaccgtcgtcacctaatccggggatgtcctgcatggaagtccccagagagagcaatgagagaggaagaacagccacggaagaggaaggaagaagtcagtggagttgaaatgaatactaccatgacagaccgtgctgccttaacaatctggatcccattctctcttcttttaaaaaaactttcaccccaaactccttgagctgagattcaagaaggaaatttctgatttgcagagcaactcaaggtttaaacaaaagattgtaagaaaaaaaaattcagcaaatgccaattttttgaccatggtcaatcacgttgccacagaaatgtcccacttaaggaataaacttctccaaatttcatagcaaattctaaatgatatccaccattacaagctcagtgctcagaaagtgtttagtgttttgggggagggaaagagtgagcaaatgtgctagtttatctttaaatcaataaagataatttaattgttcctaacattccaaaaaacatatgtggcaatggaatccaatatttcttctcagaaaataatttgtctcaagacttagagggttgcatgatagaaaaggcaaaccggacccagtcctggtcaaagataaatgttggttgggtgcaagtcccagttttggcaagtctctctccaatgccttctgcaaagaagagccatgtgaaaggagggatccagactgtagtcagacgctggtcacagtagtagacctgccctgcctgcctgctgtgttgtttgcctaggtgtgtggcgtgggagagcctacatcctgcgtgttgcctgtgaattttttttctcttatgttgcatgtgacattatctttcagaatctacttacgttcaggatcactggtttcctgctcactctgctccttgttcttgtagaatgggaattttcgtgaaaagatgaagctctttttacgcttgtcattgaatgactgtgaaggagaaaaggcatggggcaaaaacaggggacgtctaattgttgtcacactcatgctgacaaaacaactagtttgtaaaagcacagagagctgtagtgacgcaagtggataattctaaagtggtgccagagagttctaaaggtcgattttattttcaaggagtataaattctgaatggtggcaccttggaaaaattgtctcctaagcaaaagactggttacagataaatggtgatggagggaaagagtcttaaattagaaggagaagacccagaattttttgaattttttgtgctggctctacgtcttgctagttcatcaccttagaaagggaattgaatgtctctgaacctcagtatgttcatctgcaaaatgaggacaatgatagcagctcttacgttgtgagactcacaaaagacaatgtaaacataaagtgctatacaaatgtcttatcaccatcaggtagaaaacgctttattggagaaactggttttcttcttagtgtcttgatgtcttttaaaataatttgaatttgagttacttctgtttagttttaattaaattaaaactgcacaaagaagtatgtagatttatggtataattacagactgacacatgaatatataatcattagaatacaacatttttattcaaaagagatttttaacaataattaacaataatttagccccaagccctcattttatagacagggagccagaggcacagagaagttgtgtcctatactgctatcacagagctagttggtgacagccatgaggcaatcaaccaaaatctgttaaaattgctgctaaaggggtattaacttgatattaacttaacttatcaaaggaaaaatggcagtcactctagattctgatcaggtaaaaaaagtaagaatgactgtctttaaaaattttaactaaactattccattagcttaaatgaggctgaattaaaaataacacatagatacataatacgatacaggcattagaatttattcattcaagtggatatcatgtgcttacctagaagactccctaaggaaattccattaattccactgctgctgttcttatgcaaatgttttgtggggtttctctttgggaaatgtgttgacagtcattttataagttattggccatgcaggtcttactaatttcatattcatatatcattaaaaaatatgtttcatcagattgactactacccttgtttggctgatttggctctgagggtctttcagctgctgaaaaaattaaaatcactccccaaggatcaagatttgttaccacacggctattgaaatgaaggtgccaaagactctgaaggcaatttgaaaacaggtattcaaaaacatttttggcaatggaagctgttaagaataaatgtagagcagcaaggtgacccttagaaggaaaggacacctgtttggatgtgcgcttttgtcccattgctgggaatgagtcctgtgcccttatggatttgaagcttgacaaaatggtataaataacttatcttctttgtatactcatacattcccatatcaaatatccattttggtaaccatgttcatttaggaaacattaaagtactgaaatgttggtgctgtcactcggtaagtaattcattacttttttaggtagtagaaactttcagcaaagtagtagagctcaattgtatgcccattaataaggttttatgaaaaataatgaaccaaataattaataatttctgaaattaggggacatatactttacattcaagtactaaaattacattctcagagggaaaagaggtatcacttcagaatttattactctgctgacagcacctatgttcaatatagttttatcatcaattgtaatttagggttggtgtccaaaaacaaggttgagaactgcccccaaattttcctagttaaaaatgatagtccttaaaagaatactaaatattcttgcatcactccagtttcatgccacttttacatttcaagcatatttaaactccagtaactgaaaataaaagaaaaaaaatcatgtaagaattaatggcatgtgatactgcaaggtatgttagacatttaacttcaacatcaccaatgacttgtcatgcaaaaaaaaaaaattacacattttcatgcaaatacaaaacaatgccaagaggagtaaagcctggggtgaaaatgtagacagagagggacaatgcagaaggctttgagggcccaaaatggggctgcatgcaagccacatcatttaaatggtctcaagggtcaaaggaatatgaaaatgtgttatctgtgattaattcttttatgtttcaaagcaaggactataatgtgttaacatttcccaagtatgaaaatgttgtgtatcatgaatcatctgattgggacataatactactaagcatcacactttacaaaagaacagaaaatacacactaatactttaagaataaaagtatctaacatgtcagtcttattagcaaaagccatttcagattggaattaaagagaagggaatggaagtattggtggttacatttccttacatttgtggacaaaaaaaccaaatcacaatttcagttcacattcacagacttaaaagtcacatgtttaggatcttagctaaacatttcaactataagagagactatatgtggtttataatgctttaacagtattctttattttttattagacatgtgtaataccattatataagcttttttgctgctgtaattttttttcttttaatatagaaaatgaaaatctgttacacgagtgctaggtgagaataataaattagcaattctgctattatttgtagaacacattgttctgaagcaactgatggctgatttacagccctattctcaattatacttgatcaatgatattctttgtctctctagtgacagtatcttagctctagatccattgctttcatagcaggaaacatctttaaatagacactttgaaaataccaatcaaatgtggcatggggcaagctggcaaatctaagaattctattttggaatttgacctaaaatgttgagttctaactattaaagatgataaaacaataactaacaaacatttattgagcacttatgtgccacatttggttccaaaagctctacatgagttaatctccatgctaacttcatgaagttagtaccatcattattcccatattacagaagaggaatctgaagtgtataaatcttctattacttgccccagagtcacacaattggtgagcagagaagtcagaaattgaatttgcaaatattcctggttgcaaatatcactgtttttaagagcatgacaagtttctgcaacttaagcctgcttcaagtttatatttaaaattattagtgcttgactctcttaagtgatatcacagtgtgttcttcccacagcttgatgcttgaagattatttatttaaatcatcagatgctattggattcaacaacatcattttggttatcctgttacaatttttgtgatagtcattcatattttttggactttcttcaatttttctttttatgataatgtaaaaaaggaaagaatttaagtgtgacaggccatgaacggcaattaaaaggtaattgcccattaactggcaaatctgtggaaacaaaggtaaattgtggttgcttagagctggggatagtgggcacagagattgggaagtggcagccaaggttttttttaggggagataaaatgtttgttatacaattagattgcagtgatggtggcataactctatgaatatactagaaaacattgagttgtatactgtgagtgaattgtatactatgtgaattatatctcaataaagccatttctttttaaaaaaggaccctctccccaatctcatagtatggactgagaagaaacaattgtagccggtttctaattttatttggtgtaaataatttttatctttaattgaatgagagtaaaccactcattccaaccctcgcaatcaattagatctacatgtcttttgtttatctgattttgttttgtctctgttaaatgaatacctttcatgttgtgacagacattagaacacccatactaggagtcactattactcagaagtctccaggttgttaggtcaaatggcatgaaattgcccagcctgactctgagatgtaatggcattggtgaactggcttaagataaaatacatgcttcatgaaagaaggaaacaaaacaaaaaactcaaattattttcctactcaaatctcatgtttttaaacacacatgagtgaatcttgacatattttatctttctcatccagaaaaccttaaaactagggacatgttttactttttctcctcatcttcctgttcttatttctcaagctttaaaaaagtttcatagttctaaaatgtcatcttagtaatacaggtgttctctgggcagaatttaggtttaaatttatactgagctcagatacgtcttttctgtgacccccttattgttttatacatgctattttcctctccttgtttctcctctaaaataattgtgttcccctgggaaagttgttactgtacatttgggccactactttgtattatacaaatcttattttcacacacataaaaagagaactttgaaaacaagtgaggtaaaagaacaagtaataatgtaacaaagaggggttaagggaaagataagagttggcttgagatatatctgcttacagaaatgtgtctatgtgaatgcacgtatacatgtgtgtctataacattgcctaattaaaaaaagattacttctgcaaacctaatgaactaatggatgtaggcattgagtatcagtagctgctacaatcacaaagagacagtcagatgtttcacgccttctgataaaagaataaaatattacaaggtagtcttgaaaacctctatttactcccaaaacaaaactccctcaaatgaatcagaatctaaccaaacctctggattgaactaccagtttacagcaacaaagaggacagagaaacatggtaattcctactataaaaatgcaatcaatcagcaaaatccaaaatgtgggaagctctacaagacaaactatctgatttcatctatataaaattgcaagaaaccaataaaaaatggcaggaaaacacatagatcagaagaaactttgagaaggatcaaccagttacaatgtatagacttcattttgatcttgattcaaacaaacaaattataaaacaaaacaaagcaacaattacaacaaccaaacccatctgtgatacttatgagccaatttggccctgaaaaaatactggatacttgttgatccactaattgtcaatttttatgtgtaataacggcattatggtcatgccatattgcaatattaagagctgaaaaaatctgatgcattggattgcttcaaattaatatgggagggatgtagtacttatgtaccccctgagtatattgtgaaggtagatctgtaaagaagcctcgaacttcacttaacaggtttattgctggttgtgatacagggatgacaattctgaaaccatttggtgtgtgctgtagggttgagtaaatgagtaaacacatggatgttgttgggaaccagggttgtcactgtgaaagaaaggtgagatacaaacgtggtacggaggaaggagaggaagactcttaagatggtgaccagtaattagaggcatgagatataaacttaggattttctaaaaagttttatttcttctctatccattaaaggagcttagatgtaatgaaaccctaacagcaaaatgcacattcactactcagattttgtcttctggatgccattttccacaaaagaacctagaatgttttagagaaatggctcattccaaggctggagcagagaaagtataaggtgagtctgaaacatttcgtggggctagaaagtaagcagtattaaatataaacatgacaccaaacacaaaacaaataaacaaaacctaaaatgaatggtagcatatgaaaagacacaaacaaaacctggataatttgaatattaaaatgaataacgacagtaataaagtataacacattcaattaaaaaaatttgagttcactctgattaccaaaaatacataaatgatgtaactaaaaatgggataaaagaaaagctcttctttagagtatgactaataattatagaaggaaggataaagtcaggaaatcaccattttgtaatcatcactataatagtcaagttagggaagaatcatctgtggatgcctaaagcattggttgaaagtttgttggggaataggatatttatctcttcccagattatttaattattaaaaagaggggaaaagatacctttatagtggagaaatctggtaaatatcaccttaatcaagtgatcaaaattagcatcgccaaattgtgggacaacatgacaccatgggcctcctgatggaaaacactgagaagtacacaacatcacttctgtagtatttctgccaaatatgtcaatgtcatgaaaactataaaatatgtcaatgtcatgaaaaccataaaaactaaggaatcattctagattaaaggagataaggaaataggaccaacagaatgcaatgtgtagtcctgagtcagaaaaataaaaagtcatattttctacaactttctctcaattcagcggattataccaacatgagttggtaattgttgaagcttagtaacaggtaaaatatattcataattctactttttctactttttatatgtttaaaaattttcataataaggataagaaaaaagatgaattgtaaagcacttaatgcaatgccttaaaaatacttaataaaagtagctaatagcaggaaaaatgtttgtttcctttttatagttttttttctgtttttttttttttgttactacttcaaatctaacaccaggaataaaaacaattccaactcgcatgaagcacaaggggctacctgtacctagaaataagaaaaagaagcagatcagaaaagtagggaaaaatcaaatcccaacgactatcacttgtagcctagtgaaggctgagaactgggttcattatttatgaaactgtgggagctaatcctcttttgatctcaaaaaatgaaattcaatttagagttctttgcttaggaagaaatcaaaatcacaagatgccaatcattctaattaagttctgtgaaatggaatcccagatgaaacctgttttatttttcccccatttatgttatttctaagactgatcatgctaaataaaagcacatcactcagtcagcagtctaagttggggaggctcaattccagtaaaaagctcaggtaaccaaagggcatagagaccaagcccagtatagctaaggagtagctgaaattatatgctggattttacgatgactctaatgcatatagtaagtaggatgttttccttaacgttgaggcccaagacatctacagcatcactttgtctgagatgtcatacttatttctcccaaggaaatagagaccttctcttctctctcatcttgcacccttctccagccaccactcagatctttctgcttctccttacagcaaaactcctccaaagttatcccttcttctcttcccttctgaacttacttcaatcacacttcaaatatcgtaacatcatctacaccagaggtcagtgacctgtggcccatgaaccaatccagcccactatgtgtttctgtaaataaggttttattcaaggataaccatgctcattccgtaggtactacctatgactagtgctacagcagcagaattgagtatttgcagcaaagatcagatggcctgcaaagcctaaaatatttactctctggcccgttacagaaaaagtttcctggctacttatctaaaccactttattcagggccaccaatgaacttcatgttgcccaatcaaatgttgattctcaggtctcatcttactctgttgatcttcccattagacatagttcatcatatctttcttcctgaaacgcttgcttccttgaactctggtacacctccacattttcattgtcatcctaccccatatagcatttgtcctcagtctgttttgctggatccctcttcatctttctggtctttaaaaattgggggtatttggactcagtttttgagtctcctctccctccctccccagctaggagccttccctgtctccagcttgaaactttcccagagttccagactcatatatccaattaattgcctactcactatctttacttagatatctaatacatagtcttcaaaccaaacacgtggtcttctccacaaaccctcaacaagcaaataaacaccaagcaagcagacaaaaaccttggtcctccctcagtcttgttcaacttgggaaattctaactcttccaattacgcaggctgcaaacttgcagggacgcctctctttctctcataccccacatccaattggttaataaatcctgtgttctcagctttaaaatacacccataatctgaccacctctcaccatctccaccactactaccccagtccaagtcaccaccatctcttgcctggagcatgatattgacctcagctggtgttcctgcttccacctattcctgctgcactttattctccttacagcagccagggtgatcatttaaaattgtaattcagatcatgtcattctgctcgagatcctccagtgacttcccacctcattcagaataaaacccaaaatgtacaacatggctggaaaggctctccataatccagctctagctaccactttgatctcctctgccactgtgccttctttgcctcactgtcttcctgccacattggccttgttgcttttccttgaatccttaaattcaagatttccttgaatcttgattcagggactttgctcttgctgttccctctgcttgtaatcttcttcccttagaaggctgattcctcacatcgttcagagttctactcacatattcccccttatcagtgaggctttttctgacaggcctgtctaaaattgtgctggccctattactatttgccttcctttgtcttttctttctttccttccttccttccttccttccttccttccttccttccttccttccttccttcctttctctctctttcaacatttatcaccatctgcctgcatacacatttgtttattttctgttttccccatggaaatgtaaactccctgaaaataagaaatgtgttttcatccactgccatctctctggtgccttagaacatgtacatatagtatatactcaataaatatttgttgaatgaatacatgctccaactccttttgtgtttccccacattctggcctttattgctctctattttttatcttttacttgactgtcttctactaaactgtagactggctccttaagtaaagtgcttatttttacttcatttactgattattttcaatatctccctaacctagtacctggcagaaagtctgctagtgaataaacaaatcaatgatcaatgcagaaactggcttatttgtaaaaaagtgggaggattttcaagttgaccaattattcatcatgtgtggagctgttcttagggagggactttaacaataatagaactgtcaactaggacctggagaagctgaacaaataatattcaatctaaagagaatgtgatgttttccagtgttaagcaataaagccaaggtatcaaagcagaatgtttctgtgtactcaaaccccatgtttcctatgactgtctaccataaatccttgtctggttttatgaactaaagagacctgatcttgcctcattagagtctgcctactgtggctcctgccacctggccgctgtggattaaagacctgtcacatcatcaagctgctctggcaggtattacaggaactcagagctgaagcaaataaaactgctatctgagtttcactttaagtcctaattatttatagactaaccaaaatgaattgtactgataattaccatttttaaaaacagtattgaatagaagtttcatattaaccagaaacactcaactaaatggcacactagattatttcttgtaaacccgcaaatttagtttatgccagctccaccaccatcccaggatgcaggagctgtcctagctctattctcaaattactcctctgccgggctcttaggtacttacctgaggctatttcagaaacagtgactgactctacgtcccacaagatgaaggaacaactaccatgtttatggctgttttttaggttgaactgcctatttctttttttttttttttacacaatatcctcaaatttgtatggattttttagttaaaacaaatgattcctgtcaaccttgccccagactgcagagacacccagttcaccatccttagcccttagtgatgaggtgagaactctaaaggcttctaggtggagctccctgcctaccagtgcctatgtttgaaaaggatgtctcctgaagttgagcagggcacagactatgtggcagccctgtactaccataaagaaaaggaattttattgcaaggatactagaaaatctcatcaaatctgaggaactgtagaacaaccaaatgagataggccacatgcagctaaaccacatgaagaactagaatagaagattcaaatgcaatcaggacactcactctatctcctggagtgtttgtttgctttatttttctctccctactgatcagacccttttacatggtggcaaacacagctaccactgaatcctaagctccctttcttatagtttctaaaccagtgagtgactctagcactctttgggttcaagctaaaaaatctcagggaagatctctgatgtgctcagaacggattagatgttcagctctgtgtcatctaattatgacagtggtggcagtgggcagggtctatgtggacataaaaattacttcgccgtggtagatgtgtgtgtctgttggagtgggggaggtatagggagaggtattctccaaagaatgacatgctattatcagaaaaacctgagacatcaagcagagaatacagtgagtgcttgccatgcttttgtttatctacttcagaattgtaattgacaaaaacaatctaattttggactgcccttccactccacctcatgtttatcctgctgaagtactctatcttcaaaactgagcttaagggtcatctcattttctcaacttgaagttgagttagtatccttctctaagttgtcacagaactctatatacctgtttttacccataccatagtacttatgacatattattctctgtctgctgctattaaagaggaagattggtgaggttagaaattgtcgtacccatttattaacatagttataataactatggctctccccaaaacaatattttcagcttaggctgctttcctgaacctcactctcataagtccaacctctcactcatgcccacctggatgtcccatagctaaaactgcttcaacaaatgctctggagcaacttgggaaagaataaactttgactcaattcataccaaacaccaaaattattaagggatagattacagatctaaacacacaggcttaaactgtacaatttctagaagaaaacatacaatatacttataatttgaggtaggcaaagatttatggatagaatgtaaaaagcacaaatgataaataaaaaagttgttaaactggacttcagcccaagttaaaaatttctgttcttcaaaagaagtcatttaaaaaatgaaaagacaagtcacaaagtgggaaacaatgtttgcaatatatatatctgaaaagtttttattcaaagtatttttaaagtcctacaattgaaaaataaatagaaaaaccaataaaaaatgagctagagacttgactggatatttaacataagatatatatatatatatataagtgatcagaaagcatatgaaaaacatcattagtcatcggggagatgcaaattaaagccaaagttcacttgatacccaccagagtagctaaaattaaagactgacaatattaagtgttaataagacatggagcccttgcaactctcatttaaattggtggaaatgcaacatgatacagttactttgaaaaatagtttggtatcttcttgtaaatgtaatcatataactaatgtatgacttagaaattcactcctagaaaattacctaacagaaaaacatatgtccacaaaaaggtatctttacaagactgttcacaattacctcaaactggaaactaccctaatatccatcaacaggtaaattaatacattgcggtatattcatacagtgaaatgctactcaacaataaaaaggactgaactattgatgcaggaaacaacatggatgaaccataaaagcattatagaaggcagacacaaaagaatacagatagataattccaatgactgtaagtccaagaacaggcaaaactaagctatggtggtagaaatcaaatcagtggaagagttaggaaggatgtctaatccatatattatcatggttgtaaccatgacacctcccaaaactgtatttccagcccatgctagtctcctaaatatgtatagattaatcttctatatcttgtctcaggaggtggttttagaaactcttttctctttgtccatctcacaaacacttagcatttttaaggttatgcttaggtgttctacccaatgttgtcacagtgaatgccacttatttttatatatttctctcctatcacattatgatctaatagcaggtaacatgttactttcattttggtatctctgggattgagagcatgacaggtactcaatactcactgaatgaatgcaggaaccaaaatgttgagcaatgatttctactatgagtatggagagaaaatgtgggcaaagcaaaacaaaacaaacacaacaaaataactgaacatctggtgaaaggggggagaagtaatggaagaataagaaccataccggctgggcgtggtggctcacgcctgtaatcccagcactttgggaggccaaggtaggtggatcacctgagctcaggaattcgacaccagcctgatcaatatggcaaaaccccgaaaaatacaaaaattagctgggtgtggtggcatgtgcctgtagtcccatctactcaggaggctgagacaggagaattgcttgaacctgagaggcagaggatgcggtgagccgagatcacaccattgcactccagcctgggcaacacagagagacttcgtctcaaaaacaaaaaacaaaaaacaaaaaacaaaacaaaacccacatagtttctttttattgcatttctctgcagttatctcagatttgtctttttttcatgaatttaatctcataattcttatgctcaatgatctcatttacttctagctgccttttattactagtaataaaaatgaggtggcttagctatttgcttgtatgcattttttcatagtgtcacattttcagctctatctattgtccacaattcaataatggaaaacttttaaagatttccagtagcattaataactccaataaaatctaccatttaatttttcttttctaacttttttcccaattaacctttactccctttcctaactaaaagcttaatttattaaaaaaaaaacaacaacaacttttttccattaacaaatggaagcttccctttttagaaaaaattcaaagggaattgaggaaaaagttatcatcttattacagagatacaaatatcccttagtattatttcttcattttaaaaaaatgtatcctgtttaaatttagttgtactatacttttctgtataattttaattccgatttttaagtttactatttcacataatgaagtgttatgggcatagactttggaatttggctgtatgactttagaaatattatttaatctctgagcctcagttttaggtatttaaatgtgataacatattaatagctctcaccatagttgctgacactatagttcaataaatagaagccaattttaatagtaatagacacactttcccaattattagaaaatctttagaagcatcagttttaatgaacatataacaatgaaatgaaattaaaactcagtaacataaaggaatttggaaaattctcaaatgtatggaaattaagcaacactctcctaactaaccaatggatcaaagaagaaatcacaagagaaaatgaaactacttttagatgaatgagaatgaagacacaagataccaaaatttataggatgtagctaacactgtacttagagaaaaacttatagccatatatgtctatactaaaaaaagatccaaaggaataatctaatcttctacctgaagatactggaaaagtaagaccaaactaaacctaaagcaaggagaaaaaaaaaaacaataataaatattagaacagaaattaatgaaacagagaattttaaaaattgagaaaaattaacaaaacaaagtggggaagaaaaatctttttttttttttgcaaagattgatgaaattgattaaccttagctagactgaccaagaaaacaaagatttacattgcaaacattaggaataaaagaagagatattattattgaccttacacaaataagatttaaaagggaatactatgaacaattatatgccagtaaattagctaacttagataagatggactaattcctagaaagacacaaactaccaaaattgaatcaagaaaaaattaaaacgcagaatagacctataacaagtaaagagattgaatcagtgatttaaaaaattatccacacagaagcccatgcctagatggctttcctggtgaattctattaaacaccatttaaaaaagaatgaaagccaattctcacaaagttttctaaaagatagaagaggagacatttcccaacttattctatgaggccagtattacctagataccaaaatttgacaaagatatcacgagaaaagaagactacaaaccaaggtgtcttataaacataatgacaaaatagtatttcaagtgaatttactgcagtggcttaacattcctatgttgtttgttgttttccattttctttgtagtctatattgcaatgaatataccattcagtgcattttggattattttcttgggatagatttctaaaggttaaattattgagttaaaaattatgaatagtttaaaagttttgacacactgccaaattgctttcaaataatctgtacgaattgacatttccaccagcaaccatttattcgtaattaataactggtcccaagaatgtatcatgattgctttttttttccctttcaacaccctctacactctccgtattgcctccttataaggtaagtcttcctgccctcgaacatcagactcaaagttcttctgtttgggactcggactggctctccttgctcctcagcttgcagactgcctattggggtatcttgtgatcttgtgagttaatacataataaactcccatatatatatattatatatataatatcatatatatatttcctctaataggatatatatatttcctccactaataggagatatatatatatatatatatatatatatatatatatatatatatatcagttctgtccctccagagaactctgactaatacgacagtcaagagctctgcttaattccttttgctggtaaaataacctccctatcttgctccctattctacttggtgaataatgatctattctttaatatttagctcacatgtcccctcttgcttgcatatactcccctccatagcagaacttatcctgccttcctcatgccccttcggtactttgcatgcactgtcacattgccttagtaacttagaaatctctgtcattgaattgtgaggttctttagtattgtagctccagttcctagcacaatgcctggattatgcatgtgttcagtatatatttggtgcatgaataaatggatgtaagtatctaggacggaggatcctagagtaattaggcaagccttctaacaaggtgccgtcattctgaacacagggctttggcagactaggtttagtattaatttatttgctaggattcaaagtattccagcatggatatgaacatgaccttaaattgggaatatgagagaagtatcagagaatcaaatcccaaagatgatgttgttgcactgtattatccaccacggctacatttcttccaacatccatcctgccttgcaaacatcaaactttgtgtggtcactgggtcataggtccagtttttggaaaaaactgaaacagctttcttcaggttcattaaagctgatggagcttttatgctactgtcagctaggggggttatttgttcatttatttatttattttatttactaattaagttataattattattcctttattaataaatttatttattgaatgcctgtatgtcccactatgtgtcaaggcttccactgagcccttagcaattttatcttcatttagatattcatgtttggaactagtgcaagagatgataaaatttaataatagattctgaaagtgtcattttctttgccaatttgtgcatcattctgtgtggtagattccacaggaaattgccagctttgtgactcctattaattatttcataagcctaaaattgtataggatttcatcattaagtttcaaaatactatggcttatactacaactcaaagggtcagaaagcaaaacaaaactaagtaaagaagaaaaaacctttattccctactttgctcactttacagttattctcaccaattggacatgttgaaattatttttaaattcccatatgttagatagagaaatggggctcagaacatacgttgttggtcacattgctaatttcttgatttctatttttttctgtttttcttttcttttttttttttttggatattttctaaaattcaaaggttcttgtcaatgcctagagagctacctaatccctcacaatatggctgtcagcccacaatggccacagtaggttacaggagcaaccactggcaggaaaagctctagggtccatagatggaagtccgactaactgatcagtgttgggcagggagaatggctttcagaatccagtgaagcccaccaatgtccacagggagccaagaatcagactgagaatgaggagacctggttctccagtgcaatttgaacaagtcattcatatatctgggcctgtttcttcatatataaaagacagtgcatagaccagttgatcgctgaggatctctgaggtttctttcatctctaccattctcaaatcctgaaacctcattcaaggtcaagctaaaagataaattccttttttcccttttctattttagcattctctaaatgcattgctaattgagggtattattttgttcctgtgattgtttccccccaaatccagagactgacataacagttaataaaatcctaatgtgagtgaaaattctgtctgggttatctttaatgaatttaattgagcacccactaagtacatatcaccacattaggccccttctctgactatcctgatcctttccttcctttaaccacagttactcagtttggacttaagggttctctaattgctctattgatgctagtttttcgtttcatcttcagcttaaccctgtaaggaggaggatcttatcttaaaattttcttttgcactcttcaaggtaccccagaataatgtgtggaaccaaatagataaaaagtacttgtcaataataatagcatttgttggtaacatttgttaaatgcttactcatatagcggatacttttataagtgctttacatggattaatcattctaagtgctttccacatatcaagtcctattaagtggctacaaatagtgttcacaacttatacataaggaaactgagctagagaaaggttgagtcacttgcctaagggtttacacaactaggagtcacaagccaagattcatacccaagcagtttggctccagagttgcgctcttatctattatacgatactaccttttctgtgattgcttgcaaagattccaagtgtgcattttactctgctctcagtggatagccacaataactactgctgagaacttctccaggcaaattacttcctataaaattttataccttatttctaaaatataatctctatttttttcaagtgattcaagcaatgagattttggtgatcaatccccaagggctatgacaccactgaatacttttgatgggtatgaagtaatatgctcatttgcagggagcatgtcttgcctcaatttcatttcttcactcccaggaatgccacttcttctgtagcttccctaagggctcctctcctcttctggtaatctctcagactagtctttactggctggtcttacatacctatcctaaaggttatgtgactccatggggctggccaaaacctataagctgatttacccttacctgtgtaaggaaattaccctcactgagatccatacgttgattacaccaatttaaagttacaggatccccattctttttctgtttccattgctgtctccccagtacttctgaagttactcatttctcatgaactttctcttgttagaaggctttcctaattactgtagataattaggaaataattatcagatagttacatccatttatgcatgtacctaatatattttgagcacatgaataatccaggcactgtgctaggaactggggctacaataagctctaaaaaacctcacaatttaatgacagagatttctaagttactaaggcaatgtgacagtgcacgcaaagtactcaaggggcatgaagaaggcaggataagttctgctatggaggggaggataggcaagcaagaggggacatgtgagctaaatattaaatagaccattattcaccaagtagaatagggagcaagatagggaggttattctaccagcaaaaggaattaagcagagctcttgactgttgtattggtcagagttctctggagtgacagaactaattaggatatatatatttatatatatacacacacacacccatttatatatatatatatatatatatatatatatatatatatatatatatatatatagatagatctaataggatatatatatttatacacacacacacatatattattaagtattaacttacaagatcacaaggtctcacaataaggcatctgcaagctgaagagaaaggagagccagtccaagtcccaaaactgaagaacctggagtccgatgttcaagggtaggaagcatccagcatgggagaaggatgtgggctgggaggctagaccagtctagtcttttcacatttttctgtctgctttatattctagccatgctggcagctggttagatggtacccacacagattaagggtgggtctgcctttcccagcccactgactcaaatgttaatctcctttggcaacaccctcacagatacatctaggatcaatagtttgcatccttccacccaatcaagttgacactcagtattaaccatcacaagtctaccccttgtcaacttgaacccatacacatcttctgagattatatataatcttcaaataaagacaataataaggtcataattacacctaacataatacaactatccttcgtacaaccagaaatgcaccaatctccaacccaaatactattaaagttaacaatacttctatgctgatgtgaggtcaataaatcttatgtcacatgataaaggaaaaaggaaataaaatgaagatattttcttagtacaggttacatgcacaaacatgtttttaacaaaagaaggaggaaatccttatgacaattacactcctagtttctgcagctggtcatgtggtcatagctggtattgatgacttcttctactacccattcagtattccctttgccttcagcaagcacctcagcaggtcatggtttttttcctggtagagtgacctaaaccttgattcctaaagggcctgggctatcccttcctggattgggttattgtagtttcccactgaccttaatcacagggcacagtaatactaagagacaccctaacgaatctcctgtattccatgcatactcttccttacctccattatgaagtagtagactgatttcatcttgacagtctgggtcagtcaccccagccaacactgtaacttcctttttagcctgctgacttaaaagtaggaggagcccaaagtgtccaggtggcaatcttaacttcccatttaacagaatcgttgtgtctcctggtggcagcattcctccctctggaactaagactacctaggccagcagactatctaggccagcagaatgtaatgttgtgggaggaggaagcaaaaaatttgctagtggatcactaggagtgatggtgagtggtgccgcttccacttccacccgttgattcctggacccgtgaatcctggctatgggagaaacagtaccatatattagttgctgattcagagcatacgtggccttctggagaactttgccccagccctgcaaagtattgtcacttagttggagttgtaattgtgacttacaaagctatttcaccattctatcaatccagttgtttcaggatgatggggaacatagtaagaccagtgaattccatgagcagccacacttctttagccataaagtgagtgccttggtcagaggcaatgctgtgtggggtgtgtgtaacaatgtgtgtaccatgacagtggataaggcacttcatgagtccacagatggtagtcttggcagaagcattgtgtgcaggacaggcatacccatatccagagtaagtgtctattccagtgaggacaaacctctgctctttccgtgatggaagaggtgcaatatatatataacctgccaccaggtagctggctgatcaccctgaggaatggtgccatattgagggctcagtgttggtctctgctgctggcaaatggggcactcagcagtggctgtagccaggtcatccctggtgagtggaagcccatgttgctgagcccatgcataatctccatccctgccaccatggccacgttgttcatgggcccattgggcgatgacaggggtggctggggaaaaagactgagtggcgtccacagaacaggtcatcctatatacttgattattaaaatcctcctctgctgaggtcacccattggtgaggactcacatgggatacaaatatcttcatgtttttttacctctcagagaggtccatccatatacctcttccccaaatttctttgtcaccaattttccaatcatgcttcttccaagtccctgaccatccagccaaaccactggctacagcccatgaatcagtatataattgcacatctggccatttctccttccatgcaaagcgcaaaaccaggtgcactgctctaagttctgcccactgggaagatttcccttcatggctgtccttcagggatgtcctagaaaggggctgtagtgctgcagctgtccacttttgggtggtatctggatatcgtgcagaatcatctgtgaaccaggacccagtcttctcttcctctgtctactgatcatagggaactccccatgaggccattggtgcagggtggcaggagtggagaccatggacatttgagccacttcatcatgtaacttacttgtgccttcaggacctacttgagaccaatcatgtatataccacttccatttgctgatggaatgctgctgtgcacggcccactctatggctagatgggtcagaaagcacttagttcatgattggcagttcaggtctcatggcaactggatgacccgtagtcaaacgttcagtttccactaaacttggtcctagaatttccagctcgctcacagtgggccatcttttaatccatatttcagctaaacaagcaaacaaactactagaaccttttctaagtccctgagctgcaacattaaatgcagagtccctagtgggcccaaatcaataaattcagcctgatccaactctatgttccttccaccattatctcacacctttaatatccatttccatgcctgttctccagatttatgtttatattcaaagcattgatttttgagtgtagtgcacctcctcatgggtcacactctcaacctccctctaggcaccagccagaagtttagtctagttataggtctagacgcaaataggggtgttggaggtggctcctgaggagaatcaacattatcttgcctggcacctgcctcaggggaggccatcacatttgcctcaggcagcacagggtttatctcctcagacaaatgtggaaaggctgatggcagcatgggttgggaggggatgttgacactactggggatggggaagctgtttcttctggcaaaaaaaggttcatcagaatttacaaacttagtgtccccagctttatcagggttctctcacacgtttctattgtaagttgcagggtcccattcttttccaatcaatgccctcactttaaccatagacatctgatgagactgtgcatgcacctttcattgcaggtcagccactcgcatgataagagtttgtgcctgtttttccacaatttcatctttcacataggagatgagactctcactcagggcaatcttagcaatctgaggctcagtgtctgcctctgaagctgggagttagaatccctgggttcatccttttctttcatcactttgtctactgaacttaggagcaaccaagcagcttcattatgttccttggttctccacatatggtcaaaagtattatgtatagagtcaataaactccttgcctctcacaaatggtgaatcaggaatgtcaaatgcatttattttgcataactctctaaacagttcatgccaaggactatcagtgttctccatgctactagaagtagggtccttagcatttttgggtctaatcatactaagaagccaattccaaaaacccccaaaactaatgaaagaactccatccttaatattctgttcctttagaaccactcctggtaccaaaatctgtattagggttctctagagggacagaacaaataggatatatatatatatacacacatacatatatcctatatatatatctgtatatatatacacatatatataccctatatatatatatccatatatatacacatatatatcctctatatatatatccatatatatatcctaaatatcctaaagatatatatcctaagtatatatatcctatagatatctatatagatatctataggatatatagatatatataaataaataaaagagttaaatggggatgtggtgggaatcaccacccctgcatcttttaagtccttgatggtggcactaatctccataatccctccagggatgcgatattgttttttatttatatttacatatatatttttattatatatatatatatatatatatatatatatatatatatatgtatatatgagtttaacaagtattaactcacaagatcacaaggtcccacaaaaggccatctgcaagctgaggaggaaagacagccaatccgagtctcaaaactaaagaacatggagtcagatgtttaagggcagaaagcatccagcaggggagaaagatgtagtctgggaggttaggccagtctagtcttttcacatttttatgactgctttatatactagccatgctggtagctgattagatggtacccacccagattaagggtgggtctgcctttcccagcccactgactcaaatgctaatctcctttggcaacaccctcacagacacatccaggatcaatactttgcatccttccatccaatcaagttgatactcagtattaaccgtcacaactgttctttgataactcaaattgtgtctttttcccatttagaatatacatctttttttttttttttgagacagtgtgtcaagcccaggttggagtgcagtggcacgatctcaactcactgcaaactctgcctcccgggttcacgccattcttctgcctcagcctcccgagtagctgggactacaggtgcacaccaccacgcctggctaattttttttttttttttttttttagtagagatggggtttcaccagttagccaggatggtctcgatctcctgacctcatgatccacctgccttggcctcccaaagtgctgggattacaggcgtgagccaccatgcctggccagaatatacattcttaatactagcaactaatacttattgagctctcctctgtgccattgtcacaacataccttcttaaacattttgcactaattatctcattgaatcctccccataacactatgacatatacacatacaggcaaacacacacacacaaacacaacacaaatacctttttctatataaatctacaatacaaatgagaaaactgaggcttagagagataacataattttgcccagccggcaagtggcagaactgggattcaaactcagctgtctcggactccaaagaccaaacttcactactgttttgttttcggtttggattcttccagggcttagcagttgctgagtacacagtagttaattgcctaagcaatgttggctgacggaagaattggttaatagctgttgtctgcagtagaggaacagatgctgtgacctattacaggcaggaagggagagctcaatgactgtttcataatatagtttgttcaaatgtagtcacgtgatgttacggggtgaggccagtgtggttatatgctcccaggcatttgttaagtaaggaaagtgcacaaggcagggacaagagtccaatcctggtgtcagacgggccaggcacactgcttctctattagacacattttctttttgagagtccttgctaataagtttgattcaaatcactggccatctgaccttggactagttatttaacttttttaggattcattttcttcatctgcatcatgaatttaataataatgcctacttcacattatcatcaccacttgtaatgaggctcagtggtaacttgttcaaggtcacaaatctagaaaacaggaaagtcctaactggaacccaaatctctccacctacagagcatattttccttcctctatcacaagttactttcagaaatgcagtagctacgtgcctacttcagaagacaaaattcacagtgcttttttcctttttgactactcatggtactccatctctcagacttatggtaccccatctcttatggtactccatctctcaagccatttcttttgtctaagtcaaattaaccttgctcgcatttcaagactgaatcaagaaatataccttgtgagttagtgtatgttgtaagtaatgggttatagacaaagaacatccaggttgaatagatttatttggaacagtttctacttttgatacaactcccccttaatatactgttaaaaactcacaaggcatatcagagatgtcttgggagaaagtgcaagctgaaagggctgagagatgtgagacctgggcgtaagttttggttcatctcttcattcatcagttatttcttgagcgcgtagtatggaggctcacactaggggacggaatatagctgtgaactaacacacacaagatactttgcttgtggggcttaatgtctagtgaaggccaataggcaaatatttaagctataaatgtggtgcaaatcagaggcaagattcctggccctggcctgggtcctccttatctatgtgagcttaggaaagtcacttttgctccctgaacatcagcttccttttctgaccatcagggagttaagtgagatgaccctgatggttctttacagcattcagactctatactaggaagatgttctttctttctacctcccctcattccctccctccctccctccctccttcagataggagagggtattcagctttacccccttggatgttgactcagtttcaggagctgacagtgcgctctttaccccccaccatctgatgtcactccagactcagagagtaagaggtcacttgcagcattcatgtcctaggagtgattgagggcaaaccaacaaatcaagtgcaataataaacagcattcattataatgttgtgactgattgaataattctcacttcttcctacttcaatgaaaagagggggaacttgcaaatagaggcaaatccattacagctgagactcctagcctgtagtcccgttttagcaggatgcatcacggggattaggactctcgctagggagtttggtcatgcagtaggagagtggaagggtgggatgagaacacaggccccttgttttctgtctcaggctcttcggtatagctctcacggtgtctcccatctaaatatttccttgaggtatctttcagatgctaaatgcaagtagactgtgttttctatgacaagcagggccagtcagaggagtgaatcacatttacaatgtgagagcatgtgagtggctcaaaagtttctgaaccatccgtttttttttttttttttttttggaagggaaaaagcaaacattgcttgctaaacttggaatactagctgataaaagtatatatcctcacttggctaggatttaaattcctccaagattttagagataaaagccatgaagatacataaacacacttcaaggaaataaaacaccgcaaactgccctccaatactacgttttgagaaaaaaaaaaaaaccctctctgtcttcctctcacttgctcaaacacacacacacagacacacacacacacacacacacacacattcttttctatctatgctgaattcatagcccagcaggttcattcttatttctgtactagacactagtgatcaccgggtgagtctgttactgtaaaccaattgtcactttaaagccagagagaacatgctattgttttccttcaatgcttcttctgcctggggaggaatttttgcaccttgattggacatgccattcacataacaattgcattccacttatgagtaaatgcacttgcagtgcttagtacggtgcctggaaaattgtgtctaataaatgacatttttacggtctactcattctcaagtctcatgtcagtggagctcaccctagtagaagataatttatttgacagcaatatccactatgtgaagatttcagagaaatggggtgctgttacctccatcataggctattatagtgctaaatggaaccacgcatgaaaggggttagcatggtaaatggttaataaatgataagtatttttattattattagataagcattgattgtttttgtcaaatattacactcagccctccaatagcaaaaagtgcctgtgtaaattagaaaaagcttccctctctgggaagagggaatgtaaaagaagcaaacttttttttttttttttttaaagagccagggtctcattatgttgcccaggctaggctcaaacccctgggctcaagcaattctctcacctcagcctcccaagtagctgcgactacaggcaggagccactgcacctggcttaaaagcttaccatttcttatgctggctgttgttgaatgggatgtgttgctgagtcttatttccctacgtgtgtcccttaggcagcaacatggctatagtaagcatagggaacacaaagggaagagctcacagtgtgcaataattgctatgttggaaatttgtaaacagtttgtgagggcaccacggagggagccaggggaagctgggtggggcagctggagacagctcaaaggcaccattttagcgaattaaagaatgagtaggaaattgttaggtagagaactagcaaagcacagttcaggcagaggaaaggcctgcccaatggggaggtgcaaagccaccccttctgccctcttctctcccccaatcctgtgtgactgagcaatggtgagaagctgcactgataaagagtaggatttggagagggctggagctcagagaaatggtgggaaatacattcgagacgcagttctggcttggattgtgaggaacaccttagttacaaacagtaattctaaatatctactcctgttcaagaaataagcaataaacgagtaatacaaatttttctacagaaatcacatgtgcagttcagaaactattctttcatcatttaaccagcaactttatactgtatttttatttaattattgcatcattttatttatttatttatttatattatactttaagttttagggtacatgtgcacaatgtgcaggtttgttacatatgtatacatgtgccttgttggtgtgctggaccaattaactcgtcatttaacattaggcatatctcctaatgctatccctcccccttccccccaccccacaacaggccctggtgtgtgatgttccctttcctgtgtccatgttttctcatttttcaattcccacctatgagtgagaacgtgagctgtttggttttttgtccttgcgatagtttgctgagaatgatggtttccagcttcatccatgtccctacaaaggacatgaactcatcatttttatggctgcatagtattccatggtgtatatgtgccacattttcttaatccagtctatcattgttggacatttgggttggttccaagtctttgctattgtgaatagtgccgcaataaacatacctgtgcatctatctttatagcagcatgatttataatcctttgggtatatacccagtaatgggatggctgggtcaaatggtatttctagttctagatccctgaggaatagccacactgtctttccacaatggttgaaccagtttatagtcccaccagcagtgtaaaagtgttcctatttctccacatcctctccagcacctgttgtttcctgctttttaatcatcgccattctaactggtgtgagatggtatctcattgtgggatttgcagttctctgatggccagtgatgatgagcattttttcatgtgtctgttggtagcataaatgtcttcttttgagaagtgtctgttcatatccttcacctacttgttgatggggttgtttgttttattcttgtaaatttgttggagttcattgtagattctggatattagtcctttgtcagatgggtagattgcaaatattttctcccattctgtaggttgcctgttcactctgatggtagtttcttttgctgtgcagaagctctttagtttaattagatcccatttgtcaattttggcttttgttgctattgcttttagtggtttacacatgaagtccttgcccatgcctatgtcctgaatggtattgcctaggttttcttctagggtttttatggttttagatctaacatttaagtctttaatccatcttgaattcatttttgtatgaggtgtaaggaagggatccagtttcagctttctacatatggctagccagttgtctcagcaccatttattaaatagggaatcctttccccatttcttgtttttgtcaggtttgtcaaagatcagatagttgtagatatgtggcattatttctgagggctctgttctgttccattggtctatatctctgttttgataccagtaccacgctgttttggttactgtagccttgtagtatagtttgaagtcaggtagcgtgatacctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcatgatattgattcttcctacccgtgagcatggaatgttcttccatttgtctgtatcctcttttatttcattgagcagtggtttgtagttctccttgaagaaatccttcacatctcctgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatgagcttaaggagattttgggctgagacgatggggttttctagatatacaatcatgtcatctgcaaacaggcacaatttgacttcctcttttcctaattgaataccctttatttccttctcctgcctgattgccctggccagaacttccaacactatgttgaataggagtggtgagagaagacatccctgtcttgtgccagttttcaaagggaatgcttccagtttttgcccattcagtatgatattggctgtgagtttgtcatagatagctcttattattttgagatacggcccatcaatacctaatttattgagagtttttagcatgaagggttgttgaattttgtcaaaggccttttctgcatctattgagacaatcatgtggtttttgtcattggttctgtttatatgctggattacgtttattgatttgcgtatgttgaaccaaccttgcatcccagggatgaagcccacttgaccgtggatatgctttttgatgtgctgctggattcggtttgctagtattttattgaggatttttgcatcgatgttcatcagggatattggtctaaaattctctttttttgttgtgtctctgcccagctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatatcagattctgttattcgtctatttagagattcaacttcttcctggtttagtcttgggagggtgtatgtgtccaggaatttatccatttcttctagattttctagtctatttgcgtagaggtgtttatagtattctctgatggtagtttgtgtttctgtgggatcggtggtgatatcccctttatcattttttattgcgtctatttgattcttctctcttttcttattagttttgctagtggtctatcgattttgttgatcttttcaaaaaacaagctcctggattcattgattttttgaagggttttttgtgtctctatttccttcagttctgctctgatcttagttatttctcaccttctgataacttttgaatgtgtttgctcttgcttctctagttcttttaattgtgatgttagggtgtcaattttagatctttcctgctttctgttgtgggcatttagtggtataaatttccctctacacactgctttgaatgtgtcccagagattctggtatgttgtgtctttgttctggttggtttcaaagaacatctttatttctgccttcatttcgttatgtacctagtagtcattcaggagcaggttgttcagtttccatgtagttgagcgatttttgagtgagtttcttaatcctgagttctagtttaattgcactgtggtctgagggacagtttgttataatttctgttcttttacatttgctgaggagtgctttacttccaactgtgtggtcaattttggaataggtgtggtgtggtgctgaaaagaatgtatattctgttgatttggggtggagagttctgtagatgtctattaggtctgcttggtgcagagctgagttcaattcctggatatccttgttaattttctgtccctttgatctgtctaatgttgtcagtggagtgttaaagtcttccattattattctgtgggagtgtaagtctctttgtaggtctctaaggacttgctttatgaatctgggtgctcctgtattgggtgcatatatatttaggatagttagctcttcttgttgaattgatccctttaccattatgtaatggccttctttgtctgttttgatctttgttggtttaatgtctgttttatcagagactaggattgaaacccctagtttttttgttttccacttgcttggtagatcttcctccatccctttattttgagcctatgtgtgtctctgcacataagatgggtttcctgaatacagcacactggtgggtcttgactgtttatccaatttgccagtctgtgccttttaattggagcatttagcccatttacatttaaggttagtattgttatgtgtgaatttgatcctgtcattatgatgttagctggttcttttgctcgttagttgatgcagtttcctcttagcctcaacggtctttacaatttggcatgattttgcagtggctggtaccggttgttcatttccatgtttagtgcttccttcaggagctcttgtagggcaggcctggtggtgacaaaatctctcagcatttgcttgtctgtaaagtattttatttctccttcacttatgaagcttagtttggctggatatgaaattctgggttgaaaattcttttctttaataatgttgaatattgggcccgtctctcttctggcttgtagagtttctgccgagagatccgctgttagtctgatgggcttcccttttgggtaacctgacctttctctctggctgcccttaacatttttttcttcattacaactttggtgaatctgacaattatgtgtcttggagttgctcttctcaaggagtatctttgtggcattctctgtatttcctgaatctgaatgttggcctgccttgctagattggggaagttctcctggataatatcctgcagagtgtttttcaacttggttccattctccccgtcactttcaggtacaccaatcagatgtagatttggtcttttcacatagtcccatatttcttggaggctttgtgcatttctttttattcttttttctctaaactctgcttgcttcatttcattcatttgatcttccatcactgataccctttcttctagttgatcgaattggctactgaggcttgtgcattcgtcacgtagttctcatgctgtggttttcagctccgtcaggtcctttatggacttctctgcattggttattctagctagccattcgtctaatctttcttcaaggtttttaacttctttgccatgggttcaaacttccttctttagctcggagtagtttgatcttctgaagccttcttctctcaactcatcgaagtcagtctctgtccagctttgttccattgctggtgaggagctgcgttcctttggaggaggagaggtgatctgattcttagaattttcagtttttctgctctgttttttccccatctttgtggttttatctacctttggtctttgatgatggtgacgtacagatggggttttggtgtggatgtcctttctgtttgttagttttccttctaacagtcagtaccctcagctgcaggtctgttggagtttgccggaggtccactccagaccctgtttgcctgggtatcagcagcagaggctgcagaacagcggatattggtgaacagcaaatgttgctgcctgatcgttcctctggcagtgttgtctcagaggagtactcggccatgtgaggtgtcagtctgcccttactggggggtgactcccagttaggctactcgggggtcagggacccacttgaggaggcagtctgtctgttctcagatctcaaggtgcatgctgggagaaccactactctcttcaaagctgtcagacaggaacatttaagtctgcagaggtttctggtgccttttgtttggctatgccctgcccccagaggtggagtctacagaggcaggcaggcctccttgagctgtggtgggctccacccagtttgagcttcccagctgctttgtttacctactcaagccttggcaatggcgggagcccctcccccagccttgctgccaccttgcagtttgatctcagactgctgtgctagcaaagagtgaggctccatgggcgtagaaccctccaagccaggcgcgggatataatctcctggtgtgacgtttgctaagaccattggaaaagcgcagtattagggtgggagtgacctgattttccaggtgccatctgtcaccccttttcttggctgggaaagggaattccctgacctcttgtgcttcccgggtgaggcaatgcctcaccctgcttcagcgatgcctcaccctgcttcggctcatgctcggtgcactgcacccgctatccgacaatccccagtgagatgaacccagtacctcagttggaaatgcagaagtgatttgtcttctgtgttgctcatgctgggagctgtagactggagctgttcctattcggccatcttctaaccagcaactttaagtgtctgaattatatatcccaaagaagcagagctgcacagttgacagaaaagtcacaaaatctacccatcagagtcttagcatatatatatgtatatatttgtacttactatgatgtgagatgaaattaaaaatggtaaaaatgagaattaacgataaataaataaaaaaaagaagtttgttcctggggtttctcagctcgtagatttaaaatagcaaattcagtgtgggagggggctggactgaggggctgctccatacagctatctgctgacagtgccaagagagtacagctgagcactgtgcaactaggcaagaaaacccatcaagtgtgggggtcaggaacttaaaacacagtgcagagagagcagccacagagggtgtctgtagtataactgaggtccataattattcatttaatgactccaaggtgtcagtctcagtactaggggctgggtaaatggtatggagtaagacccagatggggcctttgcagtggttctgcagcggggtgtactgtagagaaacagtggtgagagaactgagtcttccctagcactcagcaggtgcaactccaaaatttccacacagcagccacaaccacgattacattgtggaagaagatttagttttactaaagtatcactaatcacattaatgctgtaattttgaattttattgttacaatataccactattacatatatggtgtttaatttgtaaatttatttgaacatgatagatgatataagagctataaggtatttgcccctaattttgtgttttttatgtatttaggtaacatcattataaaaagatttagtcaacacttgggggcatgggtgcccagaaatattattttctttaaaaggggaccctatattcttcacctcatgggattcttgtgaagatttaatgagaaaaattgttctatttagcaaaaacacctggcttatatgtaatcttcaaaaaacatcaattgtattgttatcacatttaaaaaatactaatcaaagtcaaattctttatttgccaaatgtgagctttgcctattactgcgaagggcataaacacagaagttcaggcagctcatgggatgagctgggtgatggggagcttttacctgcaacaaagcaatcattccatccattggcaatcgtagattcatatctgtctttttctgactgtcatttgggcttagactccacttcacctagagccattagacttgggaggtgttcacagaatccttctctatgaataaggagtgaccaggtttgtcattcacatttacctcatgccccaaattcattatggtattaattctttgggcaggtgagcacaagtcaattacagagcaaaatggtggcttcttagggccttccaggaaaaaccaccacatcaagagtgttcaaacaggacgtgttagtaaaatctttacaaatgttcatgaagttgtcaaaacataaaaggcgaatggcatatctgcaaactttttacttcttttcaagtgagataggctttcacttatattgacaagtgcttgtaataaatttgagacagtaattggaaaagttctcactttgtagttgtgtcactcagatttctcagaactctgtgaatgaatggaaactgcattacggttatcactactaacaaataaaagatgtttctcatagcttccccattgttgcctatgtataccaatagccctggagtcatggaaattatttttctctttttctcttacagggatttcaagtgcacagaaagggaaaaatcataatccttagtcatgatatacctttcattgctcatgctttcacattaggtggcaggttcatggtgcttactgcgttgtcatagatagaaagatagctaactagctaggtaggtaagtaggtaggcaggtagatagatagaaagacagacagacaggtaggtagataggtaggtaggtagatagatagatagatagatagatagaaagaaagacagacaggtaagtaggtaggtagatagatagatagatagatagatagatagatagatagatagagtgggctacacatggatgtttttcttgagaggtatacttttgatttgactcaatagccttcatgctatgactcttgtgtagctcgcatcttaatgaggtaagtttaaccctcttacatgtcccactttacataggagtaactggtctgtctcagatgacacagccagtggcatagctgggatggcagtactaagtttgttgactgcctaagaagaatagatcatgtatcgagactgccaacttcaaaggaaatccaaatgtttgccagaccatttaatgtttgccaagagcatgggcaaaggctcaggcgtccttgttttcccccaggccctagaacagtgctgaacatgaaagacgtcttgtaaaccttcacaaattaaatggaactgtatactaaataaatattcatggacctccaaagaacagtgtctggctgtgtgactgcacacaggtcacttatttcctctgaccctgcctctttatttatcaaatgggtaaggtacaaaagtgctttgcaaatacaaggacttattttccagtatccacaaagaattttagtcctgggggagaagtggatttatcacagccagctttctggttttaacctggcaatcaatctaaaattagtttcaattttaaaaagtttactttagtgacaattttttttattctgacctgggttggttttcagtttaatttggtggttattccagtatcatgtataaactgccattgatttctgataacacgtagcaattacttaatgctgcagacttgatttaccaggtaaggcaaatgtgttggagtgaggtgttggtgagatgcctgctagaggatagatttaaaagcatacatacaattttaatttccggtctggactctgccaagtttatttcccttccactgtcctcctagtgggcagttactttgcaccattcgccttttaccccttctctaccaattctattcagggtcccccacatgttcatgaatgacatttttaacagtctcccctacatgccattgccatctgtgggctcccttcaattcctaggatgtaggctctatgatttctcccctgagtcatcccaccgtccttccctaggtgtctccctactccagtccctcccaagtccccaccatccatcctcccagcaagagtcaacctctttatttacaaacacagcctgtcactcctccatccaataaccttgaagggctccccagtacccaaagaagagcctcttcaaaaattttaaaggaatacttaatgccctctgttactgggcctcaagctatgtttacaaccttaccactgccccattgtgtgtgcccattgaatggaatactcgctggtcaccagataccctctattcgtttacttttgctcctgctgttttctaagtgttaaagtgcacttactcctcacagagttagctaaaatgctaccttttcttcggaccctttcttaattgctctcacatggagtaggctctcccgcccatttgaatacctgttaagactctattcatgttttgctaaacttttttgccttatgctatagctgtgtgtatatgtatgtgtgtggtgtgtaccaaaagaaagtcttgggatggcagaggtggggtcttattcatctacgtctccacccagtggccagagcggtatccagtgcatacaggaaactcaaaacctatttattgaaataaaaggaagtaacactcagatcaagagaaccttcctctaaaggcaacaataaattatttggttctgcattcacaacctatagaaaaaaaaaaagtgatctgtgccttctaatttacatgatttttctcctaatacaccatgttctttcttctcacattatttaattcaatacttattggttgagtgccatgaactattttaggccctaaataattcatagtcctggccttcaaggaacttgctatctattctccagagtttattattatagttgaaaaatcacatctcagaaagagaagctatttgctccaggtcatgtagtcagaaaagttaagaataggatagtctaattttagagcccccccccccttttttttttaatcaaaatgcaaggtaattaggtatttttataaatattaagaacatattggaagctgttgctgaaactcttttcagatattacacgtgctattattttttaaaaaaacctttttacccacatataaacacaatgtatagttaagaggcaagatatactctttttacttgctaagagtctggcaataattaccatagtgagcaagtcagatgactggacattcacttctgcatctttatctttcagtgttgatgttttagctttgagatagttaaaaacttttgcaaagtgaaacctgcaagctcaacggtatgactgtaggcctattactacagagtcagatgaaaggaagtcctatagtgaatcagaatttattctttaataattcccaaagtagaaatgggttgagctaaattttctgaataatacttaccttgaattaatgatgaaaagaagatttaacaaaagctcagtgttatctgataaaactatacttgttatttatattacataaccacatattatacaactcctatttatattactttagtcttaccatcagtacttgaatggatagaattagctatgctactaacatctggaattagttcatatgtaaaaatcttctaaagaatcaattattttgatttgcttgcacaataacaatatgtaatgcagggcccagctctgccacttactagctgtaggagcttgggtaatttatctatcctttcttaacttcagttttctcatctgcaaaacgggcatatttataatatttacctcacagggttactgttaggagcaaatgagcaatggttataaaaataatatgtagaaaataacaaatctacagatgttcagaataactggtatcctaaatgagatgcaatggttctccaaagcagtaagcactgatcaagtgtgttcttctagaaattcctgtaggtagctacacaagatagcagagaactcagaaaccatctggatttgcagccaatggcaggggcagggggcggggtttagaatcagtcctgctgccaagctccatcttcctgcccattagagtcagccagtggtaacttctctccccaactaaacaagcacaaggtcaaaaacaccgtatgcaaatgcacacagggcagttttggcaactctcccttcttcctctgtgcaaaaggagatttggaatctaaagaaaagagtagtgttaggaagttgctcattctagccttataagggtgagagtttaagaggtatgtgcttgtgggtaggggtgggcaaaagatagactaatatttcttagtactttacatatattgtatcttttaatatgatttctattttcacatattaggcttagataagttatgataattgataggagttggttattctgtctgattccaaacttttccactgtgcctgtgtatctcaaattagtagcatgcctaacaaaatctctggggagcttgttaaaatgcagctttcctgcccccatctccagagattctgatcctgcaggacaggggttgagcctgctcacctccatttttaataagcacctcagctgattctgatgtagatgctgcaggatacactttttttttttcctgctgaaaattttctggtttcttctctccacagctactctatggtcctgggtcaggtcttttccatgtcttacctgaattactgaaatggatccctgccctctggggctgcctccctctggaaatttatttcacaccacagcaaaatgatctgctaaattctaatctaacctctgctgaattcctcccaaggctttccactgccctcaagatggaggaccttcatgacctggtttccaacttctctgcgttatctctggacacttgaagctttgtacttatgctttgcacttacgtaatattaagcttccttggcttccctgagcacaccgggctgtttcctgatttctgccaacaacactcttttcatctttttacacctgattagattttactgattcttcaaggctcattttgaacgatatctcttttagaaactgaaatatattgtaaacatgagtatgtgtgtgtgtgcactgtgaacagatttttcagttataaattataatacattttgtatataaggttgcagattaacttgacagtttcaatggcagtgctttgtggacccaagtggcagaaatgcctgtgcacaaaaatacataaggaatgtagtttattctccacgccattccacagaatagcagtttcgtcatcagcaacttgagacaaatagactatgaggaatacataaaataatatgaactttttcatcccaaaatgttccttgagttccatcggctttcagggtttacataggacacaccttaacatgtctcagacatggagacttgactggggtttcctctgagaaccattttcagaaaagccactagcacatcttgatcagacagttatctgtgtgctggctcaggtggttctcagtggacaagggaactcaaggtttggatagatgtgattatcacattcaaaagaaaacataacaagttataaagtgtctccacgttgggctattgaagctgcaaaattccctggacatatgcctatctttgttctttatacataaaaatataagaccagttaaaaccacactgcatgcagtatagggaaagaatccgagaggaaaggtgagccaggaagaccagtgaggaaggtgttagaaggcttggaataagaaaagtaataacaaagacatcaaagagtagcctcttctgagtttattcaccttgagggcaaagcctgccttcctgatgccccctggagtgcagcagtatggctctccttccacctctcctccatggatctgtagatcacctctggacatttgagatctttgcctggctctggccattccaagaccggctccattaaagagctttctttcgagggcagtaatgacatttcttttgtcaaaatgtcactttgaagctgtgacaaaatcaatccctataactcactctggtgaagcaaataaaattcccatcttgctaacgaaatactgactgtcacattgattttttgataagtgacacaatagtaggctctgctaccagctctttgtgtgtcctagagaaatgagtctcagtttcttcatttgtaaattaagtcaatggccatatggaaagttctaagaatctatgaaatagaaatgagatttctcaatgccagctgcagtttgattttgggagtttgctatcaacctatccctgtagcttctgccccatcccctctctcataatcaacatctgctcttaaagggagcgtaaggctttggaaaaggaaatagaatattactaggaacagtcgggacaaatgtccaaggatgatagtcctctctgatctctttagaaatggtttcctattttgctttcctattgccacttttgagttcaggttttcagaatcttacacccagaatactgtaatagctttctcaaacatttcctattgccagtctctctcctccaacctttccttcccacagctgccagactgatctctcagaaacccacttctgaacattccattccctttgctctatgtgttgagtagctagtatgtttaaggtagacatcgtgctaggtgctggggcatacagatgagtagattcagatctttgcctagaaggacctcataatgcagcctgtataggcagtgatataggtaccttcagggcattagcccagagaaaatcaacctggtctggttggtcacaacccttaaaattctttattgcttacaggataaagtataagtttcctggaaaattttaggcatcaaaactgacttgagtctaactttccagttctgattcttttcattctccttcacaaattgttccctgtaatgaaagtgaaccatgttttatttcatacttattctgtatcttactcctaaccccagtccctattttcctaatccttcaacgccccctaattcaagctggaatctccttttctgcactgaaaacgtgttttctgcccttctcctttggtattaatcacttcctccctgtagacactcattctgtcccccagaagacctgctccgtcaggaaagtgaccatgatttatttgtctttacacctccacattacttatcaagctgccttgtattggatctaataaaggtttattaaataaatgaatgaagtcattcagcaagacttgttccctcattttattttagcaggccacagtgagaaagtgtgtatatctgagctcactttagaatgttctccttcagaaagatgtgcatcatctaggaaaaccagcttctcctcaggatttaagtttatgcccaagttaggttttgacaaagctaaacccagttcaatttacttctttatttttcttaaattgcacaagtgttacatgatgtcaataaaaaagaaagcatgctatagtaagcagattgtgaactttggaatcagtcagacatgaatttttcttcacctctctaagcctcagtttctttaaatctataaagaggaaataaatgatttcctttgaagtcttgtggtgattaagagatgtatgtatgccgggcattgtgggattccagcactttgggaggccaaggcaggaggattccttgagcccaagagtttgagaccagcctgggcaacagagagagaccttgtctctacaattttttttttaaaagagaggtgtatgtaaactgtctgggtttttataatggctactcatattacttcaaataacaactatcatctctgttctgtcccagcccaaggataaataggatgatttatttgtttataccataccttactttagaaagggtttacaacataaaagagacacacattgcacgttgctgacatatagtaaggatactgatagctctctcatactctctcttacatatatttccctttcttaaattatagacttaaaaaagaagtttggcataaatcactaaatagtcattgatttttcagtgcagaacagcttgactctgaagattatgcaatttcctaaacctctcaataagtaacagaatggctggttaacggtgaaattgatttaaaaaaaggtagaaggacaataaaagaaattaaggggtgcttaagttttcaccagaggctggtttgactagagactcattagaaatttaatagacattcccaggggagcttgactgcattgctatctggggcactgagatgggtcttagggagacctatccaaatagatggctgtttgaagtttagggatctgcataggttggacttatctaggctactgacacaatagcccacttttctttgcatgtgtagacatagactttgtaaaggcacacagagtggatagaaatcctgggtatttcatttgtagcagatgagcactttcaaatgaagaacctcagatttcttcatgtatactttcaaaatccaataagcttctaacctgatagccaggccttccatacaagctttctggcctttctgaccttctttgtcaacctcatttgctacaattcccaccatgacctttgcacactggtgtccttgacttgcttaaccctattccaacatgtctgcaatttccactatcgtgttcatgctttttcctatgtatgtggcaaactcctactgaaaatttaagatctcattcaaatattgcctctttgaagccttctcttttacctaaggcatatttgtaatgctttacttcctctggcttcaacagaatcatgtatagtgtagagtaatggaaagggcaggcttctgttgtcaaaatgatctcaacctgatgcttgcacctactaactgtgtgatcttaggcaagctagttaatcctcctgaggctcaggctcctgatttttaaaataaagactgttcattccctaaattgatggaaaacattagtgatgctgtattatcattgtttgcctgcttatatttctctttttgagcctgcctggtgttttgcagcactcggtgttattgcaatcaatgaagagttctggaaaagtaactcaagcactgacagtcacattaaagtccaagttcatctataaagtgctctctggttattcctgcaacctttaatttaaattcttatagctcgtgtacatactactaataaggctcttgtcacagcctgctttcacagatactaatttaatctaagctcctccagggcagtaaccttggctttcactctgggctcctcaggacatttcacaatgctctgaaaatgccagctaatgataaggttatttaaaacaccctattatccttctcattccagacaattttcctcctcactttatgctgaatttatcccaaggtcccagagaatgaggcccctgcatcaatgacttattcctgtagtccttgcctttaattcaaagtgagtggcatctcctgacccagctttcccaactctccacatagttgttctctcctttcctcagtgcattttatctcttgctaatggttctttgctttctacttctggacaagtcttcttattgacgtattttctcataaagatttgaaaaactttgatttattaccaattaatgcatgagtaaatcttatggagagttactaacgtaaggcaccttaaaaaatcattgaatccagtaactgcaaatagagaataattcccaatgttgtgctagagatgactcaatcatggcactctttttttttttctgaaatcatttatggcctcagaatcctttttcaaaacaatactccagatataaactatcaatccattagtctacacaggagatgaaacttgtttgacatccctgatgtagtttaaaggttttattttggtaataaggcccaaagaacaacagtgacttagtagtgagctgaaaccagaacccaggttactgaccctcctgattttccattcagggcttcccttcccagatgattactcctttctttcaatagcgaagtcctataatttacaacctattcattggcaaatacctaatggtgtttaacatgtataattagaaagcacatcatatatatttcagccttactgaaaagacatctggcctctcactgatgttaggagctcttggggaaaagggcccatgttagactttgtgtccttctaaagttctagtcctgtttctggcacatggtaggtattcagtaaaaatcctctcacatatatccaactctatctgtctgtctgtctgtctatctatctatctatctatccatctatctcaaacaaataagaggtctatccttaaattctcaccaggaatcatggaaaaaaaacctacctcttgtatacaagtagtatttgtttgaaaggactttatgtcatgatgtcacataccctcacttctatgtagaatgacatcctatgtttcaataaattttcatttcatttgaatattttaggggagggtaaattattatgtcaatgactgggctcccttatgattctagaaatagaaagggcagtgctatgattcgggcctcaaaatccctgagaaattatagcttttttttttcttgtttttcatggtgacagcaattgaccataacttgtgattctgtatgatattcacaagctacaattgctaggatagaaagacgaaagaaaggatatgaagaaaaagagaacgggaagagagaagatgggaaagttattttacaacacagcaataagatacagtattatctcttcaaagaatagatttaaaaaatctatacaagccacagctaacatcacacttcatggcgaaagaccgaatgcatttctgttaatgtcaggaacaagacaaaaatgtctgctcttgccatttctaacattatactgaaggttctagctggtgcaattaagcaaggaaaaaaggcatccatatttgaaggaaagaagcaaaactctctctttttgcatgtatatcttgtatatagaaaactctgaggaattcactagaaaactgtggctttagcaaggttgcaggatataagattggtctataaataattatatttatgtacatttgcaatgaacaatccaaaaatgaaattaagaagacaattcatatgcaaaagaatgaaatcagaaccctaactcatacaacgtacaaatactaactcaacatggatcaaccacctaaatgtaagagctaaaattataaaactcttagaagaaaatatgatataaatcttcatgactttcattaggcaatggtttcttagatatgacaccaaaagcaaaaataacaaaagaaaaaatacacacattagacttcaccaaaattagaaccttttgtgtaccaaagaacactatcaagaaaatgaagacaacccacagagtgggacaaaatattgcaaagcatatatatctcataaaggtttaataacccaactatataaagaacttctgcaactcaacaataacaagacaacccaatttaaaaatgggcaaaggatctcaataaacatttctccaaataatatatacaaatggccaataagcacatgaaaatatgctcaatatcaacagtcattaaggaaatgaaaatcaaaaccagcatgagataccacttcgtaccaactaagatggctgtaatcagaaagacatataataacaaggatatggagaaattgggaccctcatgcattgttgtggaaatgtaaaatggtgcaaccactttggaaaacagcctgtcagttcctcaaaatgttaagcatagagttactatatgacccaacaatctcactcctaggcatacagccaatggaaataaaaatatatgtcacagaaaagtttgtacacaaatgctcacagcagcattatccataataactaaaaattggaaacaattgaaatgtccatcaactgataaatgaacagattaaatgtggcatatccatataatggaatattatttggcaataagaagaaatgaagtacttacacattctacaacacaaacacgtcttgaaaacaatgtaagtgaaaaaagcagccacaaaagaccacatggtgtataatttcatttatataaaataaccaggataggcaaatccatagggacaaaaagtagattagtggttgcctatgttggggtgggagggtggggaaatgggaggtgactgtcaatgcatatagggtttctttatggagtgatgaaatgctctaaaattgattgtggtgatggttgaataattctaaatatactaaaaaccactggattgtattttttaagtggttgagttacattgtatgcaaattttatcttataaagctattattttaaaaacatgtacacatgtatatgtgagtaaatattctaattttgatggctaaattttagtcattaattctcttctatgtctgtcacaacaatccgtgtattcattagataatccatgtttctatgactactgtcttagcttcataatgtgaaacagactagatatattttctgatgagcagatactttttataaaatccatcattttagaacattaatttaaaaggaaaaaacttaaagaaacaaaaaccacctaaactatcttgttcttcttcattgtagtcattacatcaccttcatcaacacactgcttctgctaaccacttgcagctttactcccagtgtttaaatatatttaccataaatccatttcatcagaaatcacattattaacttcagcaatatatttataacagtgctctactgtctggtaccttcataatttgtttgctactgaaagcctaaatgtgttaattatagttaaatccatggcaactgagagaacttgatgtttccatcattttgtacctacccctttcgaatcaatcactccaggtttggcattaaacttcactgtcttcaatcgggcacgttcctttctttccaccctaaagcaaattgagaataaagagtctctcacgtgacaaggcatttatgactaagttccatattaagtgaagaacattttttcctcctatccttgaagctcaaataaaatgtgttctaaaatatttctcttcctttgttccatataaaaaatcttggtacaaagtctctaagtttctaacatgtcccttgaaattactccgatacgtatactgagagtcacgtcatggtatttgtaagcaacagagaggtagaaaaaaataatatttgctatttaaatgcttaaataattaaatcaaaatctatttcaaatctcagttcataaagatgaacacctatattggagactaaacaagtttctcctcccctctcctcttctctcctccctttttcttctttgtttttccttctcttccccttaagaacactagtgtatttagcttcactttttaaccaaacatgttatatataatcttgagctttccttttccccaatgtccttctgtcatctctgcagattcattgttttcctgctacctcatttattcattaaacacttagtgactgcctaccatgtatcaagcaaggagctgggggacaaagaaaaaatattctaaaagcatgactgcaatgaattcttagcaagaatgaatttggcaagaacagtggtgtaaacaaacacagaaaatgctgtagaacaagatggctgatatcaatgtgggagcacctatctcactgggagggtgcaaaggaggagtagaaagcattaggatgggcttcttggaggaaatatcaatgtatctgagattgaaggattagaaagagtttgtcagtagggaaatttcagggggatttttcacagaaggaacaacacattcctcaacctgaagatatgagtgagctacaagattgcagaaagattctagtacagggtacataggggatatataggatagggcagtgaggctagcgaggtgacagactccttataatgggtattcatccacattaaggacttgagtttttttccttgggaatcatcataagctcttagaggatatgaagcagtgaagtgataaaatcagatcagcatttaaataaacaaccctggtcgaggtggaagatagactgaaggagggaaggagcagaaggaagctgggggcctatttagaagctgttgccatagtccaggtgagaaataatgagaaatgatagtggggtggagaagagggaaaggcttgagaaatattaggaaaataaaattgggtggactcccgcctgtttgaaggccagggttgaaaaagtggaaaataatctaaatatttccttgattcttctgagcccctccagtcagacatgattgctcctttgtaactggaacagtctccatgtcagcactacctcttgatttccttgtgtttacttacatttgcactgcatatacagggttgtatgtaccttaaggtaaaagcccacttatcacttgatggtgttttatagcaagtcctcaataaataattgtccagcaaaaataatattcattgcattgttttaacatgacttcttgtttaaatattgctagctttaaatttaaagatgtgggggaaaaaagagaaagaaaaaacccgaacctacagaaacttaatagtttatggagtctaagctattcatagatcaataattaacagcacactcctttctaactgagagctcttttgtgttcccaactgaaacacagtgaagatcagggtttctatagttacagaatggaattgcagaatatatttatttcagtgtgagagtagaatatctgagtggaaacagctgaacaaaatttttcaactctaacgtaatatattaaaacaatgtaaggccgggtgcggtggctcacgcctgtaatcccagcactttaggaggctgaggcaggtgtgtatcacctgaggtcaggagttcgagacccgcctggccaacagggtgaaaccctgtttctactaaaaatacaaaaacaaaaattaaccgggtgtgttggcggacacctgtaatcccagctacgcgggaggctgaggcaggagagtcacttgaacccgggaggtggaggttgcagtgagcctagatcatgctattgcactctagcctgggtgacacagcgagacttcgtctcccccaaaagtaaataaatataaataaataaataataagtaaaacaatgtgttccaccaagagtttctacttgcaccaggcatacaacagttggggagaaagcaagacagatttcagataagataagctgccaagtggaaaatgctcactgataaaatgcctcctttgagcttcatcacttcatcaccttttctcgattttaatccaagggcaaatgataatttatattgatctctttgtattcttctaaaactgttgttacagccctaactttatttcagcttctttgcattaactgggctatagtcaatgctttggcatcattcaatgatgccaaaatggctgtagtatgcagagaatacatggttatttgatcagggtatgcaaataaattctgcataaacccacagaactcacacaggttccaaacatacagaatgtcaggaggaactcagtattcaactctcagaactgtttggacagagcattctaatactgtcccctgccctgcaccccaaccccatttctatgtttatccttttcaattttcttgagaaatgtctctgttaggaagattttaatggttcatcccttaaatcttaaaatggttgcaaagaatattaagtcagccagacacacacacagacacacacacatacactcacctaccatttgctatagtttattattaatcttcaaatgggtaatagagaaagtaaaaaaaaaaaattgaagccatatggaggtcacatacttccagttcacccatgaaggaagttgaaaagctttgcttcctatttgggttgaaagtttcattaataataatataagtggctgctgaagttgcaacatataattattaataaagttccttcacatttacatcatctcatttggtccccacaacaacctaaggatttaggtattatcaatctcattttataactgaagaaactgagacttgaagcttgccagatcagaaactggtagaaacagagcctgaacatacattctctgacagctaacttcagtgtctgtccacagccactcagtttgggaaacagcattcaggtacctcccaagcctgcattatccaaattctcaacaaacgtgagatttttggagcagcttccacagtatgaaggcacatacatatccttagaagtctaggctgaggttttcacaaatgataaccaatgtacccttgcatccccatctccctaatgtcctgaatgctatgaatattattaattattaaataaaccacaaccaaatttaagcatacaatcgagttagtagcataccacaagaagttgacctcaaaattcagaataaatttactttaaacatggaaatctgcttagttaaatccctatttgagttgatccatctcctcagcacaccagcaaccctaatagtgcattcccatcacagaggcttgcagtactgcttcttggggttctctgcaaacctctttccttgagagggaggctatgtctgtggcttagcttcctcatctgcctcagccctttcctctctcctagctctttctgggatgcatgtgaatgatttactgttgaaatgagagttaagtctggaaaataggggtctaaataacgtggtgtttttttttttttttctggcaactaaagctcaaattttgaaaaatggaaaacagctattattggaatgtacactaagttttagaaactgtgctaagcacttcacctataatagctataatccaggggttgacatgagctgggtacatagtagatgcttaatgagactttgttgaatgagtaaataaataaactctcaagggggctactagttctttacctaattgtgaaaacaatcaggtcagggagtttaagtgaattgctgaacaaccagtttttcccataaaaagtgatttgccatttcacaacttactttcccggtaagaatctaggtaaaagtctagcatcactttttcttattgttttactgagtaagacttctttggctagtaaatattaaggtccaaaggctttcacctaaagaaattgtggaccacctgaagagacagaccaaatctcaatgacaacaactgccttccttccccactcacacttagactcaagcaattaattagattgtttgagcagaaataatcctccctgtccaagtctcatcactgaccaaaataccaaaaacataaatggaatggcaaaatttgagcaatcaattctgacatttcacatctctagagagcaccaaatggccatgctttaataagcccaactgtcttcctctccctctctcccatctggtatttttaggttctggccaaacccataattgggtcaggcttggagcattggacagtgggaacatcatttgtccttcggagttcctatccctatgctccacaggtcctgttggagggagaattagaatgtcacccacattagtggccacaggcttgctgtgacagctaggtgagtaaactcttatataatgccagccatatgctgccatctgagagcccaagtgaccagtcactagggaacaatgaataatctctttggcttaagagagcatgggacagccaggcgcggtggcttatgcctgtaatcccagcattttgggaggccgaggcgggcagatcaccagagatcaagagtttgagaccagcctggccaatgtggtgaaatctcgtctctcctaaaaatacaaaaattagccaggcatggtggtgggcatctgtaatcccagctactcaggaggctgaggcaggaggatagcttgaacccgggaggtggaggttgcagtgagttgggattgtactccggcctaggcaacgaaagtgagactctgtctcaaaaaaaaaaaaaaaaaaaaaaaaaaaagagagagagagataccatggaacaaaacccagcttggcctcttatacactacataatctcagaaaagtgattctatgctaagagtccagattttaaagtcacacaagcctgggtttgaattctgcctcttccacttactaggtctataatttagggtggtcctcaacctcttaggatttcagattttgtgttgatacaattagaatagtagcgcagacttcaaaaatttataatgaatgttaaatgagataatacaagaaaattgtttagcacaatgtctgatctatagtaataactcactatacaaaaggctgctacaaagatgattatgataacgctgcccataatgtcacttctcattactggtcccagtttccttacttgtaaaaaggaagtaatacaggtaccctacttcaggtgctcactgccaagtcagtccctttatgctaggtgggagcaagacatggacttccatttttctctcttaaaagaccctgccaccagacttgagagctgtagggccaagaagagccccaaacctttgcagttgctcatagagacatcagaaaggcatgtgtttgaatctaggcttagccctctgctgccactgtaattttggcaagctacttgaattatctgactttctatttccttccttggcatatgctcctagggtagtttgttcctggtgtagtgtaaagccacctggctttgctatcaaagagactggtgtttggtcagtggctggctgtgtatttttgggtaagttactcgacttctctgatcctcagtttccttatgaggtttttgtgtagattaaattgaaatgatgtatttgaaagcacctggtgcaatacatgatcagtgctgttatcagatggaattcactctctgtctgctgccgtttcactttcctggcctttacaatatagcctgcattgccctaatcgcagagtagctgtgccacagttacatgttggtcccacaagtgatgggctccaggtagtgaaccaacaatagtacgtggcactcagatgctgcccaagcaatgcttgctgaattgaattttgctagctcttatttttgtatctgtagggggcaagatttcatatgtcttaagtgcaattctgtagcctggattcaaattccagttctgccacttactacacgggcaatttcaggcacattaatgaacctctctgtgcctcaatctcctcatttgtaaaataaggataataacagcaacttactcatagggttctaatgaggtttaaataaattaataattgtaaagggcttacaacagtgtctagcgtgcaacaggaatgttttgttcaataaaatttattcaccatcttcagaaaaaaggagggggaaggtgataatattcatactcttcatctcatggtttcatttgggatgattaaatgacattatcaatagagaaacatttttgaaaaggatataaagtcatacactgatgttatccattataagatttaaaaaattttccagatcagcactactaggtaaattatactcaagaaacaggctagaaagaaattaatgattgaaaaataacatcaacctaataaatgtacgtttttaaattacattaaaataagtacatgggtactctttgtggggtagaattgtaagtgatttttatgtttttctaaatgttcccacctttctacaataaaaggtattacttttacaaatacttaaaggaataaaagtaactattttgaaaataattaaaatcctaaaaagaaaatttggcagaaatgtatttacagctatacattatatgtatataatatatattatatatatgaggtggagctactgcacccttcataaaaagtagaatgtaaataaatatcaaccttgcagtcactaatcaaacttattttccaggtcagctatactctggttgttaagatggttctcttccaaaataagagagaaatagctaattcaagaatgattaccagcaggtggaaaattattcaggaggaatagcattgagaatgttcttctggagaaaaatgatgagctaattgaacaaacaaatgacttgataagattggttagaatcatagaacctcagggttggaaagagtcagaaaactgtatagttcaacccctgtatccaaaatttgaatcccttttctatcttcccagatagtccatgccatctttaggcagctccaactagtgagaggatttctttaaaatgacctgacatctatttccgcatagctttccttcctccaccccattactatctttggggccataattcaacaagatggctctttcttctagagaacagctcttcagacagctcaaaataattaaatcaaagcaaaccaaaatgcacgttgtcttgacattttatttgaagtaaatggaaatggagagacccggaatataaacaagccagtgctgagtcaatgctttaaacatgtaacctttcagaaaacacacacagccattctacagtcagaatgccctggaaaagcaatgttaggcaattatccaggagccaagaggcttaaagaaacccagagaactctgctggtgggagatctataggcactggcatgggggagggagaggctccctggaatttcggcaccttcactgtgactcctcctggctaaaggtaagagaacagctgaggaccagtgagccctctgctttccatgtcccattctttcccaggctgtgcgaccacaggcagagagaagagaggatcagttgtctcgggagcacaaataccccacagagttattctgaggtttaagttccatctccccattatggtttgtactagctcaatcacttgatgtgtagtagcacttgaatgcccagcttcactgggaatattttacaaaggcattttgggtgtttggagatgaggatcaaagccctttgagaaatctgcagcttgagaaaagctagtgcctgcttttattaagcataattcctgactgattttgtactatatctagtctctgggatacagccaatttctgtttcttggacatcttggtgccaaagggacatttgtgagaaggaaagttcctgtctggtgatggatctgctgggacagattaaggagttggctgttctgaagcacatttctgcttttcaaaagcagagctgaagaaatgcttggaagagaaagcatgatactcttgatttaggaaacacttacacagaactaaatatcttggtggctattggaagttgtgaggtggggaacaagagtaaagaaaacagtaaaaaaagaaaaaaaattgtaaacccagtccttagacctcaccagatgtttgacagctcacatcccaagcacctgaatttgagatgaaggttttccatttttttctactaatatttggagatatcacacagccaggaccttagcctagtaaattgcctacttcatttgccttcgacttggcctttctataacattcattggtaaatgttgaaactctggaaataaatggactgaatttgtaagtcggcatatgagctgataagcacaagtttgcacatgcacacactggtaaaagttttaggaacacagtgtaagctgatcctctttcttcctttatttcttgtcacagtcaccaattttggtaaaaccctaatataggaaaaagaggatttttaattcatgtcacctgtcaccactgacaattttcctgcagattgactatcccatttaaataaatttaattttgtgaacagtttctcccaccttcttcttccctcatctccactcgctggatagctgacaagcaaatattctagtacaaaaggcattcttacctccttttgctggggatgacccccatctcctcactgtctccctccagcatgactctcctggcttgccaccactcatcatcagaggcattgataacgtggagaatatctccatatttaaaactaagtccttgacttggcagcccactgtccttgctcttgtcgtagtcgaacatggctctggaggaaaggacaaaagaggacattgttaggaatctctggcagcacagatttaggatttatggtttcaaatgtttgctcttgctctgagaacctatcatcacttgatatcaactcccggaatgattccctggatcacagtccacactctcactgctttggcaacacactaaagttagttcttgcttcttcttggaggttacaggggtggcctatagattcccccaaactgagatctgcttcttttcttggagaccatcagatgttagaaggtgataatagaagataagaaaggtactttactacctagttgagatttttttcccctcccattacaatcaaatttttaaaattactaaaaaaagtaaaataataaagagaaacatggctatatttctaaatgaagcattttgtactgtaaacaaatcatctcagatgtatcagcctgtagaactgtttcttttataatgggaaaaaatggtaacaaatgtccacccatagtaggcggtgattcctccactcaatgaaatattggaccaccactgcaactggatgaagaggttaatgtaatcacctgaatacatgcttaaaatgcagtaaattaaaaaatctatgcgtatgtgtgtgtatggatagacaaaaatcatataaacaacacgacaaatatttgtgcttccatacgatgcctagcttacctcatcatggcacttatctgtgaattacaattgctttctgtatcatgctgcccccactaaaaagcatttgctaagcatttgttaaggccaatgcactgtaatatgtatgagtggcagcatgagggaggtggaatcagaatcaaaatgatgaaccagaccttagaaactagctgtcatcattaagaggtgaacatttgccaccactcctatattgtccacatcctgctgtatatcccattttcaaaaatcaccaccccacacatacagcatatgactttcccagagaagcagatttcactacctgtctatctattcccctttgatttcattctaagaatttccttagagtataaccactatgtatgcaaaactagcaagatctggggaacagatttttctaaaaaatttgttttattttagatttttccacactgaggaccaagtgtggtttcttcttcttttttttgcccatcaaagaaatgtcacatctgctgccatggcaacaagaaagagctgaagacagcatctagagctctcaaacacagcaggaaaagtataattaattgcaacgtagtcccttctttcattaacactgtctcccagagatggaatttggagagggtttcttggtccaagctcccggaatgaatcattttcaccttgaccacccctgccaaaggctcagacaaagtaccagtcaggaacagggagctggggaaaggccaatgcccactcctgaagctatcacttctttgatcctgtgatgtgacatatattagttaacattcttgagccacaggttttttgatgcaaaattagtctagtaacaacattcacctagatttactgtgatccttaatgaaataacacatatgcagcattaagcctatagtatgtgcagtctagtgtattacagtgtggttatgaatatggactactgggtccatgtcctgctcctactatgtcttagtcttacagctagtcagctgggcaagttacttagtctctttcaggcttcagtttcctcatatacaacatagtgataatgatgacaatgatgatagcaatacctccattatggagttgctgtatgggtaaaatgttacataaggtaatatatataaagcatgtacaaatggacctggcacacagtgacaaatagtaagtatgaactaatgttattattattatctccctttttccttttgggtagaggctaatacaaatcttttctatagattctactctgtgcaaaaaggagttaatgtagcaggcctgagactgctgttcttgcttgtaagggtggcccttggctgacatctggaaagttagattttgggagggttcccaccattttctcataagaatggcttactgtgcctaaactgtttgtacaaacaatatcatttatactgaacacctgctttctttctgggagtctgatattctggtatgtgctaggcagaggctgcctacatgaccagcccccagtaaacctggacattgagtctctaataagattccctggtagataacatttcgcacctgttgtcgcaatttgttgctggaagaattaggcacttcctgtgtgacactactgagagaggactctcggaaacttgcagctaattttttccagactttgtcctatggtcctgctcccttatctgacagtttcatatctttttgtggtaataaatcataatcatgagcatgatcatgctgagtcctgtgaactatcctagtgagtcatcaacctgggagttgtcttggggaaccccaacacactctctatagattgcaaagcattttcacaaaagttaccttattgtgactcaatcagttgctgtgaagaaggtatgacagacatagtactatcctccccacttttttttgttgttgttaaaagatgagggacagatctagtggggcccactgactaactccagaatatatagcttagtggcagcaacctaggaccagaacttgggtctccagatccaagtctagttcagtgctcttcaccttgccccctcattcatcctgggaggtggtgatgataaggtgttgaagatgataaccatgatggctactactacttacgcccttattaggtggtctggcacttcatagtcatcgtcttatttgatgtcacagcaaccctaaaggtaaaaattagtatccccactttatagatgagggaaggaggctcaggaagttaaggagcctggcccaggtcacacatacacatgtggtggaggttgaatataaaatgaggtgtatctgactccaaaatctgcttccttagccattttattatgtggctcaatttccccacttgttgccctctggccatgctcacgatctagcagtgccaaagacttttaaccttcccttcagggctgacaactgcttcttccctaaattcctgaaactcccttactgctcagtccttgtccaagtatttcttatccccaaagtccttgaactgctggcctgactccaggctccttctggatgtaaactatggggagttgaggtagagaaaccatcagaaaggctaacaagtagtagccaaggaggcaggctctggagccagactgcctaggtttgcagttttttaactatgtgatcttaggcaagttacttaacccctctgggcctcagattttcttaactgtaaaactggcataaatcataacaccatctatctcaaaagagttatggtgaggattaaatgaaataatatatgtaaagtattgtaacactagcctggcactagtgagggctcaataaatgtaagatattattataataactgttattctgaaaaatatattagaatttgaatcaggggatctgtgtgccaattgtgccacttaaaagctgttttctggactatgtgaaagacatctaaaatatctctgtatcctcaggacctggtagtgtgccggacccaaagtagaccctcaatacaggtctgtgaaaatgtttcaggtgacttttgaaagcccgtcttctttcatgtctctgcattcccatttgaagtgggggtgggactattcctggaggtccctaccaggtcagacattcactcgcctgtgttcttctattcccaagagtccttaaggggaactttcccactcctgctgttagctgcaggtgtccttcctgaggagctcagcaacaggttctttccacgagctctattgatcttggacaatctgcccctctaggattacatttattcagacttgtcaggtccctaaaaccaagcagctgacacatttcagcagcttctggctcctttggatattaatggatcctcacatctgggaaaaatgctacagtgccccatcacctaatttaacaagcgataagctgtttttaatttgctttatgtgttaattcatcacagcaacttttataaaatgccattaagactcacactttccatccagggtgcttttagcaaggccattagacaaatagaattggacatgaataatgtaacaactctcccatccctcctacccctcctgaatttcaatgtgtggtggccccttgccaactggggaagtctagtaagggaagagtgaagcagctgctcatcctcatgactatgcaacatggctgtgagatacctgggtaccctaacaaaatagtgctttttaggtgtcgcacaatgtagtaagcattttatattcattgtctcactcaatttattgggtaggcaacatagcatatgggttatatgccaggcttccaagacagaggagagctgggtttatgtcccagttctgccattcttaactgtataatttgggcatgttacttaacctcttagataaccactttaccatagatggccattctcttatttaggaaattcagatagtaatggcactaacgcaaaagggtgctgcggagatacgacaatgggatgacacatgtaaagtacccaacacaggtgagttcctctttgttattatttctgacaacaattctgccatgtaagcatttttggtctcataaagaaaatgagatataaagagctgaaatgaaaataagatactaagtagcagaaccaggattaaagtataggtagatgtgtctcactcaaaagctcatgttcctaatcttagaattcttggaattcctgataagaaatgttgtacttagatcttatacctaaggatttcatgatttgatgataacacttatagtgatactatggactagcctgcaaaaaagatgcatgagtagtttttagaggacacattcaattctcacagctatcctgcagtgcatatattagccttgtattatagaagaggaaatacagatttggataatttaaacaacatgttcaatgtcatgccatctatcaagtgatggggcaggactcaaagcctgtctgcttctaagacctatgaatttcctacgataccaacctctatgctcttttgcaagcaactctttccagctcaaaacactcacactctccacttggcttagactgaggtaatatttaacaatcatggaccttaaaagtattggtgtttactatgtagaccagggaatttagttttggctataccactttaaagctaggatagcagcgaatgatgaggatggaaagacagtatcactaagaataggaaaaattatttgatgtgtttcatagttaacaaggatatgataggagaaataatatccttaactcactcccccaaaatgtccacactttaattctcagagtctatgaatatgttatcttatatagcaaaagggacttggagatgtgattaaggttaaggatcttgagaaggggagattatcctggattatccgggtggacacaatctaattacatgaatccttagaagtggaagaggaagacaaaagaatggatcagagagatatgacttgggaaggacttgacccaccactgctggcttcaaagttagaggaagaggaccacaagccaaggaaaatggtggccttttacaaactgggaatggttattaggttacagccatcaagaaaacaggcaccttagtcctacaaccatatgatgacctgaatgagcagaaaacaattctcctattgagcctctagaagggttacagactgctgaaagctttattttagtctggtgagatctgtaccagacctacagaactataagataataaatttgtgttgttttaagtcattagttctgtgataatttgttatggtagcaatagaaaactaatatcaactttggtactggaagtgaggtgctatgtaacaaatacctaaaagtgtagaaatggcttttgaattgggaagtggacagaggctagaagaatgttgaggaacatgatagaagaaaacctagattgcttctaagaagagattgcagaaatacagactttaaggatatttccagtgaagctttaaatacttcttatggaaatctggacttggagaatgctgagggtgacagctcaaatggaaatgagaagcatgtcattggaaactgtaggaaagggatcctggttacacagtggtggaaagcttagtagaattacgccctgtagttatgtgaaaagaagaatctttgggggccagagggcagactgtggtaggaagaataatggttctccaaagatgttcacgcctgaatctctagagccttatgtggcaaaggaaacttgtggatgtgattaaggtcaagggtcttgagatggggagactatcctagattatgtgggtgggcccagtctaatcacatgagtccttaaaactagaagagaaaggcagaatagagatggaacatgaaaaggacttgagtgccattgctaagatttgaaaatggaggaagcaaatttgtcacggcagtaatgtaaagctaaaacagaggacaagaaacaacatgctttaatagagggcaggtagaagacaagggccaccagtttgaggattctgtcaaagattctttggaataaaacaactactcagcaacaacaacaacaacaacccactgagtgcctgttattggccaggttgtgtgcaaagtacatttatgtaattccatctcattgaatccctgtaaacagtttgagatataggtatgattatttctattttgtagataaagaagttaagaactaaggttttaattctaattctcacaaaaaccttatgtgataaatataattttccgtattttaagataaagaagctgagatacagaagaagcagcctttccttctctaaaattgcaaatcactctgctcttttacctctctgggaagcctacagcttctagtcttgagtgggaatatgtcttatctcctttactacatcagaaacaacatcaggagctcccagaccaagtctcagcacagagttttcacagatggatttataaatgaacaagtgaatcagcaaattactcccttctgtgctgtgaacttgtttggtctagggaggcctttgctttcctgacaacattaagatgcaaggaacagagtgctttgactcaatttccttcatttcttgaagttgaggcctctgcttgattagaggagacctggtcctcacctttctatgcagcaagagaaagaacactagcaacggaaaataaagtctgctctctgctccatcccactgtgcctggcttggacacatatgacccattttcacattgtcaaggtaagcacatatgaatagtgcaagaagcatagatgttggaatgaagaaacacacggttaagtcagtccactctttctagctgattgtcactgagaaaataagtggagtaatctgagcttcagttttatctataaaatgaggtttgtcattcctacatctcacatatttgcagagattcaatgagatgataaaggaagagcatttcacataataactggcaaaacaaaagttcctttacttcacctcttctctactctaaagatgagcaagtgtcccacaagtactggaagggagatgaaataaggatggtgtttttacaaatgtgacataaaaatgcatatgtagtaaacttcttcaaaacattttctcactagaggggtatgggaaaggatgctgggagcagagagatctaaactttagttgctcttattttataaaaatcacaattttctatttgtattatcttcttaaaaacaatcattcgtccactcgtgcatttagtgcatatttgtcttgaaaacagaggaggcaccctggaagtaaaaagaagcttagatggagttaggagtgcagatttctagtcctggcttcaacataattcactatgtgatcttgagtaaggtacttaacctctatgggcttcagcttctataataattaatagaccaactgcatttctctaggatgtattcaactgtgacccaaaagatagctcccaaaatgtaggcattattctcattttatcgaagggaagatttattatgttctgtggattgtatgacatgggttataccacttaatcaaccttataaagcagattggtattatttaaagatactcttcgtattacaacagactgcttctatgttttgagggtgttggcaaatgtccatttctattgttcctaaaaaatcaggcaatcactgtcatgactgcagatagaactaattggacaccaaccagaagcccttacaggttgggcctccctgcagctatagcttttagagtataatcagggaagaagcataacttccagggggaacaactttctctttctctctcttaagtcctcagtgctcccaattcaccaagagatgtggtatgagcagatttcacatgtccgggggcttgcatgttgatcattttggacaagtcatcagagtctccagggacggggcccatttgagcccaccttctctttcaggctgtcctggcagtctgtcagattggctgagctccaatgttgactcataagtctcttatctgagggaaacagaggcaaatctgaacctgcgcagagccagaactcactggaccacagtgaatggcatttcaggtttcagggctgggtgaagctgcaaagattaatcatcttaaaatcattttcctttcccccaaatgccatcagcttgctactcaaaaattaaatgtgggtaagaggaagactgcttggatgaacagcccaggttttatgacactttcaagagctcttatgttctgggtctgtgtataaggcaattgagatatgttaactgagatatttcagagaagctgacacagccctgattacagtcttttatttctgaattgggctaaaaatgtagatcaagctttgatattcacctttcagtattttactgccattaattagtaagcttggggtgggaaaaagaagaaataacctggcatggaattttattattgctaatagtcgattatcattcaaacatttaagtttatatatgcatgactcgtgaagatcatgagatggtaaactcagatagtcctggattcaaatattagctcactattttaagctgcagtatgattttcagcaaattacttcatatctttgtacctgggcttctgtatatgaaaaatgaggggcaagaatccctgtccgacagggtccttataagaattacacatgagagcttttagaatccagtaggtactcaatatttgttaattgagtctaaaaaaatctaaattttttcccctgtaaattctataccctggttctactgttactcactggaatataaacaacttaagcctacctctgctatccagtagcactcttttaagtgtttatggactgacaaatgataaagctagtacggtccctagctcagcagaggtgctggataaaactcgttttactcatgagtatatgaaaaacgggagaaagacattcaagagcatctgaaatgactcctccaaatccttagtaccatcatagcagctcatcagggtaagtaatgacatttacacaccacaatatcagacagttgggcaatcactttgcctgccccaatactgagtttgttactttgcctatgatttttcagaaaactggatggaaactacaggctgtactgtagcaggagaagacctgaaattagggaacttacccttctaaatctcatatgcccgtaaagtttcccattatcacctgttgactagagatagagaggacatatggttccttactcacccaggcaaaagcattgagttcagaatgtaatcaaattcccacagatggaaatgagataatattcatttaaatattaaatgtgatattattttcatagtctctactatgtgccaggcactctatagtttgttgggactcagcaaaggctttcttcctacagttgtacagcttgatgtttggttgggaatatgggtaagaaggtacattcatttggccacttactcattttcattcagcaaatacttttgagcatttactgtatgtcagtgatggttctaggagcttgggatctatcagtgaataaaaacagataaaaattcctgccttcatggattttacattctagtaaaacgagattggcaaaaaacaataaacataataaataggcaaatagtatgataggttaggagttgattgttgctatggaaaaagttaaaaatagagcacggtaagggggatcaggattctggaatagagtagggctatggtgacagtgaaggctgcattttcaaatggggtgttttttaaggtaggactcgctgaaaaagagatgtttgaggcaaggcttgaaggaggtgagggagttagatatacaggcatctgaggaaagagtgatctcagagggaacaacaagtgcaaagcctgtaaatacagttacagttgagtctcatatgtgctatgttaggaattagtatagggtgctgctctgggattgtagagctcctaggaagcctcatcaggtgctcataaagaagttggtgaatggggagatgattcatccagatttactagcagaggggtggtagcacatctgcccacccctacctactaagcagcctgatctttaggcattttcttagtggaagccgcctctgtaatatagtaatctcatattcttgagggctcagcttccttccttcagcctctcccccttcctaagtctcattggaaacatgcacatgagctggaccactgaacagcttttcttcttgtagacacacatgaccacaatttataaagtgcaaatcaaattctttggccaagaattttttctaacattgttatgaaagtagaagtattgatcaatataaaaaattctgcaactttcattttttgaaaaccatgactttctctgggaatccttcctgaatctatcaagagaaggctatttcttccactctctgtgccacattgtaaccttgtatgtggtcttattcttatgcttagcaggctacatttcagttgatttatctgtaggtgtatctttccttctagacttcttgactcatgagagttaggtgaagtcttacttatctctgtgccccttgcaaagaggaaaaggtgctcacaaaaccaggctaaactgaactgaactaaattcagaacacaaactgtctgaacttcagaaaattgcctcatcttgtttggtctcttgaagtttccccatctgtaaaatgggattaaaatattgtatgacatcaactctaagattttttaaaatttttatgtctaaaatcaagatgtttttccactatcaatgccatctcataattgaattggcagaatttttccttttttggtaacacatagggtacatcttaaaatcaaggacaacctagattcaataaaacatggtagaaactatctcacaagttgttgtgaagattaatgaattatagatgaaaagccctcagatcagtacctggcacaaagtaagaagtaagcaccgtgtgtgtgtgtgtgtgtgtgtgtgtgtgtgtgtgtgtgtgtgtgtttgctgctgctgctgttgtgctattacatattgtaagtcacttggaatcacctcatcattctcttctcttcttgtacacatttttgcaaacacttttagtactctttcctcagtgactgttcaaaaattgctgatagctgaaacactgtgctgcagtctgactttcacccagtaaggttctgttcagtagctctatttaactgaataaaatgtctgtagaaaatgtccctagcatttgccaatagttcagaaatttagaggaaaaaacctaaagagatccagtacattatgtttatacttttagtatttatagtttatgtgaatattattagtattttattccaatagcacaatcttttctttttttttcttttttttttttttgtgggatagtctcgctcagtcacccaagctagagtgcagtggcgcaatcatagctcactacaaacttgaactctggggctcaagggatctttgccttagcttcctgagtagctgagtagtaaccatgtcgggctaatgttttcatgttttgtagaggctaggtcttgctttgttggcccaggttggtcttgaggccctgggttcaagcaatcctcctgccttggtctcccaaagtgctgggattacaggaatgaaccaccatgccaggcctatagtctttaaactttagcacttaggttttcaagctgggacatttttccatgcacctagtgtaagtcatccatacatccactcattaatttactgaacattgacaacatgtttggcaacaggataatggaaaatgtttgtaagacttgggaacacttgttttgctgtttacttgctctgtggctatagataaggttcttaaattctgtttcctactctgtaaattaaagactaatcctgcctgaatagatattgtttgaattcattgaggtaacatatgtaaaactcctatatcagggaggctggtatacagatacatgaaaaaattgcaataataatatgtatcagcacagaaacctatgtttcaactcaacttttaagggatgcaataatgatttagtacaaatttgcatttattttaatattgatctatctaacaatatttacctcgtccttcctcagtgccagatctgggactagtggttctattggcaataaatactatgggagcttggagcagaagatgttccattgggctggactgactgggcaatgggccttgctctactccacagtactatctttccagttggtaaagcaatcagaggctgtaggactgctctgaaaatagtcaatacagtgtaacttttagatgcctgaaaccatgcaatcatggcttcagtcatattcaataaatgctcattatgtgccatgcattatgttaggtatttggggatacagtgtgaataacagaaacaaggcacttttggaatttagagacaaaacagatgtagaagaaataattaccagtacaacacatcataaaaagcagatgggcaagtaatccatgagagtatacagtggagagaaatggaaactattctggagggaccaggttgggaaggcttccaagaggagctgctgtctaatctgagcacagcaggagcagcagggtgggcagagggagctgcacaggcagaggctctgcagtgggaaacagcaggcagcaaacctgaaagaagatcaatgtctgggatagtctaagatgagaccagagggaaggagaggccaggtcatggagaatcctgtagatcttatgaaggatactttctctttttagagtaatgggaagcctttggggattttaaacagatgtgagatgatcagatttacatcgaaaacagatctttctggctttagggtggagaatggattggagaaccatagattgggcaagacaggatgttgagatcccaggtagtggggaaaggtagtaatccaaatgatgatggtttgggtacagtggtggcaataggatggacagaggtctcagatatttactttggccaatacctatctgtttgtcagtctgtctgtttctctcaccaaaatctatgggcaatgttttcaaaattttattaccagaatatatcatttttttttcttcaaaaggaaacttctagaaatataaaaataaaacatttgattgcagacaggggaaacagaatttctggtttctcttccactccaactgcagagcatacctcaggtccctaagaagaattttgggtctacttaaatcagagcttgaaaatcttcaatctagtacttagttcccaaacactgtaaatgaagaaaatcttctcttcttttattgatatcatgacatctctaaacctgtttccaatctcacagccatttccaatctcacagacatctatttgtttccaaaatgaaagcttgatggcaattctccttggagcatttttagcaaatataacaagtctccttgagattactagagtaacaccagggtgtcccgaactctaattacaggaactctgcaggatgaaactgtgattagtcctcacaggagtaaccacagccactcaacagaattcagtagctatttatggcacgtgttttgaggagaagacttctttctgctcagaggctgtttatattaataagcagaaggtggttccttggaagaagagaaatctcgttcgaagtttgacacattcatagaaaacaagagaaagttcccaggaggaagtcaatagcacatccagcgaaacatgcgtatggactgagggcaatttgacaggcagggaaacgtttctactgagaagaaaaaaagaaagagagatttctatttgatatatacatattttcagttttgtcctttttctttcttttttttttttgagatggggtttcactctgtcacccaggctggagtgcagtggcgcgatcgtgactcactgcaacctccacctcccgggttcaagtgatcctcccatctcagcctcctgtgtagctgggaccacaggcgtgcgccaaactgccagctaatttttgtcttttttgtagagatgcagttttgccatgttgcccaggctagtctagaacttttagactcaagtgatgctcctgtctcagcctcccaaagtgctgggattacaggcatgagccactgcacccagcccgataccattttttgcatgttagcaaaagctgggctttgataaggaagtaattgggaaacctgaagttggccagtcagctctgatagaagtgtataaattgggcagaaaagcatgagaaactcagccacattaattattgctacaaaagtcagcatccagtggaaggcaagctgggatgatgcggggaagatgactagacaaggaaccagaggtaaaaggcattcaggctgtctaactgacccctggccagtggtacttcaaaccagcaagatccagaactctaattatcagcccataatatgaagccatgactgtgtttttccatcccacaatctcaacaaccatgattacaattgtctggggaccaccttgaaactggcctatgtccctttatttgttctctgttttctcttcttacctgggtcccagtatttcttaggtgtttcttaagaactccaaatagtgtgttcagtgctgaaggcaaaagatgaacaagatggtatctctgccttcacacaatttatgagactaataggcaaaaaagtactgtaagcaaattctttctatttggtttgtttgttaaatgcaacaataaaagcatgtacaatctgtagagaaaaacaaggacagtctactctgaatgatgaggtgatgagatgacaggttcctgttctgcaagaccccaggctgcttttgatggtactaagagttaaccacagagcgaagggaaaatgttctgtaacctaagtttggagtgataactttaaagttgagatctcatctgtctttaggaatttctcgttacctccaattttagcagggatatttgacacaaactgcaaagaattattaatcctctaggctctgcatcatggcaatacacttggccagtgtgcttcctgtcttgaatcaaaggttagaaatcatagataaatgaaacctgcaaacaggcttatgttgcttgtaggtgtttcatctttgagttttaggcataaccgcaattggcagtgaaataattaagtaaaatgaatacttgattcctatcaaatctgccaaaaagaaagcaggtattgagttttgaagaaatgccctacagattggtaatctggggtggtggggaggaggatttcctgttttacagatgggtgagcgctctaagggaactaacttgttgtgaagttaatcaaggcagactgtttgtcaaggaagaggctcattgcctaggacagatttagatcaattctggcaggaaggaatatccacaaggggcctttttcaattttatttaatcagttagagaagatggagttaccaactccaagcaggaggacaatatggaatctataaaataggcagagaaatatgtattcaagtgaagtaatttgtttgataatccacagacatgtgggtttctgtaatttcttgataaagtcatatagttcataatttctccaaactggctctagttgtagtcccttacttagtccaaaacctcccactgggattttatgtttctttgctgttctgtctctttcattcctctcaacttttgctttcagaatctcatacatttaatacatcttcttattggctttaaataattccttagtgttgttttgataaaactgtcagaaatttaaaaaattttttatttaaaaaacttttatcttattatcttctgtcaatctttatagacatacaacatgaaaatacatgttatgtatttttttcaggcaaagatgccttagtctacctgttatctgttagtatggtgttcaagaggaatagaaagtgaggaaggaaactaactgttattgaatgcctgctattggttaaccgctacagtaggcactttatataccttggcactgaataataagagcactgtaaatttgttaccattctctctatcgtacaaggttcacagacatcaatttcacctagcatgtaagtgggaaagttaggaattcaacccagatctgtttgtgatatgtgtctggacttgccactgtatctctacctctggagggcatcttttctcccagagaggaggatcacatcattagccctcagaggttgactgactaattaaagcttctactttcatgttaatttccatttacccagcatacatgaattaactacctactcccggtaaaaaacagtgctagatgtcgtgtgtgtgtgtgtgtgtgtgtgtgtgtgtgtgtgtgtgtatgagtaaaatctggccccctccatcaacgagattctcatctagcatggcagatgagatgtgcataaatacagggcaagacatactgtaaaagatgcataagggaatgatgaacaacatgctgctgaataaattgaagaagaagtaacatgaattccaatcatggggaaccagacaaggcttcatggaataggtagtatttgttgcaagcctagaagaatgaatacaagttggccaaagaaagatgaaaataaaagcattagaggttgaggaaacagaatgaacaaaggcatcgacttacaaaagaatgcacttggtttaggaaattatgtattgtacagaatctctggagtctagtgggtttgcttgggtgtgcaggggggaaatctgcctggaaaagtagatggaggcctgatcagggctttcaaatttgtcattctccatgtgaagggagaattactcgcataatcttgttgttcctgttgtgtgtatcaacagccttcaggtaaataggagctttttattcctttatgcatgagattcaatgaaggtactttgttttggatatggtgttagtggagaaatcaagcaggtggctggaaatgagaatttacacttaggatcaggttgtggctagagacagatttaagttattggtccacagttgatcacggaagccatgtttggccatttatccttctctctcaaattaacagaattccaagttttaaccaggtacgttgccatgtacctaaaatactatatttctttgcatctagctatatccatgagcctatagtctgacacatcaaatgtaagcagtaggggtatatggtacttccagaaagtcttcttcaaaggaagaggtcatatttatcttccaagctgtttgcttttagcaaaggacatgatgcctggcactccagcagccaaattggatgctaaagacaaagaccaaaccctaagaatggcagataagggtactggaaggaacctggaggtccttggtaaatctgtaggtagagctgccatactcaccctgaagagcctaccctgatgcttcttatatataagaaagaaagtaacttcttgtgtaagtcactgctattttggtatttctgggctttttatatgtagtcaaacttaatcattactgatacatggtgaaattagaagaaattttcaagagagtataatgaaagagaggggaaggatgggggctgaactttgctttttttttttttcttcttgagacggagtctcactgttgcccaggctggagagcagtggcaggatcttggctcactgcaacctctgccttctgggttcaagtaattctcttgcctcagcctctggaatagctgggattacagctgtgcaccaccatgcccagctaatttttgtatttttagtagagatggggtttcaccatgttggccaggctggtctcaaactcccaacctcaggtgatccacccacctcagcctcccaaagtgctgggattataggtgtgagccaccgcagctgacctgaactttgaagagtgcctacatttggaggaaaagtacaagaacatggagagttgagagtcaaagctagattaaaggtggatgttaatgtgagcttgtgttggaggagtgggttggggatggtggtggaaattctattcagtctaaaatgtctgtttctcaaaataagaaataaagggctgattaaggagccactaaaaactggagtgatccaggctactcccaagacagaggattaggttatatatgtccaatttctgcaccttaactttccaatctgttaattcattccattgctgacgtagaatgatcagggattttcttccacagggaaggtaaagtcaagagggggaaaaaactatttcccaccaataaaacagggtcctcgattgtaactatacttaagaataagtcctccgtaaatcattttccccctgtgtattagtccattctcacattgctataaggaaatatctgagactgggtaatttattaagaaaagagaattaattggctcacagctccacaggcagtagagaaagcatgatgctggcatctgctcagcttctagggaaacctcaggaaacttacaaccatggcagaaggagaatgggaagcaggctcatcttacaaggccagagcaggagcaaggcgttggggaaggtgccacacacttttaaataaccagatcttgtgataactctatgagaacagcaccaagagcattgtgctaaaccattcacaagaaatcgcccccatgatccagtcacctcctaccgggccccacctccaacattgggggttccaattcaacatgagatttgggtggggacatagagccaaaccatatcactctgcatctgacaccatatatgaataccccttttttgttctagcagaggctatttggaggacaaaacccacccatccaggactcagaggggttagtggtgagctatttagtgcctgctccctgtctcttgtgctctacctgtgcatgctgcatcccatggaccttcagatcctggcactgacagtcatttgtaaggagactgcaagtaaagagtctctgtaagttctgcaagtgaagagtaattttggttttccttaaagatcatagactctattatttgtactgtagcttagtggaaagagttttccagaggctccagtctgtttgttaattattctttttaagaatcacatacagtgctgagagttgttgacaaagcaccttcacctgtgttatttagtccttgtggtaatcctttggaataagcaatgttattccctttgatttacactgagacctaaagaagatgatgaagagaaggtagattacaaagataataatataaatagctatcatttactgaattactaataagtaccaggtagggcagtaggaacataatatttttctaacataaacaataatcctgcaaagtttgacttagtatttctttcttttttttttttttttttttttttgagatggagtcttgctctgtcaccaggctggagtgcagtggtgtaatcttggcttactgcaaccttcacctcccgggttcaagcaattctcctgcttcagcctcccgagtagctgggattacaggtgcccagcaccacgcccagctaatttttgtatttttagtagagacagggtttcaccatgttggccaggttggtgtcgatctcttgacctcgtgatccgcctgcctcagcctcccaaagtgctgggattacatgcgtgagccaccgtgcctggccttagtattcctattctgtagataataaaactgtgattgtaagacttaaagtgactctttatatacactcttatatagttaaagtgacgctttaactcttagaatcaacacaagctttacattaattgaacatgacactaagggagcatctgtggtgcactgagactcaccccttgcaacattttgattcgcataaatgtcataactgaccctgtgatgccctgggtgggggggtaccatttacccctgaccaccctggggagttgttagatggtgatgatcctagtacaggcactcagttcactgagactctggaaagaactctgagatagaaatacaaggctataattgataatcattattaaggcttttatttgaataatgagaagaataaagaacagggaaaatggttggattttattagtttatttttattattatgccaatagaatttatattgtttctaagcaaataggtacatatcagtacaatctgtgttttcagtatattgaaaaaatacatagctaaggaaaatatgataacttagtgaggttgaagtaggttttttctataaaattttgttgttctttcatgttactttttattctaattagaaatcaaggataaactaatatggaacaaatctggatggcaaactccacttctttacatttcttgagcgccttaccaatctgcatctggtctttaagatttccctagtaggttgttctctgcacatggggagttggcagtaatgtttctgtttttgtttccctaattcttttttttttttttttttttttttttgagacagagtctcgctcagttgcccaggctggagtgcagtggctcgatctttgctcactgcaagctccacctcctgggttcatgccattctcctgcctcagcctcccaagtagctgggactacaggtgcctgccaccacgcccagctaatttttttgtatttttttagtagagacagggtttcaccatgttagccaggatggtcgcgatctcctgacctcatgatccgcccgcctcggcctcccaaagtgctgggattacaggcatgagccactgtgcccagcctccctaattctttactactggctttaactctgaaacttctaaattaaacgttctttgatcatccccttactgaagtagtgaagggtcttgtaaataaaatccacaggactttgggatggttctgacatggtttcttaataaagaaaagtcattggaagtgttaacgtagctgcaggtgagggttttggaagctcatgcttcaccttacctgctctctatattctaaaagttgcagaagtaaattcgaaaacacaactttctgtaaaacttaatgatgggactgaagagtacaatcgtgttaaaagctacttttatatagcaactactaggtgctgggtcctctgctaagtacttcacaggcattatctcgagttctcaagagagaattcaagaatcctacaagggagtagggtgaaaaacatccttattttatagatgaggaaattaaagcctagataggtgttagccaagattcatctaattaaaaatgagagcttatcttacagagtcattgtgaggactaaatgaaactgtatttatttaccaaatgtttggcatggtatagggttgctgtttaaattatgttcatcttatttcaatgtctctttcatattagtctcaagcacttcactgtcttcgtagcatttgggttcttgaaatacttctgtctgagagaaaactgacagtgatattatccattgttttgatttattttttatcaaatagcagataattagactgttggccagaatttttcaattgctcaccatgggcctgttccaacatattattggaaatcagtaatataaacctaatttttcatgtgtttttttttttgttttctatgataaaatcattggtgggaatgtttatgttggatataataaatttgaaacatatgaatatcctcttgtgacaaggtaaggtattagttagggattcttttttaacttccacccaattacttattttagaaaaatgttaaattcattagatgaaaattgaaaatattcacaagtgtcctaagataccatagacaggagcacgatacagtgcactggaatggggggggtcaggagccctagatctcagtcttgcctctgtccctgactagctcgtggccttgcttaagacactcatcccctcattgcttcacaaggttgctacctgtaaattggatatttcactccaggatctaagtttcattttctgtttagctgttcataataacccaaaattcattaggggaaattctgctgctttggcaggtaacatatggggatgcaaaggaaaaaattctggcatctatgtttttggggtttactgagggatctaaccctccatccactgataaaattcttttaagaaagttacatgagtgaatgattgtttgcatttattattggtgggttatctacttgtttagagaagattgataatcttgcaacaaggattaaataaaaccattccatctctcataatgtcttataatgcctccccattcgtcatcatcatgatcattatgctggtcaagacaaaaagttaatcagccacaaacaaacataagaagaatttctttttttttctgcactgattggatcaaggaaggggatttgcaaatatcttctagtcaaagaacttcattccaagttgccattgcactttatgcattacctaatccaaacagtttacataactgtattataatcaatcatgcagttctttatctgtttccctcactggactatgatctccttgagggcaggcgcctatcttaatgactatcatgttgccattcactagcatagttcctggtacaatccctcatgataagataattgtatttctataatttgactttaagactacaaatccaaaggccacctcagtactctgttactgagtactgagattataatatgaccattgtgctggagaatcagttccaactgcaatctgaagctcccagaagggtggatatctgcatccttaactcacatctcaaactgttcactcagcaaacaaagcaaaaacaatatatcttctcttcttcctacttcactacctttagagttatgtaaaacactttaatttgcaccagaacactggggaaagagaaaaaggcagccaggataatataacagtatctttattaagcccttgtgcagttttaaaacgtcagtaacttgaattgagaacatggtagaggcaacttacaaatcatatttgaaagcaaactgaattttctcagaactgccagaaatttctattcagtgcagagtacacagtgaaatttttcccagagtatgtcttgtcaaataattatttaaatgttggattaatcactgttgaattggtttgttttctacagggccatcagagatttcaatgcactgtcaatctacaagaagggtatatgatatgcagttgtttcacaaacactgtaacaaatgattttgaagaggacatcttaggatactctgagttactccaacttggacatttcacaggtaggagaactattgaatggttctgcaaggtaaagacacttattcaagaatatttcaataactgtacttagtacaaagccaggactgaatttaggtagtctggttcccagtccagaagagtgtacctgttttctgtatgccatattgcaggcccctacttgccaatgagagagtttctgcaatagcaacatcatcccttctgtttcatgaagtcctactggttggattaataaataatggcattttcagggcagtgggttgcacccactaagatatttttgatttctagtacaaaatgactttcctagaaatataatttcccagaagaagggtacacaagaaatgtgtggcttaaaattcaccttttagtcattgtataaaagttgaaggataactgctcagttattacacgggagcagctggtggaaaaaccacaggcccagtgatgatgatagatactggacatagaggaatgagatccattttcctaataggtcagcaactttatgttctatctgtgggtgcctgtcctgaagcctgtgctcccactgaattcccgaattctgcccatctaatcccaatcacattttcacactggaccgactaagtcttttccagcaatttcattccttttcccctgccctctgcattcctttgtgatctcatttggtctaaatatcatgtgatggaattggaagagccaagtaggctagacttaaattctggctctgcctacacttgaccacctagaaaacctcatagagttcctgtaaagatttaaatacacctaccacacatttatatatagtatttaacatagtgtctagcacaaaagtgttaaagaaataattctctttctctctaattgttgtttatatagtagaccaatttgcccaattagataaaagctaagggcagagggcatggtgtgtgtgtgtgtgtgtgtgtgtgtgtgtgtgtgtgtgtgtatcctcacaatgctagaaacattctttcattcaaaaacaatctgttaaatgcctcacagtagcagaacatctcacagtaggtgtttgcaatttattttatgataaagcttatatgagagtaaataaaatactgtatgcaaatttctgaaaacagtgcctaaacaactagtaagtgctattatgatcactagaaagtacacaaatttattttagtgctgtgataatacttgggatgagctatttatcccatcttgactccgtctcatggggtaatgatttttgcacaggaacggttaatccagttgaaaatcatcacctcctagaaatggaaacagagacataaacaggaaggagccatctaattcttaagtttcgggtgactcgttgaaagcctggagtaatcagggatgacaaagctcagcattctcaacctcagaagggtggcacaagaatgagtcatatctaagcagatcccaagctataatattttcttgacttagccaagtcatgttttctttgcaaaggcttcatggacttaaaactaaactgtttataaaagcccctttttagtctatgtttaaggctactgttttacagaaatagcaatagaataaaaaagttggagaaagaattggaagattgggaacctggttttgcctctaccatgtactcatgggaagatgttggcctttctctatcttcgttttcccaactataaaatgttattttatccaaagaacattaagtattttatatgtgctaagtatttactgttttaggtggtggggtgctggacataaaaaaggtaagtaaggcagagtctagtaggaaagaaaattaatttgataattgtaattcagcaactagtgctaaaggcgtagattgcaacagaggacttaatcccaagaagaaagagttcaggggaaacctccttcaggacctggagcacagtctgtctgggtaggctgtcataagtatagtgaagatggcagctgcatgcagagtgagttgcattacaaggtatagagacctgagaccaccttgacaaatgtagaaactgcaaggaattcagtccagctagatatggctagataaggatcatacaaagcaatagatttgagaatgtcaaaaactgaagaattgaagagaagcagtaaaagctagattagagagtattttgtgtatcctgctacaggaaatgagggactctttctctccatatgcatatatatgtaaataaggcgtatgatcttatatatgtaaataaggtgtctgtaaggacacagacaggtaagcattttcaaggatcattctgactgcagtatgattggcttggcaggtggcagagaacaaaagcaagaaaaactattaggatgctgttgcaagaggacgcaagtaatgatgagtgtccgagctaaggtagtagccatggggatgagtatttgagagcttttaaggaggcagagtcaacagagttaagtgaattattgaatgaggataggaagagaaagggaagtatcagggatgatgttgaggatttgggctaaggtaatggatggaaagtgttgtcatccctccagacaaagtgatatagaaacttggctgggagaaatttgcaaagggtgagcatgaggtacctaggggcatacaaattaagaagtccagtaacagtgggatggatatcaggagctcaggagagagatttgggctgcaactaccaaattaggtcgaaattaaagctaatggaaatcattcagtgaactgagattgcccttagagattaaagtaaggaaaaaagctgaaggtaaaacccaagagaataacaacattttagaggaagagggaagagtcatccaaagaactatggatgagagtgggcagacacatgaagacaaccagaggaaaatgtcacagaatgcaggggaggaggaagattcataatgtgataatggtcagtggtgacagatgatacaggagtccaagaagcttgaaaaatgtccaatagataattctatctctcatcccctcccaggttgtcatgagttcagaaaagatcatggaaggaaaaggctttgtaaaatcgcattcacatctgtgattcattattatttcttgtctgttgacctatccacagtgctgcgctatcagaggacttaagatgtttaagccgaagccctacttccataatcatttactttcctgtttcttcgatttattaatgagaaatcaaatcagaaagagttaaattacttatcactgtctcaaaggaataatgttggttttcacaacatcccagtttcaggtataccatcagagtcattcagagatctgaagtacagatttttccttctttgggtggtagtattcctgaaatatcattaataaattcatttaaaaaatctgttttaagtacagaaaagtaggttgctattgaaagctttatgctgttttttttaattctgaatttgattcgtttaacaatgaaatacatctaaattcttaagacagtctctgaaggccattataaatcacagtgctatttctttctgacaattatgtcagtaagctcatgtcaggaggcatatgacaggcagaatggcacagaaaaatggaaacagtacagatcaagtatcagaataaaaatcttaataatagcagccatcttattgaattttttgctatatgtcaagtcctttacatatattatatccttttttctcttcaacattttaatcctcattttacagatgaggaaattgcagatcagagtggtgaagagactttaggttatacaaaagcctctggctaagaagctgatctgggatgcaaacccaggactgttatgtaatgattgttccaggatatgatgccaatgtaggaggcagagagagtcaaacccagggatagtttctcttatccttgtaagtcaggcagtgaagaggagagaaaggggattttgagttaatagaggacatgtcacacaacaaagatgaaaacactgcctagacagggggctggttaacaaagcagggtattaggaagatctctgccatggcaggggccatgtggagagactcagcaagccagtcagaaaaattcatcccatctgaaaaattcttcaagctgcagcagaactgggacatccgtttaaacaggacagctccatgggactagcttcatgaggacatgttgaatgagagtcagactttccatcacactcccccatgaaaagagagaatgagctaagcttatctgccttgtctgtaaaaaagaagttaaacctatggctggtcacttcatgcacttagcagtgtctgggacatggtatctacttcatatccagttgttactattattctaaatatctatcactatcaagcacactagttatgggtcccatcagtctagcaccttaaacatgtaccccctcaaactcatatgccgattacaagagtctactggggggcatcaaaactctgcaaccaaagttcacaggtaaaactctgagacctgtgatgtgtattaacgtacagaatattattaacgtacagaatagagatgaaaattcttcttagttcccaggatccatgtgatgaatttaaagaaataatgtaagcaccctgtaaactgcaaatgactatccaaatgtgaaggaatatcattactattactactattactggttatggctatttttagaatactcaggaaaacacatattctcatcaaaacacttttcttaatagtttagatcaatttcctttatcattttattctgaagcacttcagaataaaagtaaaggaaggtaaataaaagtaaaattaaagtaaggaaaaaagctgaatgtaaaacccaagagaataacaacattttagatgaagagggaagagtcatccaaagaactatggatgagagtgggcagatacatgaagacaaccagaggaaaatgtcacagaatgcaggggaggaggaagattcataatgtgataatggtcagtggtgacagatgatacaggagtccaagaagcttgaaaagaataaaatctgaagaacttcaggtaaatagtaaaggaggaaaagggtatagggatctatgctcaggttaaatgacagatgagttactatagttatttatttatttattgaaatggagttttgctcttgttgcccaggctggagtgcagtggcccaatctcagctcactacaacttccaactcctgggttcaagcaattcttctgtctcagcctcccaagtagccgggattacaggcatgcaccaccacgcccggctaattttgtatttttagtagagacagggtttcaccatgttggtcagggtggtcttgaactcctgacttcaggtgatccacccaccttggcctcccaaagtgctgggcttataggcgtgagccaccaaacctggctatttactatatttaaataaatatgggtttttttctttttgaaatacatttgttttgtttattcaagtactttaactcaagcaatttaacaaatgtttattaaatcaagataccatgcaagaggccaaagaataatatattaagaacactggaagttaaaaattaaaaaaaaaatctggcctgaattctacctcctccacttatgaactttcaaatcttttttttctagcaaacgttgtccatcgctgttaagatgaccttgaacactttacatgactttctgagcctctttttcctcattaaaagagagattgcatcacccactctgcttactcacaaggaatttgtaaggattaaattaaataatgactatgcaaataaaagtactgttattcgagcgagactccgtctcaaaaaaaaaaaaaaaaaagtactgttattcagcagaagagaggcatgtgcattaataagcacgatgatagtttgttatatatagtgagaaatattactgatgagcggactgaaactgttcattgcatattctctctgtaggaaattctaaatggaaagctgattatagtcagaaagatgccagagattggtatgggatcaaaggtgaattttaatggctaatgtcaacatcattgtctgatgtgttgatcttaatatattcatatttcatgtttatcttttattgatatcaagcactcatttaaaaaatcatatttctaaagtatatataataatatggagaaatgatcacaatataatgctaagtaaaagaagacagaactctctgtatggtgtgattctaattttgttttacatattatatataaagatacaaagcatatatactaaaagaataatgtttcctttgcagtggtggaattatgagtgggttatctttggctttatatttttctgtatcctcctaattttatatagtaaacattttttaatgttaaaaatatttaaaataaagaatcttagaaccttcactccaacttactataattcattattttatatttttgttttatatttgaaaagcatacaccctttgggcttgaagtcatctattacagacaagtattaaggactttgtggggtatggcaaatagaaacgggaatgtgagaagatacaggtgggaagattaggagtatgagtcagtgataagagacataatctgaccagctgtgtaactcttaaattttgagaaaaggaaggttggaaattgacagaaaatcacaaagctagaaaacaagaccaaatatcttacctttcgaggtcagtgataaaacctaggagcttctaagaaaaaagtaagatgatacagacaggtagcagacctatctccccctattcaaggcaattgaatactcagtacagaatcccagaaagctacatgcgcagtgaggatttaaggccatccaaaatcagaaggtctatggaaaactctagtctcacactcaaccactgaaggaatgccttttaccatgcataatggccagctatgcagcttctgctggagcatctgctgaggtggagaggcagctcactccttagtgaggcaactcactctttgttggatgggtctcttggttatacaagagtcctttcttactctgaatgaactccttaattcgttacagagaataagtccactccctcttctgcctgataaccatctaaataatgatagtgacactaaggacttgaacctgactcttctaatttcaaaagactacccctgccccatcactttacagcatcattaaggctttctggttaattggaattattctgccagattaaatgtttcatgtgccatttagttttttagtagctttttatgatttgaaaacaatatgcttttttactccttttttccccaactaattgatatgttggtctaacctaattaataaatcttttggtttatttactttaggagtaaaaaatatgcccgattcacatgattagaatcaatttatgactaaataaattatgaagttatgtaacatgtgatttatcctattaaaatgattacgaaagagcaattccaaatggtgattatagtctccaactgaagtcagatttcggtcttagtcatctctatgtcatcagttaggcaaacaaatgcctaaattatcactaatataagagatgtggctataagtgtcttagtactgagttcatttgcagagtaatataattacatatttggcataaatacaattcagagactgttcagaactctcttctttctcatatcaaagtctatttactactaaaatgattctgatgaataatgcaaccttattcttttatagaacagactaacaatacactgcccgtcccagaaaaacacaaaaatcattaccttcatttctaggaatataaactttggaagcctaaggaaaatctaacctaataaaggtaacattttattgagaagagtagataattgtcaaaaattgggcattttattatttattttcattttagcatcaccttttgctaaaatgtaggaaacttttatttatactaagcaaactgagccctggtattatgtatcactgggtgcatttgaatgaacaacagataagtttgtcccccaatacaggataactacatgtggttcagtcctggagaagcacaatttacaacagtgcttcgaggcagtataacacattggaaagagcaagcttttgatatggatagatttggattgaattctagctttcttctgtattgagttggtgaacttttgagtctcatgtttttcacatgtaaaatagttaaaaccttctcatgtggttgttgtaatgattaaatggggtaatatataaaagcatttttcagagcctggcacataataagcatgttagacatgttaattttcttattctaaactctgtaattaatcctagagaagccctcccctcaccacattcttttgcaggcacaaagttatgaaactggagttggagaaaggtggagggtcccttgaagccaaaagtgaagctcaaatgacagtgtctgtcttttgcagaaatagctgttatatcagcatgtactgattttaaagatgatgtagacatacttcaatcaatttaaatttcctttatggttaatacaggggagtataaaagatatatatgtagggactaaacttatcccaagtatatttgataaataaaactacaaaaatacaaatattgcatataagacagtattttttaaggttggaaataaatgtataaggatatacaatatagtcattttctgatttaaaaagccttttaaaatttttatgtgctgtgatctgatcatttctcaagtcacctttgtaagtgcctgttttctgacggcctctatacattgtcattctgacctgaacaagcagaacaattaaagtattataggttcactgtatcctgagctgaaccaaactcttgtgattccaaagctgcaggatgagctgctacctctgccataactagaagatgagtaatcaagaacctcccatcagaactgttgtttccaagaatgtactttttagctaagctacagggatcaggaggttgtctaaaacgattggatccagggacatgatacagttcctatgtcagcacagctaaaaagaagatgccctaggcacaaccacttggcacttgtgaaattattgactaaagaatggagattctgatagcacagctcagaaaaacccaacacatcttacaaccactgtgtatgccagaaaaaagtagcagatgaaaaggaagtacaatttctaactcatttccatattctaagacttgcctaagtaagtttgattagctgaatctaaattatatctgataacctagagacatggcatctgcaagggtatatgagataggtagtgagcagctttcatctttaaagatgtaagaaggaacttcaatttctatgcaagatggaatgagagaaatcagctttaacctcctgcttcaaacaaccaaaagtaaataaaatcagacaaactatagggaataatgatttcccagacaccagacatcagacaatgaaggacaagaatctttagtagatgggaaacaaatgaggtaactgccccagctttctgccttgacagagtctcgaggccatcaagcagggacaaagaacccaggagaagcctggcagactctcttagttgaagacatggaactgagaatctgaagagatcaacatggctagagtttgcagaaaagagtatcagaagagagctgcacagaaagaaaattctggaaatatgctgagaaccactcttgagtatttagcagagtactgattggcatctgtgtgcatgaagaaactacaagaggccagagaaagaaccattttgaaggatgagtaggatcaatacttggcatttgtaaagggctgagatcagtgctggttctcaccagctaaactagaaaacttcacaattcatggggcattaagtagtatgctcagaaaaatcttgcttcagtagtaaaacataattacccctaaatgctgccctcccatctaaaaaaatttaaaagcaaaacttgaagagatcagcaaaacttgaaaagatcagttccatgatacatttcaatatttacagaaatgcaaaaatatctggccccaataaagtaaaattcaccatgtctggcatttagtcaaatattaccaggcataaaaagaagtagaacaatatgactgacaatgggagaaaaaaataaccaatcaaaacgaacccataactgacacaaatgttagaagtggcagaaaagaacattaaaacaattttataattgtattgcagatggtcaacaagttaaatagggacatgaaacatataaaaaaaatccaaattaaacttgtaggcataaaaactacaatgttgaaaatgaaaaatatgctgaatagaattaaaggcaaattaaacaatgcctaaaatattaatgaacataaaatacatagcaatggaaactaaccaagttagttactaaccaactaaccaaactaaccgtgaaaaaataattctaaagaatgacaagagtatcaaccaactgtgagacaccctcaagtagactaatagacctctaattggagtttccaaagtgtaggaagagtgagaaggaaaggaaaaatatttgaaggaatcatgaccaataattttccaaattttattgaaaactatgaatattttaatccaagaagcttaataccacagaagcacaagaaacataaagagaaacacaccaagatacatcataatcaaacagcttagtagcactaataaaaagaaaaaatttatttatgccaggaaaaagaaacatgcttcatgcaaagagaataaggaagacaaggatgacaagaggcttctcatcagaaacaacatgggtaagaaaacagtgaaggcaacatctttaaagttacctgcactgtaagggtcaacttaaaattctatatccagataaaatatctttcaaaaataaaggcaaaataaagacttttttcaaacataaaatgctgaaagaattccttagtagcagatgtgcacttaaagaagtagtgaaggaagtactccaggcagaagtgaaatgacacctaatggaagtctggatatatataaaggaagtaccctgggaatggtaactatgtggatgaatacctaagccttttccttgttatttaaacttctttaaaacaattgtccactgtgatggttaatactgagtgtcaacttgattggattgaaggatacaaagtattgatactgggtatgtctttgaaggtgctgccaaaggagattaacatttgagtcagtgggctggggaaggcagatccacccttaatctggtaggcacaatctaatcagctgccagcgaatataaagcaggcagaaaaacgtgaaaaggacagactggcctagcctcccagcctacatctttctcccatgctggatgcttcctgccctcgaacatcggactccaagttcttcagttttgggacttggactggctctccttgctcctcagcttgcagacaccctattgtgggaccttgtgatagtctaagttaatacttaataaacaatagaatatatatatatcttattagttctaataggagatatatatatcttattagttctaataggagatatatgtatcttattagttctaataggagatatatatcttattagttctaataggatagatatataatagtttatataggaactaataggatatatatatataaaataggatatattatatatatatataataggatatattatatatatatgtattagtcagggttccctagagggacagaattaatagaatatatatatatatatatatatatatatcctatttataataggatatatattataacatatatatgttatttataataggatatatttataatatataatattataaatatatcctatttatatcctataataaataggatattataaatatataattattaaattatcctataaataggatattataaatatataattattaaattaaaaatattaaatatattatattttatatatttatattttatatataaatacaaaatattaaatatatattatataattataaatatataattatattataaatatatataatataaatatataaatggaagtttatatatgtataattatatatatttataatatataatatatatttaatattttgtatttatattatatataaatatataaataaatatatataatacatctacttaacccaaaatactaacaatgtgtcatggggtttattttgtgtgtgtgtgtgtatacatatatatatgtatacacacacacacacactgtatcatataaaatatgtgacaataccacaaaaaccagaagaaagaaaactatactttgtaaggttctaatgcggtacatgaagtattataatattgatagtaatgctagaatgggataagttaaacatgtacactacaaaccctaaagcaaccactaatataacaacaacatctggagagttatagctaataaatcaacaaatgagataaaatggagttataacaattatccagtaaacctccaaacagacatgcaaagagaaaaaaagagaatagagaacagtaccaagatgattagacttaaacctaatgacaccaacaatcatgtcaactgtaaaaagttcaaggcacttcaattaaaaggcagcaactgtttgttagaccggataaaaaagaaagatccaactatatagtgtttataagaaatacactttaaattcaaaggtacaactaggttaaaattaaagagatggaaaaaatatataccatattgacactagtcaaaagaaagttggaatgactgcattaatatataaaaaaagcagatttcagagcaaagaatattatgagcaatgatgaagccccaaatttatccagaggatataaaaagcctaaatctttattcatgtaataacagcttcaaaatacatgaaacaaaaatgtgaacattagcaacttgacttaattagcatttatagactacccatcaacaatatattcttttcaagtgcgtatgaaacatttaccaacaaagattattatatttctgggtcataaaacaagtcttaaggattcaagtcatacaaagaatgttctcagaccacacagacagtgagtgatagaattgagcattcaagacctgcctagtatagaatatttgcttccccactgtgttttcctccttgttgctttacatgtgtttggatttttctctgatatatgtggctctgggcttctttccttgcctcaacaataacagctccctggtagggaagaggcttccactaacctcttccacaaaactccaggaataaacactttcttcacaatcagtcaactgaagcaatgtgttgtggtaagcaaaattcttaatgtaagatatttggactttgagagagtaaatatctaggcaaataaaatgttgcatttattctacacattaatttcaagtatgaaaataactccactccagaagctgatgcaattatatcatattatgctctattttctcagctgttcttatttgctatttgatgtttaaaaaactacctctttctcacgtggtccatgccttagactacgtagctatggcaattttgtttctggccaaaccagcataatggatatcgccacattcctgtgactgtatctagattttgaccaaaaactaaagacaaaattaatgcaaattatgtgcagattttatagacgtttattttacttgtggtattatgccttaaagctctttaataagcatgtctaaagtgaaagtagacattttaagattgaaaaaaactggccattttacaagaaacaataaaatgcttaaaaaaatgaatttgaaaaaaaataaataaaataaataagtaaatttgggccaggtgtggtggctcacacctgtaatcccagcactttgggaggctgaggcaggcggatcatgaggtcaggagatcgagaccatcctggctaacaaggtgaaaccccgtctccactaaaaatacaaaaaatgagccaggcatggtggcatgtgcctatggtcccagctactcgggaggctgaggcaggagaatggcttgaacctgggaggtggagggtgcagtgagccgagatctcgccactgcactccagcctgggtgacagagcgagactctatctcaaaataaataaataaataaataaataataaataataaatttggtcagtatgtgacactgagggagaaacagctacaacttatacacttttaaagtcacaatatatagaacttccaatgtttgttgttaattttaatggtatcattcctacaaatttcatttgtatcatcatacaactttattcattgatcttttttgtgccattactaatagaaatatttgcaacatcattgtactcatgtacagtgtaaatggaattggactcttcccatttttcctctactttggttccttccttattaaaatatatgcccatggttaaaatttaaaagacagttaccataaaaatcataatttgccatccctaaaaccatagatgccacaacttttaggaaaaaaaaaaacatttattgagcactactctctgctaggcactagggctaacaaagatagatatgggttctgcccacgtgaaattaggggctagttcaataaagttctgccatgatgtctataagtttccttttctctcctaccaaggaaagatatactggaatgcaagcaattgaaagggctgtccataaaagagttattttaaatctgacccaatttataaagaaagtaatttgcaaaacttacttacttcattaatagtaacacattacattgggtgatatatttgtctacttagtaccactacccactcctatctccaactttcaacataaaaattctcacaggaattgctgtgttcttacataaacctgcaccctggtttctgtgggagagcacttaatacaggccaggagaagcaaaaactggccctccctccctcccctgccccgccaggcttcctcccttcccccctcccccattctccccttccccttacttcctccacccttctctcccctcctctcccctcccttcccctcccctcccctcccctttccctccctcattcctcccttcctttctccattcctccctacattcttctctctcatccttctttcattttggcaatctttctcttgtagcagaaagttcaacatgtactaattaggcactctgagagacaagtttgcgaattcatgaacaaacttgtccacagttacagatctcaaacctccaaatgaagagggtgagttcgaaggctgagagagtcttgatggcactcctatgcccaatatgtgttggtgacacacaactctaatcctgcccttctgtccattccatggagacatattactcccattttgcttaagcttgtcattttctttttaaaatcacctggaataaaattattgacataaaccagtgtattgagacagtccagttgggaactgctgccttaaaaataattattcttctctggaaagtctcagattcaagaaacagaacacagaattacactgttaatcaaagagcttagtaataattctataagcaagatgctctgttttatgttaaagaattaccctaaaatacatgtcaagaggaaataacattatttcagctcaaaaaaaaatacattcttgcaagaagacataagagctgtcatacacttgaattatggtgttcatttatcaaataattttgacttggtttaccacaggtgaaaatagatatgattctacagaggaactttttgtttttccccagcaagacttgtcccaaatttaaataaaaattaaaaagatcctatgtggaagttttgaaacgatataacattgaatctggagtgtgcctcaatgtaaagagtaagagtgcattaatcagagctaaaggagatttgaggaaatacctactgtttcttttcaaacattccattttattggtcctagcatggaaccacataaaaatcctaagagaacagtaagtgaaactgagtttagggagaattacatactaggttcccatatttccttctacttttcattttgatgttcttgaatttagaattctgagtttggactctttttttttttttttttttttttttgagatggagtttcactctggttgcgcaggctggagtgcaatggctcaatctcagctcactgcaacctccgcctcacagattcaagcgattctcctgcctcagcctcccaagtagctgggattacaggcaagcgccatcacacccggctaattttgtatttttagtagaggcggggtttctccatgttggccaggctggtctcaaactcccgacctcagatgatctgcccaccttggcctcccaaagtgctgggattataggcatgagccacctccccggctgactttggaatctttgccatggtgaccacaggaattactgcccctggtaatagtgctttggttccaagactgtccaggccaaagttactggaatattacagtcagactctagacttttccaattcaaggatggggatccaataaccaaaaagacacttttcacctcaggtctgtgtacatttactgaatgctgatcatgtcccaggcatagtgcttgatgctggggatgcaattatgaattaagacattctcagtatcctcacaagaaaaggaggaatgcccacagctcatcagcaaaatcataaactggttcatacttagcactagtcattcctgcataggccatccccattccccagcaatattattaatggattggttgtatttgtgggatatataagtctgctataggccttagtagataagattctgattttcaaacaaaatgtattaataatgatagttcttcaagggaagattagataagtagtaacaggaagcatacaaatatctttcagcgacaagcattctactatatgttttacttatactgtatagttacagagaaataatgtatagaaaacatctagcttagagattggcacagagatgcattattatcattgttgctaaaaagtataacaacccagcaggagagataggtattatttccatttaatagaggaagaaatgaagattcaaagcggcaaagtgacttatctaaatctcacagataaaatgtataagagcagggtaccagcctgagggtgtctggctctaaagctcttgctcttttcaccccaatgctattggatcagtgcagaagctaatttgcataatctctcacttgagagtttcattttagtaaaagtgcactagttaaataagaagaaatacttaattctgttcaactaccatttgttcagcctttatttggcaaaagacaaaaaatattctttgaatgctaaatattcaaaggggaaagtcagaaatttcctctgtaatctttaatcatgtcagacagagcaggtctcctccagagaaggctgccctctttgcactgcccctcacacatgctcatgaacatattaccgaaagcctgcaagcccgggcattgcccttcactgtacttttggttgagtccattattaggggcagtgtggcatggtggctaagaacaccaactatgaatctgagaaatggattctagacccacctcttccttttattctctggggcctggtattaattcttcaactgactctcagcttctttatccataatatggaagatttggagtggtttatctctaaggtaacttgcagttgcaaaatgtcagggcttcctttttgggttaaaagtggtcttaaatgagtcaactgatacagttttaccatagggatttcaaagacaagcctcagttcttcttctggacgataagtttcttgagaacaagaacctttaactattctctcacatcaccttgcaaaatacctattatttaattgttgttcaattgatatgtttcattaataaagtaatgaatgaacactttatatactgaaagaaaataggtaagattcaaaatgcaaaattcaacagaaatatgtttgtagtgtatcagatgttttgacacatctatttcttaatctagcccaagaatgacagaattttggctgactggtcaggctccattgaatcatgaaaaagaaatctgtattttttttctataattaactcagtgtcagaaagtgtatccaatgaaaggccaggcttagtcttctgattcacattaattttgtggaacacttgtaaaggacaacatcaagatacttatatgtgcttctgagaaacaaaacacaaagcaaaccaggtctctgtttcctattatagacttttgtactgagtcacttgtctgagtattagagtcacaatgagtcactaagggtctatggtggaagacactatcttactcatttattcctagcatctaacacagtgctaagcatgtagtagtgtttaaaacattcgtcttgtcaatacacttacgaaaatatgttcggtaatgtttgttatgatgtaaaggagttgatagcccagttccatataacaatacggctagcataagtgagggattactctaaatgtcatgaactcaatcagaatacgcttcaccaaaaatgaataacttaaggtctatgtgccaagtctgagaatgaagttactgaagttgggtcaataatcaggtcatgtactggaatattagttggttgaagaagaaccatcaaactggaataatgttctcagtgaaatgaggattgtgtgatgaataatagagtgtcatataaaatagttttagatcctggctgtaaatggaagcaaaaattagagataatagaaatgaaactctaaagatagaggatttttgagcaatacgctgagccattgccattccacagaatgtgttctgtcctgggccagcagctgatggagaagggtgagaatggagaaggggacaaggtgagaatggaggcataaagcagattgtagtgtcaaaatcagtaatttaggcaaaccctaagttaaaaatcattcattcctttactcagtcaactgtaggtgctgggcacagaactgggcattgtaaaatatgaaatgtgcataagacatgattcctgccttcaagtagtttatagtgaaattactcctctactttttaggactgaaataaaaaggacatcatgtaactgcttctgtgctttaaatttttcatctgtaaagtgacctccctacctcagtagagtttgaagataaaatggtagcattattgcaaatatttgtaatgttattacaaaataacattttgtaatcataaaatattacatggaaataattaagattcttctactatcactgtgataataacagtggtagtaaagaatcaagtaagatctttaaatgataatataaatgttgaaataagtttttaaaatagtagtggttaagatcagttccccaacaggatggagacattgatctgggcataactaacaaccagtaaccaaggccagggaatgtaccatacaatcacaacaacccacaaccctctctgctacttttggcccgtttataaagagatagcttgtgtagcttctctataggtgcccctagatacagccatacttaaactttctgagattttccccctacacacctcaactacttatactggtgtcatcctatgatgtagtacaaaataatagcttctatttattattgttcatttcatttaataatcatctcttgtgacgtaggatttgggactcaaggatgaataactaaaacttggactgaaacaagaattaacacatgaacaacatttggatatttttctgattgaaaacattacttgaatagtatttttctactgaagtttgcaaatgaaaatggtgacattctaccttctcaaagagaatttctaagcatttattactagacatgtttaaaaaattctgaagctttgagtattcctatcagagcacactggaggaaacagaaaagtcaacattcaaggctgaaaatacacgagaacaaggtatatcattaccatggtataattatgtgccatgaggatggggcttgggaaacctgacaatgcctgaagaaaaaagagaagagatagaagaaatgagaaaatgtcaagagacaaagagagaaactagggcaaataaaagccaaccttctcctagtgaaaccagaaaggactcttcaagaaataagattttgagagtgggcatgacatttagccaaaggcagtgtgcaagtgctgagcattaggtagaagaacagacaaaaacaggtgcttcaggacagctagagaatctggatggatgcaagccctcagcatcattcaggagtggggcatgggcattgcccaggtcaggagccagaaaaaagggctttgccagccttttggcatttgtgtggagtaaacttaagtgtcattctgtgcccactatgtttaccaacatagggagaatctttttgtgttctattaaaaacacaacagtaaatatacttcaacatttctgttatagcacagacagatgtgggataaattcctggttttgccacttaccagctaggtgactgggtcaattattttgcttctctgtgcctcagctttcacttctcttatgagaataacccacttaatgaggctgttgtgaggttgaatgaaataactgtgtctataaaatatcagcgtattaggttctttaaaactatcattttcttcctgctttttacctatatccctgaggtacagggtcagaactcaaaattaatagccagtatttattgagtgccacatactgttctaagtttgttacttatagtaactacttaatctgcatagcagctctatagggtagatactattttattaacattttttgagagagaatacagaggcactgagaagttaaaaaccagcttgcgtaagttttcacagctaggaaatctcagagccaggactcagttttacaacatcagggaacctagcaccaaagctggtgctcttaactactgccttgtaatgttttctctaacccacagcaggtattgttatcatgaattcacaccagggttgtgaaaatcgaagttggtagcagagcaatggccacagaagctattttccttgacactagtaaatgaggctttcaaagaaaaacaatctgactttaaatcctgactcctcttcttctagttatgtggctatgaataagttatacctgttcacaaagggtgttgtgatgattacatgaaatgatctttgtaaagtgcctaacacagagcagccattccagaatgtagttcctattattgttatgctttggattaaaaaagaaaacaacacatctgctgcttatagttttttttaaattatcttttaatgtttggctataagcagccatatcagctccagtttctcccatctaacattgaatttgctactttttttttttttaatttgagacagggtcttgctctgtcacacaggctagagtacaatggtgcaatctcagctcactgcaacctcaccttccatgctcaagtgatcctcccacctcagcctcccaagtagctgggaccacaggtgcataccaccatgcccagctatttttttatatttttaacagagataagatattgccatgttgcccaggcagatctcgaactcctgagctcaaacaatctgttctccttggtctaccaaagtgctgggattataggcaaatgtgctacttttaggagatagtgaattagaatttatatatagagagagtttctctctataatcactctatgtatctatagaatttatatagagaggaataggaacagctccggtctacagctcccagcgtgagctacgcagaagacgggtgatttctgcatttccatctgaggtaccgggttcatctcactaggaagtgccagacagtgggcgcaggtcagtgggtgcgcgcaccgtgcgcgagccgaagcagggcgaggcattgcctcacttgggaagtgcaaggggtcagggagttccctttctgagtcaaggaaaggggtgacggacggcacctggaaaatcaggtcactcccacctgaatactgagcttttcccatgggcttaaaaaatggcgcaccacgagattatatcccgcacctggctcagaggctcctaagcccacggagtcgcctagcacagcagtctgagatcaaactgcaaggcggcagcgaggctaggggaggggcgcccgccattgcccaggcttgattaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtagttctcccagcacgcagctggagatctgagaacgggcagactgcctcctcaagtgggtctctgacccctgacccccgagcagcctaactgggaggcaccccccagcaggggcacactgacacctcacacagcagggtattccaacagacctgcagctgagggtcctctctgttagaaggaaaactaacaaacagaaaggacatccacaccaaaaacccatctgtacatcaccatcaccatcatcaaagaccaaaagtagataaaaccacaacgatggggaaaaaacagaacagaaaaactggaaactctaaaaagcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaatgcaaagaagttgaaaactttgaaaaaaatttagaagaatgtataactagaataaccaatacagagaagtgcttaaaggagctgatggagctgaaaaccaaggctcgagatctacatgaagaatgcagaagcgtcaggagccgatgcgatcaactggaagaaagggtatcagtgatggaagatgaaatgaatgaaatgaagtgagaagggaagtttagagaaaaaagaataaaaagaaatgagcaaagcctccaagaaatatgggactatgtgaaaagaccaaatctacgtctgactggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaaaaaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccagcaggcctgccctaaaagagctcctgaaggaagcactaaacatggaaaggaacaaccggaaccagccactgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccagcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatagtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaagtcaacaaggatacccagcaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaacagtctctcagaccacactgcaatcaaactagaactcaggatgaagaatctcactcaaaaccgctcaactacatggaaactgaacaacctgctcctgaatgactactggatacataacgaaatgaaggcagaaataaagatgttctttgaaaccaatgagaacaaagacacagcataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggtaatagagacaccaaaaacccttcaaaaaattaatgaatccaggagctggttttttgaaaggatcaacaaaattgatagaccgctagcaagactaataaagaaaaaaagagacaagaatcaaatagacacaataaaaaatgataaaggggatatcaccaccgatctcacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggagctgaaattgtggcaataatcaatagtttaccaacccaaaagagtccaggaccagatggattcacagccgaattctatcagaggtacaaggaggagctggtaccattccttctgaaactattccaatcaatagaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaaacgaatccagcagcacatcaaaaagcttatccactatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaactccattgtctcagcccaaaacctccttaagctggtaagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccctatcaagctaccaatgactttcttcacagaattggaaaaaactactttaaagttcatatggaaccaaaaaagagcccgcatcgccaaggcaatcctaagccaaaagaacaaagctggaggcatcacactacctgacttcaaactatactacaaggctacagtaatcaaaacagcatggtactggtaccaaaacagagatatagatcaatggaacagaacagagccctgagaaataacaccgcatatctacaactatctgatctttgacaaacctgagaaaaacaagcaatggggaaaggattccctatttaataaatggtgctgggaaaactggctagccatatgtagaaagctgaaactggatcccttccttacaccttacacaaaaatcaattcaagatggattaaagacttaaacgttagacctaaaaccataaaaaccctagaaaaaaacctaggcatcaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcagcctacaaaatgggagaaaattttcgcaacctactcatctgacaaagggctaatatccagaatctacaatgaactcaaacaaatttacaagaaaaaaacaaacaaccccatcaaaaagtgggccaaggacatgaacagacacttctcaaaagaagacatttatgcagccaaaaaacacatgaaaaaatgctcatcatcactggccatcagagaaatgcaaatcaaaaccacaatgagataccacctcacaccagttagaatggcaatcattaaaaagtcaggaaacaacaggtgctggagaggatgtggagaaataggaacacttttacactgttggtgggactgtaaactagttcaaccattgtggaagtcagtgtggcgagtcctcagggatctagaactagaaataccatttgacccagccatcccattactgggtatatacccaaaggactataaatcttgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgattagttcatgtcctttgtagggacatggatgaaattggaaatcatcattctcagtaaactatcgcaagaacaaaaaaccaaacaccgcatattctcactcacaggtgggaattgaacaatgagatcacatggacacaggaaggggaatatcacactctggggactgtggtggggttggcggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaagaaatatattaaaaaaaaaagaaaaaaaaagaatttatatagagagatcatttctctctataaaaatcatgtggaaatccagtcctggcaagtatgaagttgatatttgtaaaaacacgaacataaaattgcctagctgataaggataaaattataatattctccaagtcacaatattctcactgcttgaaaaaaaaagataaaatagtgctgtcatttgacagattaaacagcatgcaataattccttttctccatatagcattgaataagtccttattgagactacttaaaaaatggctatatatatcgtaaaccaaaagtaaacctaggtaagtgtaatagcaaataaaaggttaaaatgggaagtaaaaaaatacaaggcccttagatttgcttagccttgacagaaatactgggaaagagacaattatggcttgccaaatactgatctgttccctgtatttcctggaccctttaggcagggccctgtggcatgtttcagtcaatggtctatgagcaagtgtgtcaggatgcaaccctttctcttctgccttggctatcaaggaactgatttctaatggtgcagctctaagattgtggcccctccatcattgtgagtactgagtgactgtgtggagcagagcccttcctcaagccctgattggtatgtactgtggatgagaaataaacttttatgtgtgaagctaatttaaggattgttgcatttaagaaatatgttgcatcattgcctgtcttagctttgttaatacagtcttgagtaattttatacagcactgtataatttacacagacatttcagatgcatgatcttgtttaaactgacaacatgcttaaagaacattcatttggtccaaaaagcataaaattagaggctgtattgtcgtacattgaagcaatcaaggtttatattaaatacagggaaaactatctaagaatagaggttgttgaagagaagccatgtataaaggatacttagaagaggatttataaattggatgggaaggaagggtaggactagaagaggtggctttgggttgcttctaattcttgagctgccatgggaattgtgaaatgtccattcccaggagagttgcaatacttggtcttggaaggtttgtatggaatttctcagcaaaagcaagtgggctcccactcgtccctactttaaagatggtccagattttaggaagaaatagaataggcttaggctccatacagctgagctgagtttgaactaaaaggtagatcttccactttctgtaccacagcaattaatgaaattcctaatggctttatgtcatggtggtaatgagtttctcagcttttcacattatacagatatttagacatattcttttatcaatgcatatggtataaaagctcattctgactacagaagttatttaaattatctcagagcaaaaaatctttacaagcaataaatctatttatgggaaaaaaaaaccacttctttctaggccctttgtttctcaaatgtaaataaaatgtgaggtgagttttctcccagctcttgggtattaaataaagcattgctgcactggggtttcaactattaatgaaggcattaagtgcttttatgctagataatgtattaagtcttttctcttacaattctcaaaatccagctgtgtaaggactattatcatttgcattttgcagttgaggaaactgaggacaaactgttgataacttactgtgttccaggcattaaatgagataaacagggcatcctcctcatttttcttaccattaagaatccatctaaggaaccaaattaatggcaggctttaatggctaaaacattcattgtaattaatgttactgcacaagtggctctgtgaccacaattaaactgaacaattcaggctgatttgctgtaggacttctccacaaccaaattactttgtacggaactaaaaatgctgttactgatgcggtctcaggctgatcctcagcaaactgaattactcctatttttttcagtctttgattctccagccttttggagacaccatctaaccgaaatgcaagttcattttaacatgtaaagtatcacattgcaaacaatttatagaagaacgtaatgaacaaaaagaatggatgacaagagtttcaaaaacaaacaaaagtctgccattatcaatttactggcccttaatctcataactatgcccttgattaggtagagatgatgtcgtaataggtgcattataagacaatatatcaaaatgttacccagatgcaaataaatttgcagatattaaggcaagaaacttatacaacccttaaaatgcatttattcctttgttttgcatattggcaagaacatgatctgaacataaaagtctcacagcacagtggaccttattttaaccctaaaattagctcaaacaatataactgaatcaaataaaatatgcacaaaaacaacaagatttaagattaagatttaactatgactatgactgtcatcacatcaaatcatcaaagttggcttcaatgatctgatgtaaggggaggatgtccattcttccctcccttaaagttgacataataaaaaataattttcctcccataacactggcttcttctcctgtgtttcctttcctagttaatgacatagccgtgtatccaaccacccaagccagaaacctcaggctcatcattgacttctccctttccttcaaatctaacattgctatcactattgaatataatttagaatgttgccttgctcctcttcatttattcccattgcctgtgctttaatccaggtccttctttatccttgcctatgttattataataatccccaactggtttaccaacctctggtctcagccgcctatgatccatccttcccatcgccattgggataatttctaaatcaccaatatgtctacatcactcctctgctcaaaatccttactatttagagtcccaagttactttacatgatattcaagattccattcacctgaacctaatctatcttaaaaaaattcagtctgcagtttccacgttttaatcccattatgttcattgttcccaaacataacatttacctgttcatctccacacttttgtacatgctcctcctgcttatcattttttctttttctgttttttttctggttattcttcctaatctatttcaaatgtttcttcttatgaaaatacattctgagaatcgacctaatctaaaattaattgttctcctctctcagttctcatagcttttagttcctaccttagattcctcactgtcatcagatttttaccggagctcattatgaatatacttgttttcttcactgagacagtgaagcaattctgtgatgatcaaaggagatctgagtttagggagtcagaataactggggttagttccagttcagtcattgccaaggctcaacagttgtatctataaaatagggatggatagatacctacttcaaaagataaaataaagattaaattaggtaacatcagtgacagcatgatcaacatgtctcatgagcgggatcaagagacatcaaaattaagtagcaggatcatgagctatctgagagtgggatatatctctaattcaactctgtgcctccactgtacccacacatggtatgtgctcaaagaatatttggtgaagaaaataaaaagaatgagataaaattttctactttttaatctaggaaacatagagtaaaacttggtcagacacagtggctcatgcctgtaatcccagtactttgggaggccgaggtggcaggatctctttagcccaaaagtttgagaccagggcaatatggcaaaaccccgtctctaccaaaattaaataaataaataaacaaaattatccagtcatggtagtgtgtgcctatagtcgccccagctactcaggaggctgaggcaaaaccccatctctaccccaaaaaaaaaaaattagccagacatggtggtgtgttccttagtcctagctactcaggaggctgaggtgggaggatcacttgagccttggaggcggaggctgcagtgagctgaggctgcaccattgcactcccacctggaagacagagtgagctccctgtctcaaaacaaacaaacaaacaaacaaacaaacaaacacaaaaaccaaaactggcttatagaataaaaataaactctacaattgtaagaatatttgacctttcaaaatactgacattcttatgcctatctttacaacatcttaagaaggccaatattatcatcttccttttgcatctgaagagactgaggcataggacaattaagtggcttgtttaggatcccaaagtcaggcaagagagagtcatggtctgatgctccctattttagtctacaggactaggttgcctggttgatttgctatttgctccggggtgggaattaatttacatctcaaaatcatttcagaggatatgtgttttgcatgggcaagatggcacaggtttaattctgcatttccgagaagggaaaaaaaatgagatcaactgttactggaatacttttctcagctccacgcatgttctgtctgtcctctttggctgttctttcagagaagttatcatcgtctactcattcccagcaaaacgtttcagaaactcctgagcaccatcttaaagtgaaagatgggacaacaaaccccaagcacatatttcagttttacaatatttaatagcttctcatttcagtcagaatatggctgcttattggaaaagtttaggctaatgacagtgtagtagaaagagtctggatttttaagtcaaaatggttctaatactgctggccgtgtgatcttcaaacattgatttcctctgtcccagctttagggttgctcatctgcatttggattcaagagtactttcccagcaggttattttgaggctaaatgaggtaatatactgatagagaccctttaatactagctacttaataaactttagatcttcatatacactaaagctcattattaggatctttgggagtcatatattaaatgtaaatgaattattcaggcagaactttctctaaaatagatgttacgcttcactgctttagcaaacagagtatactgaacataatttaaattcttctgaagtctcatgactatcattcaacatgtcatttttggtactgtgtatcatgcagtagtatcttcaaggctactgaggtgtataaagctgtctgcccctgccctaaatctgccacacatttaaatcctgcggccttacctccagctggctttcatctgccccatattctccagtcccattgcttaggcctagtttagggcctcacaatttctagcttggattgctgcagcagccaaacaggttcccctatttcctattcctattctcagcatccccaagtccttccttggcacttagcaagagtagtttttccaaaaccacatctgagtacttgacatgcttgcttaataaacaaaacaattctttcaatggctctctatgaactacagccttaagtccaaattcagcatggaaggtatgtaaatacctctgtgagctcaccttatcacctctcggacttccccttccctcatgcctaacccctccagaggagagtaggcttctgtcatgctgaaccaggtcttgcatgatagattcctgagggccttaggctatttcacacctccttgcttttgcttatccagcttcctctgattggaaaactgttacgtctgattggacaactatctatcgcctccctccctatcattggttttctaataaacacttaccaatccttcaaaagatccaaaaagcatcttaggttttaggaaacccatcttgcccttcctttgtcaattccctgactaggagtgaccacttacccctttctttgtgacaccatggggcactgaatagctcttcataacagcgtaatactgtggaattacctgtgtaactcccaccgccactagacattgtgttttttgaggacaagatcctgtgtcatttatcaagccccaaccacagggcaggcactctataatcactggttagtatctttttgagtcctactagttctctctttctctcttgctctcattatcctatctgtaacctacagtgagttgaaaagcagtattagtagtttggaagaactaaactaatgttaaataggttttgcatgaggggctgtagagatatctttgaattaagttcatgagcttggaaaatctatatttctaggaacatttattttggctactgattagttcttaatagtgttttgatccttgagattgttagataaattgcctacagataagctgagtgtaatctgatgtgattgacatttattgaaaccctccctaatgtcccaggttctgggccagaaactgagaacataaaggcatggtcaacaaggcatttaagaggctcatgtatacgtctatgccagttaaaataagctcatgatagagagattattcacacacacatcctatttttttcaaagatgaggaaaagatgagttcacacagctagctatagggtgtgtgtgtgtgtgtgtgtgtgtgtgtgtgtatgacattcaattccaggtctgtgtgaatccagctgagctctccattttactctttcctgttcctattggaaccagcctgtgaagacaagaatgcaatgtttctcttgagaaattttatacatctccttttctgctatcacaacttaaagtccattcctgaatataaaaaattgaatcacaaaatttggcagcctgtatttaatgggacttttagaaaacttgtttgatgctgtggattactatcgtagctacatacagtcaaggcagacaggaagagagagagggtagtgtctgagtgccaaaagtcatccatgttcttagtctagcaatagcaaatacacggccctcctgtacagagagatgtgcagactggggcctctgccctggggtgcattactgcccacacaccaatctcagaagcaatgactatctctgaaaactcctacctttcctaaagcctgagcacatgttcagtcacctcagtgaaagtgaaggagggaggaagggtattagtttagtcttgtcaaacatgggctataacagaggctgcaaacagactttgcctcacatgccaaagcagatggtgtgatagaggctgttgagaaagcttctgaagttgtctctggactcagtgggaagaatgccgagtgcaatgataaacaatgtctgttctggtattgagggaagcattgcctataggtatttactatccttggtagaagtttcagttgtcatttagcataagccaggctgtgctattacttagtgtagaagttctgaactcaactaagagcatgcaatgatagagtaagatacaatctataatacctgtcaaatctggcacatagcagatgctcaataaatgtttactgaagaaatgaatgcaaagtcctatggctttatgttggaagagaaatagagttcttcccctcataatcaggggaagtggggtacactgagattactttgccaagggtcctcaatgccatgccgaagagttgggggcattattctatatgggctagtagtttccaaacttagtttaattccctaaggtgttctgtatgtagaattcctgtgatgtatgtagctaccctgtgatgttctgacttggtaagttggtaagtgtggggatggagccaacgattctctttttgtttgaaccacctgttagcttctcaaacaacttgtataatcagccaaatatgagaattacagctgcaaagtaatatgtgatgttctttttttttttttttttttttgacaaggtctcactctgtcgcccaagctggagtgcagtggtgcgatctcggctcaatgcaacctctgcctcccaggcttaaaccattcttccacctcggcctcccatgtagctgggactacaggcacatgccaacatgccaagctaatttttgtatatatttctttctttttttttttggtagagatagggtttcagcctgggctgatctcgaactcctgggctcaagtgatctgccggcctcggcctcccaaagtgctggggttacaggcgtgaggcacagggctcagccgtcaatgaagttcttaaggagaagaacaacttgctgtgatcacagatctttgcttctggttctccaagttcttagtgttttctgcttattgagaccagaacgaaccctgctttgtagagacagacctaccagactgtgtcctggtgaatcagactccagctcccaaagcactttgccacagacccctcttcctcaggaagaaggatgaagattgagcacttttgcaaagcaaccaagagagtaatgtgctgcagtgggaataaatcatggacagaggaaatgaatgaaccacatgtttctggatttcaaatatcacttctggaaatgagcgagtctttctgctttctgatttcaattaattttcttacaaactctccctagcatttttcattgcagtcaattatttaacttgttccagtatgaaaattgggtccttacaaaacacttaattgatttgacccgtgctctgacacaacactttgcaaaatgcatgtgcgttcatacagattagtcatctgagtcattattttccagcaaattacagcaccatgccggcagtggatggcacctaatattgtgaaaatatgaacttcttattcttgtggagagttacaacaaagaaagggtggttggaagtccaataaggacatcatttgtcctaagactttgactaggagtctattcatctctaacactgcctccctgcaggagaaaacgttaaaccaagaaagagattggggcagaatggagagaatggggcctgggcccggcagactgaatctgaatttcagagcagctccttggccatgtttcagtcttagaactggacaaaatttttttttagctgttttgattcacagcacacctctgtgtaaatttggatacattcttacctgcctcatagtggtatagtgaagaacagaaaaaatgaagagagaacctgaatatagtaagtgctcaggaaatggtgacaaggatgtgatattgctgacaaaattagtttatcattttttattccaattttacttatttataattcagtctcacctatttatagaacaaactgaggcaatatgatcacattttaaagagcattcttattattttccttcatgattctattttctatatccatacactcagtctaggcctatgctttaccatctttttttgttttagggataaaacccagtgactgtgtgtgtgtgtgtatgtgtgtgcatgtgtgtgtatgtgtgtgtatgtgtgttcgtgtgtgtgtgaatgaatgcatacaagtgatggtagtgggagagagatagatcgcatattcaataaatcatataaaatctctgcacaattttttaaaaataaaatagtattatacaccgatcaccacgacaaagaatattaacagtgacttagattccctcaggatgccattttttatataatttccttcctaagtactcttcttccataagtaactctcctgaaattagggtaaatcatcctctaactatctttctttttttggcccatccatgttgatgtatataacagttcttcattcattctcacagttatattcattgtataaatataactcatacatccatcttacattgttatctttagattttattaacagtatcagtatatatattgttatacatgtcttctatccctgtatacaaattttccctaaggtacatgcttaaagaaaggagtcgctgagtaatatttttaattttattaaataatgttaaactgttttccaaagtagttcttccagttgacacagtggatgagaattctaacagtttcatatcctctctaacacttgaatcaactggacttcataatttttatcagtttagtaaatgtgagtggtgccttattgcagtttaacttgtaattccttgattatcaatgattttaagcatgttttcatatgttaataagtaatttgtgttttttcctctttgttttaaaagtccttacccattttctatagggctgtttgaatctttctgattgctttatagttctccatgtatagtattctagaagtgattttttaccagctatgcaagttgcaaatatctgttctcttttattttcaattcatgtcacatttcacctcagaaaagtcagatataagatcccaaaggtttttatttctctaaactgctggtatgagtagctaaaaatatagatagatttcaaaataaataattcattactgtggtttagcagaaatatattcatgaatatctttgctcaagcttgcagaaagtgctgaaaagctaattaaactaaactaaactaaactaaattaaaaacaaaaagacagcactgtgatgatgaaggctttcatgccaagactccaaatatactagaaaaatttatcttcagcagtttactatattcacaatgacaatgcttcaaactgcttcctttattcataagagattccacctatttcaagtgtgtttatcatccagccagcacaggcaaatgttaccaagttaagattgaatttcaagtgtgttcttggaataaaacttctgagaatatatttttctttaatacaattctcttggagtcatatttttggtcaactcatctttgggtttttgaggaactgaatatcctcacctgcttttttctgaaacaagtgtttctgggagctgaaaaatacactttgtcaaatttcagggttttttagggtagtgaaagtactccatacgatactataataatggatacatgtcattatacatttgtctaaagccatgtattgttcaataccaagagaaaaacctaatgtgaaaccatagactttgggtgataatgatgtgtcaatgcaggttcatcaaccgtaacacatgtgccactcaggtgtggaattttgataatgggggtggctacacatgtgtgggggcagggtatatggaaatctctgtaccttcctctcaattttgctgtgaacctaaaactgctttaaaaaaagaaaatctataagacaaaaactaatttaaaattttgttttaaattcaaagggtgttaaatgaaatttatgggaggctattgtttggactaagctcctgcactaggcccaacaggccagagcaaatcagaatagagtcattaatgttaggtgccatataatcaaactttgaaatggaccagttttcaaagacagagagagagagagagagagagagagagagattgattgattcacagcaaccaatcagaaggggcccagtttaacagagccagaaggataaggaagtttcctctgatttaaccctatgaggaggacagctttaaaatgcccaattcaattttgtttcccatttctgctttcttgagccattttctgcctataaagccaatctcctctcctcagctcactggagtgccttatctaagtctttggatgagatgctgcctgattcatgaatgaaagccaattcaatctttaaatcaaattggttaaaattttgtgttttctaacaggggaaatgagctttttacgacccactcggcaatggtatttaataacgtggagaaaaaaacaaaacacgtaagcaagcaagcaaagaaataaacataaatgtcccaactaatttctaaagcagtgggaccagggaaataactccagaagagacaacagtggtaacagcaacaacgattgattactaagtgccacataatattctgaagagctttaccagaataagcttagttaatcttcataagaaccctatgggataagaactggttttatactcactttaaatatgaagtaactgagactcgaagagtttaaaaacttattcaaggtcatgcagcaagttaaaggtgcagctgcttcctgcagttcttactttctatattatcagctatgttctaaaggactgcaaaagccaggtttgtgaatggaacacagaacaatacatgcaagagtacttgcagtgttccactattgtccacaaatgtgagaacttcatacttcttccatttcatggcagtcagcagtcagcatttttctgctatcaagccatgaaaggtagcaataaaaacattagtatctcataatgcatagcatttaccgctctaaactgtcgctgtgatttacttatctgtgacttgagatactaggagaagggaacatacatttgttgagtgacttcactatactagttgttatgctactttttagactcattccacagagtcatcggtgattctttggtgtttaactccttttcaagaaagggaggagctgctacttaaaaacataaattatcttttcatacttaaaagatttacacaaacttgagatccacagaggatttaagctcttaggaaccagaggttaaaaggtagtcagtatacactactatacatactagcatatatgctaatatatgctaacatttatagaatatatgtatatatactatagttgtagtcagtaaagaaattttaaaacacaacataatgaacaaaaacaattagctaatctgtatctatgtatctaaatccgtaggcatttattgttttattaagagtgaggaaaccttagatgggtgcagccagaagctaaaaacaatcttatcatagtgaaagatgcatcagaggtactgaaagcctttaacatctccactagtatttctcatcatctttgaaatcagaaaaaacaattttgcttccctttaggaacgtcagcccatacagttgtcagggtcttcacggagttgacctctgtttaaaggaatagagctactgctacttgaaaacatacgttagtgtttgttaaaaaaaaaaaaggccgggcgcggtagctcacgcctgtaatcccagcactttgggaggctgaggcgggcggatcacgaggtcaggagatcaagaccatcctggctaatacattgaaaccccgtctctactaaaaacacaaaaaattaaccgggcatggtggcgggcgcctgtggtcccagctgctcaggaggctgaggcaggagaatggcatgaacccgggaggcggagcttgcagtgagcagagatcgcgccactgcactccagcctgggcgacagagagagactccgtctcaaaaaaagaaaaagaaaaagaaaaaaaaattcagctgaattaaatttaaaggagtttaattgagcaatgaacgattcgcaaatcgggcagcctcctgagacacagcgggctcagagactctagcgcagccacatggtggcataagatttacagacaggaaaaggaaagtgacatacagaaaacagaagtgaggtacagtaacagctggattggttacagttggtgtttgctttatttgaacacggtttggatagttggctgcatttgattggccaaaactccatgattggcacaagtgtaggctatggtctgtttacacctccacttgttatagttcacgatgtacagagaaacctttaggccaaacttaaaatatgtaaggaggcagctgtaggctaaacttaatttaacatgtttaaatctcatactctcaattcacagaagaaccgtctcagttaatgtattcatgaaatattgtctatgggcactatggtggggtctgttagttgtctcccagtacccactgtccccgctgttctcttttagtaacaggactcctcccgtccatccacgacagagtcttagcaaggcacatggacacttactacatttcctacaactactattagcaaatggtttagcaatttatttaaagtatttgattataacccaacaatttcactcctggatatacccaaaacaaatgaatgcatcttttaaaaaagatttcttcaagaaagtctgtagcaactctattcataagagccacaaactggaaataatccaagtatccttcaacagaagaatggataaacaaattgtattatattcatgtaatggaataatacataaagtaataaaaagcagcagactactcaaatacaaaacaatatggatggctcttataaatatcatgttgagccaaggaagccagacatgaaagaacaaagactgcaagtctaaatttacatggagtttaagaataggccagggctaatctatggtataaaattcagaatagtagttatttctcagggtaggggacaaggtctaggattgactgaaatggggcatgaggacgtcttacggggtgttagaaagttctgtatcttgacctgggtggtgactacatatacatgcttttattaaaatccattgatccatgcatttcagtgtatatacagatgctccttgattttggatggattgtgtccaaataaacccactgtaagttgaaaatatcagtaagtcaaaaatgcatttaatacacctaacgtaccaaacatcatagcttagcctagcctacattaaatgtacttaaattagcctacagtgggcaaaatcatctaacaatgaagcttgatttatagtataggttgagtattcctcatctgaaatgcttggggccagtaatgttttagatttcaattttttttttttttagattttgaaatatgtactttaaaaaatctgaaattcaaattactccacaatgagcatttcccttttcatgttagcacccaaaaagttttggattttggaacatttcagattttggattttcagatttgggatgctcaacctgtaaaatgttgattatctcatgtaatttgttgaatactgtactgaaagtgaaaaacagaatggttttatgagtacttaaactacaatttctggtaaacatgtatcatttttgcactattgaaaagttgaaaaatcctatgtcaagccatcataaatcaggagcaatccataattatacttcagataaataaatcaggacacacacacacacacgcacacacacagagagagagagagagaaagagagagagagatccttcagatactacagctggttctaatataaaagctaaaagcagagttgattatgctatttgttggggcagcaggctaatgaatgaactgctttatttcatttttagctctatcattataatttaaaatccaacaaactatggtggatttctattacacagccaccattttgaaccctctgctgtccaagaacctttctagccaaccaaatgatagcaagccgtcagcacattcaaacagaagcccccctttaaagtaaaatactaggctgaatcatatgaaaccttgatagtttcatatggtttaacctaatatttacatcaaatcataggatgaattaaatcagagatgaaagtgaccaaaaaggagatggcaagaagaagagtacttcccttggttcgacttatttcattatgggcacaaatggcctacaaattgaaataaacttagaagatttcctaagccaggcaatcttttaaccctagacatgcccttctataccaacatacaggcttcagagacctgagataaccatttccagccttgtagccaacctgccccagcagggcttcatatgctgtcatattcttggtccaacaggtttagtgctaatgagaaatctggctctgtgctcctttctggctccaagcacaactagggcagatggaggagccctgagagctggaaatgacagaattttgaaatttcccattaagctggcttgagttttagttacaatgtacacaaagtaggagaatctgattttacgagattatctaacaattgattttaaacccaaaaacgaaaatgtatttcccattattgacaacaacctaggagtgtataagggcatgtgtgggatctttgcatgcatcctcccttctccccactctcatccttaatctctctgccaaccttggagttgaaataacctgaaatttgaaattcatgacatataatccctttctatttccaagcaaaaaaaaccctgctggaaaagtttgctcctaaactagccatgttggagccctatcgttttctactgaatttttcttattaattcagaattatgtcctcatgtaaaatagaatttgcctttcttgggcaaaggcagccacatagatacaggttggatatcactctctctgtaggacatgtggtcaagttttaaatacttggtacttggatttaaatgcttgtccttttgggaaagctgagaattattttcatactatgaaattttgacagtgtaaccccagggtctcaacactcctcaaacatcacactaggtaaaaatattgaaatgctactggtaagaatgtccccttttcatgtccagtgtttatatttactacaaatactaggtctctaagacctgggctcctgtactatgcagcgtccccaagaccatgactaaaaccgagcgtgagagtcagtggatgtcggacaggaagggatcccagagtttacctcttcctatctatgtggtttacgtgaaaaacatctaaaagccagaaatggaagtaattggcacaaggctgcccagctaacaagaggggcaccacaactcaaagctaggtccatggtgctgcacgaatctgtatcagtgtgggaaaaaggaatgtttcgacttgtgagacatgattgaaaacagagcaaaagggaaacagtaagctaattaaacatctgtggaaccctgtgatttgacgagaagtaaacaaagcaaagagggaaaagaagggaactttagggactggcagtatagcaaccaactatcgaacagacagggtaacagatctgtggtaaccataatggaggtaatatttattaagcacattcaatctgcctagaagtgtgtcaagcaatttaatgcatcatctcatttaatcctcacaactatgcaatgaggtaataataataataataataaataatgactaccatttattgagcatcttttacatatagactgaacactatgctaagcatattataaatagtatctgattttatttatacaacatgattatgaggttggtactcttgttatccacaatagaaagaggagaaaactgagacttagagaaaacaacattttccagatcacacaaccggtaaacagaagaaacaaattaaaacccacatcattttatcaaagaacctaatcttttaaatgcatcattttatcaaagaacctcatcttttaaatggatcactattctggctctcaagtacaggttgcttaaaaattaacacaaaaacattatttatcaatactcatggtcttttattttccacaaaaaaaatcagatctaaaataaaagtcagtattttacaaagaatagtctaattgtctaatctatgttgcaggctggagtgaatcacagttttggcactggatctagaactgttattgtctgtggtgttaaaaaaattatgtgtattaacatgggaaaacaattgcatagcccttttgaacgtaaaaggaaatatgtttaatgcatgtatattgagaaggggggaagggggagagagagagagacagagagaggcaatatgacagaattcaattcactgcttccaggattctgtaggaggccatgctgttcgataatttcagaactataattttaaaatgagtaatcttggtaaccaaatccattagtgaagcatgctatagaaaacaaacatcgtgtgatgactggccctagacaaactgacaagctttgttttttgcttttgaaactccaggcattatttacatacactcagctctaacacaggatcctttaattaagacttttacacttatctgtacataaaaatggaaattatttcaataacagcacatctttttcttttgctaaattgccagttagaaaggaaaattatagaaattcactgaatggtactgaatgattacctctaaaggttaattatgtccccttaaatgggactcacttaactattctcttctttgtccgctgaagcagtaagggactgatactgaactgaaggacgggaacaggggacactgagggcttgttgccaggtggcagctgtcaaggtgatttaatagctattcaaagatcatttctttctgcttttcagttctccaggagccagtttacctttagctgcttttgaagggggggcaactgtttgagcgggagggaagcatgcatttgaagtagcacacaggtataaacatgggtgatagaagtcttatatacttgacctttaccacacacttggagaaatggtgcacattaggcctagactagaggaaagagtttaattttccatttggatccccatggagtgcttaggatcatactttttccaaggcaatttatcactaattcttccatccattatctgtccccaccccctcctcaagggcaggcacagggctaggtgctttacttgcatatacaggcactagagcagagtaacagagttagattttggcttgactattggctttgccacctaagagctgtgtgatttagaacaggcttctcaactctgagccatattttcctaattgtaaaaataggtcaataatgttttatctctcaccgaattggtgtagggattaaataaggttaaatgagaaaatgcctaaaacatagtcagcatctgataaatagtaggcatattaggtaccatcatttccatttcaggtatgagaaaactgaggcttaaaaagataagtgacttgtgcaagatcttaattctagtaatgaacagagataagatctcaccccaggagtatgagaaacatactcctcacagtagcatgcctctcctttaataaactcaccatctagggaggaaaatagtcccttaatcttggaattttctacaaccattataacggaagtgctatgagagtaggtgcagaggtgaaagcctctaggaaggcatggtgcctgaatggagtcttgaaaaaccattaagaaccccataaactgaatgggaaggaggaagagacagtatgcagattgaagaaagggcctgtgcaaaggaaaggagaaatgaaggaacaaagtgcttcctgaggctccatccagggcttttaggggaagcagcagaggagggtgtagaggtaggcagagtccaagttaaaatagtcttctttacctatttggtgatcaagagcagtgggtatgttttaaatagatggagaaactcaagggttaaaatggctggaagcgaatgacacttgaatcttttccattttcacgtggaaacagaacatccctcccaccaggcaggctggcctaatgtttccatgccaaccaattgcagaggcctgggataggctaagcctaagtcaggggagtggcatgggtaaacaagaacacagaggggaaaagctagggttagggtcaaactatggaggcaggcagcaaggggagtgaggagcagtgtactatggagtcgggaagactggagcagtaagaaccagaaccagaaatgaggattgggtaaacctagttgtacctgaatttactgcaagcccagtcattgctatatacacatgtgcacacacacatatgcgcacactcaaactattaatatgttctttggcgctcagctgcactctgaacattttcaaagggacctcatgaaaattaagaatttctaatcagttcatttcatcactggaaatcaaaatgtaaatgtgagaactctgattttcaagaaatcttaccaaccttttcaatctgttttacaaagttatttatttttgaaacagggggttctatttttgctgagtgttagcaaattgtagcatcagattcaaggttggtttccaaattctgagtcaactaatgttaaatgtgattaaaattgaaagtcattttaggaactggccttctcattagctagctgcaggtttgcactagacttccatgcaagaaatctgagactttaaagaaatgattattttcagcttaaacatgagctgaggaagtaaaggtaatttttttaaaaagaaaagaaaccaaaaaaagaaagaaaagataaaatagtggttctcagatttgctgcatactgggatcactagcaaagctttaaaaacactaatgcctggggacccactcccagagattctgatttagagtaggtctgggctggggtgagacatcaaggttttgaagagctctacaggtgcttcttacctcgagctaaggttgagatacaatgagataaagcagagaggcagctagtaaacaaggcgatttttggcccctccctggaaagaaagccagtgtgaacttgatgaagtaggaaagaggctgagacctgatttacaatggcagtggctccctgctcttgatcaatgtgagttccaaattcagtgtagggtggggaggtggagttggaggttcttttattattggtccctccactacactgggagtaccctaaagcaaggactgagtacttttatccttgtattccttggacatgtctaactgtctgcaatatgggatatcaacagttgtttgtaaaacgaatgaatgaaaaagtttgaggtcgagtatgtgaaatgaatgttacagagactcaatttttaccagatttctttcttagcacattcaagaagtcatgcgcatgggcaactgcagcgtgctttaatagaaaaaaataataaacaagctgggagcgatagatcatgcctataatctcggcactttgggaggcggaggtgggtggattgcttgcacccaggaatttgcaaccagcctgggcaacatggccaaactccatccctacaaaaaatacaaaaattagccaagcctggtggtgcatacctgtagttgcagctagtagggaggctgaggtgggaagatcacctgagcctggggaggttgaggctgcagtgagccgtgatcacaccactgcactccagcctgggcaacagagcaagaccctgtctcaacaacaacaacaaaccaaccagatgccgtctttaatttcagtgaacttaacaaatatttatgcaactttctgtttgggttctgtgctagatccttagaaccacagactgatacttccagcaaaagattaagttctagaatcctatctaattagtccaatattttaagaagtacttgtttttcaatggcatagcacagctgatttgctttgggtggcttaaaaagggtagcaagtggtattctggatggagctagggcagatcattcagcatttctttgtgttttcaacagcgtttcatgtaagcaaatttctaaaagcagtgtttcccaaacttccttttacctaagcagcacctggggttcttgcttatatcttcatttctgaggaatattcattaccaggcaagtttaggaagcaccattacagagggtctgcaagtcttcagaatatcttattctgcatcgaagtcctgactgcagcattattacaggtgaaatgatgaaggtggaattgggagaagggaaggaaacaggaaatgacaaataacagggctatgttgtgacaggcactttacaaggcaattgacattactgttggctataatacttgcaacaacgctttattaaaatgaatactgttattcctattctagcaacatgacccaagggtcataatcgctcttggcttccatcatcatgggttcattttgcctgttcttgaatgttatataaatcatattgtggtgggcagaataacaccccctcatccctaatccctggaatctgtaatatgttcccttacataacaaaagagactttgcagatgtgattaaggttaagaaacttgaaatgtggagattatcctggattatccttcgtggatccaatctaatcacatcaatccttaaaagcagagtatcttttgcaagtgggtcagagagatacgccatgagaagcactcaacttgcaattgttgattctgaagatggaagaagggggccacgagccatggaatgcagcagcctctagaagaggatggccctaggctgacaggagcaagataacagggactttggtcttacaactgcgtggaattgaattcagccaacaattcaaataaacttccagaaagaaacacagcctgctgataccttgactttaatctggtgagacccatagtggacatctgatatacaaaattgtaagatgataattacgtttttttaagccattaaatttgtggtgatttgtttctacagcagcctagaaaactaatatgcatatagtagtgtgtatgtgtgtgtgtgtgtctggcttattgtacttaatataatatttgcaagattcctatctgctattattgattttcattgttgtatattatccttttgttcaaatatgccataatttatttacctattctattgttgatggacatttggttattcccaggtttaggctattacaaacaatgctgccatgcacatccctgtatatatttttgttgaacacatgtactcattactattgggtatatacctagggatagatcatagggtatatgtttggctctgatagatactgacaaaaaatcttccaatgtggtggtttacttcccatgagcaatgtttgagactctctacatgttcacaaacacttggtatgaacagtctttaattttagccattctgggagtaccaccatttcatgtgaattgaccgttttacatatcctcttttaagaaatgcctgttcaagtcttttgtccattaaaaaaaaatgttttttttttctcaaagacttgtagctgctctttacatattctgaagataaatttcttttccagatgtctggattacaaatatcttttcctgtgctctgtcttgccccattctcttcatggtgtctttagatgaacagaggtttgtattttaatgtagttcatcaatattttcctttgtgattagtatgctttgtgcctgtttaatacttaatctttgcctatcacacacttaggaagttatttttcaatattatcttctagacttttattgttttacattttatatttttatctataatccatgtagaaagatttttgtgtatagtgtgaggttgggtcaagagccatttttaaaaaagttggatatccaattgatgcagtgtcatttactaaaaagatcatccttttccacttcagagcaattttacttttgtcataaaatcaagaggttgtatgtgtgtgttattgtttctgcactctatattattccattggtctacttgtctacacttataccaatttcatactgcctgtaattatgtaacctcataataaatcctaacatcatataatgtaaattctctgacttcatttttctgtgttttgcctattgttggtcttttatatttccatattaatattagaatcactttgtctaatctatcaccatcaccaacaaataaataaaaaatatcttctgagatgttgataggaattgcagtgaatcaatatatcagtttgggagaaatgaaatctttgccacattgcatcttcctattcatgaataaggtataccccacatttatgcatcttcctttaataacatttgtggcttttttgtatagtggtgctcttttgtcagttctattcctatgactttaatgtttttcactcctactgtcaatgatatgtttagttttcttattgtttagtattgttatatggaaatacaactgattactttgatattaaccttgttatttagtaaaattgctaaagttactttttaattatagcagtctatctagttattttgaattttaaacatacagaattatgttaccagaaaataaggatcattttattgttttccttccaatcatcttactttttcttgcacctccccttaatagcagtagtgatagaagggtagagtagtgatagaaggtgtctcatacctgtttccagggaaaaagcttccaaaatttcattactaagtatggtgtttaggctggctccctggctcacacctgtaatcccagcactttgggaggatcacttgtggccaggagttagaacagcctgaccaacatggtgaaactccatctctactaaaaatacaaaaattagccaagcatggtggtgcatggctatagtcccaggtactcaggaggctaaagcatgaaaatcacttgactaggggaggcagaggttgcagtgagccaagatcttggcactacattccagactgtgtgatggagtgagactctgtctcaaaaaaaagtacaatgtttgccttttattagatttaggaagcccattatttttcacgttttctaagaacttttgttcacagatgagttttgaattttattgaatggttttcctgtaatatttagatgatcatctgaatcttatcttttattctgttaatgtgattttctaatgttaaagcgttctttcatttctgtaataaattccagcaggtcatgataatattattctttctgttttgggaaatacagtcatctaatatataaaatatatcactagatataaaatatatatcactagatttattttgctaatatttgatatgtttaatttgatgtttatgagagagattggagtataaatttcctttcttacaatgaccttgttatgttttggtatcacggtgatgttaacattgtaaaaagctaggaagtaccctctcttttctaatttctgaaatagtttgtataagacgctaggtgatttacaaacgttattcctcataaactttaaatgagtatttctattatacccattttatggaaaaagcggaggcctagagggagaagaattatgttactgaggtcataagaaaggtactaagtggccaagccaggatttaaggccaggtatttctgactccagaacccaagcttttggcctactctactctgctgtgaactcataaatgcatggctgattgagttagaattctacaggacttatcatttcattctatggtagtgtatacctcctatggaggggaaatatactgccaaagataacaacaacaacaaaaatacagctttgcttttggaacctactacaagagactccatcatagttagcttctcaaatctcccctatttcctaccctctgcataggtgtcagatcctggagcagaatttgtgttcacaataatagcttattattttcctctgtttttttgcaactaacttcagctggatcctcaaagacatgtctgattcatctttttacccctgacagcatcctatgtagtattttataattaatactcactgaagaaaaacttaaacccgtatccattccatcatacttgctctaaggcagtcagaagatcctgcaatcgtcttatcctctgtgtagcatcctgtagcaggaaacctcatgcctctttgctaaggatgcatcatcaacgaatgcatcccatggtttacatctgaactagtataacttcatgtcaaagatctactcactgaccatctttaacgtcctcatttattactgagggagttgcactatatattagatgactatatttcccaaaacttatagaacttgctttaacaattttaagtacctacaggaatgagagagcatatatgaaatcaaatacatctaagaaaatgtggtatttctagaagccatggaaattaaggttaagagccggtatttggcataggacagaattgagtttttatcatgttgtccttctttgctgtgtaaatatgggtgataacttcagctatctaaccttggtttcattaactgtaaaatgggaatagtaatgatgctccctcatagatactgtgagaattaaatgttcactgccagctcctcatcctcaggatacttgaatctatcatgtaatcaagggctcataagaggatttgagtgtgttgtggaggtggaagtatcatggaggcccccatttatgaggaaaggggcaggaacacagaattttaggaaaagagaaaagttatcttatgaacagccagcaatggtgttcattcagcataggccttttaggtggagaaactccccactcatctggatttacagcaaccagaaacacaagcagagaccccttcctgatgattgcctaggaaccctcattaacagaaaaagtaagatgacactggctccaaagaagccactggaactagtaaagaggtttgtctacagtaagagctacaaagttaatttaaatgagaattagattttcatgttagagggcattagaagctattaaataccctgtttgttgcaaacttatactcaattcacaccacattttctcattatgttacctgtggaatcagataattgtatgttttttcatatatataaaagtatggaatcctgagtttgaaaggacatgtctgccttttaagacaattaaggggaaaaagtacatgaggtaagcaatctggtttgaaacaatgtagaatatacaatgttataaaatacaatgaaagatactataatgtgatgatatctttaaaaaaaatctgtttttttaaacacacaaaattgtatgtataaaacgtgtaactttttgcatatcaattatatctcaataaagctgtcaaaaagtgggtctgttttaaaatgtagaaagaatgacaactttaaaaatgaaaaataattttgatgatgaaagattcctttttatcttttaataagtatcactgaaaagcatcagcttatcacagaagatgggtctgggcttattatttattgagaaaatggcataaaagatgaagaaagcatacgtacacaaagaaaaagaaaatctaaaagacgtctttctttgtcaagaaaaggacaaagttaaaaaaatgcattcctcctgtaatcccagcactttggaaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaaaaaaatgcattcctaaggatcttagaatgatttagatccaaaatactcaagattaagaattaaacaacttagtcatcatgatgcttactttaatttttttagctataaggtaagattatatggatagaaaaaatatggagatctatctagtgaggttttaaaactacaaatttataatatttggaggactttttctgatgctcagattatgttcataagtttcttctggcattaaaatgccctctcttctagaaaatgatggcaatattaaagagcaaccaattcaaatatatattataatttgcctttttgtttattatttttagaattcttacttggtgcaatttagttgtcaattccctatcaacgccatgattttttttttcttaattgtaatgttgccagtcaggggaatttacaaatcttgcaccctctgaattttggcaatgacatatgggaaggacacaagcatccaaccggtctcactgtttttcaaagtcatctgaggcacttttatgcattttctttaaaacttaggcctgaagagaagggccaagaggcagaaacttttgcagaacaagaagaccaaagtgtcctgcaggtgctaaataaatgtgaaatgatgctacttagcttttgaaagatttgctttagtgaagacagatgactcaaagtggccccttgacagtttagggcaagtgggaatgtagtttctcaagcaggaagatggctggaagaaaatgtttctacatatcataaaagcaggcatatgcttaatttgtaaaaaatactcttttagaaaaagaataaggcctggatccttgaaaatgttcccagtgctgattttgtgtttcttacctctactatactacatattaaggaaaataatcatgcttttagttttgaattaaatgtcctaagtcgggggtcaacaggaatggcttcatgggtatgagacctgtgttcccccgtcccacacctggcattatgctctgctctcactgtcttgctactaattttttattttgattgactgattgattgagacagagtcttgctctgtcacccaggctggagttcagtggcaagatctcagctcactgcaacctccacctccatggctcaagcgattctcctgccttagcctcccgagtagctgggattacaggtgcctgccaccatgccaggctaatttttgtgttgttttgttttgtttttggtagagatggggtttcaccatgttgcccaggctggtcttgaactcttgacctcaagttatctgcccaccccagcctcccaaagtgctgcgattacaggtgtgagccaccatgcccggctttgctattaatttgtgaacaagaattgagcattttcattttgcaccgggcccctgcaaattatgtagcaggtcctgggcaacccattgtgtgataggcacttcaactgtgctctttaatgtgggaattcataggcatagagctatgctggctgtagaatctatcctggaacaagagaggcagggacctggctcatacaactgtaatgatcacaactcattagggactctctcaatttaatcacaaatccatatgctctgggcatcttcaaactcaactgtccattcgacatttaaatttttgatgtaggcatttagtgctataaactttccttttaacactgcttttgttgcatcccagagatttttgtatattgtatttctgatttcatttatttcaaatatttttttatttctgccttaattttgctgtttacccaaaagccattcaggagcaagttgtttaatttccatgtaatcatgtagttttgagagatcttcctggtagtaattactatttttattccactgtggtctgaaagtatggttggtaagatctcaattttttttgaatttattgagaatcactttatggctgaacttgtggttaatcttataatatgttccatatgcatatcagaagaatgtatatcctgtgtttgatgggtggagtattctgtagatgtccaattggttcagtcacattgaagtcaagaattaaatttaagtcaaatttaagtccagaatttctttgttagtttttctgtgtctatgatctaaagctgtcaatggggtgttgaagtctccaactattattgcgtgactaagtcttttcataggtctagaaggttttatgagtccgggtgctccaatgttgggtgtgtatatatttaagatagttaagtcttcttgttgaattgaactcttaatcattgtgtactatccttctttatctttttttttctgttgttggtttaaagtctattttatttgatataagaatagtgactctggttaaataatttttgaaaatttaatctgagatgattaccaaatagggttccatattaatttgattaacaaggggcaaggagcctagtcagtaaaccatttgcaagccatgacataattaggtaaaatattaaatacagttaaactctctccaatttggtgacatctgtaatccattcattttaattgattcagcagttactatatgccagactgtccggaagcagaatttaaggagatgaaatctccatcttcgagatactcacagtccaatggagggagcaggtgagtcaacagacaggaaagagcacgtgaagcctggaggagagctgttctgtgtgtggtccacaggaaaacagaggagcatgtgcttgactccagcaatcattggtggctctcttaataccactttctatttaatcatcatctttaactgctaatcaaaaagttcattccacaagtatttaaagttaatttaaagaagtgtcagacactgttcaaacactgagacttaaggacaagtgatttctgtctatttccttgttcccttgaaactaacctaacctacatgattggcagttgggcagggggaagagggaagctccctcaattttttcatgccctcccctctcacctatcctcctgtgagcattctgtgtcttactttttactattctgttctcctttttagctagagctgtctagtttgttctagaaagtagtcattttgggttatgaggcaaagtacctcctgcggagatgagagatttctggaaatatgattaccatgggattagtggagaggtaagcagaatctaggttgtaggaatgatctgtgggctccttaatggcagaaaagaagttttattaatctttttatttccagagtctagcagagtgtgaggtagaggtctgtggctcagaagaggttttctggatgaatcaattaatgacaggccaaccattaacagtaatgagatctggattctagaccttgaagtagaagaatggaggaaaacgtgatggtcaatggaagagtcacttatgatacttttgttcctcttcctacagaaatataaaaattaaaaaccttttaaaatcaggtagcctatgattgcaggggaaagaggaaactcccagatccacaatgactcctccttctttctatttctggcataaaattagctgcctaaagacaaagccttttattccacaattaaggatacaactaaaaatgcaaatccctgaaagagtaagcattatgctaatgggtctcaaaatataaatgaagaatcaaaatctattctgctttaaagaaggcaccagtttaggaggcaggctctaagtacttgaagcaataaaaggaactcccctttgcctaacaagtcccatatagcagcctccttcatacattcagtttaacgtcatcctaacaacaagcctgtgaactaggtactatgtccattttataaatgtgacactcaagttttagcaaacaataagctatgcacgactatcattatccataacgataagttatgaattctggatgagaagccagatctacttggaggaaatcagtacaaagtataaaacagaagttatataatcaataggaatttaaccagtgccttgacaagtctagactctgtccagacttcctgcttcatcctgttaaactgtttcaggtacctgatcatgttcccctcccagttacctttgcccccactaagtttttaagagagaaaagtaattctgaattcaagaagtttctatttcctattctgctgcaacatatcatagtcaatatgtttctaagtgaataactaatgatcttgctaaataagaattatgaggaaatgaatgtgtgcaataaaaataccactgtcagctagccctgtgccaagtactgggcaggggggtgcacacagctaactgtggcatgttctctgggaaacagccaacatgttgggtccaagattggaggggaagaagacaaaaatgtgacttataacacagtccacggattttatggctttgccttaaatgttctcaagaaatccatcgccaagtgaagctggaagcagcttgtaccactggagtgaagaatcctgccattccacactcttctttatcatccccaggatactaaccagcagttaaatggggcaggaagtagagtgaaaagacatgtttgctactatagagaaaaataaatgaccagagtgtcttacctgcatgatgatgtagcttttccctcccaccaaaatcaatcaggtgggaccacccttcccccagaacaaaagctcaaaggcgaagtgtctaggatggaatgtgttttcttgagactgctcttgacataacttcaagccttagttcccaggaatagaacgactaactgtgttgagaatgaggttcaccctgggcccttcccttacttcaagttgtctcactaagaggttatgggctgtgcgtgcttgtctaaatccattattaaattaggtcccaatttaaagagtttgtcacacagtttagcaaacaaatgaaacagcctgaaaggccttgcagcaccacatattttctggaaatcccagtagcagcaggtagagcctgcatcctgaggatgcaaccagactcgatgcacttggtgtcagccaagctggtactggatttccataggattgttcaaataccttggcttatattttaatattttctctcacatttgtgtaggaaagatagtcttggaattaattcatttaacaaacgtttcctaaggagaattctttatgccaagcactgtggcataatgcactagagctatgaaacatcaagacattactgggatttgcaggtccagtattgaataatactgattcatttcaaaacattttatcataaatgcttaacaaggaccagagcagtcactatcttaacaggtgagtttcaaatattagtggtcttctgggcaaatttcacttcagggagtcaataggcatgttgtaaaaatcaaaataggataataattgcaaggcacataacacatggggtatcaggaaatgaattaccatttctatggtctgcatactatttggattgcctatagatctagactgtgagaaacttgaggaaaggggttctgtggtcttattcatcactgtgcccttaacatctactacagactggtacattgcaggtaagtacaaacaccatatttattgaatgaaagaatcaaggcatgaaggaatcaatttatgaatgccttaagttaaacgaggggcaagaagctgacctgagtgcgtttgtcatattacatagcctttgaggcaaaaactgtctcaggtagtagcaactttgagtaacatatagacttagaactactgtaaaagaaataagactttgaaattcagaacgaaactatgagcagagggctggaaaggggtgaagaatgccgaggggaaatagaagaaatcatgtggttaggaagactgataacatatatggagacttggaatggcctactgtatatgcagtgagtctttctatcatgtggcttctactgaattcctttcaggttctgcctctgggtagagccttgtttggatgagaaatgctgatgagttgacagagctgagcattctggagccatggaatgctggccatctccttcaggcttcatggggtccagaggagcaaaaatctaaaagtcatcagaaagtctatccttcttcctttgctgaaggcaagcaatgggatgagagaggcttatctcactgctgagaaaacagcgtcttagtcacaaccaattctgtggtctctctgtctgacagggaaaaggtggcttcatagtaaatgatgaatattaccaacatttatcaacgacttcccatgtgccagatatctaaattcactattttatttaattctcacaaccacttattttattttatttattttttatttatttattttattttattattattatactttaacttttagggtacatgtgcacaacatgcaggtttgttacatatgtatacatgtgccatgttggtgtgctgcacccagttaactcgtcatttagcattaggtatatctcctaatgctatccctcccctcttcccccaccccaccccacaacagtctctggtgtgtgatgttccccttcctgtgtccatgtgttctcattgttcaattcccacctatgagtgagaagatgcggtgtttggttttctgtccttgcgacagtttgctcagaacgatggtttccagcttcatccatgtccctacaaaggacatgaactcatcatttcttatggctgcatagtattccatggtgtatatgtgccaccttttcttaatccagtctattgttggtggacatttggattggttccaagtctttgctattgtgaatagtgccgcaataaacatgcgtgtgcatgtgtctttatagcagcatgatttataatcctttgggtatatacccagtaatgggatggctaggtcaaatggtatttctagttctagatccctgaggaatcgccacactgacttccacaatggttgaactagtttacactcccaccaacagtgtaaaagtgttcatatttctccacatcctctccagcacctgttgtttcctgagtttttaatgatcgccattctaactggtatgagatggtatcttattgtggttttgatttgcatttctctgatggccagtgatgatgagtattttttcatgtgtctgttggctgcataaatgtcttcttttgagaagtgtctgttcatatccttcgcccactttttgatggggttgtttgtgtttttcttgtaaatttgtttgagttcattgtagattctggatattagccctttgtcagatgagtaggttgcaaaaattttctctcattctgtaggttgcctgttcactctgatggtagtttcttttgctgtgcagaagctctttagtttaattagatcccatttgtcaattgtggcttttgttgccattgccacaaccactttatggtatcctattactatactcatcttcacagataaagaaagtaagcccagagaaactgattcgtccatggtcacagagctaggatgtggcagaaccatgattcacatgtttttctacctggcagaagctagcaactgtgtgcttaaatgctgctctacaatgtctcacaaataggatctgaatgtccatgctcatgttgtctagctgtgggatcgtgggggaatcatttaacttctccgagtttcagtttcttcatctataaaatggaggcaatatcccctgaatcatagtgttttggggagaattctatgggataatacatgtaaaacaatagaataatggttgacccatagaaaatgtctgacaaatacttccctctatttctacctcctcatctgcatcagggataactgccttccaagctggctacaacaccaagggtctaaggatcctcgatatgtttaatataaggtagtaaagacactctcttttgtttgtctgtgtaccgtgttatctgcctggcatgttccctcttgtctattccatctgtaagccgtaaatcatgacccattagtgagttattaaatcaagttaatgagctatgatctccattttttaaaaaggagagaaacagaatggaaaataacaaagtacactgtatacaaaaagtgttattactatttaacaaaaatgttctttctgttttatgtgtatatgtatttactgggtcaggataaataatgtacttcttactttgcttctaaatatttgaaaggctcttggttacctcatatcagagcttcaaaaattacttagatatctttccatggaagcaatcaagattccaggcctttctagagctaacagatcttttcatttcacattgcatttaattatcttcccttcgtctgtcttccccagcagacataagttttttgcagacaggaaacatgactgttactgctgcgtcctcagtgtccattataggtcctggcacataatatacactcaaaaaatgtttgatgaaggtctgaataaatcacagcaactgtttcttaaatccacattcaaaactcagaggttatttgcttgaactctgaaaatcgatacgttttattaacaagtgaacagggctgagtttttcttttacattctttcctgtgacctttttctccttccccttggtggaatgatttgctttttttccttgccctccccattctcccagcatcctgggtactctagctttccttttatcaaaacaaaggattgttctttagaaatctgcacttttgtataaatttaacccccatatctttggcttctcctagtagcatttatacaaaaggtgcatccctgttagtagcaggaaaagccttgttctttctttattataccagcttttatcagctagtagataagaagggaaaaggatattttagagtagggagatcttcatgagctcataaactcactcttccaaggcagtgaacgagagcctcaaaatacacgcaataaaattcatattccagtagctcaggagcctaaatgcatctatgtttgaagaattgataatgtacttgtgcagcattttgaaaaacattttattcatatttgtaactttatttacttttaaatgaactacatgtttcacaatgctttactgctatatgtttcacaatgcaggaaatacacaatacaagtagcatattaaatcaaacatacccaaatcattcccacagaacaagaacagttaacattagcaataatcagttccacttgcacagcaccactaaagtacttcaagcacttcacacgaaagattaaaggaaaaaaagtataactagattagaaaatagagagggttggctcatatttaaaatactgcctggctcagagagtgctggttaccactcccttcaaaatttcaggtaaacaaattgctactacctgggaagatcatttctagtggggaaatgaaggcagcttctgcaagaccccaggaaggtacattctctctgacaccaccaggaccagggctagagttgggagcatgcttgtgagcatgcgtgtgtgtgtgtgtagggtatgggaggtaaatccaaggggaagaatggttttttggtgcaagcaaatattttactaagtcagctaaattgtttctcacagaacaaagaaggtgcttgctttctgatttaggttttggcttcacagaaaactataaataataccaaagaaatcccacattcctacagcacagtttatcctgtgcaaaaacctcaaagacatttgtgttagaatttctcctctccttattccttaatcaaagagtccagcactgtgctgacagaagcagattgggaatcacagctaaagtgtattcaacagctgacaccacataaactaggcccttagggaggcagagtgatgtggggagaagtatgggactgggggtaggagagctgattctgccacagatagctgtgggatcacaggcaagtctctgtctctgttctcctcaggtctcagtttcctcttctgtaaattaagcagagggcccaatgatagctaaggttccttctagccctagaattacataaagctaagtaaagtgaggagaataacaccattttcaggatgttattctcagatttgagacatgatcatcctcttatatttatataatcagagaaaccctgctagtaatttattctgagagagcaagtagttgactttctaaaataaacacaactgaccgtggtcctatacaagcactctagacaaagcaagcatctgtatgaaaatcctgtagccaaaattagtattcaagaagtacaaaggtacaaacttgttgaatcctttttggtaagaatttcacttaggccttgcttcttgcttttttttttttttttttttggtctgttttatcacttttcatgagaataaggccagggggctcttgtaagttctttctttctgatttgctgatatgactatacgcatggcccatatttcttttaatttcatgtctcttagagtcatttagatgctaaagtcagccctctaggtacaaaataagtagtaataattgaacatttggaaactaaataccatatttgtatattacagagatttcatttggggactttcttatgaaatgtcaagtatttttgagtctcattaaaaagaggttcctcctttcaatacaatctccaaccattactttgttactctaagtctttgtctcttctgtacgttatacttttatttatgattttagagaataaagatctgaatctaattactactctttcaaataagtgtattagttttatataatatcatatcacttcatttaattttcttaatcttccaaaacttaatagctattagcaatatatttcagcaaatttcttctagtatctgaacaatttatgcattctatctcttaataagacacttggtaattttccctccgagctttattatatatataaccatttcagttacactaactgatttagttctatcctattaacccagctgactttttccaatttgctaccagggactaaaacatttcaaaatttaaaaatactttgtagcatgtagaccagcaatacaacacaagagagaagaagaaccacaaatggagcttgttaactttccatcatatttgtaatgtcactacaagacatgttttagggtggttctgaacagtcacagattacaattaagggtatcaaaataatcttttgaaatggagttggccaaattcatagggttaataacttgtttttcttaatctcagggcttccctggaataagaagggactctaggcttatcagttcagtcgggaaattaagccctatgagaacctgtgccttccagaatcccactcccttcttagccctgctgtgaataccaaatacatacaaaacttaactttagagccaaagtggaaccaacagcaaaagttcaactcaagcatgtaaattagtatctataacatatacgtcatgcctaaaatttcaggtaagaaggatatgacctcaggctggagtcagattgaattcaggccagagtggggagtggagaatacaataagaatgggcatggttcttccatatggtacatagattcatgttgcccgttaattaggcatcactttcttccttttgcctgttagtacttatatatttttaaaagtacagtcagcactgatgaagtttggaagtaatacaggaagcttgtcttggaagaggagcatgttatagttgagtgttgatggatcttactcaagaggtagctactaggatgaaagactggaaggcatttcacattcaatcaatcatttatctttttctggtaaattgatgagttttgtcagacaaggaacaagtaacttctatggtctgagaaaaaaactggtagcgagatgacacagaaggaagtctttctgccaaaacttgttagagaaaagcacataactctttagaagaatgccgtggattttaaactgatgcactaaagttaatgcaatcagtatcaggcaggttaggagataatacaggaatattttcttttcacactgatggtaagtaaatgtccaagggtttggtccacatatgccatttaagatttattagaaatgaaaatgtttcttctcattatttttattgcaacctatgctgagcattttatcctgaatcataactttgccaaagaataacttgataaaagcaggcacctttaactaatttaatctaataacatttcaaacatttattccaaatgcttaaacacaaggtctttcagtagtgtactgatgaaagtgggttaagtgggacacatgttctgttgctacatggtgttgcctttgttttctcaagttgaattgctcacaaagtgcagatagagaaatactcctttgcctacctgacgtagagggagcgtttctgattggttcgcagggatccggacccggagctcatgctgtggttcatcatctgctctcgtaggtcatggattttggcctcaaatcgagcgtaatctgggaatgaaaacaaaggtagcaaattttgctctgtgccctcaagagttggaaatgctgcacagcccaggcagcccctcacccacgttgttggttcctttgccaaacaatggggagatgtgcaactcaagggtatgcctgtttcctattatttattcacagacatttataagaggaaaatgataaatcagttatttcccaaaacgtacctggaaaacacaccaccatcaaattcccaacttgtaaaaagtccatgggggctgggagagggaggatgggggatcatgggaaggcagggaggtagatgtggttataaacaggcaatgtaaagtatccttgtggtgatggaaatgttctctatcttgcctgcacggtggatattggtaactgcacgtgtgataaaattacacagaactaaacacacacacacacacacacacacacacacacacacacaactgcggaaaatctgaataatatcgatgaattgtgtcaatgtgaatatcctagttgtgataatatgcaatagttttgcaaaatgttactattgggagaaactgagtaaaatagttatttcttacagctgcatgtgaatctataattacctcaaaaacaaaaagcaaaaagcaaaaaacaaaaaacaaaaaacaaaaaaaaactccatgggaatcccaactcaatagggtattgaggagagactctagttactctcagcctgatagacctgacaatcaagagtttggtgatgaattgtgtaagaaatttcatttaatttaactaaattttgttagggggtgggggtctgctagaagttgaccacttgggatcatacctcaattttgtcctatagctttgcccacatgccaaattttagaaattttcaaacattaaaagttatggggataaaaaaatcaaagaaatctgtatattataacattgctattgtttcacagaaaaaaatatttttggcatgtcaacccaataaagataaagaaagaatcggttctaaggtacttattaacacaatgaacatgtaaaaagaaacggcttttgatgtttcaatattttttatcacaacctagaaacttctatcatttccttggcaaaacaatgtcttgctttagaaaattcagcaggcttaacttacccacaaataaacttaaaaatgttaattggaattataaatggttcttttaattacaaagaaactcaccatgaagaattttaatagagtatatcagtatatttcagaaaacaatttgattttcaattcaatttattcacaactttaataaaacaaggatgaatgtatacaataaaagatgatctacttacagagtgtttcaaattctttataagaaaaagttctataaaatgtaatttcatttcaacttactggatatgtattgattaatgtagggatagcttttctaaaagatttgaccttagttttcagcaataaatagataacaggaaaataaactctgaatattaaatatttttaaagtttagtacacaacagataaagccataatagttggctggaaatttctggtgcataagcaaagtctggtattatccagatttggaaggcttcctgctcatgcttagctttgaataaataagtcctaaatgattaaataagtagaacacatatttaacaacatatttaaggtaaaaatctattgactataatttaggaaaatgtatttcattttctagcaagagaaaacatttatttataaacatcaatatgatactgtatgcaggccaggtgtggtgacacacacatatagtcccagctatttgggagaccgaggcaggaaaatcacttgagcccaggatttcaaggttttagtgacttatgatctcaccactgcacaccagcttgggtgacaaagtgagaccctgtctttatttaaaattaaggaaaaataaagatacgatactgtatgcagatttaaatcattttgagcaagtcgtattttcttgccaccttggaagagtcaattaacatttattgctggccacatggcagacaatatgctcaatgcttcatgggcattatctcatttctgttttaaattacaaaatgaagtctatggatgttgaaaattttgaaagatatagaaaaacacaggataaaaattgagaggctctcgtctcttctgccttcccttaccttctctctcactgctctctttccctacagcttaccctagtggtacatgtatggttgtgtgccggatatgtatgtgtgtgtttgtgggtagctgtgtgtacatacacacataaccatacaaacaagaccatagctatttattgtattaagacttttcccccctttttaatagtgtaatttggatattttcctgccttctaccaaatacataaatatcatgtttcttaatactcttaatagtctattccatagtttagactgtatttaacaactcccttatcattagatatttaggcttgtccagctttttgctatcacaaacagggatcttggtgtatatgtgaatgttggcagcaggttagcagagcaccagaagtgggactactggtcaaacctttgcacaaaaatcatacagcctctaatagcatttcccagagaagaaaagggccttgtctggaacacagatcaagaactcttaactttttctgatccatgctttacattgccacttgataaatactacatgtcatctctaagtaccactaaatctcccatctggagagatgggacactctcctttatacctttgatgactttactacccatgataaaagcaggagatcccaccttccagctgccccttcttaaacatctaactctgtgcaagtcccaaccctcatttaatcactttgctacttcattgcattcatcacaccaacttgcagttatttgtacagttgttcatcttccattagactgagccctctgagggcaggaaatatttttcattcttcttggaacttccttttcctaacatagtgtctgagatgctcaataaacttttttttgagtgaataaaaaataaatgagggagtagaatacctagatgaattcagttataaaatggctccaggtactgaaattgtccattttcatttttatgtttttgcaataagaaagatgaacatgcatctcccctagtgctacttttttcaaaactaaatattctaattccaaggctttatttccgtcaaataactaccacttccaaattcttctgttatttttattgttctccaggatctctccatctcaatcatgtcatacattggaaacaattctctgacacttcatctatatacaatcaacactttgttaggctcttgtagctgcctcattttttgtaacacaatagaatacttgccttaataataaattatatttgccttacagtatggcttattagatacccaaaatgttttctgccatgctttcgaaatgttttgactgcatgacattctatggtgttaaaattccccaaaatgaatgatttatactgcatttgccttaattggaatctatcctgttttcatctttcctactttgacagtcatctcaatgtaaatcctgtgtcagaggtgcttatctgtctctttgctacttttctttgaaaactaaacataaacacaagaaatttcacatagtaaaactagtaagatctgggtttataaatataaatggtgcatctgtggcggcagagctctgtctccaacttcttggagataaacaagttcatagttagaaatgctctagaagtaaacaggaaacctgctacacaaattgtgaaatataagtatgttttatagaagtcctgaaattgtatttttcaacaagttaaaacagaaaaacctaacactaccatatccattaaatattaattctctcttcctcaaatgttttactcatatctatgcctgtccctttggaacatttttcagtcaaattcataacactgtcttgattccaagcctcaggagaacatttgaatgaaattttcaaatgcttcaatttttatatcatccaatgtggaattcacatttactgagcacctgcaatgagctaggatctgtactacatacttttaaaaatacattatttttcctaagaaagttctgaggtagatatattattttacagatgaggaaacagaggttcagagaggttaactgacttcacaaaagtcatagagctactaggtaacagagctcattgaacatggagctaggattcaaccctggatcgccgtgaagccattttgtttccatgacatcatgacattggttataacaccacaattgtttagaatataaggcttgtttagaatgcaaggcttcctcaattctccacccttcccctcttgacatcttgctcttcttcccttcatctattgtgttagtcaggtgcatgctggtcttccctctatcaaactgtaagctacttggagacttgggatgcctcactcatctctattcccaaacctcagggtctatcattctaccttctgtatagacaggactttcatagttttgaacaagtcagaacctgaaagaatttgcttccagaacaggacattgacaggaaaattaagcatgatcatgccgaggtataaaacaatattaaaattgcagcattttcttctgtcttgctttgcatgaaatagatgtttggtaaatgctttttaaattacaagttgttttatgttttggggggattttcttctgtaacaagaagcaaaccactgaaacccaactcctaagcaaacgttttagaggagcttcatgaaacattacccccagctagttctttctccacctctatatatgataacccattttctcctccacatttttgagtatgtaaagccagttgttcctgactaggtgcatttaatttggggttctggcatttgtattcacttgaacaagatggatgataatagtaaaaagtgtacaagatttgggttatgtagatggagtcaaaatcctggttgtgccactaaatagctatacattactgtgaaagttattaacctttctgtgcttaattttctcaagtaaaataggaataagaattggacctacctcaagatctgttgagaagattatgagagagctgatggatctaaaagattggcgcttggtaatgactgtcaattctttctattacttctgtgtgtaattcatcacctattcttgttcatcacttgcgaaaattgtaacccctttctgtactgagtaaaatggaaacctgtgtctgctcctagagccccctgttacggcctccctctacttgttatgaattgatgtcttcaccaggtcaaataggaatgagccacagatggccatactttgggacacttgccatcaggtggaacttctcatctgctaggcaaccactcagggtactctcataagttcatagtgacttggagtccaggagaataatgtccaattccaaagctgctgctattttcaggaatatcagtgatttcattcatcagtattatctcaaggccttgagctactgatggacacttggatggagcaaggtcataggtgtgaacaccacaaactacacagtgaggggggctctgccatacacttgtttgcaatttgttaagggtaagtaaggcgactcagaatgcaaatctaccattcacacagaaaaggaggcattgcctcctgtgagaaggctggcattgtttaatgcagtaggattaatctgcattgattaaaactgcccagctgctcatgtcttcgagactcaggtggcttactttggttctgagataagaaaacaatacactcagtgggttaggcaatagcatgaggccatggcctgccctccccctttcccaagtgagatggtgggcagcatgcccctcgatcagtcacgacctcatccaggggtctcatgattgccagataagaggaagccataaacggagggaacagggttagaaactctatgttatggctggctgcatagtattccatggtgtatatgtgccacattttcttaatccagcctatcattgttggacatttgggttggttccaagtctttgctattgtgaataataaaaaacgatgagttcatgttctttgcagggacatggatgaagctggaaaccatcattctcagcaaactatcgcaaggacaaaaaaccaaacaccgcatgttctcactcataggtgggaattgaacaatgagaacacatggacagaggaaggggaacatcacataccggggcctgttgtggggtggggggatgggggagggatggcattaggagatatacctaatgttaaatgacgagttaatgggtgcagcacaccaacatggcacatgtatacatatgtaacaaacctgcatgttatgcacatgtaccctaaaacttaaagtataataattaaaaaaaaaaggtactgggagtaaaattaaaaaaaaaaaggaactctatgttagaaggccagcttttagtcttaatcttgtcatttattactagtggggccttgggaagttactgaacctcagtttgttcatctacaaattgtgaggttcacatcacaaagtggttgtgagactcaaaatgagatttgactgaagtgttctgaaaatataagataggtgttgctgttattactttggtgactcctgtcaggacaaagacatatgcagttcttagtggtactaatggtgacagtggcaccctctttctatttgttcattataaacgtgtgcagctttaacaacaactggtaagatcactgagctgtaaacaggactctgcacatccaagcaacagagactgctttcctgctgagttatccatttccacactacaggagaattagtttgaagagaccacctgctgtacacacgcgatgctttaaatagacacatctgaactagaagctcttggtgtcttataataaaggaaatttgtgctttaggacaacttccaatatggctggggtaaatgtcaatggtgtgtagtctgttgggggtcacaatattgtttacctggatgtgaccctcattgtcactgaggcttaggaagggtacatggtaaggatgaagcagaaatggtttacatctattcttagcagagcatgtaatcactgctccagggatgagatgctgtgagcaattataaatgtttccatttctttggcggaaacatccttctttcatttattcagtaaatatttcttcagggtttattacatgccttgcacaatcctaattgctggggataccgaatccactgaacagatttttttcctcaagaggctcacaggatagtgcatagttacttgtaattttctagtttcatcttgtgaatacaaaaagagcatttggtatttaaatatctgctccatttgaggagtatcatgttctttttagatggtaacaggatatcaagaaacccttctatcatggaaagacgctaatacagtcagttccatgttaaaatggacaaattggggcaggttaaatctttgtgaactatctggttacttatagagtgagaagagcaacttggggttcaaagcagtaccttggaatcagagtttctggatttgagtcctggctctgagagatgttaagaaaataccatacccactcagagatgctgttttctcatttgtaaaatatagaaatcatccctacccccatacattgttgttctgaatatccaagagagtgtaatttatttccatccttttaagcagtatcgattttaaaaagcaccatcaatgaataaaagcatctttttcttggagagggtggacacaagactcttctgatttcacaagctgaaatgtattttgtagagaggggaagatgtaagtcttataatcaatgaaatatgataattcagaatgtttaaaactagaaaatcccaaacaaatatactactgctctctttccaccggactcttaaccaaatagtcacacataagaggattagccatagaacactatttacacctcaatttcaagaagcaatgctttgtcaacattctttcatatgatgatacaaaaataattttaattatttggagctcagaaaatattagacggttgccatttcatcacctcttctttttctagttttcctgggatttcagagccagatatgcacagaaggggcccagtcacattactttaggctttagaggtacacttagagcttttctcaccctggctgcttttcaagtcatcctgtcaggaaggacgtcattaggaactatttgaggagcgtggctcccctcccagatacgcactggaatgctcacctccgtcaagagcgctgagctctggtgactggaaggatttggggtggatctctccaggctactgcctaaggattttactagcttttacttcaacccgacttagctcatctctcaagttgccaacctgcctctgtgttgaagtggtgacgtggaattttccattgctaaagacttacagatgtttggcttacaaatccaagagagagggagtgtgtgtgtgtgtgtgtgtgtgtgtgtgtatgtgtgtttgtgtgtgtgtgagagagagagagagacatagaaaaagagagagagatacagagatggagagagacaaatagattatgaactaaattcatcagaatccaacttaaccagaaattctagacaatataaagagtctatcttttctgcactccacaaaggaagaggatgtatgcacctatctcttgtacttctttgctactgaccattaataactcagttatggataccatgagggcaaggatgttatcatgttttcttctgtatcctaacacctggcatagcgtgtggcacacagttatcagctaataaatgctaacgtaagtgcttgctgaattggatgagttaaatgaagagttctgataaacagaaatgatcctttagcttaccagatctaatactaaatagatcagccttttagaataatttttaataacacactgaattaaggtatgtctttctccattcctcctcaccccttctctgttttcagatagaattgggatcatttgttttgactagaacaatctcttgcagcttggatggagaaactttacagaggtttcagccaaacactcatgaattctttaatgtgtgaaataaagtaagttttataggcaaataacaatctgaatccctaactagctatttcatataatatgcatataactctgaaaattacatacatcaaatttcaatttggcttcatgcatgctttgttttatagattcataaaggcagattttctctgattatcagacttattgcaaaatggagtcaacacagaaacttcctgaagttggcaaagcttgttttctttggctgacaggagtaactgatgtattattattttttaaggctctgagataaatctgattcatgtttgaatcataagtttattattgatttttagtgtggattttgcataagatactcaatttagagaatactcagctttctcatatgcagaatagaaaaaaagtagttacctgatcagattttttgaaaggtaaatgcaacagcagttgtaaatggcatagtccattgttaggaatagactaggtgttcaataaatgaataaaaaaaaaccgtgaagctctcctgaagctttatattccctgtctataaaatggagacatcactgatttcctgcttacattacaagactgctgtgaagatcaaatgaagaaacagataaaaatgtttggtaaactgaattgtacagtataaatagaaagcggtgacaaaagtaattcataccaatgcagttttttaaaaatatcccaacctgcctacacaactacttcctctctctgagatttatctcaaaagtggaattagattcctgtcttagctgtaaaaataaagccacaaagggcatcatgcatgagagagtaaatgtgaaactctgtgggggaaaatggaaacttcagatattattagggcctagctgccaatggtgattctctcaagattttattggcaggttgagtgaaagtgccagagtgtggatgcacaaattgtagtttaattggtgtgatttatagctaatggtgcatcagaaggaggaactaggaactgtgccttctaatttaaggcatagtacctaagactgcatccactaggtaagaaaaccttccttggcaaactcaaatattaaatcttcgctgaatttgtcttgttcttttatataaaaatcatggagccaggagctaaaataatatctaagtttcctctttgcctgacgccatccatgcaaaatgtgacttgcttcttcagcagcagcatgaaaacaaactaatacaccactattcctaggtaagtagagccacaatgggaagaccactaagggaatatggaggctcacagaggctagtcaatttatccaaggccacgcagcaaagctgggactcaaactcaaatcttctagtcctagtttcattcagttttttttttttcctacattgattctagactttgttctacaagtgactacttttctgttttgttcctgacatgaacatgtccatggctgtctcagacttgtttggttaccctaagtaaccatttagcagccaatttctgatatgactatagatacatctctataagtgaattctataggtgatttggcatgatcaaaatgaaaaggctttgtttgagttccccaatatactgctcaaatgaaagcttctcaaaatatcattttgagatacgacaggtctttccttcaaatacaacagatacttttcttttgcagcactcagcatacatacaactatttatttatctgtaagtacttgcttagtatctgtgaagaacattgcaggtacctgacatatgtctaactgatggagtgaggctgctaatgtggccatctctccctcttcctgataagaaagtgaaccagccatttcaaaatgtggagaattcgataaatatgttctactcctctatagccctcccactaaaataattttcaattttcaattgaggtgaaaggaagaatcggcaaagagacggattgagagaattgtttatactcataacttcgttctcaacataattatctatttctgaatcctaaaaatcacctagctagattctccctcaatctgaagattaccttttactccttgagatgctaaatgtgttcctatttatcatattaatattgcgagtattttgtgttatgcagccagaaaaatcacataatgggaacttacccacagcccccaaactcataaacaggagctgaatagaaattcctcagtgcaatttatggtaacaatttcatgctcagtttagttacttccatgactcagaaaagaaatttcttttgcttatttcagtaatttttttctaaaaaattgttcccctaatttttggcaaaggatctatgagaaagtgaagaactccctggttgtacatggatttggaattgtcacttaagtgaggccaaaatgtaaccctatgccattcattgcatagtaccatttgttataaatttgacctctaaaacaaagatattacaaagccattgagtgtttttttaagggatatattatatttgtcacttagtccccagtattatgatggaaaacctggatagtggatagaaaacctggaggtcatttaggcatctctttcactggttgggtgagaaatggtgaagaagatgggaatggagaagggacatacatttggtaagtgtaaataagagtctttgctgattaattcagtgtggcccatgagaaagagtggaagtgtccaaggttccctcaggtttacagcttgggcaactgactgagaacagaaaggagctgccattgagaggaagaaaagaaaatgacactgagtccatgttgggacacattgggtttaaagggatatcattatgacctaagctctctgaattccagtgactgggaatatgggaagatacatctttaacagttgaagcaatttatacactttaacaattgaagcaatttatacaccagagcctaaggaatatttatagatgagggctgtgctgcaatgacagatagggttgtatgaaacatacactaatctgaccattctatcctccagactcagggaaggaaataataaaagtaagtaaccataaaaaatagacttttatgcataaataaataaaaatcagctaggagacagttcatccctgtataagtaaaacaggcaaatttatctttcctctgattaataatttaagaaaaaatcccaagcaagctgcctatggaggtgtaggagtagctcctataattagactccaatttgaaccatgagggtgaggatcagaaagctgactcagagcctggtgtcaattatttgcagtttgtacaacgaaaggctaaaaatttgggagatgcaggatgactgaagcccgattctgggggttgttacagcacagttacagggtaagttttttccattgttatttgctggaaaatttattctccatctcctttagtctgtgcctgaattttgtgggacttgctcgagaatggtattcatgctttaaatccaagagccaggaatcatcgcatttcaacaattttcctatttattttaaccaaaacagagctggtttctataactcaatttaagaaattatcctctttgatacaatctacttatgtttgattgattttagaataaactaacagatacacaagagcttatcaagctagctcggttcagtggagaactatagcagaaacagcaggtttctatttggcacattttggatttatctggacgcaagaggatgtgaaaagaacacctttcagacaaaagccagtcttgagtaggaatttagtgttccttgcccaaacagcttagtttgtttcccattttgagtcactatctgaatccttttttatctcctatatagaacaaattctctccctctatttaataggctttcagatatgaaacagagagagagagagagagaggaaggaaggaagggagggagggaaagagaaagggaaagaaggaaggaaaagctctaatttcttctgttcttttggtaacacacctccccttcacatccttcagctgctccccttagggctttttgtagacacttttggtggtctctcctctcacacactgctcaccactgtactttattttgtatcatctgtctccatcctttcccaactcctgagcactcagcctcctctggatcttttctggttccttcgctcctagaactgtgtctgatggcttatgaaggcaaatgacaaatgtttgccatatgcacatgtatgtgcatgaatgaatacatccaggttctgacttcctcggggcaacctctactttctcaatgcccctcttaagatgggggtgggggagggtcctcctagaactgaacatgatattccaggtgtgatctaatacatttaaatgtccaaaagctctttcttccctaaacgttcctttttaaaagctactgttctcaattaatgggtgtctcatcttcttaagtatattaataagaggtattttgatgtttccctccattctgtggattacctcttgattctctggattctttgtgattccgttttgttttaaggatgttctcaggtgtctggtgatccttgcttataagtccaaattaatgatgaggcactaaaatgctgattggaagctctctgtgcaggcaggtattgttgaatagtggtaaacaggggacatgttcattttggagacactcaaatatcaggacctataaatctctatgccaagtcagtttccccagagtctcttaatatcatttctttcaggttaaaagcctggttaccaggttctgggagtgaagggaggagtggggcttagacaagggtgggggcgggggtatgtctcacaattcactaaataccttcttttatatatgtgttctctgtgcagcattttacccccaccatcgtccatgtctgatgcctcaggttcaatcttgttcagtctttccaaagaggaaacattggttgggtgggaatgattggcaggtcgaagagagaatttgaagctatagctgctccttttaaaacttctaactcatctttgttttttcaggccttcctcacacccatgtcttcagatacccaaggcctttaatacccaagtccttccaggattctgcacatctcattagcttcatattcccgtaagtacttgggtttctgctttctcagctctgatgtgtcattttctaatcaatcatcagcattccagcttccaaagttttgttcatatatcttacatgtgttgtcttgaccgacttctttttggaccttagattatttacctatttaaattccttaattgttactttagtggagttttggaagggaacaaaaatataggcaggtgtttatcacatttaacaaggaactcaaaatttatatttaattctatttaatctggctgccttcttgccatcagtctatttgaaaagttcatatggacccagctctgtcatcatcacatgttctatatccccaaaccttgtgacatctgcaaagaagtacagaagacctcaagagaagataagctagaatttatttatttttataccttttattcagtttttattaaagctttcctacctttccagattgacacagaattattccatgaatctgtctattaatccatttacagcaagtgctggggatagaaattaaggtttaaacatataattcctgccatcaaaggactccctgttgattaggggacacaggcaagaaaatagacagtaagtttgttaaggcatgaacaaagaactgtgttggtacacacagtacagagaggaagtacaaagaggatggtgcttaagaagagttaacacctagacctaatcttagaggatgaggaagcattgggtagactagaagactaggtgtaggggtaaaggaaggcatatcagagaaaagggagcagctacatagaggcaaggactatgcctcttctgcctctgaagaggagaaatttctttcaatcaatagaaagtgcaggacaaagggtactaagtcatcttttgatgggataacttgatgttagtgtccttccatgagaaaatgggaagcagccccttataataaaacctctggcttttgaattaccaagtaaaactgaggtgtcagcaacccttggctgaatgtggaacttgctaatagaacccctacattcatgggaagggataaaagagctttaaaaagtacaaaagcattgtgtgaatatatgggattaatattactactacaatattgcctaccaccaccatccccagccctgaggagtcttcttaaacttacaaaatgaagctgcttctctatggatgtagacatttcctggtttcaacattgcaccatagctatgcattatgtcaacattgggaaaaggcagggtggaaggtgcacaggagctctctgtacatttctttgaaacttcctttataccttttaaaagttaaaaagcagcagcagtggcagcttctcaaggccaaagatggggagctctatttcatttgcatttctactcagggctataatgaattgaactcaatgtgttgctaaagattattatgaaattaaaatccaattaggatggtctcgtgggtctggtaaaagcttggattagagaccaggcacaacacggggttgggggagatggactgctcaatagaagtagggctgagtggggagtttaaagcactggcctctaagtataggaaccactgtacaaattttaaaatatactcaggatagttaatatttgatcaaaatccactgtgaagtgaggaatttttcctgctgggcattctattttccagttctatgatcaagcccagtgactggtaaatacaatatgccccactagcccccagcttctcccagctcctgttccctcctggtgctcaaagggagaaaggctaagaaattccaagccctggtcaggaaagtgatcttgaaatcacacacaatgaatagtgccatcactaatgactcagcttgtaaagaaccagtgaagtgaggaaattctttctatgcacagaatgtctagatatttaggcaaaattgaaggggatgaggcaggaataaccaggacaaactcagtaagaacttcaaccctggttttctcaagattcagtttatgtgctgatcattttctctcatatctaattcccttacttcccctgctctgttttacatcgaaagtgctgacttcatgcaaattacatgcaatttgcatgtaatttggaatttgctccctgggaaaatcacttctgactaggttcagccaatgggaggcactaacaggagattggagggtaggaggaagggaggcataagggaatttctttcccctctctgtttcaggtggcatttcaagaatgtctgtttttcctccatgatttctatagatattccttaattttcaagtctccattagcataggtatgaaggtttctcaatgtgctcttgctttggcttcctttagtcagaatagaaagagaaagttttttaactttattcaaacatattaggggtttgctagagaatacattatttgcccctagttatcctgatgttataaaaggaggcagacctggacaagtgtaaattagcacagacattctaacaatcaccagaaaaatgcacccataagtagtgccaatgcaagaagttttgactgtaatgcccgtgtgcagtaggctgaatgatggcccccaagtatatctatatcctaatcccgagaacttgtgaatgttacttgctatgctgaaagggactttgaaggtgtgattaagggttttgagatggggagattttcctggattatatgaatgtgtcctaaatataatcacacaggtccatgtaagaggtaggcaaggtcaaaggaggaaatagaaggtaagataatgaaaacaagaggttggagggctgtgaggaagggggtcacaagccaagaagcataggtggcctagagaagctagaaaacacaaagaaatggatttcttatagagtcttcacgggggactagccttgctcacaccttgactttagcctagtgaaactgatttcagacttctggcctccaaaactgtaagagaatagaactgtgctgtaataagccactaaatttgtagtaatttattatagtagcaataggaaactaatccaatgttcccagatatgaaaaaaatttctttttctttaaacacgccacctgaatgtgaacatattcctcttgctttaaaaattccacatctaggctattagcaaaattcatacacaaattctagcttactataaaataatcatttaaggaagtgtataaaatttctttgcctcagatatcatagtgcctcagatcccctttcaagactgaaagactttctactccagatgccattggctgaagacagcttctattcaaacagggaaatggcctgtctgcaacatgcagcctttattcttatctgcatggcatactccttctccttctttaaaatttgatagtaagtcttttatgattttgctcttttaaatgaaattaatcatgcccctcttcatcttacttactctatacctcatatatatattcatttttgcatttatgacatatcttttatgtttattatacctgtttcccctgccagcctaaaactctatggaggaagacattatgtcttatttgactgtgtatactcagctcttagtacaagtaagtacctagtacataataggtactcaataaatatcaattgaattgaataagaaaactgagtttaggttaaaaaaaaatctcagatggaatgtcagagagtaagtacatacctattgctggggtgaccaggggcaaattacttaacatttctgagttggaaataatgccaactacaattacaagaccattgtgaagataaataagatgacacaggtaaagaagctgtacaaagtaggggtctagcttgggtgacagggtgaaactgtccattcttctcataataaatgcccattctcttcacaataaattgaaaattagtttgcaacaaacttattcctgcccttttttgtattcagggtttggcaagaccttctgagttaatttaggacaacttagtgtttagcataactctttcacagatttgctgtattatcagtgtctgatgatgttgacaatgttgaagaagaagaaagaagaggagttggaggaggaggaagaaaacatccagagcattcaatttattctagttaaattactaaccagaaagagaatgccctcggaagtctactttataatgctgtttggttctaagtaaagagcatctaatagggagacatgtaaatcctgtttccaaaacacacttagaggattacagcatgtgaaagatttgctccctacctggctcagagctacgaaggtcacattggctgtcaaaggacatgtcttctggctagaagaagccctggtgaaatcttatgtgatatcggcacctttgcagaaagtaagaaacaaatcacctgaaatctacacacttaaattcagcctgtgttggtctaatcaaatttggccctgttagagaattgaattcacagcagaaaagagaaaaaattatgctcttttctcagtataaattaaaatgtagtatcatcgtttgcccccaaatgctaaaaggttttgtaagtgatgttattttgtgtttttttggtgtggaatcttggcagcgcaactggaccccagcttggagccacaaagcagcgactgtagatcatgcaggagggtatctatctggcaatagcctgcacttgttctgttttttctctgcttgctcttgaaaagggggagaggaacaacctttgaaagctaattattcactttgagagatgattaagatgaatagtcctcacgtgtatatttgaagtgcagaggtgtggtttgtttttgtgtttttgagatggagtctcgctctgtcacccaggctggagtgcagtggtgcaatcttggctcactgcaacctccgcctcctgggttcaagcgtttctcccaccaaagcctcccaagtagctggaattacaggcgtgcaccaccacacctggctaatttttgttatttttagtagagacggggtttcaccatgttggccaggctggtctcaaactcctggcttcaaatgatctgcctgccctggcctcccacagtgctgggattacgggtgtgagccactgcgcctagcctagatgtgtgttttttaagtgtgttgtcttaatatcattgtggtatgattcacaattaatgacacctgagggtagcccttctgtgtatagtgtcatataagtgtggttgtcacttcctcctcaggctgatctccctttgataagactaataagttatattttgggtttccttattcgaccctttttgttgagtttcatatcccaccaagttgtacattactagctcacaccttctaggttttatatatgctctcttttaattctttcaaaagctctgtgtggaagatagtcttattccactgtacatatgtgaaaactaaggctcacactagttgtgaaatatgcccagtcacacagctagaaaatgttggtggcagaagtggaaccccaatctaataacttcccaatgctgtacgcaacttcattcatgtacacaaaatgactgtaaatatgagaaattacctgaacaacaaagagaagacaatgacttttctatcatagtcccaattatcataatgatttaatatccatgggggctgcatcatatctaaatgtaacaactacaaactgaagaaacctgccatggggctgacaaaagtggatttgcagtgaatctcccttgctgttatttattttctcctccagagataaaagacacaattcacaaatagaccgtctttcaaatgcaagcaacaatccctcctccctgtctcctgtgtccatatataattctcttaaacagcataaatctcttttctatgcacgttactatttgtatgcattttttcttggtcccaaattaaatttattttgtctgtaaatgcaagcaggctacaccttgggcccctgagaattccttgatttataactgtcactgtacatgtcatatccatgcataaagtccaataaagtattaatcacttcatctccatcacaggaagaatttctttggggccattttccccaagaaatacatacattttgtctgttgataaagtgaccgcacatgtccaaggagcacaaaaataaatcacgttaagaggtagaagttagatttttattttttttttagatggagtcttgctctgttgccaaggctggagtgccgtggcacgatcttggctcattgcaacctctgcctcccaggttcaagagattctcctgtgccagcctcccgagtagctggtattacaggcatgcaccaccacacctagctaatattttttttagtagagatggggtttcaacatgttggccatgctcgtctcaaaatcctgacctcaagtgatctgcctgcctctacctcccaaagtgctgggatcacaggcatgagccaccgcgcctggccaagaatttttttttttaactagtgaatattaaattttgaagtgctgaatttattctattctgtggataagactggctgcccaccagtctggaagttcttaaagcagtgattgtgttctttccatgctattgccacttctcacccaatctggttctttgcccccatacaagataaaactttcaccaaccaagttaaaggatgatttggactctgtcatggagctacattaggattagaataatatcagagaatgtgccttgaatgaattagcctggcattcgaggccaatttgatctgccctctgctttcctattttatcccctcctgacaaccttcctgataacactccaagtgtaccaagtgttttcagagcataccttgtactttcccattcatagtccttttagttttattttttcttccccttacaatgatggttcttctgtcttgacattctaacaaatcttcatgactcagaacaattaccattttctcttcctgagtcctcaggtccaaaagaagccacttcattttttgtatacttacaaagcactccattatgacattcaggcattttgatgtattttggttctatgtgtgtacttgttctactggaggacacactctagaaggataggagacacatcctagctattgctgtaacatctaatgccccagcagagagtcttgtatgagcgacttaaatacgtctatagaaatgaagtaattttatttaatgcatggcagcattttcttaggatattgccgaatgaggttacagcatgctagtaataattaacatattcattagaagataagaccttagtcccagaatttggctgtgtggtcttcttgaggacatctagagatgggggcatggataagatgtcttggggactggtccaggtgcaggacaagagaaacaactatcacaaataactgtacattctgtatcagggtgttgtaagattccagcccatgtgagaatgaatggttgtcttcatgcccaggtggcatgaagtagacgcttaataaatgaggtgccctctgtgctcccacacatccatccagtgcttttctccatcttggcatttactctccagttgtattgtaatgagtggcctctctgtgactcattactaaagactagggcattacagtttaaaaacataatcttaacacctagttcagtgcctagcacataatcagccctagataaatagatatttattgaataaatgaagaaaagagtataagaagaaaagaatgaaagacaataaacatgaacatggaagtttcctattcagccttttgaagaatatccattggaatcattgtggagattatgagcattatgatatagacattgttactggcttcactgtaatattactcagccttttctgtttagaaaaggctaaatttcagggagagcacttgtcagagtgcttatattgggtcagctgggacatgcttgggagcagatggattaatcccatttcctgcccagacctcagtagcactttctctgtaaccctgagagtttatgtgtatatgtacatgcttgtatggatttaaaagaagcaataataaaaattctgaggaaagtctgaagatatttgattttatcatttacattgtattcctttaaagaaaagggaaattttaattgagagtgtttaggccaactaatagctcaggaaacagctccccacacccatataccctggcctaccaacccctctcccattcttattgccaaagtttcattctccaaattcatatccaaaaggacctattccactgcccccaatgtgtatttcttttccctgaattgctgtcacatactgttttactgtttcagctgtaagctgttggcatcacagtgctctggggaagttgtgctaatccaagtcctgacatctcctcaaagatgcctaaacagtgcagtaggaattctgcaggtgcaacttgagccttctaggaaaggctgtgccacaaaggcaccctggtcagcaccccactcatctggccataacatgtctgagattacgcaggtcagggaacatcttgcagcacttgctggttttgcagagaactcagaaatgttaacagatggcatgcagaacacaaccctgaacagtcagcagggtgacactcattaagagtcatcactgaatctatttccaacaaaatctcattccaatgaaacatcgcttttcaaaaagtgtcaatctgcttaaatgaaagtgactacagggtactatgatgccaggcccggttgaatccctgcaggcaacaagaactgtcttagagcctcagggcctttccacccatcatttcctctccaaggtgggtcctggtcagatttctctccagcaatcttagcctctgcagatgagacagaatgcctggtagcactcagaacttctcctcctgagcctgacattcattcctctgcctacttttcctccccagtagaacacttggggaagcaggagggagggaagaatgagtagaggaagaataatatagaaaacttgttgttcctcaagtcagaattccttccacggtggaaatgtatttattcttacctttcttcaagtatatgaccaattcattcttcaagaaaagtcatttcctctctctccctctattgattcctaaagggacacattgatcccaatgcaatctgctaatctacattttgttgtactttagatatcactaatgaattaaaatattaatatgtgaaactgaagtcaagtgtacacaacaccaatacgggatgatgatgcttaggttgtcaacccctttgcttagcactcactgatgcagaggccaacatctccctttccaccacttgcttccctccacccccaccaagaggtggaacctccaatagtcacgtttttcatacttccaggtcttctccctacaaggcctttgttacccccatgagtgcctcctgaaatcctactcagtcatccaagacccagtgcaaatgccacctcctctagtcaacattccataaagcttcagtcagcaagagttgctctcttatcagtgtttccatatctctttattataacatctagattaaaacttgtcttattctgtctgtaatttcctgctgctacaactccaatgaaaacgtattaaacacacctagtgcctggcatcatgagtcaattggatgggctaacaaaacaacagacctcttgaattgatttccctagctcactaaccccatcagcaggagtgaggtgaaaaatcacgagtgaggccttaacactgcttagatgaaaggctggtatccattagttggtacatagcctaggagctaagagactttggttctaatcccacttctggcactaacattttccccaagctcacaccatggtaaaccaaaggtatcagttatttacttacttggtaaatgttatcagtaaactttgtcttggttatactgttgtttaccagtagtccgtgcttttatatattgtctattcttttttttttttttttttttttgagatggagtctcgttctgtcacccaggctgcagtgcagtggcgcgatctcggctcactgcaagatctgcctcccgggttcacgccattctcctgcctcagcctcccgagtagctgggactacaggcacccgccaccatgcctggctaattttttttgtatttttagtagagacggggtttcaccgcattagccaggatggtctcaatctcctgacctcgtgatccgcccgccttggcctcccaaagtgctgggattacaggcgtgagccaccgcgcccagcctatattgtctattcttaacaatcttcttgctaccaaagcattgggccaagagaacaccaatagttgcctataaaaaatagactcagatttctttcatgagcacacacatatcaaagaagacatggctgcagaggaaggaagacatggctctgctgtgtgacctctgtggaataaggataatagccaaaccagtcttggctgcatggttatgggcataccagagctaaattctggaaaacacttagcaggaagtgcccccacaatattagctacttctattactatcttttaattttactccagcctcataatgttccctgattcttatttgcttatagtgaattcctaagagattttaaacttgatactttctatatctaatgggctttttgaaaaattacatttttatgttcttgttttcttaagaaggatggaaacaaatatatagagactttattatttccaaaaagtgcttctttactgtaataatctaaatctccaacagatagatgagagaagaaaaattcttgccaaaaatgatcagtccaaaccataattatgttaattatatccaactgtcagcaaagagatcaaaggttaagtctgttctctgcttcacagaatgacaatgataataaacagttattcttagtagctaaagtatattttgcaattgtaactgacaccatttgactttcatttttttataagcgaaatgatttgcaatgaattttcatgcttgaaacaataagtgcttttagcttagtaaaattcacttttgcccagcatgacccaccttcctattcacagtctgctctagtacttgaaaacactgcttgagcaatgtaacaatgaacttggaaaaatagcttatcttttggaaagccctggaattgcatatactcttcagttttctgcattttaagcaccttaaagaagtttaccacttctctagtggtttcatcactctttctagtattgagcatttacaatgtaccaggagctatactgaatgccatatgtagcaatttatctcagttgttctcccaacaatcctgtggtgtgtagtagcatcacccagtttacagaagtagacacttgctccaggttacttaggtggaaactaaatgaagaatcccagatctgaaaccaggtcctcctgtccagatatggtactctcacttactgtcttgtattgccttggctgcccataatattctgtacttccatatctcagtgcctgtcgtagtttctgatacacataaggaatacaacaatgattatgggataacagtcattataatggccaacatattttaagcatttacttttgtcatcaaatgttctaagaactttacctgtgttaactcatttaacaagtctataaggtaggtactgttatcccattttacagatgaagaaactgagacacacggggattagttaatagttaataaaacagagagagagagagattgagggagagagagacagcattcttggaccacacccagaccagagcatctgcaggagtccaaataatcctctctgcccatacataaagcatacaattgcactccatctctttttgcttactcctttacccttctttactcctgaatctttcagtcaaattctggaaaacttgggtgattatttcccccaggtcctataaggctactcacctggcaggccaataggtttggcctgtaaggttttcttacaatcttattcatccaggctaacatgtcaatggggctctgcctttctttgtgtgcaaccctggtggtgtagggattactctcatgatatagacaaggaagctggaaagcagaaaggctaagtaagcagctgagctgggatttggtaggagacagtctgcctccagagcctgccctttaatccacacactataagaacacgcccttcctgaattcccatttgcatactaaactgtattgtattatattgtattgatcttgtactaaattgtattgttatgtaattgtttctaaaatacagcccatttgattatcaagtgtttaaggggtcatgtcattcttttcattttgtggccctcagagtgcctatctcaatgctattatttgctgaatcctaaattggaggttctgtcccagactggaatatctgcttaagcactgtgacttctgacgactagaactttacaaataaacgttgtatagctgagaagactaagatacgaaaagattgttctggagggtaaatagagggtcatactttaagaaaaagaaaatgtgcaaaaggataggtttttgttattttttttcttttgagcatctactgtgtctctgatttttgaaaaataagacataacctagcccttaggagctcttagcccagtgggaagaatacacagaaacaataacatgtaataacatgtaatctgaaagattctgtgacagagacgctatggaagaggtcataagtcagcagactgccaaccatatgtgacccacaattatgttcccttttatttcacagtgtcttcagaaatatgaatcaagggttaacatttaaaaattaaaaattttacaacaaaatccacattggtggctacccaaaaagtgaaaagtttgatgccactgaacccccattcctgcgcagccaccatcagcctgagtccagtagctgctacctccaggggtggtatgtgcatatatttttatggatggtcccatgtttctttaacaatgtttaggacacttacctatagccattttctacaagaagcacatatgatataatacgtcaccttggtaacactgcccatgtgactatagataaagtcacacactaacatgtaaggtgacataaataaaaattatcaaggcagtatagacagaaggagaaagacttgaggtacataagggggtggctgatggaaaaaagtgatggaaagataaacagaaagttgataaaattgtactatttgacctctctccctcctcccatcttggtctccctccttctgtccctcatctcatctctccccatatgtacacttcttcttctgactccccccataataataatatccacaaccctatatcaagcacctgcttagtgttggagattatactaagttttgtgaacaacaaccctgcagactgatattactctacaacaaagatgtgtttttaagattccagtcatcatgttctttgcatgatgccctttgcttgctctgcttgtagtaacagaaaattcaaacaccaaatataccagttctcctgctttgcccgaggttagtgggagacaaccttgtgctgtgggggatgtgctggctctggggaaaaagcatttgcatttaaattccacctataactctgaattagtgcaatgatcttgggtgagttattcaacctctcttgtgcttaaattcaggatctattagatgagaatataattattattcagataactattcataataactatttatatagttgttatggagacaaactctgcataggatgcccatgtaaaaagcatctactattcctatcatttttcagataaaaaataaattgaaataacaaaggaaatatctacaacaatatattattagtgggtaaacaaattaacgtgtgtggagcacctactatgtgccagataatatatattttgtctcatttaatcctcatgctgctacagcaagttagattttataatattaatttttttttggttagaaacagcaacagaaagaaagtactttgccacttatgactctaatagtagagccagatttgtatgactccaaagctcatgtccacctgctgtgacccacggcttggaataaggacaagggctactgcagtgctcaagacagcttttaccctggactccaaagggcactgcaaggctccctcaatgctggattcaagtaaatccgctacaccttacacttccgactcaagacagaaatcaagacatagtgacctcctattgggggcagatatgaaggtgactgacaaagcatcaggacagagcgaatgaatcattcatgtaaatgacaacattaacacatgccctgacatgttcatctctcatcctcatgcctactgtgaagaggcaatgtttgtatctctataggacatttgtattttaatatacttggagtgcatttaatatacacatgtattgaaaaatgtcttcaaagatggtctaccttaaataccaatttttttggtaaggaaacagcagcagaaagaaagtactttgccacttatgactctactaggacagccagatttgtttgactccaaagttcatgtctacccactgtagcccacagcttggaataatgacaagggcatctgcagtgctcaaaacagctttcaccccagactcaaagatggcctgaattatctatggaaagaatacatgctctgaggcaggtccaaatgtctttcaaagtcaatacagattgaaaatggctctatctgcaaaaagcaagcactgtattgaaacctcactatttggccccaaagacacgacccccagctcttctctctctaatctcagaattatttaccttgtcagaaatctcatggagaggaggcggagtgttatattctcttgggccaatatatagaactttaaaaaagggaacaaatacttctaaggaacctgctataattctggctctatggaatgcatcaatacattaactcaatgaatctccaacaattaaatgtgatccacatgagaatatttgtctcttctatttatccctgtactctcagaactgttcctggcacataggaggtgcctgttctggctcttgctactggtcctctgcactgttccttaactctgccaccaccatgcttcccactgtattacaagatcaggaagcccgagaactatatgctcagaaccttttgtcagtagaattgcagtttagattctctcaaccacagtaacttctgttaagttccaggatgttaaaggcaagtagcagactggcacaggatcacaggattttgtggctctcagcactgctacagtatcttacagtttcctcagactccacagtccactgttggtctctagcttcagggctggaacaaactgtggctcaggaaacggcttcctgaggttacctgatttggttgtagctgcctccattcctaactagcagtcttcaaacaatttctaagcacattattaccctgaattacattgctttctgcttaaaataataaaggtgctatctattttcctgactaatttaatgttcaataaatatatgttaaataattgagtaaacaacccattcagtgggcattattatccctgccttacagttgtggaattgaggctcctagagacaaaataatttaagattatacagcaaagtattaaatgtcagatctgagagtagagccctggactgtctaattcccaatgtgcttttgctttttccattcaaggactgctcacagtgggtataatataccacgttgctgtcaaaatcttatctcagaggttaagagttgtttgtatttctcctcctgccagagcaccattgcagctgaaaacctctctatacataggcaaaggacattcattcccaagacaagtggtttattaaatatgtattaggtctggcaagacaccctgttaaaaacatacattgtatctgcagcgtcattgcagatacaatgtgtgtgtggcacatagtagaagcttgccaagtattaactgaatgaataaatgaatgaaagttcactggttttgttccgccagacattcctttgcagattgtatgctctgactcaggggtcacctgggccataagccatctgtgggttggtaatactattatccttaatgcctggttccctcctatagttcagcaaagtaagaatacctcagaggttcctagatactgacataaggctgttgattttccttggaagcctcagttgtcaagggcattgtaattccgaggcagatagaaataagaatccatccatccctacattccaaataagattgaggcactgaaaactattaatctgccttcattgtaatgtattaaaaagagtgtcacatttggaatcaaactgatctgggttttcatcctgattcctgatacttactagacgtgaaacattgggcgagctgtttctgtgacctgttttttcatttatataatggtagagatgatagctctcttacagagcttactgtaaggataagctattgtagacagaaagcatctagttctcctggcccatgttatggattcagtgaatgaaaatagtattgtcttcactaacaccaagagtctgttgacacataggctgtcatcctgcaggctggtccacataagccaacaaggctctccagtcccaaataggcagcagtggtgtgaaggaatacttaaaagcatgttttttactagagaggttatgtagttgcaaggaattaaatgtctgcatattttgtaagcttcgcggtgtctgatgcctttgggtggaggggagtgggaatggctggtagagagtgggtagagcagaatcgtcaaacctcacttttttttttttttaaatgggaaccaagatttgacttactgaaagaatctgaggggtggacaggtagagttgggtggcttttgtacactgggaggtagtagttaaagctgcaggaatgaatgaggtcatggatggtttggaattaaatgagggaaaacgaaaccacacttgacttcagaaaactcacagtactagtctctagcttggtgcttgggatacagcagatgctcaatgaatatttgttgagttaaaagcataaggttaaagagtgcatcacccttccttaaaatgtctgtgtgtctaacttatgatccaggttcattttacctttgaaaagctaactgatgtctatgtgcttcctaaagattccaagtttctcattctggaaaggtcctcttctgaaagctcatgaagccagcactaacatttatttagcatttaactgagtcctggaagacactatgagttttttcattctacttatgtatcttaaacctcaactagagtttgaggacagagaccacatttttttgcatggctgaaaatttctcagtatctagcagagtgtttgactatagcaagtgctcaataaatagaaatgtagcacttgattaatcaaccaatattaaagtattgttagggaagaaagaaataaatagaatgccttgaaactttagatgtgtggaaaaatgaagtgtgtgcctgtaagagatgactggtactcagcttgaaagagagaaggcttaagaagccttagaaagaggtgccaagctaccgtaaaatagaactggggtgtgagggggaatcttgcatagaagaggctggtagagttagttctaggagagaagcaatgggctgtcttttattcttcaactatgcatgggttgccttcttatgtcaagtagtgtgctaggcaatggagatacgacagtgaataaggcacatcatctggtcataagggctttacgttatgctataagagttaaaccagcaaacagtcaactacaacatagtgtcacagcatagagcaatatagagtacaaatgggggttatactttctaaatattagattatctcttatgtactctccctctgcagggatgacctgagggattcaacagatattgtgattcaagggttaagcaagctcaaaggaagagagatcggagagaatttcaagactatagagcttaccattttcttttatctttttaaatgttactttaactacaataataaatattcaaaccattccgtatgttctagagaaaagaaaggcagatcagacgtgccccttgtcaaccactaggcaactcgtctaaggaaaaatgaataatttctactaccactttggagattcttgagatttttttttttagagaacggggaatgcgttacaataggagcatgagattggaattctctatcagctgtagcagttaggagtcaaaaacacgaagaagtgatatatacaagggtgcatgggaattggaagataaataaaggactatcacattccacgggaatttttctcaggccccctccaacttgacccactatctcccccatgatttttttttacaaacatgaatgtcaagttctctgcttcctgtcttcactagcattattttcaagattagccccttccatttgctagatatatctcattattcaatagttttttatacagaactattttcattccaccacatgagatctacttctgccctttgcagttataaaataaatttataatctcttatctctttaaaggctgtcttgtatttgaatgttattgtatttgttgttcttatcccttgaagctaggcagccgtggtttctttaactcagaggtccccaacccccagtccgcagactggtaggtgtccatggcctgcaggaactgggccgcacagcaggaggtgagtggtgggtgagtgagcattgctgcctgagctccacctcctgtcagatctgtggtttcattagattctcagaggagtgcaaagcctattgtgaactacacatgtgagggatctaggttgctgcttcttgtgagaatctaatgcccgatgactgatgatctgagatggaatagtttaatcccaaaaccattccccttacccaccccatccgtggaaacattgtcttccacaaaaccagttcctggtgccaaaaagttggggaccactgctttaactcattttatccagtaagatttccagacttttgttccctacgtggttacctcttgaaacagcttaattataactatctaataaagtgatccttgtaccaagcacaagactccaccatgagttgaaaagaactgatacccaagagaggtcccatgacttgcccaaagtcacaatgctggtaagtgaagggggcaaaattcaaagcctgggctttggccttctgtgctagttctcatccaacctctaaatacagagaaagaatggagtccctttcattccctctccaacagatcttaaacaacaccatactctcattccagccccatttgccttgagtctgtgatcttcttccaaacccaggcatacaccggaactggcctgggcaaactgcgatatacggtcaacgctttatctttccttaggcatgtttgcctttgaataattaaagttgtatctattcatagacataagccaagacaatgaaatatataaaaatatgaataaaggatatttattttaaggaagaatttcttaaaatatgcttttgtcttctgtctacaatgaagtttagataaccttttcttagtgtatccaatgagttttcaagtgcatttttcattcatttgccctttgaaatggacttattaccatttaatggtgataagcaaactctgtcctacctacgcttattatagctgtctaaggatatgacattcagattgacatgcattcctggagggtggtgaatatgcagctggcatgatgttaatagattttctcattcacttgtaaacaattctgtttttatttctgccgatcccaaggtttggattgaacttttgttttctagtcttaaaggaggaatttcatgtgagcttcacaaatactcattacctgaatataaaggtctcagcacggtagttggtccaaaaatgcagccagcttgttcaaactccttttcaattcagaaagccatgctaaggaaattagtgatgttctcttcagaggtggctaacttccttctagttggtctaggtcttgctactaatcatgtacagaaattaaaggaagaggccgggcgcagtggctcatgcctgtaatcccagcactttgggaggccgaggcgggcggatcacgaggtcaggagattgagaccatcctagctaacacggtgaaaccccgtctgtactaaaaatacaaaaattagctgggcatggtggcaggcgcctgtagtcccagctactcgggaggctgaggcaggagaatggcatgaacccgggaggcagagtgcagtgagccgagaccgtgccactgcagtccagcccgggcgacagagtgagactccgtctcaaaaaaaaaaaaaaaaaaaaaagaaattaaaggaagagggaaatgacggcccctggctgccagtcactttgcaattttctggggaaatgaagtaaaaaaaaaaaaaaaaaaaaagcagaaacaaaaacaaagaaaccaaacaaacaaaatgagggcactcaggctgatgttcatggaagcaatggctatgtctggcatcacagacgtggtggatattgaagcagggtcagatttatgtagaaacaaggtagaatggagggctttcagactgatgcataaaaatatccagttgtcaatttgccaagaaaatctattttcaattcttcctctccaggctcatctaccactcttctctgcaaagacaacacattttatagcttaagaacaaaaagctatcagtcccaggacacatcttgctgtttcatagctccatacttttgtataggctgctcattctacctgggatagccttggttctttaaaatactgcaaagacattcagagaagtttttcttagccctactaagtagaggtaatcactgttttctctgggttacctctgtacttttttaacagtaatataattgtactcatatgctattactgtaatttaaattacaataaaatggaagaaaaactatatatacacacacacatgtatatatacacacatgtgtatgtatatatgtataagtatatatgtatgtgtatatatatgtgtatataaacacatatatatgtgtatataaacacatatatatgtgtatataaacacacatatatatgtgtatataaacacacatatatatgtgtatataaacacacatatatatgtgtatataaacatatatatgtgtatataaacacacacacacatatatatatatatatattttttttttatgatagactatgagcttctaaagcccaggaacagttattcgctcagcaccaaattactagtccctggtaaaactcagaaggcaatacatgtttgctgagtttaatgaaatctacaggcagcaaaaatttcttctttattttatggccaaagaatttcctggcccatcaaaatgctctattggaatattttcccaatcctgagcttgtactaattgatctgtttattcactgaacccctgctactgtgtgccaggcagagtattatgttaggtcccaggaatacagtagtgggtaaaacagtcctggtccctctcctcatgaaccccctctccctactcacactctttcaaattactcattcctattaatttactgcaaaataatattcgcacctctagcaataacttttcaattcagaaggccacatataaaagcaaattgatactgagtatgtttctgctgaaaagtctataaagaaacattctaggctgctgtgtctcatggaaggtgtactccatcttcatgaatacatatatagatgtatgtatttctgtctacatgtacatttctatgccaatgtatacatatattatagatatgcaatacacaattaaggctcacaaaagaatacaaccctcttataaacagaaggatcccttgacctttcaaacttaggtccacttaattaaaaacgaagcataatttgtacccttaatataatggcctatgattttcaagtttaactattttcatgttgattgctatgttttgactctattttgaagggaccacaagggtgtttatgccctgaaataaagaggaacagacaacttttccaaccctgaaaaacaaaggaaaaaatttaagacaaacaaacatgaaaagctatcatgtatttctctgcacccagaacagtgctaaacataaagtaagcactaaatgaatactttctagataactgaataaatgaaagagcaaacacttgcaattatgcagttcctcgttaggacaagccaaaggaagagctatggatttaagagggaaagatagtttaaaaccaaatcttgacccaaatggtgaaaagatgattatctgaaaataattttaatcttatagctatgctttaaattctttggtctcttagctctcagagcagtgatgtatactgtggtgggtgcaatatcacatctacctaactcaaccagcttatccagctgaggacaggcatcataaatattccagtgagttccatgaggattaggagtaaacagatgtctagttcacctctgcatttctcaagagtcttgccaaactctgtagacttttctccagttaatgtgcttttatcatttccaggcttcttctacgtgttacaaatagagtggatgcttgtggtggtaggtgacaaggttcccaggagaaggtgaaagcaggaaaaaatgtcaacaaacatctaccaagcacccacaggtttcaggccaaggctaggttctggacatacagaaaaaaaaaacccatcactggtgactctatatatggagtctcaatacttcttggtcaccatgataggttttggtatacattgtccttatttgcaatttaatatcaggaattttatctctaccacagaagaaaatgaatacctttgggctcactcacaagcacatattcatgaaattttaagatgtaagaaaattcattgtgttgtcatagatgaagacatttctttaaaaaaaaaaaccaaaacacaaaaaaacccagcaattccatctggtctgctaaacaggttctcttgggaacatcatgaatgttttaataaatttatctcattgcattgctcctgggtgggtaactaagaactctgaaggacagatatattcccaaattctttctcaggcaaatttttgggcatgtacatgttaacattagaagggaatctaagtaaattgatatttccaataatagtatactactatgaagtgatttgattaaaatattctccttaaaaataaaaaggaggcaaacttttgtttctataaagaaacattctaggctgctgtgtctcatggaaggtgtactccatcttcatgaatacatatatagatgtatgtatttctgtgtacacgtacatttctttgtacatattatatttaaaaagtagattcaaataaccctaatttaatttttaaaaattttaaacacaaggaaaatgttttcctttatatcttccttatcactatgacaactaaatgggtttggtacaatgctatcttatcctaattaagaacatggccctgcaacgtggtattctattaatattaaatgaaaatgtgtgaattatctagttttaattagagtgctgcatttatggctttccgttgtgagcaaatgctgtgtggtatatagaacataaattgagatttatttcttaagaattagatgaatgtaggggaaatcaacgtgaacccacactgcttgaatcacacatcctgatgtagagtctgtatcgattcatttatcttttcatccttctacccaatactattgagcccctcctatgagcagtcaatggaaggacaaagaaaaatctgtccttactaatgagctccctctggtgataagatccaccaaaacagataattatcatataataagataaatgtagttaaagaaataagctgtgagtatttgggatatagcaagaaagacccaactggtggggaggaagggaagagaaacatctttcagaaggacaattaatcaataaataaataatgcttatttattttttgtttcatcaatatccctactccctttccctctcttgtattattttgaggcaaataatttcatccatgcctatgtcagcgtgtagctctaaaagataagggtgcttgtttttaatataagcacaatacaattgtcacatctcaaatattaccaataacttttcaccacatatataattgatgtccaaatctccaattgtctcattgtcatgacttgttttaccatttatgttttgtttgaattgaaatacacaaatgttcattgcttacaatttgttacttttaagtgtttcccctatgtctcttttttctttgccaattatttattgaagaagcctgagttttaaagaatgaatggagggtaagacaaataaaggggaagggagtaaggaaggaaatctagagaaatgggacaccaggagaaaaaaatgttgtagaaacattgaggccttccttgatttcccttccttcccttctttcctttccttcccttccttccctttcttccccttctttctttctttttcttcttctttttgatggaatttcgctcttgttgcccaggctactgcaatggtgccatctcagctcaccgcaacctctgcctcccgggttcaagtgattctcctgcctcagcctcccaagtggttgggactacaggcaccacgcccggctaattttgtacttttagtagatacagggtttctccatgttggtcaggctggtctcaaactcctgacctcaggtgatccgcccaccttggcctcccaaagtgctgagattgcaggtgtgagccaccgtgcccggcctccttgattttcttaaacatgcaaactctgtgagcatacttacttattttgggaagattgctcagtgtactcctaacaatactcttctctatatatctagtaaattcctgtatcatcttctagttcagcttcagaaattcttccccaccttttctatctcatgttgtctccatcctcctttgaaggatgtatcagctggcatttatcaaccagtatttttggtgtgtttgtgttgaggcatcatgtgagatgctaggcatatagggatgaatgaaatcaaatccctgtcttcaagaaactctcaggctggatgcggtggctcacgcctgtaatcccagcactttgggaggccgaggcgggtgaatcacgaggtcaggagtgtgagaccagcctgaccaacatggtgaaacccgtctctactaaaaatgcaaaaaaattagctggatgtagtggcacacacctgtagtcctagctactcgggaggctgaggcaggagaatcacttgaacccgggagtcggaggttgcagtgagccaagatagcgccactgcactcactccaacctggacgacatagcaaggctgtctcaaaaacaaaacaaagcaaaacaaaacaaacaaaaaaaactctctgtgaggtattttagtaagaaatgaggcaatgcctatgttttggactaaaaacatatatttgtccatataatttttagtcatgacaaacacatgctcattgttgtgcagggcataactggagagttttttaaaaaagcaatatttgccacagaatcattaataaataggctcgctctttcagtttccatttaaagatggaaagcaacactttgtcaataggctaaacattttgactgtgttttattgctttttctaacgtcctatgttatgaaaaggtcatgagaagactaatgttggaagatcagataatcaaattataatgagtttagctagtaccctatggctcacattttactctttatgttgctagtggggcaactgaagcaagcaagacaataatgcattatcctgtaatattttaaaatgaggttgttgatggtagaaggcccactagcacttttttgttcgattaaggggctgccaatatttccttgggtttgctactggcccttacaagtagaaagatacatcttcatattcaccatgccagcacctaatacagtgtcttgaacattgtgggaaatggtgggtatcatatgtgctgtcctgctactttccaactgtgtgaacaagcctcattttctcctctatttttatagtgctactgtgagaagtaaatgagataacatgtattcagtgctttgcacacagcagcagtaaacaaatggagaattttgttattatttgttaagtaaatgaattttaaaaattgtacattctgccattgtcttttactcctttacctctgccctatccaaatccctgacctgtctttccagacaacctcaaatatctcctttaccactttttaaaaactcatacatggctgccttaaacatcttaatacttagttacacattgtttctgtgtctaaatgttattctccctaattgtagccgtaagttctttaaaaataagatgagtattacatagaagtgatgtcaaaatatttacaactagctgtgccaggtattaatgctttagttgctcaatcatggagatgtgtgagagtcctagggaagggattcaggggttccagtgtgaagcagcttgtagaggagcactcagcgggcccagggtagaagctctttactaacaagaatatatttcaatattttaagaagcagaagcactgcctgcagccagaatattagtgctggcatctttgatacttctttggcatcctctatttgtcaggaactcaacacacttactgataaggtaagaaattcatccaaggaacagtttctctatttgtacaaggaagccacaaaacaagacaaagaagattttatctggtttgtgctatggggaaatgaagttatgccatagtaataatggtaccttttaatgcttatatgacatatgacatatgtgcttttaaataaacattatctgtcacccttccactatttttagttgcttctttctctgcactgaagaactgtctaatctgaagaggaagaagccagtgccctgggaagcatttcctacctggtcactgcacccttctctgactcaagcatgttttctgagtgaaaacagaagtcttgggctcctcagtgacacagctaggctgggagcacttactcatgcctggatgcaggttttatgaacagattttatacaccagaagcaagaggcaagaagaaatatactttgattctgtttattgctattattgtctgttctttggaaagaagctagatagaaaaatgaatatttaggagcatacccaccaggtaggtggattgacagcactgagacaagcttcatgagtgaaaaaagaatgttttatcattgcatttggatgccagaaaattgtgaactgtatgatcacgcttgtgatagaaagtaaataacagttttgtcacttcctcttctatgctgtaaaagtggaaaaacaatccaaagtgtagttaattaaatttggagtcagaaattttagcggaaaactattaccaagcccattaagtacaatcttaatgaaggaactattctacttcctcagtggaaagaaatgattattgccaaaggctgaagaacttataaattatataaactttgaattatccagaaatcagagtgaagtctaatttttctttgaagcattgacattttgttaacaaatattttactctatgtctcattcgcaaagtgatatacaccatacaattagcaaacacatgtacaaaaatatattcttatttgtcttatcatattttttagtatcacaaacatcatgatatcaaaatccaaatacacttgagttactgcataagtcattaatcttctctgagcaggtttaatcagaagtaaaaaggagaagaagaagatgatgatgattttgttcaaaatacaataattcttgagcctggtaacatatattttaaagttcacattgattgactccaaatctgtatccacattgtaaagaatcagaacatttgactgtggtttagcttataattcaacggtcatttttcaacaacaaatttttgtgagactgatactttaggttttctgttccttattctactgggcacatggcttctggctgtctggtgatttctgcaatagtgccaacgtaaagataggcaacgagttgaacaattacttcattagcttttgtgactgcaaagagcatttttctctacctcaaatcctttccttctttcttctcccctagcaaactcctactcttcctggaagccaatttaaggacatgcaccatcatatgcttggccttcattccattatgttatgtactaactctagtagacatttgtacattatgtattgtacatttcacaagttatagatggctgctggatgcttttccagcatccttccccaccaccatcccatcctaacagcaacagctgccaaatttcagttaaggactcataatgtcctggggagactgtctttatcctacctaagctttagaatggggctggagatttggtctcatgttcaggggtggatataagccagtctcttcaaagtgaattctaggaatcattgccaggatctctttctagctggatgtgactatgaaaacaagttgtctaggagtcactggcaactgtcctggggccatgagggcaattagtcttggtatgaagctaacacaaagacaggcagtgtggcaggaccaaaagggatttcttaacaatattgtgagctgagctacaggatcagatctcttgaagctagctttactgatgtacttttaagttataatcaccactatgagtatatattccctttgttgagcaagtcagtttgagtcatcagtttaactgctgtattttcagactgggtgggcacttaatgtaggcatactatgtgttaagtatttactgtgccagatactttcatatgcatgagagcatagcttatactgggaaataaacttatctcatttatatcttcccaaccgcctgtgagacaggaattgctatgtctgctttatagcaaaggaaagcaagggtgcaaggtttagtagtagggaatacttccaacaatgcattctgcctttccacctagaaaactactttgttttgcaagcttggcactacttacaatggaaagcagccttatctgttactgtcatggctgagaaggaatcacacttgcaactaagggcccatttatccatgtcccttggattataaactcctcgagttcaaagattaaaatatttcatctttgttatctcatcacccagcagagcacttggcacgtggtccatgcttaataaataactaataatagacaaatgaactagaaaacgaccgaacaaagcaaggtaatctggattattctgactagaacacatggctttcccaagtattttgcattttttttgatatttggcttgactctttcagagttagatgttcacaatatactaacagctattttctcccctaatttcctaaaagtgtgttttcccttttcttataatcatatgaatgattcatgtttattaaaagttcaaatgataaataaaacataaagaagaaactaaaaataaaatggagatactaccactaaaggcatgctttgtcttgcttttgtttgtttgttacctctttgcaccatccctactaccaactcttccaggcaaaataaatatggcacccattagtcttcacagagtcatcaatttaactgctgtattttcagattgggtaaacacttaatgtaggcatactatgcgttaagtatttactgtgccagatactttcatatggaggagagcatagctaatactgggaaataaagttatctcatttacatcttcccaacttcctgagacaggaattgctatacctgctttatagctaaggaaagcaaagttgcaaggtttagtagtagggaatacttccaacaatgcattctgtcttcccacctagaaaactactttgtgaaaataatactaaaagaaataaaaataaaaggaaaaaatcattcatgttaattgcataatagctttcatttcattaaaaaacaaaaacaaaatcccccaaacctcaaatttcttagtaattacaaaaagatttgttgcttagaactcctggctgttaattctccttaggagggtctttgtctccaatgtgacataagatgaaaaggaactattgggagaatgatgcactaaacagaaggggctgtagtaatggcataaggccacacaaagacattgatagccatctctgctttgacttgactcttcctacaggcggaacctcccctgtgaggcagggttccacttggatgcttcaggcagctttctattagtcctcagctctaagtgttacaattgcaatttaaaactagagataaggaaaatacacctgaaattagctagggtctctccaagcaactgttttcaagtgccctaaaagacaaatggcagacagttttaatccagccaatcctaaaattgctttccaaagtaagactatgccctctgaactagaaaagccaatgtcttcccttgaacctgagatcatcattgttttgaccacttccttcttcaaatgatttcttttgggttaatggaggaaaaaagtcaaaagcaaaaacagacaaaagccccacaaaaccaacgcagtggaattttagtttactactctgaaatagaagtaaatgttctgcaactcaaggtaggctgactcatatttttgggacccagaacaagaacataagcagaagctcccagtcctgggctagcccttcttctttttcatagtttcttcctgcactacaaaagacctttcatgcagatgtgtggacatctcagctcatgagtgcaagcagtgattaacagcatccatcccttgccctatttcctaccctcatgcaaatagaaggctcttggtttcccctcagactcaggggcaacgggttggggaggcacatcatacacctcttgaaagtgagcttaggaatgtttggggaaaaaattattgggtcctatttaccctgaatgtgatccagaagggacagagagcaagatctaagtgagcccatcctcttggcctacagcctcctctaaagccacagatatggggaaatttgctcagttcaaagggtggtactgatttagggtaactttcagagcttgccttgaatttggtagatttacgaactttttatgtttcattttttatatcaaattttatacttcggtaaaaataggagagatggctcaggaaaatgtgatcttaactggcatagaccaaaagtgagagcaaggaaatccccaacttcatttttaaaatattccctaaactctgagagggattaaacatatgaggagaggaatcaaagcagatatggggccaagatcccaaaatggaagtgtgaagagctgggcaaactctattgcatacttccaacatgttggtcatcgtgtggatcctgaaatcagacaggcgtgggtttaaatcctagcactgctatatgccaatttacattagtagtatatttaaacaaaattttctttatcaattcctcatttgataacggaaagcaaaataggatctacctggtagggtagtgaggaggattaaatgagaaaatgcttgtcaaaccattagcacagtgcctgggacatcataaactatatttactagtattgtcaggtattttaatacaatgttagggctggaattctggcctagttgttatttggcaaataacgtggaaagctatgatatgttatttggcatcagtttatttccatgttctctatttgaaataaaatgtattctttgaataattatgtaaggattttggatactatcctaggaattagttaaaagtgaacagaaaggtaataaccctgtttttactaagtttccaaaataaaaacaaaaacacaaaatgatctagttataagaagtctatctggttaatttaaaaaattgtataatcttcctgtttaccatgccaatttctttcaaaatcaacatctatcaaaatgagttaaagtatttgacaaaatacaatttacaacaataataattacctttcattgggcatcactttgtgctaaacagtatactatttgctttacctacatcatcaatttggtttaattctcctaattttcccctcctccattttacagataaagagtgtgaggtgcagacaataatacttggttggggacacagaacccctgccctttccatttacaccttgctgagccaggtctttgaacagcacctttaaacctgtcctttttgccaccttccctaccctctcaaaggaaattatatgtgtcacgtaggcaaaattaacatttgcctctttcgcttttaatcctgttttgagagacatggttttgtgtgtatgtgtcctgtaagagggttcttgtcacagcttatatttgccttgctgtaaatttaattgggaataactcatactaaattttcttttgttgctataaatagagttcatcacgggtgggtggagaaaatagaaaaaccaccaccaaatgagaagaaattcagtttgttgagattggtacataggtttatttttccataaaaccacactgaatcaaaacccagatactgctgtaaaataaaccgtggagtgtggcgtgtaattttaaaaaatttaatgtacagtgcagctcaaaggtactttacaacaaataaactaccttgttcttggcattaaggtatattaacacttttaggacccttcagctgtgtgacctaagctttaaaaaatgtcataggctggctggagcatcaaacacagatgttcatttgtatctgtgatgatttgctgaatctcctatcttaatcattattgctctatccagaagctttgagccaaacataagacattttacagaccccttgtggggcagccgcttgtggattagaaaccaagtctcaggttacacacccctaagtgccaaccacaatacatcactcctctgctctttaagcagaacttattcagagaaacggaaaatatggaaaagctatttatggacaaaagaagcatgaacaaaaaagtgttcctgaaaaaatatatattccattttcaaatctgccaagtttttggtataatcagaaagtatactaagaaaggagaaataactttattggaagtgtggtggtgccgataaccaaaatatttatgcaaaaaataaagcaatgagtaagctaagtctttggtgaaaaaaatgcatacatttttttcaaagagatgctaaaatgagttgctttctttgaggttaaagaggacatttgtcacatctacagattctacatgtaaagagaaattacaatagtgtacaggtaaacactttggacaaacaattatgggtttagaagacagtagctacttgccagtgaaataaagcaaatgtcaacaagctagacacacttgaaacatttgaaaaaaatgtccttgctactcctctccatatataatatgccatatgacaccagagttaaatctgctattgcaaaaaaaagtacgtcaagctgtcggtttccatgagatttggacagaggcaaaacaacacagcagagagtctaagaaggtacagctttcacttctctttccttctgaagaggaaatgacttcctatagttagctgaccaggagttagcacgcatcccgcctggagctaggacctggagcaaatacccggagcccacccaaatgagaccaaaatgcagcttcaggtaattgttaatggtgataatgaaactagagaaaacagccagccacaagtcatgcaaatacaacagtcatgccttctgcatttgtccgtcctgcgggtacgtcgtacagctctttccataacgatctagtcttttctttcactccctctcccacatcatcaacaggcacgccaaatgcaaatctcattggattctgatcccatcccggcaaaacgcaggactaccaccatactgagtttcacaataatcgccacaatgccaattattcacagcccctctgttctgttcacacaaaagattgcaatttgaatcttgccttgcacaggttcagctcagttggagctggttaccaggcaaacagtctgttttaagatttgccgattgctgaggagagtgaattagtggggtggggatggacaaaccaccctgtacatacctccttttggcagctaagaaaaacaatttcgtgacaaagagacttgtttttttcaaagctcacccaacaaatgaaactgatagaatgaaacctgagaaactttagcaaccaaagaaagcagccttccaaggatcaaggtgaataattgattcatcggcttttctttcatcttttaagctattttgctcgttaaaaggaaattgtggaatttgtcaggagcccaaacactgacacacacttctgacagcaagtgcctattccaaactatgggtacgtttgccaagcttattcaacaacaacgattagctgcaaagccaggaacttaccgagcacaaaattattggaacaaagcagggaggaggcaggaggcaccaaaggcagcttctccgtctccttggtgccaggttctcctgtctgctgtccggttcacacttgcctttataactaagactctgacagaactcactagcggaacctgatgaattataaaacagcccctcctagattctcatattttacatcacagggggtgaccatgcagcattctcgctcactgggtacatatatttccttgtaactcatcctgataaatatatcagccttagaagcagtgacagtaattggtgtttgggatgtaccactattaaccaataagatgctttcccaccatcagtagtgtacccccatcctctgctcgtgttcccctacaccttgttaaggtggatccacccagctcagtgaggagtaggcaaagacaacaaaatgtggaaaaagcccctgcaccaatgcacatacagcaaggcgtattactcagggttaaagctcttaatagtaaggatcaactcctatatttgcatagcctgtcacagtctaccaaacactttcactctcactgagtctctcagtgactaaagaaggtatcaggagtgctacagtacagatgagcaccagagatcagagagactaaatggctttatttggtattcactgaatttatggaatgcaaggagtcctagagattagggagtcctacccccttactgagcagataaggaacccctggcaagaaagataaagtgacttgcccaggtcacacaaagtgtgatttgaacttgaacccaaacccaggtcttctgatggcaaagtacagtgcctttctattctaccatgctgcctctggagcatgaaagcccagcaaacgagaagactggaaatcataaacagtactgttgaccaaaaatcattaataggcaggcttcatggggagcagtgcctgagctttttgttccctccctgacaaggtcagtttaacctttttaggttcatcgaataacagcactggaaaatatgttttggataataatagctaatatctattgaacacattttaggtgccatgcagtattctaaatgcttagcatgtattgactcaatcttcaaaatgtccctgtaaggtaagtactatcatgagcaacatattgcagagaagaagctgagattcagggaggtcaactaatccacgcaggatcatatatctgttaagtggcagagctctaatggactccacgcaatttagtttcaaagcccagactcatatatattatctggccccaagtagtgttttacactaaactgctagaggcagatgaacaatgagagcagactgatttactatggcctttagtagaaaggataaaaagataagttttgaaattcaacagaattgtgtttaaccctgtctttgccactaatttactaaaacgcagattgttttatctgtaaaatgggtatattgaaacgtacatcacaagactaaatggagaatatcaagaaaatatagtgcctagtttatagtatgtacccccaaatggttctcattcctgccgtatttcctttgacaaaatgaatttctgccacaccttctccctcaactaccttttaagatgttaattttactgtgctaaggagtcttctaacctgccagtcagtgaaggggaaaaagccctaaagagacctaacatctctctaccagagatgggctttctataagagaatgaagggcccagggctctgtgctgggctgctggcccagctcactagcttctctctgctttacttccaccattactcaaataaattcatcagcccaagaaagcaaatttgcaacatgtctgctatccactgtgagaccatcttggcttctctcacccttttcaaacaagctcctaccacaaaacccataaaaacaatgaacttttatatgtaactatacacttacagccactaagtcatggtgtgccaagcaggaagacaggtatctctgtcttgaacgttccactgctaactcctaccgtaagtcagtataacctagtatttggccactggtgaggtctctatctgatgagctcctcccgatcagaaactgctatcttcaaggtatgcagtcagcattccttgagagccatcagaagtaaccctctgtgggacaaggtgatgctgtaatgttgcaggatatgcaggtttagacatgagagattttcttagctccatgtttccagagaataactctgtggccaacttaatttgctcacatacagtctgttctctctttgtttagcttttcctctgagcgtcttactagaaggtctggaatacgcatggatgagatgccgtctttcctgaccatacttaatagtaggtactataggagcagaggtaagaaatataattggaggtaaggggtggagtaagacatgtgcttctaaactggtaagaaaagtcagatgtaaacaaagaacaggtgataactacagctacaagatcaatggttacttcctatatgtctgaagtaggtatccacttattatctgaaatggcttggtctcgaagtcttctcagtgccttccacctacatttagcccccaaatcccctcaggagccatttcttccctgtccattttcccctgctacctggctataccaccatcattccatgaaaaattaatatatatgagtcatgataactcttatattgtagcatttctctgttcccctgtcacgaataatcataattttatacatattctttcataattaccacttcaaccaacaattactctcagacataatgaattatgtagaaccttgaagctgtatcaatattttgcttaaattagtgatggtgctagtatttattgagcacttattatgggctgacaatatacaaaactttatgcatatctctcatttaagcttgacaacaactttttgaaatggtctgtactattatctttaccgtataggtgaggactctggctagaaaggttaggtaacttactaacagatggcacagtcacaataatagctgaggtctaagaccacagcacctgttctcttaaatctcatatccactgcttctaagcacttgcggcaacaggtaacataaaacattagtgtctgttttcacttcctcacatcccattctctcctttaatgacttcaatcaggcttcccactacaattgttcttatcaaggtaaatgaaaacattgtcactcacaaaatcaatatccggtgcacagttttcagtttattcaaccattcccagcatttggcagaatcaattacaacttccctgaatcgatcattgtctctgtttggttatcaagacccccttggtttttctcctacttcactaatctatccttctacgtctcctttgctgggcgcttctctgctttctgatattttaaatttgagtgtccccaagtttgtcattagacttcttttttatactcgctcccaaggctagccatccggtatcaagactaaaatgccatctgtagatcaaaggctaccacatgtagatctccagtctcaatctgtgctctaagctccagactcttatatccagctgcataccacatctaagcatctctacttgattgtttaataataggcttctgatatttaaaatgctcaaaactaaactcttggtttcctctcctgaatctgctctactcccagtatgcaccatttaaataaatggcgcaatcattgacctagttgctctggccaaaaacctgggagtcattcttgactctcctttttatcttacaccccatgccttattcatcatcaaatcctgtcaactctgtcttcaaaatgtaccctctgtcttttttccatctccaccctcatctccctaatctataccactatcatttctcacatggatttctgcaaccacctcctcactggtttctttgtttccattcttgccttgccgccacccttcctccacacagcagccagccatgtttttaaaacaaaattcagacaccaacactccttgctcagctcccttcagcagctcccctttcacttggaatttgctcctttcactgcagccagaattccatctgctcaagtgtctccttggaagaagagatttctctgacatcctgtatagaacagcatcctctattcctccatttatctctccctcttattagacttctaaaaaatttatagtacttatctctgcttaaacattatatactaaatattgtatattaaatgtatatatgaaatattttatagttctttgttcatttctttacttttgctcctctacccaactagaatgtaagctccatgaggccagggtcgttgtcttttttgtccttggttgaatctccagcaccagaacaggacttgccacataatatgtacacattaaatgaatgttatatgtaatatgtatttattaaatgaatgtatttgaagtcttatcttcactacttcttagtcctatatccttacacaaatttcttactgtccctacattataaatttctcaattataacttgttttttaaaaacaaacaaccctcccttatttttctttctgatgctttataggtactttctaatatattcagcctatcctgtgtatgactttgatacaacaattccagagattggtcaatgttgtgggttgaaatgtgtcaccccaaaattcacatgttgaagtccttgcccccagtacctcagaatgtgaccttattgggaaatagaattgttgcagatgttattagttaagatgaggtcacactggaatacggtgggccactacttccatctagttcaatatggctgatgttctcataaaaacaggaaatttgagcacagaggtgcacacagggagaatgttttgtggagatgggagttatggtgccacaaacccaaaaactaccacaaggcagagaagaggcctagaccaggtatttccctagtgccttcgcaggaagaatggccaaaataacaccttcatttcagacttctggtctccaaaatgttgaaacaatacatttctcttgttctaagccacccagtttacggtactttgttacagcagccttaggaaatgagtatagtcagtgagatattatcctcatttagtacatgaggaaatcgcagctgagaaaagttgagtaacctgccccaggtttcacagctagaaattggcagggccgggctttaaatcaaaatctgtaccgcttcaaagtctatgcacagtggcggtggttcttagacactggtccctggcccttgttggtccagagcagactgagaaaaggaagtaggatgcagtgatttttcattgagctaaaatgaccttcttttattatagaattattgccttcctgctatttattttttcttcctattgttttggtattgttctttttacttctgaaatgatggtgagaataaacagtagttggatttttttcgtaaatttttattttgttttttaatgtctttcattttattgacaagataaaaagttggcaattctgtggcctatagaagtttgttctgaaatgtttctggtttatgaaacataaatgtctgaagacaaatgttccaatgctgtcccctttatgaaacaagtcctcagcctgggcaacactgtgaggccccatctccactaaaacaaacaaacaaacaaaaaataccagctggtcatgatggcatacatctgaagtcccagctactcagcaggctgagggaggaggatcacttgaccccaggagagccacactgacactacagtgaggtatggtcacgtcactgcacttgtgttgcctgggtgacagagcaaggccctgtctcaaaagaaaaaaaaaaaaaaggaagctcttcacaaacagtaacacacttggtagagagaagaagctgtgctctcaatcaactgtagaggtccctgctcataaacaaagtgtccacgttaatggtcacaatctcaattaattaccacgaaattattctgatataatcccacgcaacgaatttgtttgaatttaacaatattcatttattcagaaatttccttagtcttgtccccttcctttttagtatagatttcctagttttcagtaaaattcttgagttgcttttgacttgatccattttctttcgggttcaggatttgtgggcttgtgcgaatgtctgaggattaaatgagatcacctttgttaagtatctagaacaccataaaaaagctttcagtaaatgctagttcccttcaaagaaagaagtgaagatttatgcatccagaagggaaacgactttaggactaagggagatttacagcaactggatgactttgcaagatggaccagcctggagagtgttaataaacttcaccctcttattgaacattcagtgatccccatgacagtttatagaaattgtggcagtctatttttatgaattcgtgttcatgagtatgtgtgcatacatataaacataagtatatatagaaattaatatatattgatgtcatatacatcattaatataaatttgagtggtatgattgtgtgtaccttcttcaatttctgagaaaactcagaaggagaaagccttcctacatataagagtttgccttctttgtttatctattatctggtcccctataatctaatttggggaccaccaatttgtcctatcctgagaaaccttagttaagaccacttcaatctatccctttgccaaagttatctcagacttcaaatcagtaaagaagagattccttcattctgtgagtatatatggagggcttacgatgtcccaggcactacattattacgttgaatgccagaagaacgatgtaatcaaggtcatattctccctctccttaggctctcagtccagggagtaataaatttaatagataatagctaactacacagctgcatagcatatttttataaggactttcattaaggtgctatagaggttgagagcaatggcatctaataactcagtctggagactgaggtcatgaaggcttctggaaggagaggatgagtcttaagctgggtcttaatagatgagtaggagatattgagatatccaaacaacaagtgttgcaatcagagtaagaagcatatgcaaagagatggtggggggttaaccacggaactctggaggagtgaaattttatccatttagcacttaataacataagtacatgtgatggaaaaaaagactaacttgatagtaggaataccagagactaatcatctttttttatgaacttcttcaatgcaatgaaggctaaagtggaaaatgtcatgctttatagttagacagtcctgattcattcaagctgacctttgcaagttgcttaacttctctgaattaaaccttggttcctcatctatcaaatgaggataatattatctagttcatatagctgttgtgttcttatgaaataaaaaaaatgtaaactatcttgtttctcacacaatgtacttacattaaatgtcaaaacaagacaccagactaaatgtcagtttatgtcctgaaaacacttgtgtcattgtgaataagaacattcatcactcataccaaatctggtttcccattgggatatattcatctgtttgcttcctaaaccagtggtttcaaaactttgcttgctgacaccatcatttaaaatcactttgcatactcacccattatcttaatatttacataattgatatttacataaatatatttatgtaaatattatatatttacataaatatataatatatattatatatatttatataatatatatttatattataatatatttattataatattatatttattataatatttaataaatatttatgtaaatataaattatgtatttttatatacataaaatattataaattattgtgtaactgtattactgtgtcacagtgtggcacactataaaacatataacaaaacagaaatttaaaggctgtgatgaaaaattaataaaaagagaaggtcttggctaccactggggtgcgtataatcactttgaagaataccaagatctcctagacagaaaagacctaatctcattcatttatggagcacccagaagcacagaccaagcactaaagaaatatctaggaattgaagaagcaacactgggacaatagaaaaaacccaaaaactctgtggcctactagtgccactatctgtacaaaccagttttttagtttttatttttaatatatattttaattataatacaagtttaatatagtagaaatgttaaacaacctaaatgtaatggctctcccccctcaaaggtcagtggcaaatagagagtcaatattcattatttctaaaagagctaattgtaataataaccacttgctgaacacttataaggggcagacactacattaatgcctttacaagtacttatttgctctttacaataatctggacaccatattatacctctgtagagggtatcaaacatttcggtccatgctgtgggtgggggtggggggggtgtctgcaaaccatggcctgcaggcaaatctgtcccactgtccatttttatatagtctataagccaagaatgtttttcacattttcagtttgtggaaagaaaaatcagaaaagaatactgttttgtatgaaacttttatataaaagttacatgaaattcaaatttcatgaccacaaatagttttactgaatcacagctacatccatttatgtatttatgtattgtctatggctgcttttgcactacaatggcaaagttgactatttcaataaagattgtatgccctataaaatataaaatgcttagtatctggcccttgacaaaacaagtttgctggccccttgtgtatatgactggagtctactggacatgtgcacgttgcagcttgcatggctctaagtcatggttccaataacaatcctatctggaaatgtaggttcagagaggttgtcacttctccatgcacttaggaaatggcagaatcagaggtttttaggataaatttttaaggctgaaatatgcacttgatctcacctagagttcaggacacttttctcttctggcctcttctggctatgtaacttaactagccacacgtaatataacttccccactgcctccactgtcttctctgtactctcctatctagcttttaatatatttatggctaaggacagggtagggtggggaacaggtcaatggaacaaaagtacaattcactcattcacaatacttttcattctccctcttcgagtctctcaaatacacacttggcccctgcgtatgaggctctgctgtctctggctgagctgaaagtgatgaaaaggacgtgtgatggaatgctggaaacctcattactggctctttgcctacagaaactcagccagcttatcttctttcccaacgaacttcaaacttacactggctcagctggttctaggtgcctgtaacaagctgctctgcccagtggagatcagaagccgatagaagatactctgcatatgctttgctgtcctggagaatatgttcccttttttctcattctcattgtagcagattctccaagggtctcggccactcctgggttgtaacgtggataccgaaaagtgcaagttacaataattttttcctggacggtatccagaagaccagacatgtgaacataatttctgtggctgcccaattatagttagaacttcacttctaagcaaggacaactacactggcaggacatggactacgtaaagttgtgagaagagctttcacatatgttaatctcattgactcctccccgcaaacaggaatttgttattcccattttatagataaagatgctgggactcaagaggaactaagcagtgtatatttttcatgtatccggtaagtggtagatctgagtttcaaacctgaagctttctgacacctaagtgcctgtcatttcagtaaaggagcctgttataaagaagtcagtttgttgccataatagtcattagaaaacaagcaaacaaacaccccttccctgcaacaaatcatggcatgatatgactgggatgcagtacagcataatggagttcaatgatgagcagggcttaaaattattggcaaatcatttaaacagcctgattctctgtaaatttatctgtaaaatggaagtaataacatgcctaacttttaggatcatggtgagggttatataaaagaatgtaggtattctgtttatatgaaatgcctagaataggcaaatccatatagatggaaaatagattgatggtgcctagggctggaggtagggggtgggaggaaatgaggagttgctaatagttatggggtttcttttggagatgatgaaaatgctctaaaattgtggtgatggttgcacaactctgtgaatataataaaatccactgaattgtatattttaaacaagtgaataatatggtatatgaatttaaaaataatgtaggtaaagggcttagccaatgcctggcacaaaacaaatgctttataaatgttaatttttgtcattactactttgaggcagagactatctggttcaccaaactcatttcctcttctcctagagcacaaaactagactctaccctaaaaattaggtgtggccatgtgtctgagtctgggccaagggaatgtgagttctggccaatgtaagggaacaagcttggcccataaaaataatcccctcacaagccttcatgttatttcccttctactagcttgatgcaatgaatcttttggcttcagagctacatgttgaagatgaaggagccatagtgtggaaaagccaaagttcctgaatcactgaccaggggagagttgcccattagccaagaagaccggctttagactttctgagaaagtaaataagcttctaattgtttaaacctttttttgagttttgattgtaacagctactggtattattataactaacatattattgttagtttttacagtaccaaattgaggagaagtgtcagcccttgtcacatgcctgaaataaattcactgtagattggctgaccatgctgggtctgggggcatgagtgcacacaggaaaagttgtctggtgaatttgagcattattttagtactgttgaatagtcactggacagtttgagtgtagtatgcagcttctaattaccttccccaactttggggaagcagagtccttgttttgccctccagtcccttcaggaagggccaaatgaacagcaggcaacacgcaatcaaaccgtgcatagcagtagggtgtgggaacggcgaaggcagctctgtgcctgctgctccacccttctctcctacccttctttgtggaggacaccgtaccctgtccacttcccttttgataaaagggaaagtaatacaaattaaagatgtgacccaatcacattgttttgtccttgcttagtgctttttaaagcagtatcctacactctaaatgtggaaggcagagacagcttttagctctccgggtgaataatgccaaagtatttgattgctattgtctctctttcagagggtttgctgtcaaaaggaaaagctctgagtcattctttagaaaaggtgaagagaggatatgcaaccacaagccaaaggtgacagatcggaaagggaccaatcactgggagcagggtttctcgggtttgtgagccccttccctcatgcaattgtgtcaaattgggccaaaaatgccttctgtatctttctcacagaggagtgctgtaaaacccaaagggcatgtaaaatgaagtacagtcagatcttataaaaatagctattgattcctgagtgtttactgtgaagccctcttacatagcttgtttaatcttcttgacaagcttaatacataagtattattggtccacttgagagctattgaaactgaggctcagaggttaagcaaagccgtgtccccaggatcacacaggtagtaagcaacagagctgggactctaactaaatctctcaccaccatgcccttcaaggacttcaaacaaatgaaaagcattagcaaggtaaatggctcttctgctggagaatctagaaagtccaaagccaaaatgtctacccttgcgtggaaagaacatcctacagggctgcctgtgttcagcatattaagtgcctaagagaataatgaaacagataagaaaagggaagaacaaaggccattgtccccggccctggagactagcctgcctgaacatgattcacagtcattcatggactcagacctcatagattttgaatatcagatcattgcagatagaaatgtgaacttccagatagcaaccatatcttcttgctgaaaatagcttccctccccccagcacaaagtcataaagaaagaaaaaagaatcttaatttccttctgcttcctgtttgccagactgttcctttcttccttcaacctcacggtcccattgtttctcttatttcttcctagtatgctctatttaaaccagatggagcagtagcattttgaagcgatttttgaacccaagggactcgcgtcataaataaataaaacaaatgaacactttagcaattggcaaatcaggcaggaatgggtttaacaacggagctggaaatgtagctgaaaatctactccacgatgaaagatcggaatgtggcacaagttcttttcaccgaataggtaaccacactgacttctttcagtaaactgggggctaaagagagacgcagtgggaaggcagtggcaaagagcttcagagacacattcagtggccccgtctactttgcattaccaatatgctgatacattatcccatggttgctacgaaatatttgttcaccacctataaaagtaaggcattttcaagagctggttttctttaaatacattctctttcctttaagtcttacataattcaactatcattccatgtgaggcttaatttaaagaaaaccataagttgagttaattcactgtgaagggttatggaagctatatttattccagagagtcagcagcagtgtaatggagcatctattatatgcctgacctagtgccaggttctgggaatacaaacatgaatagcccagcccctgcccttaagacgttcacagaactgggaggattcacaaactaagtgaaagtgaaaggcctgttaccgctattaagatagaagaaaatatatgaggtgcttagcgatcacctctaatgagggagaaattatgtgtggggaggggaagaggatagagtttgtgattcagtaaaagagtcctagctgggtgcagtggctcacgcctctaatcccagcactttgggaggccgaggtgggtggatcacctgacgtcaggagctcgagacctgtctaagatgttgaaaccctgtctctactaaaaataccaaaattagctaggcatggtggtgggtgcctgtaatcccagctacttgggaggctgaggcaggagaatcacttaaacctgggaggtggaggttgcagtgagccgagatggtgccactgcactccagcctgggtgacagagtgagactccatctcaaaaaaagaaaatcctcaaaaaaagaaaatcccctgtctgtctacctagaaggcctaagaagctgttaaccaagggagaagaggttgagatgatggtctgggcagagagcacaggaggaattgggacaggctccaccgtgatgtgaaacaacctgaaggttatggtcactgtagacatttgaacccagctggaaaacagactgaggagagaaatgagaggcaggcttgggagtcacggggtggatcattctctgtcatgtgggtcaggggactccatcccataggccatgggagcctctgtaagactttaaacagcagagtgaacatgatctgatttgcactttagaaaatcaccttggcaaccaggtggaggatggactggaggtgttgaggctgggagcatagagaacagttaggaggcaatggcagcagtccaggtaggagggatagggcctgatcttagatggcagcagtgggaatgtaaagaaaagaagggagaactaatattaggaaggagaaaatctgggctggaggtaatgaaatctagattctaatcctagctttggcacaatctcttaacgtgaccttagataagctcttccttttctggaccctgtttcccaacgtggcaggtgagagggcgacattttgtggctatatgagaatgcactttatatatgtacttggttattattatttactcattaggtaagccagccagtcagtcagtcagtaaaggcactcattccttgagtcacagttttgggcatcttgatatgaaaaagcaaaatggtagtacaaaaaaatccaaccaagggaatgaggagacttgaagtccataagcatttactgatgatacattaagtacaaaatgtacatcataatctactatagatataatggaaacagaaatgaccaagatgtgttctctaccttccgagagggaaatgaggcagcctatgattaattcaattaaacaaatattgagtaaatgactatgtgcagagtattgggtctgtcatagtaaggaaacagagaaataggacatggtccctaacatgaaggacttcgtagtcacaaatggaagaaaagtgatactgctattggagagttgcaaagcactatgggagcccaagacaaaagagaatatgtaccaagtcaaaaatccatttttaattttcgccatagtaaacagaaatataatttccctttctgtggttcaatgctgctaaaagcaccttcagaaaagcagatgaaagaagagatcattcattttactctaaacaaaaatttttctgtgggtgaggtcctatactaggtgttcaacgtaagaataacaagacatgctctttgccctcaaagaaatgagtcagtgtttgtaacattttgaattctggggaggagaaagtagaagtttggttctactttttctacctaacaattcaaagtgccttgaacagtgcttagcacaaagtaggtgctcaataaatgatcaactgaagtgaacaatattaaatttgctacttaaagaaagaaaatgaagttgactctaaaataacaaatacttgacctctaattatccaaagaatacatttaggaaagattacttttatgtaagaagtcatgagtaattaatcaaaccacaggccactggcttgttgtaatactaattcaaacaaggtttctaagcagcaggtctctactcccaaagtcttgggaagcagatggtacctaattgctttaaggggcatttggttgaccacacttagttctttaagccagagtaagttcagttttttgaactctccttaagacaaatcaacctccaaccccttacgtataacaagctgatctgtttctaaacatgtaagctagaaagaccaaacttgggaatggtgttgcttagaaagaaaaagttatgtcttcggggcatggcagggggattctactagcagcctggccaagaaaagttgctgacttggcatataaggtatgtaaaaagctttaataaaattaaaggtgctaacaatgcaggtgggatttaaaaagaacatgcaccacattgtgatattttttcaagaacagagaggcccagaatattgagataccagctggtaagaattatgacatttactttaaaatctttggccagtaagaagtgattctaaaagacttgcaatgggtttggctcatggtctctgaaccttgttataggccaacttgataaaacacagtgatttcacataggagcttttgattacagactggcttgattgtcatcaagtctctgccattcactagctgctacaaacttggataagtcattgagtctcacttaagcatcaatgccatctgtaaatgaagactatgatgaataatgtcacagggttgtgatggggagtacatgagataatagaggtaaacagcttagtacagtgcctggcatataacaagtatggtgactattactattataattatgtttgctgagagggaaatgttctttccaaaattggctaaaaaccctgtttcaaacatttctgagactgaaatgaaatatatagatgataggtttgcagaaatggcagtgggtgtttcattttcatataattataatgtgcagaagaacatagcagcatcttatgccaatcatgaatcttttctcatagtaaaattattttgtgagtgaacctgaactgtatgtacaatgtcttactaaatatgtacttccatgtgacatttggtatcatgggtttcttctgaattctatttgatgataaaatatagagaaacctagcctggaaggacctcaatgtagatatcatctctgtcacttaaggactgtaagctctggcaaaacaaaaactttctgatcctcagtatacacatctgtaaaacaggtataataattgtactatagttaaatggttttgaaagaatttcatgagatgataataatatctttactgagtttttgccatgtgccaagctctgaaagcctatcctaaattatctcttctcatcctacgttatctcttccacatcctatgttatctcttccacatcctatgttaccttccagagtgtggttgtaaagtcagggtctgcggccaagagttcagaacccgccaggtgggatcaggtgattagagaggcagagggctgctaaatgacagccaaaaatatcagtagcttttgctgcattcaagagagagctgcatctttgacatgtgagaagtgggctgcaggtagacgtccagcaggggcagaaaaaaaatagttctgaatatatgcaaacatcagaaactttgggacctgtgatcatgccctaggtttccaaagcttattacaaataactgcttccaaatatctgtctagagaagacgtctaaagggccccaataaaggcagataggagcataaggatagatgtccccaatatatcacatgagttaaaaaggatgtaaagaagaaaacaaagcacatcaacctgctctgctccaagttaaagttatttagctcctggaactggtttcatctttaaaattgagataataaaactatggcacaattcacattgggctactccacacttgtaagaaagaatggagaagctttctatgtactgatacataaagatctccaagacacatcattaagtaaaaaataataataatggctgggcacagtggctcacgcctgtaatcgcagcactttgggaggctgaggcaggcggatcacgaggtcaggagatcgagaccatcctggctagcacagtgaagccccgtctctactaaaaatacaaaagaaaaaaaaaaaaaaactagccgggcgtggtggtgggtgcctgcagtcccagttacttgggaggctgaggcaggagaatggagtgaacccaggaggtggagcctgcagtgagcagagatcacgccactgcactccagcttgggtgacagagcaagactccgtctaaaaaaaaacataataataatttaaaaataataataataataataataatacagaatagtgtttatagaatgctcctttggtatataagaatggggctaaaaatttatctatctatctatctatctatctttccatgtatgtatgtatgtatgcatgtatctgtctgtctttctatgtatgtatgtatgtatgtatgtatctatcttatctatccccccaccacacatgcacacacacacacacacacacacacacaaatacagtttgctgcatttgcaaaggaaactacagaaagatacacaaaaacctaaaaatagtgattagctttgtgagacgaatgagggcaggagaggaacaaaagttttcaataaataccttataaaaattaaatatttaaattaatttaaataataaaattaggatagcaattggtacataccttataaggttgttttgaggagtaaatataataatgtattgaaagagcttaccatggggcttgacacacagtaagcattgacacacatcagtgaagattatcctctctttttgagaaagagtgggaaggagcccttccttggccttaactttctgctcaagggccaaagagaggtggagacaagttgtaggaggctgactgctggggctttcattgagacttaaggagcaaagaggctatgatgaccttctggtatcttcctaggtcatgcagctctattcccagaaatttgagagaaaaagcccacttagaaataaagatggagcttttacttaggaacctgaatacagtggatgaaagactacaaaatgtagagaatcaaaatccaacacataccagatcgatccatgactctgagaattagaaatgatttaaaaacaagaatgtcttagaacaaaatgagaaaagatgaacagttgccaatgaaatgttattttctttcactgtgttcctaaaaaatttattcaatgtccttaaataatacatcttgcgggattaattgaaaatgccacaatggaatgaaaataaaaaaaaactggctctgaataaaatcctttatatagtcacaaaattgataatctacattttttttgctccatctgcactgaaaaggaaaatttaataatcagatacaaaggtaggaaattataatgaatcacaagtgttcagatattgtaacccaaacaattgctctagtagtgcctgctttacttagggttatgctaagtggctgacaaaataaagactaattctttcagtttcttttgaattaaaacacagcatttgtaacatagaaaagcaccattttgggtacttgtttgggaaatcgcacacaacaggatgtctaggctttgttagatgcttctttaagtagattctataaaaggagcaagcaggcaggagtccgggagatggtgatgagaaaccccctttgggtagctgccatattgttagttatggtggttgaaaattccagctctgaaagtagaaagatctgaacacaaactctgtcactcattagttgagtaactttggcaagttactcaactttgctgaacttcaatttcccatcaataaaattaggataaatataatccctaccttatagggatgttatgaggatccaaagagataatgtatttaagaatttaaatatacctttcttagaacagtgtctggagtagatatcagtaaatattagccctgatcataaacatctatctttgtattcattcatccatccattaaaccatcatttaggggccacttcaggtcaatctttgggttaaacaaaggaaattgaggaagaataagacatagtccttgtacacagaaagctctcagcccattaagggaagatgaacaaagaaggctgtatggaattagggacgctatgaaagaagtcaacatcagttataccgggacatacaaaggaagtggttgatgtggaaggagtatcatagagaagatgatacttaatgaaaggcttgaaaaggcttgaaatgtgtgtatatacaaggcattcaggacaaaacaacaggaagagcacagacactgggataacctgtcgtggtagggaagggaaagaagtctagtatgactgggtcccagagaacaagtgagccagcttgataggtaagcctggagaggcctaggggccacatcacataatgctgagtatacaaggaagtttctgtaatttggtgttcaacaaatcaacttacttaatttgaagttgagagatagtcagcattgccctgctagggaaacatcctgaggctattccacattattatagtagaaagataattttgtgctttctttgtcagctgtataagatacctgctgaaagagtatcttgcctgatcttgccagggacttaccccctttgcaaactcagtgttggcttgggatcaggatatctcagcaaattccccttaactttcactttttttttcccctaacatatcttctcttaaacaggtagttcacttctgtacaaaaggattaacagtgtcagtactggttaaaaaagtgttttttaatggggtgtggtgaaatgaccaggatatagacacctacagtttcaaacatcttcttctacttaacaatggtatgaacttggacaattttttacctttataaatcacaatttccttatctacaaaaaggtagaatgtgacttatctcatggggtgttgacaggagcaaatgtagtaattaacgctaagtatctactatcaagactgacacagttctacaaatggtagctgtcattattgcccatgaaggtgaagtaggtgatttacatggcaggcttgggagaaagaaatgagtctgttggggaagaagaaggccaggtttgtttgaaggcagaggaagctaggccaccttgcactgctaaattgtgccatgttctgactggggctgggcccagagaaagctctaattcctgtgtgttgattgaaactgaggttgaagacactgatctgtctcttcctggtgctcatgaaaattcttcctacctagcctgagcttcatggacaaataaaggctaaccaaagcactttcttttaaaagtttcaagttacttaaggtctctagatttggagcagaaagagatgctaataatgaaacttgctaaatacagcaatttttctgcagtccatacaaattttattagttaaggaggtgatgggaagaaagcaaatatactctgatggtaaggaattgcagttcttccgaaaagcactgtaaatgacaatataatgacgcatcaatccagtccccaggggggaaaatatattatcctctatggtacatctgtgctgttccagcatttcacagacaagattgaactctcacatagccccaggaaagccacatgctcttgccttttaacccagcatctttaactggttaaagcctatttcctctgtagctcacaaatatgtttataataaaggtcacctacaatggaatataaagggaatctctctgaccatatcacacaaattctataatctggatcctgtaaacccactgatgaaaaaaacagtgacaaagaaacaaaatgggactttattaacctaggttcttgaattgtaatgtttaatgccaagcattaatggaagagtacacataaaaatttcaacaaacggccgggcctggtggctaatgcctgtaatcccagcactttgggaggtcgaggcaggtggatcacctgaggtcgggagttagagaccagcctgaccaacatggagaaaccctgtctctactaaaaatacaacattagccaggtgtggtggtgcatgcctgtaatcccagctaatcgggaggctgagacaggaaaattgcttgaacctgggaggcagaggttgcagtgagccgagatagcaccactgcactccagcctgggcaacaagagtgaaactctgtctcaaaaaaaatcaacaaaaaccaaagttttctttacatttgaaataattattttccatgccaattatcttgaaaagctttggtttttagatgagagctctgaaagatcatataaataacccataacaagctaacctaatactcatcatgactgttatttacagtagtgaaaaatcagaaacaacctaaaagtttaataatggtaaataggctaagtcaacagtgtcacttccctattatggaatcttagatctcttttaaaatttacttttacaaaagaaaaaaaatgtatggacatgaagaagtgcccacaaaacattgttaaatgaaaaaggaagtatcaactaccatgactaccatgtacaataaaattacagttttataggatgcagaaaataaatggcaaggacctacaacaaaatcaatagttattttttattgccttatttattttttataatttaaaaaaatcccaataaaatatccttttaagatatttaactttctaagtaaaagctggcaggctgtggaagtataaaaaagagtgcatctgaaaacatgaaaaactttgcatgaaaaatgtttgtaacatattttagatgacattgttaaatgcttatgctataatgtaactaaaatgaaccagggtagttagttgtacatataatataacctcccttatgtatttcataaacagaaatgatactaaaatgagacaaaaacagaaaccagtggttgcctctggatagtagaaattattgcttagttcttcaattgtttttttaaacatgcttctgtattttgcagtttcaacaataaacatgtaataccattataattgaaaaatagtttctggttttttctttttttaaaaaaaatgtataatttgaccgactgaggtggctcatacctgtaatcttagcattttgggaggctgaggcaggtggatcacctgaggtcaggagttcgagaccagcctggccaacgtggtgaaaccccgtctctactaaaaaaaaaaaaaaaaaaaaatattagctgggcgtggtggcacaggcctgtaattctagctacttgggaggctgaggcaggagaatcacttgaacctggaaggcggaggtggcagtgagccgagatcacgccactgcactccagcctgggcgacagagcgagactccatctcaaaaataaaataaagatataattcagcaggaaaaaaactgagtataaccttaaagtcactgaaatattaagttattcagactaaacttccggatattacacttactacctgggtgacagaatcatttgtatcccaaatctcagcataatgcaatacacccatgtaacaaacttgcacaaatatacctcctgaatctaaaataaatgttgaaattataaaaataaataaatgcgttaattaatttaattaaaaaataaagcatagacatgaacaggaatgtgatatacctaacttgtacttgccctttgtactttctgaatgcaggtgggaattagctgcagctctgtttcctctgcatattttcacttattaaaagagttctaaacttcttttctccaggctaaatcttcaatgtaaaaaaattattttggaattaatacatgtgattgcctaaaaatcaacttatttgttattatcaagtaaacttttattctctggaatcctcagagaaaagaagtatctttctgaatatctgaattttccatatagctgaagattaagacttcaaatggagagagttaaattgattacttttgcgattactttacttttcaaaacatcattattaaatacttgcctcacctccagaataatatactagatataataggtttttaaactgatgactcaaaactatcattatgaagatctgttattgtgataataaaacatcaagtagttcttaataaataaacttctaaccctttaaattcaaatctactttactttccatgttgctaacatttaaaaagaacaacaaaataaatctaagaatataatcctatatcaattaaataaagtagaaacgtttacagtttctacttaattccattattttattttttaaaatatgccataaaagatttacagattctctagcaatgaattctcttcgtgaaaaaaccacatagactcaaaagcatatgaaggcttattttgcatggctcttggaaaagtagaactatgcttggaaggcaaaagacaatagatttgcagtcatcgcgcacaccaacaaaagtttcaacttcacaattaaacattttaaaactaggccgggcgtggtggctcacgcctgtaatcccagcactttgggaggccaaggctggtggatcatgaagtcaggagattgagaccatcctggccaacatggtgaaaccccgtctctactaaaaatacaaaaaattagctgggcatggtggcgggtgcctgtagtcccagctactcgggaggttgaggcaggagaatcgcttgaacccgggaggcagaggttgcagtgagctgagatcgcgccactgcactccagcctgggtgacagagcaagactccatctaaaaaaaaaaaaaaacattttaaaaccaacaaaatttttacttaaaaatttatttgacaatgtttattaagctcctattctatatcaggtgttgtgctaggtgccggggacatgtgtctagtgcctagacatggtactggagacagcatattcctttcataggacatgttaaggcagcggctgaatgaccacttggcaaagatattatagggggaatccaaatacataatatcccccaactcctatgattctcaccctctccaactgcacttccataatccccaggaaagcagagcttgaatcaaaggtttgcagtaatatatgcagaggctcacatgtgatagttcattttgagcagtgatcctgagaagaggaaagaggaagcagggaaaccttctgaggagcatacacaatgcaattcagaactatctatccaagggatggaggagagctctacccaccagttcccttcctctccaattgtcgagagttgccacatgcgatgccaactcccttgcacgtccagttttgtgcatgccagagtggcgagtgggctctcgggtagaaagcagagagaggcgtggcagctaaggcaaggtggtgtcagttacacctggatgaagctggttgctacagcaatgccttgagttagtttggcagaaaaaatgcaagactgagtgcaagaggtgacaacacctttaagattcttctaacccatatggggtcatgataacaacaaaagtaattaacacttatcatcaagcaaacatagatactttccatacattttatcacttaattatcaaaatcaactccatgaagtaggtcatacttttatctctatttatatatacttttatctctatttcaaatacgagaaaatagctttctagaactaagtggtctgcctgaggtcatcaataaatggagaacaaaagatgaggctgaaggactggctgcagagccctagaacaacactgactcccccagggcctataagcatccaaacttctcctatataggagaacagaagtagaaatcagttgcccttaggagttcctgtttctatatctgtctctgacaagagttccttgaaggtagagattgtgccttattcctgaattatatccagtaccgtgcagtgcatgacatataacaagtgcacactgttggccgggctcagtggcttacgcctataatcccagcactttgggaggccgaggggggcagatcacctgaggtcaggagttcaagaccagcctggctaacatggtgaaaacccatctttattaaaaatacaaaaaattagtggggcgttgtggtgcatgcctgtactcccagctactcatgaggctgaggcaagagaatcgtttgaacctgggaggcagaggttgcagtgagctgaggtggtgccactgcacttcagcctggacaacagagtgagactcggtctcaacaacaacaataacaacagcaataacaaaaacacaaacaaacaagtgcacaatgcttttgagattggttgagtgtctgttccctctcagtgcactcacggttcttgaaagcaggaaccctgtcttaatcatctttatatcccagcacccagcacacatagttcaatgtttgcttgccctaacagaataaaattttccagaaggcagaatgcatagggttaaaaacgtgcagcttctgtcatatgggcctgagttagagtcccacctttgatactttaactagttatatgatcttgagtgaactatgtaatagtcttttaaatccagagcttcctcatttgcaaaaaagcatgatactaattgtattccatcatgaggttgtggtgattattacatgaaatttacgtaaaagctcttatcattaatacttggcacatggcaatcttgcaataaatattagatattatgataattgttggaaatttattctgtgtttaagttatatttgaagttcctaaactagatctgaaacatttagaatgttcacagtggcacatatgggaaaatctctagaacacaaagtacctaggaaacagatagtacctgtacacagtgatgctcaataaatatttgttgaatgtcagataaaaaacaatgagccatgtttgcttttggcatgaattaccagcacaaatgttgaaaatagaaaaatataatatacgttgctatttaatacctgacagggagaaagtatcagtagcccaagatctgactgtaaacaaagaggagaaacagctatataacctatgaaaggtgtgaagccataaaacaaggccagaaatttggtaatcattctcaagacaatatgataacaaatgtctttcaatacttggctttatgtacctccccaatttcgtatcacttgtgttttatggtcaaaaattgcaatatgttgccatttttttaaattacagagctatgtatttccttaaagtactgtattttccttaaagtacctaattagctaatactacttaattacaatttacatttagattctgcagactgaaggatctattttggaatccttttttttaatgggatatggaacccagatactaaggaagaaactgggggatagaagatcaatgcccaaggctgtgtaggcttagtgggtattctctttggatcatgagagaaagacttggattgcattccagctctgccacttatttactagttgagtgatcttggacaaattatttcctgtgtaaatctgtttttcatagtctctagtatgaggctgctggtgcccatttccctgactttacttgatgatttattaggggaacaagcagagtccactgtatgtggtatgtactcaaccgctgcttgttctcttcccctcttaaaggtaagagacaagtctgagtcctggggtagctgccaataatattcattcaggtccccttcttaattatgcaattcatcaagaaagaatctttttgagaggaaaaaaataaaagtctgaaatcagcatgcctaggacaaaattttacactgtgtgtgtgtgtgtgtgtatatgtgtgtatatatgtatgtatatatacatatatgtacatatatacatatacgtatatatgtataaagttatatatattatatatacatatatataatatatatacacacacacacacatatatatataactttagttttttcaacaagattgctcattaagcaagaaccacattgtaaagttcagctccaccttagtttgctttctggccaactaatctgggcagacttttaaaatcacactggctggtaggtgaatatggtgtttcattacaatcattacatttaccaccccagtgctggtaatattctctaggctgcctgtgatgcttagtggctgagtggcaagtaagaagtttaatttagctttctcagcatctgcaggttttgttttcaacaaagaacttcaggttacataacagccttggcttgtttcagaaggtgaaacttgactctccaaattaactgttgatacaggtcttcagaagcagaacttgatgtatctggaagtgatcccccccaagtcatttggaaagtaacaatggcacttgaccttcctggttacttagcaaaagaaggcaggagaaagaaggttctaagcgtaagtaggtgatcattgaaagggcagatacagcctctaaaaatcaggttaggccttcctttcccaaccctttctagctttaccctcttgctgtccacactccactggataggtgtgtctcactgttgtgggtgagcattttgtgaaagattttagaaaaagcaaaggggaaagtgtaacatgaaaatagggtgcctgggatcatatgaaaacaaaggagagaggaatatgaggtgggtacactgtcctgaactatttcatttaacacatgtgaaatgtggatggaatgaagcccagcacagcaaataaggtacttttttttttttttgagactgagtgttattctgttgcccagtctggagtgcagtggcaccatctcggctcactgcaatctccgcctcctggattcaagcaattctcctgcctcagcctcccaagtagcttggactacaggtacccgccaccatgcctgattaattttttatttttgatacagacagggtttcactacattggccaggttggtctcgaacttctgatctcaagtgatccacccccgctcagcctcccaaatgctgggattataggcatgagccaccttgcctggccagatacttttcatccactcaagaggaagacacaagaagcggataattttagtataagatagtgagtgccaagatggacaattcataggaacaaagagcagtggtattggaatgacagaagaggataatcagagactaattaacaacaatatatagttcatataacatgtttctatttgcagatgtggacggcataaccaaagcttgaaactggtacaaggacattcatgtagttagtaggacatgagagacatttagggtttagtcttgtaaatacaacagaaataaattttctgactccaaatcctatgtatttttctagtagcgagaagaagctgagggcaggtggaatgggttcatataaatatactccagaataaaaaaggtaaatgtaatattataaagtattatagtaacataaatatgctagtaacaatcatttgtaatactaataaatgtaaccaattttcatggagcactaactgtacccaaggactgtgttaaactcttaacatggactgtctcatttattctcacagcccctttgacaaatgtaaagcctgatacttggttaggtgacacacctaaggttccacataactagatcctgactataaaaccatagcctcagcagtcaccaacccccttattgaactgtgcattcaaagaatgcaattcaaaatcagatacacattccttcttgccttgtgcacacaaagagaactagataaagaagatgacaactcagcaaaggccaaaatgtcactgataagctgtgtaaagggacaatcacatgggatagggtgtatagatgctatgaccactctgctcagtagaggcactacactgctgaaggttagttagacagataactagcttcccagcatttcccctcacttggacgcctctgtggtatcatttgctacaaaaggaggtcttctcgggtaatgggatgacgtccatctgtgacttgacgtcaagtgagtcattggactgtcgtcatagggcaggcacctcagtgtagatcaagttcaccctgtgggaaccctgcaagtttgctggtgagttttatatttattctgaagtaacacacttggcacctcaggctgactaatatctatgtgtgaccaaggtaactacccagctagccagctttcacagttgtaagaaaagttacaggcagaaaaacataattgaacactaagatgagggtcactgtgcaagtatcatgtctagactccagtctaagtgtgtgggtgtttccattgcctgtctttttattagggtttacaggaagccttgctaatcaaagcatgctccatgggccaaagcaggagtactaggtcacctgagagcttgctataatcattttagactctacttggtgaagcatgtacatattcttttaaagaatttattttttactaagctcaacatcaaattattagagaaatgcaaatcaaaaccacaacgagatactatctcatgccagtcagaatagctgttattaaaaagtcaaaaagcaaaaaacaaacaaacaaacaaaaaaaccggatcttggtgaggttgcaggaaaaaagttgcatttacactgttggtgggagtgtaaataagtccaaccattgtggaagacagtgtagtgattcctcaaagacctagtggcagaaataccatttggcccagcaatcctattattgggtatacacctaaaggaatataagtcattctattataaagatacatgcacgtgtatgttcactgcagcactattcacaatagtaaagacgtggaatcaacctaaatgcccatcaatgatagactagataaagaaaatgtcgtacatatacaccacggaataccatgcagtcataaaaaggatcaagatttgccgggcgtggtggcttacacctgtaatcctagtactttgggaggctgaggcgggtggatcacctgaggtcaggagtttgagaccagcctaaccaacatggtgaaatcccctctctattaaaaatacaaaaaattagcccggtgtggtgttgcatgcctgtaatcccagctactcgggaggctgaggtgggagaattacttgaacctgtggggcagaggttgcagtgagctgagatcatgccacttcactccagcctgggcaagagaacataaatccatctcaaaaaaaaggatcaagattctgtcctttgcagggacatggatggagttggatgccattatccttagcaaactaacacaggaacagaaaactgaacactgaatgttctcacttataagtgggagctgaatgatgagaatacatggacacacagtgggaaacaacacacactgggggctgtcagtggggacaggggcacggagagcatcaggaagaatagctaatggatgctaggcttaatacctaggtgatgggatgatctgtgcagcaaatcaccgtggcacaagtttacctatgtaataaacctgcgcatcctgcccatgtaccccggaacttaaaataaaagttgaaaaaaaaagaaagaaaataaaaaaaaatttatttttttactaaatatttgtttaattgcaaactgagaatatacaaaaaggaaaagataaatgaatacactaggcagattatcatattagttacacagtgctttcacatgttttcctcctttaatctttttaaaacccttaaaatcttatctgttttcttactgataaataaattgtctgaagaaggtaaaaagatctcatcattggggaagaatttgaacctaggcattccagctccagattccacaattttccccataagttacactacctcattaaaggaatttagaaggttgctttaacttggagtagtcaaaaaaggaaaaacttgaactgagatttgaagaatgggtgaggtttgcataaaagacggatttccagagtcgaagaacatcaaaaacacaaatacttggagaatggcaagacaaagtatttttcaggagaagcctaaagaaagtatttaaatgtagggttcatgttcctacgtgagcagcaggagggaagaatgagatgacgatgaaaaccagatcatggaaggccttgaaagctatagggcagagagttgggctacttggaaactcagggaaagagtgacataaggaatatatttccagaagataaattattccagtttggttcattaagcttttattgtagattttaatatgcaatggaaaatatgcttttaaaatgagggatgaataaattccaaaaagtactttagaaaactctcttcacactactgcactgtggcaattgcaccatctgtaattctgcacctgcttcgtcaactgctggctgcatttcaggagacctgacttcactgttttctgactgaggcatacagtatttgccagagtacttgcgaatgtgcaaggatgaaaagagcattggctaggaacacagatgtcttttcagcagagaattaggtggatgattcatctctagagtatcaaaagtgtgaagtaagtgaagttgccagagtgggtctgaaaacatactattgggtcaatgttgtgcaagtgggacatatttttctactaagggtcacatacataaaacaacttgattccaaagcaactgttttgttcttaacaaaacagaaacagttggttgctgtttatgttaagaatagaaactacaaatgtaactaaagtaaaactttaaaatgtcagtttaatattatgtgaagattaagaaagagagaaaaggagtagttctaaaggggaaacaattgaggaagaggagaagagagtaaaatgtaggcaaatgcagaggaaatggggagaaaagataaagaaaaagaggaaaagaaggaatggtggggagacacttaattgagggctatcaagccttttaatgtgcattatctactttaataatgatctgactccatatggtagatagtatacccatttcatagataagaaaactgatactattagagattaagtaatctgtctaagatcacatagataaatagtagagctggaattcaaacattcaattcatttgaatctcaggatatattgaagtgaatgtcagtcagagaagccatactaggctacttaacctctctaacattaacatgtgcttcctcatttgaaagatgagtagcatttctaaagctgctggatacagtaagctccacagtaacagctatcattacaggagccctttgagaggatcagttaactcactactgataactataatttgttttattattattatactttaagttctagggtacatgtgcacagcatgcaggtttgttacataggtacacgtgtgccacgttggtgggagtgtaaattagttcaaccattgtggaagacagtgtggcgattcctcaaggatctagaacaagaaatgtcatttgacccagcaatcccattactaggtatatacccaaaggattataaatcattctactataaagacacatgcacacatatgtttattgcagcactgttcacattagcaaagtcttgggaccaacccaaatccagtcaatgatagactggataaagaaaatgtggcacatatacaccatggaatactatgcagccataaaaaaaggatgagttcatgtccttgcaaggacatggatgaaactggtaactacaattttaactccttccctctggtcccaagtctgaggatcaaaaactcacaggaatcattggtgttctgggaaagaatcctcaaatccaccaggcaccaaacattccacatgctgaatcaagaatatcttctccatatatttcctactagatattaaatatacatagattgcactgtgaataatttaatttgatgtatcattctatcattcaccattatctttatcaacagaatctaaaagtaccagcattctcaaacagttaaaaagggattccttgcattcaaaacctgggaacgactataagtataatcttagagttttccacactaaagaggcaagagagcagccagctgaggcctatacctgacatttccacctttgaggcaaatgatccccacccttgtcttcttaatgactgtcctttgttcactgcagagagatgtgatttttttctaatggcaaaattgatcttgtccctttcctgcttaaaaccacttaactggttttactaccttcagactaaaaatcaaactcaactgggcataacgattgttccgtgatccttctctgattcaggtccttcctagcaatccaggcccgaccagatactcatctaagctcctgcctattgaactactttcacttcctaggacaagctgagagctccctctccctgtcctacttttctacttactgttccttctcctttccactcttcagggttgacttctcaatgtttcacacctcagctttgacatttcttcttccaggaggccttttctgatcatctcattaggctgaattaagcattcctcacctaggagcctataagactcccatagtattgattacattgattatattgcattttgattgcccccaaactggattctaagctctgtgaggatggaggtcatgtttgatttgtcctccaatgcccaccatgcctggcacataacatagcaagtgctcaataaagatctgcttagtacatttaaaactccatgagagtcctaactccaaaggtcagggaagcacgtgtttttttgtttgttttttctttctttttggtttattttgattttccgcagaagaaaaccacatatcaataaatctatttcctacttaaaaccattaagttacagcttcaagcacagagactagagaatgggagggagccagcagccctggcagccagtcctggggttcttggccagttgtcttactctcaggccctggcttttcctacttaaccagtggaattaacatcagttgctcatttttcatttctacaagaacttcagtgtctctcagtaagttttatagaactagtgataaaaattgacagctcagtggtgttgctttagatgcactgtgttttaacatggggatttatctatgctcggggatatacaaactgttttaagtcctctccaaatgctcttcaaaatggatcccaaaaaaagtattaggtcactgtcacagattatacccattttgcagatagaaaccaaagatcgagaggtcaagggatgatttccttttgatcacataatagaatgttttggaaaagagatttttttttctcgattctacttctttccttttggcccatcatacagacttttctcacataatcttcaatgctttaatgtatttggttttttataagtctttcttttactagactttaagctccttgtaggcagggactagatcttgtttttctttctgtttttagcttaggacctggaattgcgtaggcatgaaaaaaatgttactgaaatgtttgcccagctcttacaaatgctctaacaaccatactcttaggcttactgtcatgaaagtattcctgtcttgtgatttactgaaatctcagttttaaaaggaacttaaatattttgtagtaccctccacctccccactcctgattgtactaatgttatactctacttaaacttcttcagtaaattggagctcctgtcttttcgagaaagtacagtatacctctcactaactaggaaaaagtcctagatttttcctttgaagctacagagaacatgatttgcacacactgagctccctaaaaaacgaccaccaatacaaattaaaaagcaacactctgcaagtttaaatttaaatcttaattcatctaatctagatgacttaaatgtttgcttttcactttaacagcagggaacccatttaaaaatatttttcaaataaataaagactcctagatattaatgcagatgcaaatctgtctggagattaatgaattactgccacatcctaaaagtggccactagagaaaagaggagtagctgaaggttttgtaggggcttagtcacatagtccagtagtaatagttgggaaatgagtagagaggggataacaaaaataaaaacaaacagttcaattagtctagatggagaaaaacagcccacaggctaattgactatagctgtcacgacagttgattacagtgtctgtctgtaaaaacacagggggaaaaaagtacagaaaaactcatggcctgtttggctgccttttgttggtgaaatatcctacaaatagatgatgcaatgcaagccagcccctctctggtaagaaacagagtgaacccagtgacgtggcagtgtggtaggaggcactgtctgctgacacagaaaaaaaggtggccttgcagactgtggtttgaaatgccttaggagccaggtgctaggttacattattgtgttcaaagacagatcctttgggttatatcttttctgtgtccaaatgacttacaaacgatgatactcttagggctactgactcaatagtaaaggaacaatccctgttctggtctatctttgggagtaaagacggctttaccttcaaacctgctccgtactccctctgggggtccattatgctcagggggacaaagacaagtgcagcacatgcttttgggagaaaagattggtcataaacagtaaattaaaatgcaatagtttaaattctataggtgcacagaggaaagggagcacctctctgctgtgggcaattgggagtagagacggcttctcagagcaggacttaaaactgggcttctaaggtcattaagagtttgttaaggccaggtgcaatggctcatgcctgtaatcccaactcttttggaggccaaggcagccggatcacctgaggtcaggagttcaagaccagcctggccaagatggtgaaactctgtctctactaaaaataccaaaaattagccgggcatgatggtccagctactcaggaggttgaggcaggagaattgcttgaacctgggaggcggagcttgcagtgggccgagattgtgccactgcactctagcctaggtgataagagtgaaactccatctcaaaaaaagaaaaaaaaaaaaaaaaaaagaaagaaaaaaagaaatatcccatgttatggaaacaatcagcagcagttcttgatggctggaagattgaggaaatgacaatgggtttcttattttagcgaggtaagtatattggcagggtggaaaatagactgagaggctgagagggaggtgaagttggggagcccagttaggcagctgttataaaaacttaagtcaagatgagtaggattactctctaagaagacaatattgaagaaaatgttgccctggggtaaaaagaataaggagcaactgggttctaatacaccgtagggccagcttgcatctcctagcccaatccagtcaccaggcaagtgaaggtcacattcttgtccagacaactgcagctgggactagttttgatctcagattccagcacctataggcaccagagcagcaattctcaatcctgcccattcttcacctgggaaacgttttttaaatgcaggtgcctcaactctacttcagacctactgagtgagaatccctgaaaggagctacagtttaaaaataccctgcacagccagaactgagagccatggcccacacagcagtcaggcctaacagtgactcttatttggtgtctttctggaaaagtctgtaggtgtatgcatatggcacttgggacacattgtaatggatgcagtgttagaggactgagaagcccatgaagcaagctgctttttccaggggagacatcactattagcagaaatggaagagacgccctgccactatgtgacttgagtgttttgatcttgagagatttgaacatacctctgagcacactcaaaggagatgtcttagtccatctgtgctgttataaaaataaaaacaattctgaggctgggtactttataaagagattattttggctcacaatcctgcaggctgtacaagaaacatggcaccagcatctgcttctggtgaaggcctcagtgtgcttccactcctggcaaaaggggaaggttagcgggcatgtgcagaagtcaaacagtgagaaaagaggcaaggtggaagtaggttccaggccctttttggcaaccagctctgaaggaatttactcagtgaccccagggagggcattaatctattcatgagggatctgcctctgggacccaaacagcccccattaggccctacctctaacagtgggagaaaattacaacgagaagtttggcgggcaaaaatatcaaaactatagcaggaggtgttccaaaagaatttgggggactgactctataaagaatataatacaggttcttaatcatcaatgacagtcaataaggagacaggagaaaacaccagtcttagcctttgttcccgacaaacagactggataacttccatcaaggtgaatctgtatattacatgctatctccacatccagaactcttgtatactgtgaataagaaaatcttagtaaaaagaatgactttcagccgggcgcagtggctcacgcctgtaatcccagcactttgggaggccgaggtggacggatcacctgaggtcaggagctcgagaccagcctggtcaacatggcaaaaccccatctctactaaaaatacaaaaaattagctgagcatggtggctcgtgcctgtagtcccagctacttgggaggctgagacataagaatcacttgaacccaggaggcggagttgcaatgagccaacatcacaccactgcactccagcctgggtgacagagtgagactccatctcagaaaaaaaaaaaaaaaaaaaaaaaaaaaaaaaagaatgacattcacttaagttatgtaagttatgcctgagaagctaaaaccatttctgtttctcaagcttttccactacaaaaggtactccaagtgtattgtgttctttacctttttcaagattctcaaaagcccagggaaataataattacaacctacagatggaagaatgaggttctaaaagcttcataggcttagtaaagactatataaagtaacttgggaaagctcacagagctaagaagtgatggatctctccctgaacccatatctgacaaagccaatgctggtaaccaccacactgtaaatacttacatatctccagaattcacagtccgtcttgaatattaacacattgaaatgaaagagtaagtaaagtttaggattatctttgactcccttcttcagccctccctttttttttttttttttttttaattaccagagagtagggccagggaagaagcttctctaactcaagaaccctctcttctgctgctcaccaggtctgaatagcccttgtgaaggcagcatttgagagaacttctctgccacatgctgattcctctcaccgcgggaagaaaccaacctaccctggggagcctgagagctctttgagtatctgggggtgaatcaactaatctgattaattgttttcagaggtgaggagctgggtactgaggaagggaaaattttgatgagaaagaatctgggcctttagcatgtgaaacatgaggctcagaatttaatgacttgttcaaagggagatttttaatagacatgctttaaccagctattttggacatcttatacaggtgagaagagaagggggatagcagttggccaagctataaggacacttaaaaggacactataagactgcaaaccagatcagtgtgaacgtacaagttaattaactcatttaacagacccttactattgagtaactacagacattttttatttgcatggttccaatatgcatgaattttcattaccatgatttgagtagttccagtcccccaacaacacaattcaaactttagctaccacaatatattaagtatgagtgattgcataaggcacaaacctgctactagctcttcaattcacaaatttctacacaataacacatgcgcatcatcatcagtgactcacgtcagttctttcaaggtctgtcagtgactggtcactgagcacctgctattcacttcacaacacagacagtaaagcatacttgttttgcctccttgtctccagtgataaatccacagacattttacaaaaatggataattcaaagagggactttgtcagcaatgaggaaagcacagcaagaaaacaaaaagttataatgctgtaagtgaaatttagatgcgacaacgaattatagaagatacagctgactatgggaatgtcgacctcaacgctcattgagaaattccacatatgcagccagaggaacttactgaaggcaaacttatgaatataaataaagaaggtggctgggatataaaggatgaaaatgtcccagagaatatgatactggcaaaaaaatttacattgaagaactcttgtaggtatttcaaaacacaaagtgcaaaggataaaaggttgccagatgattagaaaaaagtgtgacagtttgccaaggcatataaaaaatacttgctctgtatcacaagttatatgactgacaagaagaaaaaggcaagtactattccaactactcttttttccaaagaaatataataattttcactgtttctaatattttaaagaatagcatactaataaaatattattttactattttttatttccctatatatctaacaaaaagataatttttaacgttttgacaaaaaactggaaagtttatgggtcaatcatagtttttctcattgatcattatggtttcattcttatggtctcccactgccatgcaaagtaagaattttcctgttttaagtgccaagcataagaagacatggtccctaccctcatggtggtcttacggcaacaattaattctaaaaatctgtgattgttctatttaataagggtgctagcctagctcaaggcactcataaagcctgtagaggagttgtgggaagtaaatttggtaggggatatggagaaagtagcaaaggaagtactgatgggggtgagctccaactctgaggaaaatgcaaatctctccagtccagcaagtttacctcctcacctccagaggcggggtggggagtgactccaggctggtttttaaactggctgccaactgctcagctgtaatgccagatacatattaattgccaacagaaagcagagacacaggttcaagttccttctcaaaagtaatacagaaacttgaaatgctaacaagtgccaccttcagccaacttaggtgaataaactttcttaaaatcagtacaaaatgtttggatgcaagtctcttagtccccagagccacagaaatgcaaagaagcatcaggggctgtgacaatatatgttcttaaggaaatacagttataggagcatatgaaatgacgcatctggctttatgagctggcaatgatttttaagtccagaacgtatgttacattgcactgtttttccatcataaaacatttaaaaaattttatttatggcccctaccagaaagatgtgtggctatgttacatgcatgtggatgcaattaggaacaaagccactaagaggtagaaggttcattaggattcatcttgtccaacttctcatttaaaaaacaacaaaacggccaggggtggtgtctcaaacctgtaatcccagcactttgggaggccgaggagggcagatcatttgaggttagaagttcgagaccagcccggccaacatgatgaaaccccatctctactgaaatacaaatattagctgggcatgggggcgggcacctgtaatcccagctacttgggaggctgaggcagaagaatcgcttaaacccaggaggcggaggttgcagtgagctgacatcgcaccactgcactccagcctgggcaacagagtgaaactctctcaaaaaataaaaataaataaataattaaattgaaaacaacaaaacaacaaatgaggtgaatttagtcgaaggaggccaactgcctagctccatagtcagattcctgcatcataataacaacagctgacattgagtgagtattagtttgtgctgggtgcaatgctgtgggttttaccaaagaagcattatcttggggggccagaaatagtggctcacgcctgtaatctcagcactttgggaggccaaggcaggtggatcacccgaggtcaggagtttgagaccagcctggccagcatggtgaaactctgtctctaccaaaaaatacaaaaattagccaggcatggtggcacatggctgtagtctcagctactcaggaggctgaggtgagagaatcacttgaacctgggaggcggaggttgcagtgagccaagatcgcaccactgcactccagcctgggtgaaagagtgagatcacatctcaaaaaaaataaatacataagtaaaaataaaaagcatgaacctcagaaattgtaaaatagttactactaccattatcattttacaggtttatgttattcagctaaccatgagagagctgggatttgaattcaggcagaataatctgagctgacattcttaactatgaagctatgattgttaaaaattatcctttccagttacttaactatgtggcccaaaataaggtaaccgtgccccctggaggatgttagagtctagctttccatatactactactaatctttaaacaaccaccagaacgtactacccattttactgataagaaaactgaacgcgtaaaataaaatggtttcccaaggttgcacagtttatgattggtgaaagcagaattcaacattcaagtctgtctggttctttcacacacataagcctggctccctggattagaactaggctctcccgaagcacgctctctggtttctgtttgaacaggacttgcatacattaaatgtctgatctgaaatcaatgtggatccaggtattgctggaaccaatttaagtctaaagcaaatatttcacattccttaatcaatctctctctccgtgtgtgtgtgtgtgtgtgagagagagagagagagagagagagagagagagagagagagagagaatatcaagagtctagcagttcacatgagataatcctgctgaagaggccagtggtaaatcaaactcagagtgtgattctgaggttgcatttagttgaaggaggataaaaattcactgattgttgttctcacagaacacagatagcaacagacatgaaaacagagccactgtagaaaatgcctgcaagcagtggctactaacaaacggcagggaaaggctgttttaggaaggaaagggaggagaatctgctgccctcttttcattttactggccacacctcccccacatggtctgtcaagagaaatgggtctgagaaaagcagcatgattctcaccacagctctttagcaagtttccaggggttttcagcatagcaggcagctgcttcccaaattcagctctgttccctcctcctggttgagctgcttggtgtataaactccgcctggccagcacacacctcctgacgctcttgagtggtggccaaagcctgttaggagtgaagcaggtagggctaccttcccaggctagtggcagagctagtttgagatgctttgcaacacaaacaagccaatttgaaagatgggattattttctccgttttaaacgctgtaacaaatcactttccagatgttggctatctcactcacctctttttctttctcttctcagttaaaaaggcttagtcctggaaaagtcgaagaggtgaaaacctgcctggggaggctgctgaaggacgccaggaagaattcttatctccaaattcaatcctgcctcccagctagctgctggtgtttgaaattccaactctgaagtggtagtctggtatcttcttttaaaatgtggaagagagtaaacaaagttattcacagcgtagtgttaattcttcagctgcaggctggaatctgctggctccccttaggcaggaaatgcctgcttaaatcgtcccttaggtgggaagaaaattcaaaaagggaaggtttatggaggcggactttcactaatttcacctttttgcgtggcaaaaccaagtcaagaaataaggtcctctcaatctcagaaattaatctttgtcttcatttaatttgaaccaggaaaacttgtaatgccaacatcaagactttgttagttaaagcttttcttaatattttaggatgaatagctaaaacttggaaaccaggacgatttagattccttcctaaaaccattttccaggtacgcttaaggacttttgttttgatgtgtgctatatatgcatttgaagccaaagcacagatgttgatattcatgttttaatggttggtcatttgattaagcggagctcagacattttcactttccctctcaatattatcactgcagttcggtttaacaaggcactatttcccagcacggtctactgctacccaaatcagctgtggtggtcaccatggtaaccacccactcatttttccctgttatttcactttataacacttaaagagcagtgcacaggctaaaaaaccctatgagggaaaaaaaagtccctcaaataggagtcaatcaagctcacctgagatgcaaagtcatctaagtgtaaatgttttattttttaaaaaaaatcagctgtgaatgtattcatcagaaacaaatgatcactaggaaaacagcactgaaaagttgaatctgctcattgcttggagactaaaaacattttaaaagtgttttttagggataaaatggggttaacactaacatttctaactaatcttgacaaagggcttccctcgatgggattgaaagctgtggaagtctccagggttttaggttaaatcataaaactaaacaaggtctgtttaaaccacacctacgagcttgggattgtatttttctatatgaatttccttccctccccacacaaaaatattaggagaaaagttttttaaaaagaactttctttcaaagcagtattttgctcatttattttatgattggttattgagtctgccaatcatacgtctaaatgacaaggaggtatgggaaatcagatgagtcactgagccaggcaggaaggcaggtattcaatcaaatccccccaaaagataagggctgcacaagtgtagacctgtagaccatctctctgttagacacaggtatttgaccattgccaaacaggtcagccacaagtggaagctaatcttgacagcaagtcagttattgcagaccctgagagacatcagatctgcctgaaaacaaacaaacaaacaaacaaacaaacaaacaaacaaacagtgctttgaggagtatcatgaagactttccgtttctctgcaggcatcctgatagcatgccccttttggctcctagaaagacaataatgaccccttcagatgaacactctcttcctgcccacaaatgcctgttgcatctaagacaggtgtcttacctcttcccaatcaccaccacggataaaaaataattgaaaatgattctcccaccattgcaaaatgattctactacttctagtagagaacttctggttttcagggatcaggactctccaattcctctgctcactgaggttgagattcagtgttgttttaacaatataagagcagctcctatcacttttcaaactgaacaagcttattttcatagcctctacatagtctacatagataattttattcaacacaatcaacagtccactcattccctggttgagattgcctagggacagattttgagggtgatgccgataagtaagttgtaagggacctcttaaacagacaggagacttgagggacccagggttccagagtctgtcctatgtagaggccacagtgattgttgttcacagccattatcagctggtccctctccaccttccactccccaccacccaaggctaatgtggtgcacaggggagaggtttatagggaaaactcagtggattcaggtgcaacaggtgcccttggactgtgagtaatgcaaatattgacatctggaaagcctggaagagtcattattacttggctcccctttgccttctactggacacctcttccttcccaaaagttcccaggatttctttgtgacttttccaaagctccctgcttcctattctgttcaaaagtctctccaattttaatatagtccatgtaaaatataaaatgggtggagtggatggagtgcaaagctatcagatttgttatttgatttaaagtttaagactagggaacatggagacttggttctagtccaacctccgaaaaatccacttcggtgattttagtcagattattttcacttggctttttcatctatcaaactataaatttagtgagatcaaacaaaaggaagttctctgtaaagttaaaagtttagttcaaattttaaaggccacagaactattatacagctgaagtcatactatagattggagagttcagccaaattcatggattttacagggcataaagtctttggttagtggtatcacaattgtagtgatatgaactagaatcttcagcctcaaacctccacatctaatcaggcaccaaatcccattaatcttacctccaaaatgtctctctactctgtatgtccctctgttgccactgccactgtcatgaatgctactctctccaaacttgctccttccctcttatgtcacgttcccttagtgcattagccacaccagcagtcagaggactccttctaaaatgctcacctgatcttgtctcttctctgttcaaatccattgctgactccccatcaactaaagcgcaaagcccatgtttttagtaaagcacatgacaccttcacaattttgcttccctaatagcctctcttctcaccatcttcttcctagaaaacttggtgactttatacagacagctctttcttcttttttgtacactcactttattcattcttctaaaacacactcaaacactgctgcctctgggaatccttccaaacctcacagactgagataatgaccaacccactattcccatagcatttcctatatgcctgttattccagcatttctcacactatcctgcaatgttttggatccttgcttggctgaaggttccactggtatgacccaacatagcatttctgatggcctggtttgaataactcacaaaggactttgcacaaatcccggacacatctaagcagttctggggcaaggagtcattcttcccctgctttcagcaatgtcatgccagcaacactcttgtcttaggcctaaatcacagggccttcctccttgaaataggttcagttcctgggaatccatttggtccctgcactttaacttacaactgaacagggatttaacagcacttatgccagtgtttgcaaaaccgtgatacacagttgtcttgcccaggaataaattaaggttggtagaatattgttgtcctgttttatttttctttcttttttctttttaaaattctttccttctacaatgcaggcatgattataagcattgttacttccactaggtaagttccaagatatgctactgtgaagatatcttaataaattattttagacaatgctaggtaagaaaaagtcccacccaggaaagacatgtgtaagtctgtaaagtatatatttcttatttatcaactgcttaacaggcaaagttaaaggtttaaattctgatgtttggacgttcattgccactaaggataatattgtaagttattctgcaaatgactctaaatacaacatttaatggtggggtggacatctttcattcaaatctaaagctaaggaagggaagtggaccttattaggcagaagtttcctgtggtacttgtgacagttactgaatgaaaaacaaaggtagagtttttcaaaagcatatttcaagcatacaatctccgtgtgggacagcccgagccttcctgaaaatgaagcactccaagcttcctcaggttaatcaagtctaataatacaggaattactcttcctcagctgggtacttaaatcatgagcctggagatagtacacatgtggaggaccttccaaaatggactataaatcacatcaccttgcattaagttcttcaaaccagctggaccagccttcaccattctctgtgagctgaaaaatacaggatcatagttcgcagggctgcagataaaattctgcagcagtcaattcggtggaattgatgaaggtggcagtaaattcagtggagattctatacattagactccagtctgggcaaagttgaattggcagtctttgtgcatcttaataattgaatgttttatagtgaatctgagttgcccatttctatacagattcatttattgctaaatgaacatatgaccattaaaatatatcttcatttaagaagagtgagcatgaaagcatgatactttatacacaataacgtcagatcagaaaccaagtcacttgtatcagaaaagtaaaccgctttatagaaccaaaaataaaacaaaacaaactttttttaattgtagaaacaattggagtttactaagtaaaaatacaagagatttttaaagaaaagatattagaacaaaatagatattgctactcagggtcaatcattgtgagtatatttgtcatttccttctaggtgtttttttatggtttttttttttttttttttttacaatgttaaggtcacactatatcaaaaaaatgttcactttactgtttcatctgctataattgcacacattttcctgttaatacctctttgtcagaaacattttaataactccttaaaatttcactgagtagataccttgtaaattacttaaccatttccacttgttgaaaatttataatacaatatttcaaattttaagaacatatacttaagctataatgtatatgattgtgggagaccggaatatgcctccccaaaatataaagaattactgagctaaagacaatcaagaagaagcagatgtgggaaaactctctgccctccattttcctaaaagcagcacatagatttacaaagacaaaggtattctccccccatccctgcttttctaccagggagagcaaaggttaaccactgaacacaactttggaccctcatcagcctggtcatggtaccaggagaatctacattaacaagctttactaagtagcctttatctgccatttatttggcttcctacaaactgctcgctgtgcctgaagagactcaaagtccttttccttcatcttgtcacttctctaaaaatttgctgtttctcgttgaagatgttacataagctgaatttcaaagtcacttctttgagaattactcatgccctggttgtcgcccatgtgtatatgaaaccaggggtctgttccaactaagaacctataggggtcattcttcctttctcagcatgattatttccaataagggggccttactaggtccctaaattttagatgatgaaacagaaattagcaagggtcaaaaacatctaaataaagctcattttatagataggctagtggttatgagtttattctgttgagttagtatactcatcggcattaagtcctggttctgctatttccaagtggccctctgcgttatgtaatttccctacctcagttctctttctttttttcttttgtaagttcagagaaacaagtgcagaatgtgaaggtttgctacataggtatacatgtgccatggtgttttgctgtacctagcaacccatcatctaggttttaagcccctcatgcattagctatttgtcctaatgctctccctcccctctccccccagcccctgactggccctggtgtgtgttgttcccctccctgtgtccatgtgttcttgttgtataggtcccacttatgagtgagaacacgtagtgtttaattttctgttcctgtgttagtttgctgaggatggtggcttccagcttcatccatgtccctgcaaagaacatgatttcattccttttttatgggtgcatagtattccatggtgtatacgtaccacatttctttatccagtctatcatagataggcatctgggttggtcccatgtctttgctattggaaatagtgatgcaataaacacacatgtgcatatgtctttgcagtagaatgatttatattcctttgggtatatactcagtaatgggattgctgggtcaaatgatatttctggttctagatccttgagaaatcaccacactgtcttccacaatggttgaaataattgacattcccaccaacagtgtaaaagcattcctatttctccacagcctcgccagcatctattgtttcttgactttttgataatctccattctggctgcctgcctcagttttcttatctgttaaatgaaaataagagctataccaccagaaagggttatcattaaattagtacctttaaagcacttagtacagcatttgccacacaatagtcatttaaataaatgttagcaacttaagaacaattgtcaatgttactagtgctttgttactatttggtattattcataattattattactaataatttgattttgctgagccatggctatattgtcagaagagactgactgaaatgtacttactgattaatttcgatctagttagtatgttaaagacgtgttcatttaaagagaaagccattttgtgtttttggatgtgattccagaaagcacgtataggaagctgttttagggaaaaaactcggttgtgggctggagaaataattaaattaattatttaattaaaacatacaatctcaagggtggtaggaagctaaagggtaattttgggtaacattctccccttactccaaccagatgccaggtgaccttcaactattcttaaatgtctctcatgttggggagcttaatacctaccaaggtagctattatgcttagaaatttagttttatatggaaccaaaatatgtctttctgtaacttcaacatgttgataataaactcacagataaccctaaacaagctttaacagtgaattttccgtgtagtgaaatgatggggatcacaacttctaatggatttattttggaatttaaaagaaattggtaagagcccaaagcgtataaaaccaagaattcattatgcaggctttgtgggtatttgagaagatttatgtattcattatcatgtgtgctttcctgcaaattaaacaatctaaaataaaaggaaagcttaatgatttttctcaagaaaaaatgtctaaagctagaattctaaaatggctcctttaaagttcagatggaagctctttcatagtttcatgctccaactggggaggggaatgggggaaggaagcactgggaaacactttcgctgaggtagaaagctcatagctcaccttctgaggacatctgcttctccataactgaaccactttctgcacagtagtgaacactcagaagtatttagaaattgactcaatggctgggcgcgacggctcacgcctgtaatcccagcactttcggaggctgaggcaggcagatcacttgaggtcaggagttcgagaccagcctggccaacatggtgaaaccccatctctgctaaaaatacaaaaattactgggcatggtggtgggtgctcgtaatcccagctactcgggaggctgaggcaggagaatcacttgaacttgggaggcagaggttgcagggagctgagatcatgccactgcactccagcctgggcaatggagggagaccccatctcaaaaaaaaaaaaaaaaaaaaaaaaggaaagagaaaaggaaaaagaaattgagtcaaatggcaaccctggtaaatgaggagctctgtgagtcactaataaaaccactcactaggacttaacaaaatctctccatactgcatatcgtatcaggcatgttgacctatcacatcactgaaaaagcagggtttctttgcataaagattaactaatgtatttggtatttgattttcagtctctagcacagaagctggcaagtagctggtgttaaatagtgctcaggtggctgaatgagtgaaaatccatccctgggagccacaggaagaaatgcttagtccctctaatgtcttgttacttcggtagctgctcaaatattggaggactgagacttactcttctggcttcttcctcctctctacaatcatcacttgtctctagcccaggctaactatgcccagttctagcaatcaacttcaaatcccttcatctaagaaatttccaaatgtgcctttgctcatttgtttctttgttgttgttgctttaaatggatttaggaggatacacgtgcagttttgttacatggatatattgtgaagtggagaagtctgggcttttagtgtaaccatcacccaaatagtgaatattgtacctattaagtaatttctcattcctcatccctctcctaccctcccaccctcccaagtctccagtgtctactattccactctgtatgtccacatgcacacattatttagctcctacttatcagtgagaacatgtggtagttgactttctaagttatttcacttaacacaatggcttccagttgcaaccatattgttgtaaaagacatgatttcattcttttttggctaatattccatatctatatttatctatagacagaaatatctctacatctctctatatgtatcacattttctttacccaatcatttgttgcccacactattcatagaggtcacggtgaactcatatctggcatatctgagtaaccttctttaaaagtatgctttccaaattgcaaatcacaacccaaaagtggattgtgaaatcaaatcaatttatgatcactaattttcccttccttccttccttccttccttccttccttccttccttccttccttccttccttccttccttccttccctccctccttccctccctccttcctttctctctctgtctctctctctctttcctttctttcagatgtagccttgctgtgtcacccaggctggagtgcagtggcactatcttggctcactgcaacctctgcctcacaggttcaagcgattcttcttcctcagcctcccgagtagctgggactacaggcacaggctacaatgccaggctatttttttgtattttagtagagatggggtttcaccacgttggctaggctcatcttgaactcatgacctcatgtgatcttcttgccttggactcccaaagtgctgggattataggcataagccactgtacccagcccatagttttctttaaaaaataaaatagaaacttcagaggataatgcacacagtaagagtattatttcatgaaacatttatgtcaattgtttaattatgtgtgcctatgtatcgttatatatacattaatattatatatatacacatatgtataaaatacacattttatacatatttgtcgtacaccacacacaaacaaggcgccccacacagattgtgcagaacttgttataggtattagcctctactcacctgtttgtcttgtcacctttgtgtaggggttaaactgtattgacataagtggtggctttgtgtatgtgtgtcctctgttttaaaataaatataattatttttttaacatttgatattaatattggccgattagagagggttaggatggaaggtgagggcatcacaatcatgccacataagtttttctttggccttttaaggtaaatcacttgtaatttcataggtacgtattttaaaatgtaaccagcactgagtgaattgttaaggattattgatttgatatttaaattagtgttttagtaaaattgattaaggatttaatttggtattataccaggaagactaggtcacacagcttctactgcacaggcagagaggtggaatcctcccagtttgggggcaagatgctttttaaaaagccactgaatcctcagtgttttctttaattggtcatagttgttaaatcctactattcctacttttaatgataaatttaatttaggtttaccattatcccttctatttgttgcagataattttgttaactcttggtgacacataatttgcactctgactatattttggcctaatattttgtaataattaggctttaagacatatggacacttaaatcatctgtattcctattgctaaagcatatgcaaacataattcttcccacacgtacattttgcttttatagtcacattctttctaaccagcggttctgtttaccactggaaattgagagtgattggaatgaatgagacataagatggttcaccctttctaagtgaactacagtctgaaaagtttgagatctgcttatttaacagatgaaaagacaggtccagggaaatgaactgactaatcaaaattagcaatgggacttggaaaattccagtctccagattcactctctgccaccaaatcatactaactccagcaacatccagaaaacagggcctgacccagagcagaggcctcataaatgtgtgcttagttgctttagttgcgattagattggacagtataaaactacagatctgttaggtcacaaactgtcaaatattgacatttttcatacagttcaacctaaatcattttattttaataactctgcctatgccactctgaggttttgcttttcacatgaggagcatgatagtatatttgttaagagggcatattttttaagacttgagccaaaccgctcaggttcaagacccaagtcttaaactgattggtcatgtgtccctgagcagattagattacttagcttctctgtctctcagtgtcctcataggggaaaagggtattacacaagtgtttgcttttaatattattattactagaactcaacatacatactaattagccagatggcctgaccaagttagggcaactttatgcacctgttctgaaatgcattttttagatacaaaaaaaaaagagaaagatacagagattctgcaatgtcttttcttggcaagattggctatttatttgtttgactgacatttggctttattgtttacaatggttgtctcaaaagtcctatttttctctgctgacagcgctggttaataaataaaacagaggccaaaacatcctagcaacagaaatcaactgtgtgtatgatttgttgctctgttttaatttcatctatttttgaaaatgtagttgctctctaaagtgcctgtttcttctctagagcattgccctaaagaataagaagaagaagaaaaaaaaagcatccaaacttgaagaacagctttgatcagctcataatgcacagtgaagacaataatttaagggtgaatcagagtgcagcaaagtgattccaatgaaacctgatgctggctaattacttctctatagatggcagtgttcagtttactgagcatctgtgcatgacagaatttgggacactgtgggtggtacaattccaagatatctacacaatctgaaaagcaaaatattccaactacaagtatcattttattaggtgaaataaactatgtatacaaaaatctcattttgtaattaagccataggccacactgtagagccccaaaaaccacacctgtttggataaaagcaaacaaatcataccatggaagctgtacctgtttggaatgggacttagaacaaaagggtttagaagacagatgctactgtgatgctgcaaaagattatttacctcccagattttaggtgtgaagctgtaataaagttaatacaactcttttatcagatgaattatttttagaattactttttcactacattctcataatgtcctactgaaaacaaacattctcataaagaaaaagtgagtggaggagaaaagcaattaatcagacaaaaaaagataaagtatgttgagaaatgaactttcatattgattggttctattttttaaaattatgctttaattaatggcatacattttcatgctctcttggagctatactttttctccatttctgctgaatctgaaagatatgtttctacttaaaacacatctcaaatatattcggtggcaaggcacatcaaagtccatacgattataaacacagattggaaaaggatagcaaatagaactatatgcttggtccatagttaactctagataattgttaaatgaataattaagaaacaataaataggccgggtgtggtggctcacgcctgtaatcccagcactttgggaggccaaggcaggtggataacgaggtcaggagatcgagaccatcttggttaacactgtgaaaccccaattctactaaaaatagaaaaaattagctgagtgtggtggtgggtgcctgtaaaagggttagttgaactggttcctgaggttttcttctgtacttgcaattttcctgtcttctccacttattcttttggtgatgctgccttacataatcttcttttcttcttcttctctttaatacctgtgcccccttgctctcctccctctcctctcagatccatattcagagaggaaccccagagggaaacaattaagagatgagaggatggcattggatagcttatgaaacagggttagtgatgatgccaattctcttcctcctgatccttctgtgagaaaaggaggtttagaacaagttcagattccaagggtctgtgttttccagggggagttaaacatgcaccatcacaaattataaactgctgctctttatctacaaccagccaccattacaatgtttacccaaacccacatcagcaaccactcactgtccacagtaatgctgacatttaccaatttaggcttctggagataatatgatgtgcagtacacagccaagattttttttttctagttcttatgttgaaaaagaggggcaggcttctctttgggggctgctccccaaagacacacactagtcactagcaaaccactggcattattgtccaaatgaaatgtacctgtctagcacactcagctgagcgggctgtgatttgataaatacattagggagaaaagcttcgaaataatttgaatttagttccaatttcctctgcctcaaaacagcaggagatacagtcagacggagaagctgtgctctgtacaataagggacagaattctaagtcaccaactatcaccaaagttgtcataatcttcctcatttctctaaaatttgctctactcagagattctccatccacccaaatcctaggcatcatatcctaattaccaagtgttgtcaagccgacttcctacacacctctcatattcaccagctcctctcccatcatagctgcatgatgatgggtccttgttgtctgccatctggaccatgaaagtaactgtcttgctttattcctatccatcttctgccatcaaggtgaacttttaacacacaaatcctgctcaacatcttttaaatgttgcctactgttggtgacagtgaagtccaaagtgctgggggataagcagagctcagttaagtgtgcatgatggttcaaatggttctatttatattattttattatttatatgattgttttctccttgtattagttcttctctctttttttaaggattgtaggcatcttgaggaaagagagacattcacaaagctgaagggcttcactgtgcccccatttgaattctatgattcaaattatcttaactggacccaccactgatgggttaagataatttgaatcacagaatctttacagtattttgtaataatctgaaaagtggccataagaatcttttgtgctatgcagaacttcactggtgtcaaagtacttaaaaagaggtgttaataataaattatgcatttttatttttcataagcctctaaattctactaatcgtttctatggataaattgttaacagaaacatgttacttagcagataattaaaaagaacattaagcatactcaagacataaagaaaaatatgcattggagccttaaatcatataatacttctgtgatattaatcagtaaggaaaaagaaagataactcaatagaaaaaatgaccgagagatttgatcaggcaattcacagtagaagatattcaaatagctgaaaaatatataaaaaaagagttcagcctcaacctcattattcatcagagaaatgcaaattaaaccaaaatgagatttcccagaagataaagtaagcttattttcccccattcctccctctaattacagctaaaaatcttacatgttatttagaaaacaaacacaggaagactgaaaggtagacagaaggtagcagactggctagggacctcagggtacaccacagtatggagttccttggattctcatggactcatcacagtgcagctggagaggagctggtgaacatgagaggtatgtaggaagtaggcttgacgacacttggtaattaggatatgatgcccaagcatctgggtggatggagaacctctgaggagagcaaattttagaggaatgaggaaggtgatgacaagtttagtgatagctgatgacagaattctatcccttttagtacagagcacaaagacagcacagagcacaatgcaaaagaaaaactaatgtggaagtaaattcatcttcactttgcaaaactattaagcagttgctcctaaagctaaactaatacatactctacattccagcaattttgctcctatatatacacctttgttccaaaggacatgcacaaaaatactcagtgcagcattgttaataatagttaagtacagaaacagcctaaatgtccattaacaatagaacggatatgtgaattgtggtattttatacactggaatactatacaacactaaaaatgaatgaactacacctatatccaatgacatggatgatcttcacaagcatcaagctgagtttaagaaaccagacacaaaagattatatactatatgattatatttatttaaagtgccaactggataaaaactaatcaaagacattaggagttaggatagcagttactcttcagaaggaggcagtacttctgggagaagtacaaagaagcattgttttctctcctcatctgagtggtgatcacgtaggtatcttcactatgtattagcataagctgtatacttctgatttgtgcattttcctgtctatatgctatcaatacaaattttatgaaaacagtaaaaataaatatactttctctgtctctcctgatacaaagtaaagatgatatattagcaatgagtgaaaaagttactgctttttgaaaacacttgtgccatggagggagcactgtgaagaaaagagtttggaaaagttttcattgctgtatgcttttgccatgcccccagtgacttgtgttttacctctctgcatactaaaacacatggggacagaatttttgtcctgcacaaaaatcctcaacaaaatactagcaaatcaaatctagcagaacatcaaaaagttaatttaccgtgatcaagtaggcattttcctgcgaggcaagtttggttcaacatacccaaatcaatgtgattcaccacataaacagaatcaaaagcaaaaaaacatatgatcatcttaatagatgcagaaaaagcttttgataaaatccaaattcccttcactgataaaaacccttaacagactaggcactgaaggaacataacctcaatataataagagacatttatgacaaacccacagccattatcatattgaatgaccaaaatcttggaccattccactttagaactggaacaagacaaggatgcccactctcaccactcctattcaacatagtactggaagttctagccaggacaatcagggaagagaaagaaataaaaggtacccaaataggaaaagaagaaataaaactatcactctttgctgatgatatgattctataccaagaaaatcctaaagactctaccaaaaggctcctagaattgagaaatgactttagtaaagtttcaggatacaaaattaatattaaaaaatctgtagcatttctatataccaacaacatcatggctaacagtaatatcatgaacacaatcccacatataatagccacaaagaaaacggaatacctaataatacagctaatcaaggaggtgaaatatctctagaaggagaacaataaaacatctctgaaagaaatcaaaggcaacacaaataaatgaaaaaatatttcatgctcatggattagaacaatcaatattataaaaatggccatactggctgggtgcagtgggtcatgcctgtaatcccaccactttgggaggccgaggcaggtggatcatgagatcaggagaaagagaccatcctggttaacttggtgaaaccctgtctctactaaaaaaaaaaaatgcaaaaaattagcaaggcgtggtggtgggtgcctgtagttccagctacttgggaggctgagaacctttccctgacattctagacagacacactggaactcttccctgaaaactcacactgtattttggaagctcaaccaaaagactgagaatgctgtctcccagaagactggtgatttcttgggcacaaggagtatgtgcctttttatctctttatcccagtgcttcagaccagctagaatactagaaacttcacaaacgttttctgaataaacaaatgggtttcaaattttagggaaatattgtattgtataatggaaatttgctaagagagtaaattttaccacacttttaacacacacacacacacacacacacacacacacagacgtaactgttagatgatggctatgttaatttgactgactgtagtaataatatcataactatgtatatgaaatatcaaaacataatgttgtgtaccttaaatatatatagtttttttaaaactttaaaagagaaaaataaatagtactctaaggaaaaaaaatctatggaaaaattagttattagcaggagaaggttaattttccatagtcacagacttctatcatttgtgttagcagaaataatgctaccaagattcaggagtccttgactttgcacccacctctgcactttctggctgtgtgatctttcatggtcactctccttctctggctctttatttcctcttttgaagggattgaattagctcaactctggattccttctagttttaacagtatgtacttactttctgtatgatactcctgatgttaatgaagcagtagtatttactgggcacacactacatttcaaaccttcccaaaatacctttcatcctggtccatattgtcatttttacagtagaattagaattagaatttttctgtcttgagattaaagtttcctcattatctggccctaatctaccattggaccataaaattcattcaattaaatttaacatatagttatggcattagacacccagaagttagaagtaaatgaagacatctctattgctgctttaaagtaccatatagcctagtgagaaagacaacacaggaacacaaacaaagtaaaatatgactttgtgggtttctgtaaccatcaacttaatgttagtcaataattctatctttggctgcattaataatgactaaaaagaaatggatctatccaaccaagactagggtaatcttcttaggccaggtcataggtaggccctacatttagctctacaattcatgttttaaaaggaagcttgactgagcagaagaggtggttttattcatctctgctaatgggactaccctccatagtcttctaaaccagtaacttctagcacccttgtctcttcctttttcctaacccctgcatctaagaggtcatgaaatcctgtcagttttactgcagaaatatctcttcaatccattgtcttctttttctatgccctaagcaccctactttatatctctgtctctttctctctctttcacttacaatgtacataacagtgggcaggccattttttttttttttttttttatgacagggtctcactttgtcacccaggttggagtacagtgatgtaaacacagttcacactacaatttcgacttcctgggtttaagggatcctcccacctcagtcccccaagtagctgagactacaggtgcatgccaacacacccagctaatttttgcattttctgtagagatggcatttcactatgttgcccaggctggtcttaaactcctgagctcaagaaatctgcctgcctcatcctcccaatgtggggagattacaggcatgagtgactgctcctagccatggacaggctacttcatcttctcagtgcttcagttttctcatctataaattgtagacaaaaaatagcatgcacctcagagggttgctatggggattacacgaatgaaaacaggtaaagggcagtgaatgttcaataaaggttggctatatttattacgtactgggtatgtcaatgggtcttcagcatctattcctacttctttctatgggatttcctgactacagaggctggaaaatgaaaaactacatttctcagactcccttgcagctagggttcacaatgcaaattgggtttccacggttagatgccctaactggatgtgaaagctgaagtaagagagagaccatcttcctgttatctttctactgtcaaccaagcttatccagaattgaatgttgagaggcagttctgtggtagtggataatataactgctttctaatccttttccccttctctctagatttcaagtattgcagtgtgttcttgactttgatccagcagctgcctcctaattcccactccttcaattattcagcaatactacaaacacttaattccctgaattaaatttctttcttcttaaactacataggatagtttctatttcccatatgcactctgattaaatcatatggtgacctgtggtcctacacataagtacagggcagagatacaaaccaagtactgcactataggaatataaattataaggtattgctttttggcaaatctgtgaactcatttcccatattaaatatgaaagtcaacatcaccaccctttgttattaaggacctacacttacatatattcactttacgtagccacataccagagagtgatttacagtatgttctagaaaacagacaatttagtcctcacccagagatcatctgctttcagaattctggaaatcctcagcagtcttttagtgtttggatccgttaccacttcaatttcatagctgaaaatactgacacagaaaatgcctcatgaatgtttatgattcaccacttctgggagtctaggacacctgcttggcacaaggctttggtataaacaagggtttcaggaagttttttattctacctacacagaagctaaaactgtgttaagttagctgcccagacctgccctgtagtcatcagattttgttatgaagtaaaatgattaatttccagaacctttcatgttgagggaaaaataattcactttccatacttagcagtttaatccagcgtggctccaagccagctgtcttcttaggatgctgcaatactcatacctgtcatcagcaattagcgaaagcaaccaaaaatacgaatctcagttctcaaactctggatactgacactcatgattggttcccatgcatcgcgatcaactcatctgctcatcctgaggttctttttacaggatttaaacccctcatatattctcagtgtttgtgatgcattctgtagaataaaaacctggccaaatgctgtgaaaacaaattttgttggttgtgttctttatacagcaagaagtggccaaagtttgaaaaaaattagaaaactatgcaacactatccttgaactaaatttataaaattgcattgatttagctttcttctgttctactctaatccttccacctctgtttttgatttcaaaacctccctgtctctttcaagattttactctctcaattattcctttactctttcattttatctccaacttcttcctctgtcctagctccttcccctcaacaattaaatatactcaagtctttcctttcttaaaagcctgtagctgagcacagtggctgtaatcccagcgctttgagaggctgaggcagatggatcacaaggtcaggagttcgagaccagcctggccaatatggtgaaaccccgtctctactaaaaatataaaaattagcctggcgtggtggcatgcacctgtagtcccagctactcaggatgctgagataggagaactgcttgaacccaggaggcagaggttgcagtgagccaagatcatgccactgcactccagcctgggtgtcagagtgagacgctgccttaaaaaaaaaaaaatttttgcaatctactcatctgacaaagggctaatatccagaatctacaaagaactcaaacaaatttagaagaaaaaaacaactccatcaaaaagtggacaaaggatatgaacagacacttctcaaaagaagacatttatgcagccaacagacacatgaaaaaatgctcaccatcacgttcatcagagaaatgcaaatcaaaatcacaatgagttaccatctcacaccagttaggatggccatcattaaaaagtcaggaaacaacaggtgctggagaggatgtggagaaataggaacacttttacactgttggtgggactataaactagttcaaccattgtggaagacagtgtggcgattccccagggatctagaactagaaataccatttgacccagccatcccattactaggtatatacccaaaggattataaatcatgctgctataaagacatatgcacacgtatgtttattgcggcactattcacaatagcaaagacttggaaccaactcaaatgtccaacaatgatagactggattaggaaaatgtggcacatatacaccatggaatactatgcagccatcaaaaatgatgagttcatgtcctttgtagggacatggatgaagctggaaaccatcattctcagcaaaccattgcaaggacaaaaaaccaaacaccgcacgttctcacttataggtgggaattgaacaatgagaacacatggacacaggaaggggaacatcacacatcagggcctgttgtggggtggggggagcggggagggatagcattaggagatatacctaatgtaaatgacgagttactgggtgcagcacaccaaaatggcacatgtatacatatgtaacaaacctgcacgttgtgcacatgtaccctagaacttaaagtataataaaaaaaaagtttgtaatactacactcccttcagtttttctttcaaagcagctccttataactttatttcttagattggaattaggtgacatattactaaggtccataagttcttcacaagaagattaagcttctgtttgcattttcatgattatcttgaacaataatataaacacattttagatcatctgggtgcctgccctaaaaccaagcagtaccataagatttcttatctcttacctttgtatgtatgaatgcgtcaataccaaatggtactgatttaattttcttgagccaagaagaaaagaaaattgatggacatataataaccttaaacagtaccttggaatattatacaaatgaggagaagtggtgggaggttggagtgagtcataacatagcacatgaaagtagaagtatatcaaactcaaaattacctgcagccagtatcatacttcatgtggagaactgttatgtagttttggtagaataacataagcaattacattaaattaatattgtaagtttgattttaatttgctttaaaatcttccttccttccttccttccttccttccttccttccttccttccttccttcctgccttccttcctgccttccttcctgccttccttcctgtctctctctctctctctcttttttgacagggtctggctctgtcacttaggctggagtgcagtggtacaattctggctcactgcaaccgcctcccaggctcaagccatcctcccacctcagcctttccagtagctgggactacaggtggacgccaacacaccttgctaattacttgtgtatttttgtagagatggggtttcgccatgttgctgggctcaagctatccaccctcaagtgatccatcctgggctcaaactatccacacatcttggccttccaaagtgttgggattacaggcatgagccaccgcacccggttttgaattttctttatatttattttataagcatatttagtttttatggttgtattagtgctgcaagtatagatgtttcatatgaagtttctgtttatatatattatatatttaagtaatataaacaaaaattctaagccaacctgagtttactcaaggattcttttcctttcttatttgaattttattttacaaacactcatatagagctttctatataccagatattaagtactaactccttgtaataatcatatgacataggtattgttattagctccactgtgctgtggagaagattgaggcacttatagaaattaataacccatgatcacacaacaagtaagtggtacagttgggatttaacaggcaatctggcttgagaatccccatctttaatcatataaaatgctgctttcctttagatagattctgtatgtactctgtcaaggtttgaaaaataccactttaggaaatatggtctacccttgatacatattcacgagggctctgttcttagctttcttccctttacacttgacatgttctcccaggacgatatcactgattactacagttctaactatcaaccacaccttgactagttccagatctctaactgtggattagacctgtattctgttctcaggatgcatataatcaactggacattttcatctgcaactttcagagacacctcatgttcaacctagtttaaataaagccaagctttccctttccctgactccactcttactctaataagcctgctttttctactgtattagccctcctgtttaatggtcccacttcctactcaaaatgctcactgtttagtgaagaagagagataaacagtcattacagtgagtacatgacaatcacagggatatgtccaaaatgccattcagctcagaaagaaacatgactctgcctgaggtagaagggtcaaggaaggcttcactaagaagacaatgtttaaactgattcacagtaatgcctgcttacatttagaaaaggaactctcatctttgtccattagtatatagtttaagggtatcttttatgtgcactatttatattggcggtagaaaatagaaatgtatgataatttttcactttagctccaaaatgaaatctctactactttgttcccctccatttcccagaaaagcagaagtagcaattttacaagctttttttgccatttgaaatgaaataaatgaaagataatattttccgtactcttttaaaagatcaatttatctctaaaacatttttcatactctaacattttatgggaaaaattctacatagattttggtcaattatatcagttttgactgactctgaggcagctgcagtatgtagttcattagtggtcatggctccccatatggcttttgtgggttgaccatcataggcaataggtccttctagacttgtgcaggtaccacattggaattctagcagcacaacacagatgagagatggcagtgatgattagcatggagagccatagaatcaggtcacagttgccagagaggcaacctttttgcctttctttttgaagatgttcatcctgatagcgtctccttcagaaataattttattgcataaaagagatgtccattcaaactgctcaagctaaagtgataatttccttgtcaggatacaggggtcatttctaggaacccaagaaaaagatgcaaatcctggctttgaaacagtctagaaacagcaaccacaaggcctaggaataaagggagtttttcagttatgatctgtgccatttgtctctctcttggttatactgtctcctcttgtttcttcctgtgtcagtttccctcttccttctctctgccaacccactttctctgcacacagagcccccacccagcagctgtatttccagcctgcaccccagctgtatgccatctttgagtttaagcactaacagagagaaatgcatctctaagatgcaatttcaaatcctgagggggtctgatgagttccttttggttcacatctagctatgcacagcgaagtaagattatttcttagaaatgtgtatgtagggacctacactggggaaaattggcagataccttcaaattgtctcctatgggtatgtttgtaaacactgaagttttgtttcaaagagagaacagccacaaagcctgacctcataagataaaataagtgaagcgttttctctgcttcctaagaattatgctgttactaatcaaaaagactgccctaattacagccacctgtgccattgaataaacataattcttcaggatcaggttgttatgaactaatttgatacatgttacctttcacttttagggagggggaactctgattaatgctaaggtaaactcatggacaaagactaaaaggggtcacaagaaaaaacgctcaagcttgtctttactctagttcttaagttaaagcatcaagaggaacccccaagattcccatctgaagcagctcactggccctaggatttaaggctaaaagtcgtgtaggataaagaatatgggtttttctagtggtgttcatgggaagtccctctggcagtttagttgttattctgtgactgaggctaatgaccacgtataatactatcgacaagtatgaggaatgttttcttaacattctgaatacctgaattgcactgaaatccaatatagttaaagagcagagtcttctggttaatcaaatattgagataagaattaccaaatgtagaataataggacttttcgattagataattatgcagttcagttacctttagactctactctgaggtgccatagaagcaatagagagaggctctactccttgctgtaccctacattcatctctactttcatctgttctacatatagacatttcaaataatgtgccatttgaacaaatggttccatgacattatagatatatgaaataaatatgcttgcctatgaaaactgctgatgtacttcagtcttctcaagagaaaactgagagccccaaaaaagttaaatttccaacactgatcaaaacatatagaataaaaaataaagaacacactaaatatgattattttttcaataataatttaaaaggtacctttaggacttattgtcccagagttatagacctcctaacttacagtccagatatggagtagacagagttagtttatttctttatgcatttaacaaacatttattgaccactccccgtgtatcagatattttactaggcactagaggttcaacagtgagcaaaacaagataaactctctgtcctcactgaacttctcttctaatgagagagacagaaaaatatgttagataagtaaaatatatattgatagtgttcaatgtaaaaagtcagaatacaaagcagagaagtgggatataaagtatatgtatactgtggaggcagaaaagttctcatgtggaagctaactttttaataaagtttgaagaaaggtggttatgcagatactttcagaaataacattcttggctagagaacagcaaggacctgagctggaagtgtgcccagtgtgttagaggaacactaggaagccagtaggaatacagcagaaacagtagaggaagagtagctagaaacgaagtcagagagtaaatgggaaatgggagagaaatatataggagcttagaggtcaatattaaggactttggcttttgctctgggtgggataggagaagtttagagtagaagaataagataatctaacttacatttgtgttgacaacagattgaagggagaaagaacataaccaaggtgaccattaggagtcagttgcattaacccaggtaatgaatgatagttatatggactaggatagaaaaatgaggatgctaagaaatagtcaagccctggatataaatctaaggtgtagctgatcaaatttgcttatggatcaaatgtgaagatgagagaaagggagaagttaaggatgacatcaagttttttggcctcagcaactggaaaaatggaattgccactgaggtaggaaagattgtagaagtttctggttgtagaaagtagaagatcaaaaggtcaattttggacatgctatgtttaagatacttactagacatttaagtagagaagtcaaatgggaactagaacaccaatatggagttctttggagagttgttccagtgtccagatttcagatagcaatgggaattattagcattgagctgggatttaaaattatgacactgcatgagatcagcaagggagtaggtagagataaaaaagagaggacttgcctggctgcggtggctcacgcctgtaatcccagcacttcgggaggccgaggcaggtggatcacgaggtcaggagatcgagaccatcctggctaacacggtgaaaccccgtctctactaaaaatagaaaaaatcagctgggcatggtggtgggctcctgtagtcccagctactcatgaggctgaggtaggagaatggcatgaacccaggaggcggagcttgcagtgagctgagatggtgccactgcactccagcctggttgacagagcgagactctgtctcaaaagaaaaaaaaaaaaaagaggaataagccaagggacactccaaattacaggttttaacaatgaaggtgaacttccttccctccccattccaaaacacacagaattgaccaggagaaaccaggaggaaaatcatccaagtatgaatcatataagccaagcgaatcaagtacttctaggagaaaggagtgttcaactatgacaaatgctgctgatggagaaatatggtgaaaattgaaaattgagaagtgacaatggagatcatttgcaacactgagaataaaaattttggtgagtggtggggatgaacgccagatagagtgggttcaaaggagaatggaagaagagcaattggagatataaagcacacttttccaatgagctttgttataaagcaagattgtttaattgttttaagatgggagaaatagcagtgtgagttttctcctaagggattgattcaatagagagaaaatgttgataatgccaaatacaaagaggaattgctgaattaatgtcacctggaatatgagaacgaagaaggcattggccagaaatatgggaaattcatccacagttccaggaaagaaattacagatgcagatagatgggcagatgattctctcttgattaaataaagttgtttcagaaaagtagaaaggaagctcagcagctgacaatgagaatgaggagagtgttgctgaaagtttaaggtaagaggagaaataaaaagtagtccttgaggggacagtgaatttacaaaggaaatgtagtatgatttttaggtagtattaactgagactcagaaagggtaaatattttgaccaaggttatttatctagcaatagaataaggaataaaactcagatctcatggccgggcgtggtggctcacacctgtgatccaagcactttgggaggctgaggcgggtggatcacttgaggttaggagtttgagaccagcctggccaacatggagaaactccacctctactaaaaataccaaaattagctgggcgtggtggcaggcgcctgtaatcccagctactctggaggctgaggcaagagaatcccttgaacctgggaggcagaggttgcagtgagccaagattgtgccactgcactccagcctgggtgacacagcaaggctctctctctcaaaaacaaaataaaacaaaaaaccaaaaccaaaaactgagatctctccactcatggctctttgaccaaattgttttcctctatactgtatagcatagtagatgtttatttagggagtttccaggagaaatgcaaaattcatactcaagtaaaattaaagtttatttaactcctgtgccagtcatcaatttaaaatatatatataaaattgatataaaatatatcaataaatatatatatattttaaattgatatatatatcaatttaaaatatatatagtgtctatttcatatatagacactatatatatgatatatatatatttcatatatgtaatatatatgatatggcatatatatgtcatatatatgatatatcatatatatcatatatatatttcatatatatatgatatatatcatatatatcatatatatatttcatatatatgatatatatcatatatatcatatatatatttcatatatatttcatatatatagtgtctatttcatagctttaaattatcgaattacatgccaagtgaaatagagaaaaaaggcagtaatacaacaattcaaccaaatcctgcctctgccccatccccaattccccagtgcacataaacaatgcttttgccctaaacatggagcttatttagttaaaaaatactgggtttacaattgggggaaatttatcctgaattatccaaataatgatctttagttctctaccagcagaatatcttagaaaaatacttgacccccgcaaaaaacaaacaaacaaataaacaaaaactgttaaaatcaattgtgccctatatttcttgggggaggggtggagtttctaacactaactttttaatgagtatctactattgtataaatagtagtggcagtggagcacttattttgcattaaatgtcaagtatatccaataagaggattagaattgcaaataatgaatttggtttctgtcttgcctaattgtctttaatttattatgttgaaatctcctatatttaggactcccattatggagaagcagtgcatcatgctaattaaagtgagtaaattgcaaaagtaacatttatcatttgcatcaagaaggtagaggtctcctatccttactgacagtaaataaaataggggtctattccacatgatcactttacattcctcactttggtgcctgcctttctggcctgtgacttgatgattagagattcaggaggaccaaagggtaagagccttacttgtgattgctgaagcttgtcatgtaagagatacaaagatttcactgaaacacaagatacaggaggaaacaatttgccatgtgaaaaagaagtcattagaaagcaaagagagtgatgtgagttagttggagaaacaatattggcaaagatatggcccaggatgaaaaatatgtaattatcagtgataatttaatttataattatttattctaatttctataatcgctttcatttaagcaaggaagaaaactaacttgcctccaggaaaatataatattattttaggtaagtactagaatatgtttctagcttctaaataccagcatggtttaaatgtcagatttatttgttgtgagaaaatttaaatgaatgttgcctatcattaacattcaaaaggtaaactgatgtgttgcaagatcttacctacttttaccttatttcaaagaagattgtgtaaataaaataatattttttaaatgtaggttttaaaaatcaagaaataaaataaacgtaactataatgaaaaagaatacaagttaatatcttttaaattacatttccagcacagattatacacttgaatgactataaatggctttaagctattcaaaattagttctactctgatatcgagtttgcgatatgtttatcagaactcaagtaaatctgtgggtgatgtccacaagcaaacggcaaaaactagatatgactgtgttttcatttcaatgtaatagtctcatatgaatgtacatatacatatagtatttttaatataatacactgtaagaatctagacagtatatttaagttcattaacaaagggtaaatataggaatgttttattactttcccagactcaaaaaacactgttttgatttccacagccctaaaaattccatagtcattgattagatagagtaatggacacacattatgatctatagtgttaatttactggccaagaatctaagctattgtaataaatatgtaagaggacatgaaatggttaaccatacaaacctcaggggtcaatttttagaccatttgaaatacagcttctaggagaaaggggaaagagggagacagtgaggaataggaagtgactatggcggttactacgcaattaaggttaagagaatacagatatcttgaaatttggctttaggtggttggcagactctcttactagttaagggtttattcccacacgtgcctttaacaaaattacaaatcactacaagctatgggccttatgagttacactcaaatagttgcaaattaattttgaaaatgtcaaggtcctactgcatatactttttgcttcagcaaaagattaaattgggttgtctattcctcggtatatttaattcttcttaactaatcctttgctttactttataagctctagagccaaaagaatagtttccggcatcattatggagaggcaccacaccctcagtattagaatctttttgaattatataattatttaattgaattaatttatgaaataatttataattatttcacaggagtgaaatccagaatgcattacctgcttttagaaccacctgggccacaggtttaattctgaagtgtgaacttatgtaatgttttgtgtgctaaagatggcaaatagctatgaacttagtgtaattatataattggtaaagatataagattgccaaatgcatttatttttactgtgctttaaaagactgagatatattgctaattttcatagcttttatgctaaaagcaaacaaacaaaacaataagaacttgtgaagagaagcgtagtagtttcaagtcctggctctaaggccagacttcctagctggagtcctgggtcttcctcctacaagctgtgagcctgaacagatcaccttacatctttatttctcagattcctcatctgaaagaaggagataataacctcataggattcttgtgagaatcgaatgtggtaatacatgtaaaacagaacagtatcttataccagagaaagcatttgataaaagtaatccagcccagttttgaaaaaatatataaacaaatagaaaaatttccatctttataatctgttactggggattattacatagagttagcagtcttagggagtcttggagttcattattaacataaaatacaacatttgtatgagaaaaacccattatagttagcctttcagctttgttcagcaaatatttattgagcatatactatgtgtcacattgtgtcttaggtattacagatacataaagcactaatatagaaatacatgtcatatattgtatattaaacaaacatacacaatatgcatatgtggcaagtgtgcctatgaggataatagttatcacctgtcctattcaccgagtgcttagtttgtatatggttctctactaggatttcctgtctgcattattttgtttatgtgtcttacttttgaggaatttatatgatccccattttcactatgaagaaaaatgaggctcagaaaggctaaacaactttcccaaggtcagcagagtaagtgacagagttggaattcagaggtcagtctgactccagagctagggctcttctgctttttgatactgctttggttcttactgactgagtaacagtgaatttatatatttcaaacaatttaaattgggttctactgagtggagactgcattgtttacattctgaaacttttcaaagctagaaagtcatcacttaacaaagaactactttgtggcctaaagtggcactgaaagtgttaaagaggtgagctgggacccagaggtgggatccaagatcgccactcaatgcataatggtagggacaacccaccatgttgtaaagcaaactgtctttaaatagaggctgagatgaatagatgaagactttcagagactgggggcaaaggtaaggagaccttagataatttgtgttgatcagaaacagggatcctgatgccttctcttgatctcagggttgcttaaaggagatggcttgatgaaggggggtttagggcttcttagaaagcttctctgacttcacacacacatatacacactcatacatgcacattccctttcctcatcagactttgatgcctaaagttcctttaatataactaccacccccttctcttcatttcctacttttgtatttcccttattttctctcctactcacttcctataaccacctgtagaaaagctggtatcagaacaactgcactgagtactgatcaccatgtctgttgcccctattgacttggttaatacaaacaaagctaacatctgtgtccaccaactataagtcaaggacataattattacagaatttaggctagaaatggttatatggaagtaatcatacagagattcaaataaaatttttgctgactgtaaatgtcttttcttttcttgggagaaagactctgaaggttgtaataaaaaattctgtaacctaacaagtcactctattacccaacaactctgtgtgcctctgctagactaatcttccaaacctgccacttctattggttagtctcccattcatttccaccaggatctagttcagccttcttggtcccttttcaggccccacacgtctttccacatcacatccaattaccccacagaactatgcacccctctccacccactccccataacccagtccatcaggggactggatcccttgatcctttagcttaccagccatgttccttttccatatctttgcagtctataggagaataggtggcttctattctctagtcacatttatcgaaatctatgagacttcgttgcatagtacagcataaatgaagttatatatatgagttgtatgtgaaacccagcactgctacttaatggctgggtaatctagagtagattacttagttttgccaagtctcagtgtcctaatgtgtaccataaagagaatacaagtaactatctcataggcatgctttgagattaaatgaaaaaatgcatgcaatctgcttagtccagtgcttgacatatagtaaggagttaaaaaaagtaacttaaaaataattaaataccacagtttcaatcttactttctaggctgatcattcttgttttgattatatcaccctcctctttactcataatatggcttgcaattgtatcatttatgtaatttcttaggatatttaccattttgtaatataatatttttatggatacgactgctgaacttttgatgaagcagaaactataaaagagatgctttccaaggccacagagaaagtacacttcaaaggacatgttatttattttcactgattgagtggttaattgatggcttcattcattcaatcaatgaagagatatacattgaatatctaatatatttcagacaccggaatgagtcagaaagattctgatttaaaggagagaataagaagtacataaattactatgacacaatgtaaaaagtcataagtgtctatataggtaaagtacattaatggttcagaagatagaaagatagcaactggaagctttatagaggagggagacttgagctgtcctggaagggcaggttgtatgagttgattgcaaaataagaggtgagacagggatagccgaatggcagagggcacattccaaatcaaggcacatgcatgagcatagaattgtggttggagagaacaagtacctgcggtgaatagcaagggaacagccgttcagatggggggcatccaaaagctcttttcaaaatctgcttgacccccttgggctttcttttaattagcacaactgtgacctcgaaggctttagcaaatgtctttgctttccagctgtttttattgatttttttttcattgtaggactttaatttagagtagttcctccctgcattcattgttcaacaaattacactcatgcggctgtcataccaccctacctgtttctttaagaagtgacttccctctgtgagagaggttcctgttgacacaaaatcacagaacgttagatgagacctaggagggctttgtactcatagtggttttaaatggagaaagatctctgcagaaaaatttatactagtagctaagatggactgccaaattcctgttcttcactaggagaagtcctataggttctataaaggacatccagaacccaaattaataattacaacattgataataattaccagctcagctcagctctgtcccagattccaaaactcacaagtaggacattcaaaacggaatcttgaagctcccgaagatgttttattaaatcatttcaaaatgaataatattcaatatggtttgtgatatttagaaggcagagaggacatactaactttccctccatgggtggccttctattcccttacattaaaatctaaggcactgacagttgaattgcttaataaacaaactcaacatccaaaagaccctcagctgagcaatatcctcagactcttcttgtgaattcctgaagttcccttgacatgctcagttcattaaaagcctttcacctggtgggcagaaattgtctccaggcttatgatgaatgaaaaagaacagaatactaaatttaagaatttaagaagtccagcttatattcccattattggcagataacaaaattgaggctcaaaagaggctggatcaactggatcacttagctgcatagtgcaaaagctgagaccaagtcctaaacacatattctttctcatttctagacttccagttcaatgcctgctcactttcttctctaatctcactatctccatctattcttttttttttttggagctgggattacaggtgcctgccaccacgcccggctaatttttgttatttttagtagagatagggtttcaccatgttgaccaggctggtctcaaactcctgacctcaggtgatccacctgcctcggcctcccaaagggctgggattacaggtgtgagccactgctcctggcccaccatctccatctattctaaaaacagaaacagaaaaacaacaacaaaaacaacaacaacaaaaaactgtctccaaatagatcagtcacaaatccagtcccttctttccatttccactggcatcttcccagttcaacaccacggtcccttgcctagacaactgtagcagcttactaactcctccttgtttctctagtcttgccctacctttctgcctacatcaagtacatcatgggttgtctctataaaaatattcccttatttaacaccctttgaatgtacctcattgtcttaaggtataagacaatgagcagaagatacaagacctttcaaggtttagccaaatttttcttttcagatttatgctgtatagattttgcttgttggcttctcagctctccacccttcttcactctgatctgtgcctgggaagctgataagcatggagcacatatggcttctggttgggtttggcaaagggacaacactagcaggagatgagaagcagaatgacagtgagaatgggcatttatttgctggattcctcactgcagtctccttaggagaatctctgcagttggataattgctacaaggacaccccgtctaggaggggtaacaatcccatacttaatagtcctggagtacctctcaagtgttaatacatctggcccactttttggtaaataactcctatgttaaattctccacaaataattcacttcgagttctattagtggttccttgccagtctgatatttggccaatcccaagttgatgccttaatttacaattacaatttgcaacttacaattatattgaataatgatagtctctgaaacaaatgcaccctgttcattcttctctgaagctttgttcctgttgtttatttctgtctgaattgcatttgtatgcatgtatttctgtctgaattggattcctacttcccattacccccaacatcatatctcaggtcctagactaactgctcctagactccttctgattgaatgcaaatggctacatagacatctctaatccccctgtgcttccccctattggatcacccttgacaacgtgctgttgtgtgttccctaatacatgggaaacatggaggccgggagctgtatcattcatcctcataaactcactacctagcacagatcccacaacagcatagcaactcaacaaatcttacttaaataaaatgtatctttatttggatgtggaggtctttcccttccagttcttacttggcttgaaattttcccttgaatctcccagggagttattgtaattaccagatgctgggcaagtaccaacaaaccgtgagaagaacactgttctaatccttgagaagctcaaagtccatgatctaactcccaggctatttaagagctcaaagcagatgatatgtaagtaaaaatgcattttaaataagatattgaagccaaatatgatttggtttcaaaagagaaattaatattttgaagaaggcatcacaaatccagatccatttatctgaagtacaagactgccctgccaaattaaatgtctgattctttattcccgccagtttctaaaatctgtcagcgattgctgactcaaaaacaaaagcataaacaacacagtttaaagatgttcttaacaagtatctggtcctttctgatgctatgtgacagagcagggaagaccatgctgcaggtggaccattctattcaagttacaatggctttccaattaagttagggcaaaattgtcaccacattctagcatcacctcacattttgttctaaagattttgtcgactatacctcacattttgtatatagattttgtcaacacatgtttgtgccatgagtttgggaattgtagtaattttcatgataaggacaatggcaaacctaagtgttgagattaagtattaattttttttttttttttgagacggagtcttgctctgtcacccaggctggactgcagtggcatgatctcggctcactgcaagctccgcctcctgggttcatgccattctcctgcctcagcctactcaacagctgggactacaggcgcatgccgccacgcctggctaatttttttgtatttttagtagagacggggtttcaccatgttaaccaggatggtctcgatcttctgacctcgtgatctgcctgcctcggccctccaaagtgctgggattacaggcgtgagccaatgtgcctggccaagtattaaattgttatatgacagcttcttagaagctttgaacatctgagtcagagtctgtgatatagtttcaagcaagtagttgtttgttttgttttgttattttctgttcccatctgccaggttggctttttgagcagcaacctccctgtccacccttgaaggcaaagttccctataaagggctgccatactacccttttgctagcttgggacatcagttctcccctatggtgcattacatactgttacatcacgttttagcaattatgtacaaagaactgaaattaagaatttttttaacttttattttaggtttaggcgtatatgtgcaggcttgttatataggtaaactgtgtgttgtgggggtttggtgtccagattatttagtcacccaggtaataaggataatactcaatagattttttttaaatcctctccctcctcccaccctccaccatcaagtagactccagtgtctcattcttttctttatgtccatgcattctcacaaaacagatttttaataaattagtgtgaatcaagattgtttctattatagcttccttcttacttttgcttgcattgcaaattgctctcttcattaggaatgaaaggagtgaacttatcataaatgcatagaaaaacccacagccaatctcacttatgccacatgtgactgttcaccatgtgagttgcaaggaaaatgtgaatgatcaccatatttcatcaattgtaaaaggcaactttttccacatttttatatacctgaaataaggctgcatcttacagttgatcataccttatagttaaaataggcaggtttttaaaatggaatataacatataatgctgtatcccacattagctgcattttagactcaaagttaattaccccaggacccatatcccactctttattttgaaatttctctctagtcaggcacaatggttcctacaatattgtctgtccttcttctctcactggtcctgtcatattattaactcattttaaaaatattgattgtctattttgccggatctcatattcttataaagtggttccatttatagaacagtcattgcacctaatttagaccagttcaagatatttcagaacttatctttcaggtaagcccatgttggccatttgtttgaacaagagcctctgaaaactgtttggtggattctaactacagatgggttatttaggaaagagaagccatttcttaatgaatgggagtatgcctcataccagcttatgtaaaatcacagcagtactatcgcatggctggaatcacataagcattggctaccagatcccctgagacaggtgcagagctgagaaaatcacggtgggagtgattgtggagggagtaatgattgtgagacagcaggagggagaagcttcctaccctaccactcccagcttttggaacttcaaagtgctgatgtatcatagacattcaatatatggttgtttaatgaatgaatatatttagccaaaaaatcagattaaagcaatttgaatgagtggtgctgaaaagaaatggaaatcacaaaggccagttgccccaaaggggtgtgcagggaagggagaaggcaaatgtcactgaccttgctgtggtggtgaggttggatgggagttactctatctttctgcctgtcaacacttgggatttattatcattgagtcactattgtaagagctttataaacattaacctacttaatcttcaaaattatcttataacatagctactattatctcaattttattaataaagagactgatacaccaagaggtgaagtgcctttcccagggtctcacagctagtaagtgacagatttagggtttgaacacaggactctggttccagagtctgtgctttgatcacttcatttcagtgcatctttcttcactcaggaggtgttctctattttagtcattacaatactatggcctttgaagccagatgtctgtggtctgtcccagacttgaggagagacaaactcggctctcaggctgcagaatgataggctgataggcctgccctgtaggtgtggtcaggcagagatggccggcacactctctagatttgacttggatatgatccatgtttttagaaatacaattaaaaactttacttaaaattacatgttctgttatagtattaaaatgacatctcccctgtaccctcaaatcccaggttagaaaaaagtaatgtttgactttctttgttcttttttgtcctggcattgtaaaatatagcctaaagaaagtcctggggaactgctcatagctatatgtcaaatgaattattttatcagtgtgttaaaacaatttttttaagcccacattttctctaaaactcttgatggaaaattaacatcttgatgggatacagaattaaaaacaaatactttaagaaattactgctagaggaattaatcaaaatactgagaggcagcagatttgttctgaaaataatcctgatatctgagtttctgtcttgaaaaggagaaatatttaccttttaaaattccatactataaatacattctaaatcaaaattctggctcttgattgttgtttaatatccagaaaggaaaatggcttttgatttggggttggcgtttaacagaaatcacaaaagtgtccatttgtacaccataggctggatttgggcctatgatactaacaacataccttcagttttaacagaggttagatatttaatgcagcattagaatccaagatgtagacagatgtctcagacagacaaacatggtagccaagtagaccttgctttttcagcctatgagagtgagagctgtgtctttgttcctagtgcctagcaaagggctggaacataggaggcacaatatatgtacaattgagtttctccaactgaacagagatagaaaactgttgcctttgtgcaccaatggaaagttaaggtattagaattgctacccaaatatactcaatagtgatagtgtatgtttgtctggaatgtagatgtagataataaataaaaagtagattcacatgaaattttgagagcacacttgacagcatacaatgtccattttatttatttccttgacactgtgttttgctcagttacttggatgttgacaaatgctattatcatattttcttcttagaagcaatatgaatattaaaactaatcttgggagattccactgaatgcttttttttttttttttgagatggagtctcactctgtcacccaggctggagtgcagtgacgtgatctcggctcactgcaacctctgcctcccgagttcaagcaattctcctgcctcagcttcccaagtagctgggactacaggcacgtgccaccacacctggctaattttttgtatttttagtacagatggggtttcaccatgttagccaggatggtctcgatctcctgacctcatgatccacccatctcagcctcccaaagtgctgggattacaggtgtgagccaccatgcctggcctgcctttttttttttttttttataatgagttatgagttaagcctatttatctttggtattcttctttgtgttccatggcaatgcagattccactgtgttcctccttcttataaatttgaaaaatgaggaaaaatgagattgtgtgcctttaattatattatcagcaattgagggaaaatacaggtaccatgtattttgccaaggttatcttttctaacaaactgcctgttaatttgtgggaatgcttctgagtcattattagcaatgcttttgtttgctattgtctcttagaatcttaatttcttacatatattttctttcatttttctaacttgattctctcatcatcttttatggtttcttaacattcttatttaccagtagtaaatacaattattatcattttttcttagtagctcacagcaacatacatttatctgagagtctagagtttagaagacaaaaataggtttcactggaataaattatctgtccacagcactgcattcctcctagaggtccagggaagaaactgtcttcaaagccagcgatgccctgtatagtctttctcgggctgtcaatctggtctctgcttctgtcataacatcttcttctctgactctcctgcctctctttttctatcaaaaggcccttgtgattagattaggcacatccagataatctaggattgacttctcatctcaagatccttaatttcgtcacatctgaaaagtcctatttgccttataaggtgacgtaatcataggttttaggtattgggatatggacattttgggattaattattctgtagtgttctttttttaggataaaattttattttatattttcccctctacttttaagttctggggtacatgtgcaaaatgtgaggatttgttacataggtaaatgtgtgtcatggtagtaataattatttgattagagaattatcccatcacctgggattacagttataattcaattaggtccttgttctcatggagcttattttcaactgggagaaggaagaccatggcaaataaatatggtaattatatgtggtgacaaatgctgtgaagaaactaaaacaggctatcattttacaataaaaaggtagcaggctctgatggtcaagagcagggaggctacagccagaccagaattttaatctcagcactaatactttgctgtgtgatcttgggcaagttattgagcctttctgtgcctttgtttcttcatctctgaaaaggaaacaatcatagcccctatctcacaggcttgttttagggattacattaattaatacatggaatacatagaaccctatctgatatacagtaggcactttgcaagattaactttttttttcattattttagtaattaatacctcccggatactttctatcagccggaaattattattataacttgtccatcaaaattaccctatgaagtaggtgttagtcccttttcacagatgagaaatctgaaggttggagaggctaaataactatcacaaggtcatgcagctagccaagtagcagaagcactgcatttgacttctgctctgtcctcaaacatctttgcctctcttcataagacgtaagtttgattttttctgaatatttactttctagtggctcattaattaagcccattatatccataatctcacatttaggactagcgagataatgcacatttactgacaataaaactcatccttcttagcctttttcttttctgatttttttcttatacaaaagaaaaaattttgctgctgcctaaagtcagactgattataacctcagcaacatcttttatatacatttgacttaactttattcatatagaatttattaattacgagccaaatatcttgctccttaaaggttgcatgcagtttcctgttgcatctgtaccttctacattagatgctttagagtagggtgctttagaaagtatttccatttgtgatcccccagatttcacccatttagttgaaattcaaaattgctattatttttcttttcatgactttttcagatgtctcttttcttttcctaatcacagttccatttagaccaaatgacattcagaaattctcacttcggtggtaatctgctttctttaacatccagttttaaaccataatcactaccctcttccctcaattgctcagatagttggtgtatattttattaagcaacaacttgccagatttaagaaaagtgctctcttagagcaaagcatcattctaaagccccagggcttggcagcacaacgtggctcagcagatcctgaggccatgcatataagtttaatgaggctgtgaagggaaagtgctgtaaaatccatgaacttcgcccatactagttaaaggagcatggcctttttctccttctaaagaagtgaggaataggtgaggacccagagattggcagttaagatctggctgttggccccctcttggagatatggtgtttcaaatggacaccagagtcaggcaggccattatcagaattttgcctcttctacttaattgttgtgtaacttccctgggattttattctatcattcacaaaatgggaataacagtgtttacagtgctttgtgagaattaaatggcataatgtacataaatatttagacatactgggcactccataatgataacaagtattataactagttactacctgttctttctacattcacttgtgatttttttctgaatccttgaacccagttcattccttcataagtggactttcatgatggtgtagagcaaaacctctcctttggctttgttagttcaccatttatttttattattttaaggactagccatcagcttctccacatgaacctacccattttcatgatgcttaggcttaaaaatattactggcactcaaatttttattgatcaattgactgaatcattcatcaaacatttattgacttcctactagagtcactcctttcccccatgaagctcatagtctctggccaggtcaggtgcttgtttacatgaagtacaagtctgagggagaaaggcaacaacacaagatgctgagatagcacagaggaagcagtgttcctctcctggggatggagtgtatggttagggaaggcttcctagaggagaatgactctagcttcttttttttttttttttttttgagatggagtttcactcttgtcgcccaggctggagtgcaatggcgcaatctcagctcactgcaaccttctctttccggggtcaaactattctcctgccttagcttcccaagtagctgggattacaggcgcccaccactacgcctggctaagttttgtattttttagtagagacggggtttcaccatgttggccaggctggtcttgaactcctgacctcaggtgattctcccatctcggcctcccaaagtgctgggattacaggcgtgagccactgtgccccgcctaccttgttctttgaaagtaaaggtgggttccagtggcagctgccccagggcctgcttcctcttcctaagtctgttgtcctctggaatggaggggtggtgctccaatctgtggtgcccaaaaacccaagtttatttctctcttaacactggcaataacccgtccacatgactgttgccttttaaaacctcttaataatgtcatactgtgtttgttgttgattccaactaaattatcaccagggctgtgtgggtaaatgcttttaaatactctctcatcttgctctttcccctgtatgatgctaatcttgtccctaagtaagtttcttcctgctccttttgtaccttcctttcttgtctttcctcctaccttttgtctcgtggtgtctggtgtttttttttgtttttttgctttttgtacaaagattagtttcaatgtagtctatagcctcctttgtaaaccagttaaaaagttctttaattaaaaaaaaaaagaaagtaaaggtgtgttaagtaggcaaaggaaaaagggaattctgggcagaatataattactaagccccagaggatgaaacatcaaggcctgtcgggtgaaggatgagcaatttggtgtcatttgagtaaacattcaaggagaggtatagctgagaagaggatgataagagaagacatacatttggatgtataaatttagaggaaaagtgcccaagaaaactgcctgacatatagtaaatgcttgataagtgcgcttatttttttttcttctaaagaccagctcttgttttataaaataatatacattatgcttaaaagccagatattatacttgattttctttatagcttgttctgtactctcaggctttctgtaaaattttactttttatttttggtttatagttaagaaagtcaaagatggaaaatacaaattgtgagaaaaaattacaataatgtatccttaatatttcaacatcaacaatcacaaaacgaacaaataagagattaataagaaaatccactttttttgctttcaataagaaaattaaacatccatatgtcagcagactattaaaaacgttttctcttgaatctattagaaggagggaaaaatgcattcctaatgataaatagaactatccaagttgaaaacatttgattttcctcagcaattttctcagcacgtccttctgtctcccacacccctcccaataatcttcacatcttcatttctttggagtttgtttcagctttgttttgataatgatagtgtagacacactactttcattatttctcactaatagttacctaaagcaactatttgtctgcaattttatagataattgtgtttcttttagaatgctctttgtgtttctgctgctcattactaagtatacaacagtggggaattgtctctaaaaccctactactccttcttttgcatactgggaaaatctcccacagtgaagaatgcctatttttaagaaattcaaatatttctttttcttttttgtaggaaattcaagtgtttaaaagaaaataaaaatacagcaatgtgttgcttaacaatggtgattatgtcttttggtgtcacgggaacatctcagagtgcacttacatgaacctagatggtatagcctaatagacaactaggctgtgtggtatggcctcttgttcctgcgctacaaatatgtacagcatgttactgttactgtactgaatactctaggcaactgtaacacaacgtaagtatttgtatatctaaacatataaaaagtactataaacatatggtattataatcttataagaccaccgttgtatatgtgatccattgttaaacattattttgtggtgcatgattattttaaaaatttggataaatggggtatgattatttctattaccaagaaatcaatcatttataaaatcagttcttctgagtgaccttcaacagaggtatttacgcgttgactattgcataatgaaaacggattataaatatctttatatgaagatgtctatgatatgaaactggttaatttttgcacatatttccaagggaatggggtggttttaaccttgatttcatatccctttagatgccagtaacctctttaaagattattgtgttccatttttttttctagaaaatcacaccagttaatgaagtacaattgcatggagatttcttttgtaacttgtgatcccttggcaatctacagaagattggttattatgatagtcacattgaaagaaaaatctaggccgggtgcggtggctcatgcctgtaatcctagcactttgggaggctgaggcaggcagatcgcttgagctcaggagtttgaggccagcctgggcaacatagtgaaaccccgttgctaccaaaaatagaaaaaaattggctgggcatggtgatgtgcacctgtggtcccagctacctggaaggctgaggtgggaggatcccttgagcctgggaggtggaagttgcactgagctgagtttgcatcactgcactccagcctgggtgagagagcaagaccctgtctcaataaaaaagaaaagaaaagaaaagaaaaaaaaagagaaggagggagggagggagggaggaaggaaggaaggaaggaaggagaagggggaggggaaggggaagggaagaaggaaggaaggagggaaggaaggaaaaaagaaagaaagagaaagaaagaaacagagaaagaaagaaaagagagagaggaagaaaggaaggaaggaagaaaggaaagaaggaagatctaatgctataaaattatttctgatttgggaaaatatctttaggcatgaagagcaggtgtcagtggtaagccaactaagaaatcacaatgtttcattccttaactccccaggccattacacattctcctgttaagtgtttttttcttctttaaaataataccaataagatttacctgtattcctctatggtcttagtttcagattttatttagataagtttctcattaatttaactggctactaataggggcaagaagaaattgggatcaatggagacgaagaggatatgtgacttctcagtgtacacattttaatattattttgatttttgaacccacatattatgttagcattaaaaataaagttaatataccaccaagcattcactcatcaaacaggtaaataagttttctcaaaatatgattagcaaacttatggaaagcctgataattctatgctccagctagttattatttggataataaaattaattagagtatgatgctgaagaaagagcacaagaaatggaaccagagcatctgggtgcaagtttggctcatagtatttactagttgtgtgaccttgagcgagtcacttaacttcactgagcttaacttctcttatctatgaaattacaatgatgataataccaccagtatatttacctcttggagttgttctgtagattcaataagaaacacacatgagagcgctttgtaaactgcaaagtcttatacttgtgctagctaatattttatatttcaattaatgtttccaagactctattttcaaattctcaaagccactattaagatcattacgaaatatgtttatttgtttgcttaatcttttgctttcatgcaccaaacaaccaaagtaaaactgagtgtgtgtttgtctttagttaacctggtcagcaggagtgtcagaatcattcttggaagcaaagaaaatctgctcccatagaatggctatttttcggcattgaagatcaatatttgggagctctagttaactaacagaactcccaacaagcatttcagcggggatgaatttactttgttacccatagttcgaagagaaactgcaaggtatggtcatttttttggcccatttgttcattccacaaatatgtattgagtgccaactctgtgctgggtgctcctctaggcacttcggacacggctgtgagcaagacagacaaaacatgatgctctcatggaggttactttctactggaaaaataactgagcttacagcttttttcatcctaagcacacaaataccttaatctgaagagcatttcttgccttctgataaacagctttaaaactgttttttggtggtaagatccttgcttcatgtatccaagaccaaacatgaaaaacaaataaagattgctctggctggagtgggactggggccaggggccaggttgtctcctcctacactccccatccctgctcctgccatccctctgccagaccccaggactcttcagaggacagtttatttgaaacttccacacagggcgttatctccacatcagttttgatactgaagacatcctgtaagtgcctgcatccacagtctcccaagggttttctcaagttccattcctcctctgggtctaattatctctctctccacataatagccacattatagggtttctgttgtttctgataattatgataataacgataattatcgcttatggaggacatactatctgtcaggacagtgccaggcattttatatgtacgccttcgtttaatccccagagtcatcctgtgagataggtatgaatcatcattttacagataaagaatgagactccaagaagtgaagtaattttccaaggctacagagctgttaatggtggagctggaatttgaacatatctatccgatttcacagtaggaattcttttttttttcttcctatatttcaggcccatcagcaggaagtaaggaaattcttaactactgctgcttcccaaactctgtgaagctctttgaccctctcagggatagttctaagtatggtgcaaagggctgattagagcaaagggcagcacaatgctcactcaaatatgtgttgaaggttattacactagctgtcatttacgcatggcctactccattctgaacattctacatccattttcactaatcttccagcaactctggaaggtaaatatgattacccctacattcctggtgaagactctctggcacagagaggttgtcactcacttgaggtctcacagctagcaagtggtgagccctctgcttgcctttatgacagcttggggccaaactattcctagagccaaactattcctagagccaagcccaagactcccatatcccccaaaagaacaacaacaattttaaaaagagaaagaagacatactctcctagcccgcatctgctcctaatccaggccctactccaagccgctactgtcggactccgttctcatttacaactgggtgctaaactctccaactccaccagcatgaaccctcctaactctatttccttgtctgacaaattttgtccctccatatccctctcctggcatctttttcttttggtttctccacacccattccaaactattttatttgtttcctcttcaagccttttattacagcatgaatctgtttatattttcttccttttatgagaaacaggatggtgcacgggttgttctggagcctttctgcctgagactgaaactttgttttactctactgtatagtttttaacctcgggaaaaccacttatgctttctgtgtctcagtttcctcatctgtaaaatgagtaagggaatataacctatatcacaagtttttgcaaagtttaaatgagttaacacatgcagagatttttagaaaggtgtcaggcctgtagtgagtgcttcatacatgcgagttttaattattctcttcttgtaaccatgtcccattctctctacatctttctttttctctcatctatattttactctgctttagctacacattgttttaaaaagtaaaaacagagtttatataaaataagttcattgtcattattctttttttttttttcaatttggtctacatttaaatgcctactattagccagacactgtactaaggaaaaagaaggaatataaagatgaatagccgggcgcagtggctcacgcctgtaatcccagcaccttgggaggccaaggcgggcggatcacaagatcaggagatcgagaccatcctggctaatacggtgaaacctcgtctctactaaaaatacaaaaaattagccaggtgtggtggcaggagcctgtagtcccagctactcgggaggctgaggcaggagaatggtgtgaacccaggaggtggagcttgcagtgagcagagattgtgccactgcactccagcctgggtgacagagcgagactctgtctcaaaaataaataaataaataaaataaataaataaataaagatgaataaaacatgcttttctgtgaagggtttgttaattttttaattagccaatcatgctttccatgttttcaggaaaggatgaatttatgtattcataggtccatatttatgtctattggttttatcacctacatccttccctgaatctatctacttctctctacctattctgccacccctctttattttttattttaccttttttacagatagggtcttgctctgtcctgcaagctggattgctgtgatgtgaacatagctcactgcatccttgaactgctggtctgccaccatgcttatccaactagcaccatctctcacacagactcatgcctttcaactggtcctaccccagcctcttcggtgctttctggcctactttctattcagcagccagagccatctttgtgaacagcaaatctgatcttgccagcctcaggcctaaaacctttcaaaggtcctttcattgtttttagtagaaataacacagtcctgtgtgatctgtctctgcttctctcttctgcctcctccagtgtttctcccacattccctggtttgctttcagtccctccactgcaccatcctctctccttcagatacacttcagatatctttccctcctgaaatactcttcctcctttttctgctatgctttgacaatacctactcacccttcagattaaagaaagtattattcccgtggaatgccttcttgacgctctcctctaggtcagagcttttgtttgtcttcgtttggtctggtttagtattctctgagtacatttgagtacctagactttaagattttggatccaagttctcttctttttcttgagcattcactttgtataattcgttagtgtgattttacttggctgactgtaggtccattagggaaggaaggggccatgtctattttgctcaccattgtatctccagagtgcaaggcagcatgtcactcactggaataatttaataaatattagctgaataaagattgaatgaatgaatgttgtcctgccattgcttaattttaccaatgtgccagcaattctttagtaataaagtaaattacttttagcaatgggaacatgataaatgtgaggaagctaagaggagaataagagattatcttgaaacaaagtgcaatttggaatttttgtcttttaaagacttaggtaatgagtctatcaggaattctatgtgaattaggaatctaaaaagcacattaaagatgtatactttctatttcttgggcttgggtttccaccctaaagctgccactacttgtgattctgacagttcaagacatctccactatttcagctttctgcatctttaatgtcctgaaattgattttttacattactttccttcagcctcaaaaaatctatctgcaagtttagcaattacaatttaatttattaaactgataagatttaggccacaatggttctataaacaaaaagatcatgaacagtaagttgttaatcctgaaacccccaagaaacaataaatgcttctacttgaattaaacttaaaatcattattgaatgtttcaaatcccatggtacacagagacagcaaattacacagatacagatctttccccttcttccgagtgggtgaaagataatttctgtgtgtttaaaatgtatggggaaaaaaggaaacatttagaaattaccttcttgtaataattgttatttgatggcatgttttaatcagaagacacaataaactaaacttcatagaacatcagctggaaagggccttaaaactaatctcttgaaccaccttaattaacaaacaatggaatccatgttcagaaaagtgatatgacttaggcgtgctcaataaagttgcagagtgagggacaggacgagaaaagtgcctcattactcattattaaagttgaggactgacaaatagctattcaaagagatgtgagggtaaactatactgggcacccagaatatagagtgaagtcagaaagttttaaagctgtcttgctttatagtcctctttgcatatctctgtgcaacattcttttacagttctctaacaccctgaaattccttatcaaattgaaggattatctagtgaagatctgtgttcattttgtaatacttgtagagtcaagagtagtattagaaccctttatttccatgcatttgatctgggtgttgctaatgatagatgtgaatctaagaggtctccttgttgtcaaaatgtctctagcacaaggatttatttggctttttccagtattaatgagtgactgatttatgtcactaaatgtcaacatacccctcaaataatataaaatcacaagatgaaactgtcaaagataaatatactttattacggaatgaaagtttttatggggatgttcggaactgtaatcatacaatgagaggaggttatatctattattaacctataatcagctttgtaaatatttttaacccctttgatatgagttaaagatgcaccattcccaggatagataatgagatgaagagagttttctaatttaggagttaggaagtgatacctgcttttgtccttattatattactcgaggtcaaaaactggctgttaggcatggggagaggtatgcagcatgattaattattaaggaatctggaaaggacctttcatgaatgaatctgcagactgttcaggaatcatctttttagtcatattctacgctgctatgggttagatggaggttggggaggaaacaaaggcaactaggagaaggttattaaaaggatacaataagtgaagagacttcctgggaagtgtctagttgctggcagaggcctttttctgttagtagaatgtgtacatgtgtgggagagagttgtggagaaagaaatgtctaagcaataaaaatctagagtcatgtaaagttttatttaagtttctttcctaatatttcagtacaaattagaatatgataactagattaattagaacataattaatgtaacatattaggtgaaatttaatacttggcaacaaagagtatcactaaagacaagcttattgataacagataaatgaatggataagcagctggctggctggctggataaagggtgtgcacgaagaaggtaggatggaaagagaaaaactgtaatatatttgaactacttgttgaaaaaaataactatttccagatttgtggctattttaaaaattaacaatagttgcctacacttacaataatgctgtcatgtatacatcattcagttgtgatacagaaacaatagcaattaacaacagtaacatgctagaaatgaaagtgatgcagtatgcccgagaaagtggtgaggctccctcagaaattttttgacccctttatgtccatttgattataataatctcattgcattccattccttgggctattaaagccactccccatcatgagctactacagtaaattttaaaaatcaaggaaattactaactgctcagctagcctcagctttaacagctataccaattttaaaatattaaacggctttcctatctagatgctgaactttagttcctccatatgtgaaatgagtaaacttgacaagattatctttaaggattcttaaaacttttaatttctatttcttagtgattctagttaaactacacagaatctatcaagttaactaggtcgtgcattcatttctccttatgtattaaaaatgcaaagaaaagatgtaatgttagcgacaaaactttcaagtaatgaaacttatgcttctatctcacctaagttggaatttgcactagaaaactggtcttgtccagtccaagtcgtgtacggtactttctgttctgaaagcttacttaaatgttctctgatgattctgatgcaatttctgatcaagatccacagctggactttaaaaatctttcctgggtatttgtgatgcagttacgtgagttgggaaaatgtttcaacatgccacagctgctcattcatatgcataagcctacatagatgttgatttaaagaaagaaatatgtcttgcattgtaagtatgcttcttggatggcgtatgtactttcatttctgagaaccttcaggtacagaaggtgtccatatttttcaagggataaattgcatattcatgtcaagctttcattatatctttgaccccatagagaaatgcaccgtggtgtccaactgtggtttaagctctgtgacagtggttaccccaaataacatcagagtttcacttattgctgaaaagaatagttttccttctgaattagcctcacaatttaaaaggagtgaaacagattatttacatgagtttctgcattaaagtgtggtaagctattcaaattttcaaattttatagtgaagccttaatgactttcccttggttcatagaggcatctgtgaggataggaatcaatgttacttcatcccaactcactgcttctaaactcacttgctgtagaggtcataactaaaggcaatgaagcccgaataggttcattgtctcactagctgaggagttctagcaagacttatgaatttgcttgatattggtatttagatgggcggggtagacaaagtagagctgaatggcacatgaacttcttagatctcctgcagtttgacctatccctgctaaaaccactgagccatgaccaatcattgggtgacacatgccagaaatcaaatctagtgatgcagcctcatgtgactttgcccagttctccaggtagagggagtccaacccaacagtgacaagtgacaatttttgcagggtctccaagtatgttagggcaacgcctcacaaactctaatgtgcatacaagttatctggggaatcttgataaaatgcagattctgattcagtagggttgggttgagacctgagatcttacaattctaagaaggctctcatttaatatctatgcttttggtctgtagacaacatttagtagaacaaaactctagaataattcatttcttccttcagatgcctgcatagcttactccctcatttcttttagatctttgttcaaatatcaccttattagcatggctttcttgcccactatatatttctctgtcactattgtctttctcctgctgcttctttctttatactacttatcaccatgtgacacattttacatttatttgagaggggcttttttggttcactgctttgttatttccttataacatggactgaggcataataagtatccagaaaaaaaatacctattgattgaatgaatgtataaatgaataaatgaaccatgtggtcactctgccacaattccataaaccagactacacttatgagtctccaggcaattatcaactctgctttttgggcttttcttttaactccagtaccttattaaagaataaagggtggatgaaatcaggtcccttcactatctaccgaagttcctcatcactggtaaggactgtaccatccacgacttcttttctacctgcaggccattctgaaatcctggcagtctctccaacaatgtcctgagaagtcatattcaaggcaaaagaatttgtggttctcacagggaccacttggctcttaactccattttgagctttatctaatactagctactgcctacctagttctccaagtcaatatctgtggcttattatttcaaacctaatcagttatctcacaataaatgtagatattattagaaagaaggcagcaaatacagatcagatttaccctgatctgacttggggaaatgctgtgttatcttttttgaaaaatgtataattaggttgtaatcaattccctttttattcatcaatggtgtcaaagttgagtttcagaacttgaaaaaaatgttagtgctttaatcatcttatctttgtgctatatttcaaaacaacagctgtagattttctgcaatgcaggggaaatggagtttatctactagggttgctaaaggttttatgactgaaaaccaaaaggcaccatctaaaaactgtgtcaacaccaaatgtccaaaccagggattcaattaccatctctgaatctaatataaaaacccatgccattcctttaataattactcagcaaacatttcttaagcacctactattaatatatgtcaacacactgaaaacattatattgcatttaaattaagagcagacccattcaataactcattaataaaccatagtcaaattcatattgcatggattaacacaagatataaaatgagtgacagaagggtctatcacagctcctagtgctgtctaggagctcactcgagtggagaggtgtgcaaactgtcataatgggcacaccaggtgtttacatacagttttggggaactcagataaagaatcaattaatgctgactaagcagattaaaaatggctttgtagtggaattgacatctgtgggctctcaagatgagtaggaatcctgcaggtggaaagggagaaaggcaattctgggtagaggattccacagagcaaaggcatagttcaggaacaagtgtaagagcagacagcagtcctgtgtagcaggggtacaatgagaaaggctgatactgtgggtggtggaggggtgagtggggtgagttggctgggaatatattgtgaaagacaaggagttagtgcacagggatcttggtgtcatatctcttagaaagataattctgaaatcaaaggggaaggtttctgggaagggtaaggaaagggaaggggtacctgtgggtgcacatgtgtgtaagacattatatttccttctgtgaagtggcattacagcaacttcactaactgggtataggtaattaaaggtttgacaataattaactttgcatagtgcttaaatggaattattattgaagtacaatgtatgtaatcctcttgaaagaaagaaaaacaacttcattattttcctcttcttatgaaagtaatacatgttaatttcaaagtaagtgcatgataaaattgaattttaaaagttggcaaaaatgaatcacaatcacaccaccagagaaaaacatcatatatgactcttcaaattggtgtcaattctactaccatgaaccagacactgaataagattgaggatggatatagcaatgtggacaactggagacaagctcattttaagcagaagtgagtaaaattgtgatctcgctttgtaaagtgaaacttgccaaagaagacatttattgctacattatgttaattagacattttataaattatttataattatcacaaaaatatgctaaagactatgaggaacacagttggaaattgtttgatattttgcaatacacatttctttagcaattcctttatgtctttgaagcaaaaatgaaaagcgcaagtagtgaaaatgaagaatcccttcaacctttaattaccttcaagtgaaaactcaagtgctgaggaatggtaggcttttatccactagttcatcaactctttaagaaataccaagtaggacaccagagatagagctatcagctacctatattttgttaaatataggtatggtgtctgcatgcatggaactcacaattttgtagtttagcaagatattctttctccctccactcctgaatagaaatttcacccatttttcaaggtctggctccatttccacatttccatggtgcactcttgcactgtcctgaccccttcaggcttatcctttctctgacattccataattcctagaaatactgctgctaagatcattcaatctgatcatatgttaccaggaactatactctattaaatgtataaaaatctcttttcctcaactagattaaaaaaatccttgaagacaaagactatgcttattacttaaggttaggggcagatttttgtgagcatctgataatactgacagatacatttaggaaatttttgataaagcatttgattatgactgaaaaatgtattcactgaaagtctaattcttgaccatactaaaagtatgccaataaaatcatctgccagcattgtcttaagggttgaacgacttacaatatgggtgcagataaagggcacttggtgagaatttcctaatggaatctcatgaggcactcttcatttcatttgttattttaaaggtaaattattctttatttcctaaaactgttgtacaatttaaatgtctctaaacaataattcaatcactttttcattgaaaactgcagttaaattaaggctcagttacacgtaaagtttggataggagaggaaagaaatctgattgcttgatgttgccattaccacatttccaactaatttaaagctgcaacagattagtatacagttaggctattaaaacagagaagtcattctgtgaatccaatctgtactttggcattttgtaaaaagcttgttgttatctgcaggtttctttacaagcactttaaaaatcaatttgtatgatttataggacatgctttgaacaagcatcttgataaactacagcatagtaaccaaattaaacatattgcttaaaggaaaccaagatgtaaggaagctccagtagaaagatgaagatctacattgatagaacagggacatgtttgtccttttatgtaaactttaaagcttgaagtcattctgttcaaggttatttgaacacttgatcactatcgagagcttctaattgcttatctatgattctaaccatcttatcgtctgcagaattgtttgagatgagatttttcagaaacaggaaaatggggacatttatgttgcaatgtcaggcgatggtgaaggacatacagtttgagactgaaaaaaacagctattaagaaaatggaagattccgatgaaaaagttcttactctatatgaagtagaacttgttattcaaatggtaccagcatatatcttttaattttcagctttataatggatacttattttttttttgagatggagtcttgctctgtcacccaggccagagtgcagtgccacggtctcggctcactgcaagctccacctcccgggttcatgccgttctcctgcctcagcctcctgagtagctgggactacaggtgccagctaccacatctggctatttttttgtatttttagtagagacagggtttcaccgtgttagccaggatggtctcgatctcctgacctcctgatccgcccgtctcagcctcccaaagtgctgggattacaggcttaagccaccgcacacggcctatgatggataatttttaaagcatttgtccctactgaaatacaagtctactaatatttagcaaatagaaagacttttcaaaactatctgagaagagaatatttccttggtgttgtcatcatccatctgtgaccatcacaaatctcctctttcccactctctggccatatctggcctaggccacataggaaaaaacatttattaaaaattttgaataaattaatttcaaattctaattctaaagccaggcacaactgaaagtaacatgtcaaaacatgcatggaagaaaatattttctttattcatgggcagaccatgtgattggccaccattaatggtaagatctaagctgtcacaggcaagacacaaacctcagtcttccaaacaacaatagacccatcgatgctaacaaatcatcacttgaaaaggagctcctaatactcatatgcacagagactcttccttgatgacatcttatactctcatgttcagctgtttaatactcctctttgctagccatatggaccaaaagcaatgcgcttcatttcttgaagacagtagccattttcctcttctttttttaataacaagatctgacccataattgtgtgcttacattaagtacgtttcatttccaaaggagcaacctatatatgaattttctaagaaatcaaccatacaataagtaacatcccagttgtctcattgagcctcattttaaacacggaaacagatgtttaaataaaccaaaaagcagggcatggctaatccaatttaggatatctcatcaagtttaagttggctaatctaatttacatgatctcactgagtctcatggtttacagtgatttatttcaaacaagggatattgtaggagtaaaggcaaaaaaaatgtcaatcaagcacccccaaaagccatgttagtgttaatgagaattaagttaatgccatgaggagagaatatggtctactggtctatttctgcagatgaaatctctcccttttgcttcttaagtcttaactgtttttacagtatccattggtgaccgaaagtgtgtaccacataagaatataaatgaaataaagctgatgctggttgctatttatttgaattcatattttcataggcctttctaactgcttgatattttcctggaagattagaggtaacaaagccacggttcacgttctttggacatgaaccatcaatttttcactataggtaggtttacaaaacaccaatgatggtgactctagttaataaaaattattagtaatgagggtacagatccacacagagacatatcagaacattattagtttgagttctgactgaccttcaggttgatattgtgctataatcgtcactgtctgtccagccccctttagtgcagcagctgcctgctcgtgggatgcaccacggaggtcaatgccattcacctgaaagagaggaagccagagaatcttggtatttcataaggcatattatcctgatagaagaaaaaagtttcccaaaaccaggctgtctaacattatatcacatgcctcagaaacccctcatatcctactcaggtgtttgtggactttcatgatcttaatcacttttagttaggagagacattaaatttcaccttgtggtgtttgtgccatggtctgaccgggttggaaacatttttatctattcatgttctagtgtatgcatttaatatgcctctgtgagcttcctagatttctagggtaaatagggataaatatgagccttcaaaattagagggaaaacaggatgataaagagagacacatgtaatgtaaatagacaaatatatgctaaaagattaaaacattcagatgagattctggggacatggtataaaatggggccagatggttgccaaatccctctctgtggtcaattgtctagccttgtcatcctgagcctggttagacagccttaagccttgttttttttttgtttttttttttttttttagacagagtctcgctctttcgcccaggctggagtgcagtgacgcgatctctgctcactgcaagctccgcctcccgggttcacaccattctcctgcctcagcctcccaagtagctgggattacaggtgcccgccaccacgcccggctaattttttatattttcagtagagacggggtttcaccgtgttagccaggatggtctcgatctcctgacctcgtgatccgcctgcctcggcctcccaaagtgctgggattacaggcgtgagccaccgcgcccggccgccttgttttaaaatatatacttgactgtcctatttctcatatacaattctagaataaattctgacaaaatgaaataaagagtgcctggagtttatttagctattgctaactcccattttgggtcccatactgaaagagaaacagaaatgtcttaaaagctccaaactctgccagggtgaaaggcattcttaactcaaatttaataagaagaaaatgctaaaatttttcttgaatcagttcagcctaagtcaatataatgtaattaataagtgctctccaatgacagagttctctgtctgccccagaagagggacaatgagtggagcacaaagggagacaagataagccctcaagaagtttttctgatgaacacacagtaagtatgggtttctaacctacaaaaaactaactttttgcagatgatagcagaattctgcttccttttattcatggggcaggttgatatgggctatgaaagaagaataaagaactgattagcttatacacgttcaaaatgtataatcgtattttgcttttcatcaatcctatttgagaatgacattgggtggcagatggggggttactactttgtttccccatcaggcctgggacatccatacgcttaaattccacatcatgatcctctcataataacttcgttaacatctccttattctcttttgtaattttccttgcctcatccctggctttctagtgtggtgaactccttacagaaagcattgattacatggtaacattggggagtccactgagctaggcctgatctggctgtgccactctcttgctgactgtcatactacctgagactcaattttctcctccctcggagggaagagactgttaggctatatgaatctaaagcccccttaaagtataaaattccagatctattcttgagttattcttgctagatatagtcatttcagagactgtctaggctattgatgagttagaagtatgaatctgctggccagaagagacaggaaaggtaattagatccaggctactgcctacaggaggctgaattgcacaaacttcacatgccaaataatttattctcttgtcaaacagttaaggtttactttttataaaagaataaaatgtgatcatggcaaataaattctgtttcagaaaggtctaaaaggaagaggtaaaagtcccctcaccatctccatttccagtggaaccacttttatggatacttttttcttttaggatcatctaatatttctttaatcataattctagttccataggttttcatgttatggcaatttgtacctgagtttaatgacagaaaaggcaacaatttctaaattggtggtaaacatttctttacaattttttaatgtaaggccatttattataataggcaaactataagatgaaaatgaaggcaacagatgaaacgaaggcaacagaaaagctcaacttctcacaaccaataaaattagcacaacctaagaaataatttagaaaaaagtgttgttagaagatatgttgtagatctccattccattacccaagagtatgccaattcatgattctaaataaatctttttaaagtaatagattaaaaattcatcttcagtgtatacgtaaattctgtgttttatcacacgggtatgtttattcaacactatcttttgaaaatgggccatttaaaaagacatagcaatttccattctgtttaatgcataaaaatcacagtggatagcagcaaaggacagggcggggcgggagggggggcagcattgaggagaatttgataattcacattgtgattattctgcacattgaggaaaggtaattcacacttctaaaacctcaagacttccctttttaaataaccaaaataaacccaagacaccttgctgacacttccccacccctaaacaaactgatgactttttttttttttttgagacgaagtctcgctctgttgcccagcctggagtgcagtggcatgatctcagctcactgcagcctccgcctcctgggttcaagcaattctcctgcctcagcctcctgagtagctgggactacaggcacgtgccaccacgcccagctattttttgtatttttagcagagatggggtttcaccatgttggccaggatggtctcaatcttttgacctcgtgatctgcctgcctcggccttccaacgtgctgggattacaggcgtgagccaccactgatgactcttttatacataaaagtgaaatagttatggcagcaaaagattttgatggcaatgaaagtttgtaaactgtgtttcaatctctttttcttattcccaaagtgcaagatgcagggttctcagtctttcagtagtgcttctcctgtaaataatccttcattttgtttggcaaaggcagtttctgaattaagtctattctggtatactgacataaaacaaaatgacacaggtactgcaacgagtgtacctgcatgaaccgagacactggcttggccagtctgacaaggtaagttgcagatccaggcagctgagaccttgaataacaaaaagttccattttcagagtccctgactgaatgctcaattagatcaactatggatgtatgcccttccacatttggctgttcataaaagctaaacctaccatttgagtgcccaagtctagtgtgaactgttttaccatgggagcgaaagctcaagcttaaaaggtaacagtcttcagaactgtcccaatcaaggaaagaaccatctggcaggactgctagcttcccttctgcctcccaacatgtgattggtccccagtaccatccttgttttgcaagatctttttagctcctctgtaaggcttgtcactaccatgggaccactactttgcactgagacataaactcttgcaacaccaggagcagagttaaaatcaaaattcaaatgacagagcatactttcagccatgtgggcttctgtgccagtaagtccactgaagttcctttggatttgattattttgcattggaggtagcaatggtgagagtggagggacatgatgcggacccactctggggctctgcaacatgactcccgtggtgccagtcaacaacccattcatggactgatccacaaagatctctggggcaacaactaggttctggtctgcctgactctcatcttcggggaaagagcgccctcccacttgagaaggaaccacagagacttccatggtagaagaactgtccagacaatagctacttgatccttccaaaggacacatcccctcatctaaaggcacagtatactgaatgtagtcctgaggcagaagtccaataacgacaggcacatgttcatccaggcgaagatacaggtctccgttctgagaagccgagcttttcagtgaattggcttgttcctggcacgcggtctcagactgaaggtcgtggaaatcctttcggacgccattcaggggtggactcggactggaagagtggccttgactctcacctccatcttgatgcacgtctcctcagagtttgtgggtcgaagaggccatggcatgggactgcagtgatggctgcggagggaggtggccttatcggcctctgagctctcacggctttaaagactatcggtgctgaggaggaggagaaggtgtcctcatcggcagagctcccagagggtttgcccgccttgccttttggcttctgtttggcagaaagctgcctttttaacgtatccatcaagcttttgctttttgatctgtcttttttttcttttccacctttttcgtctttcctgttgatatcgcagttggccatatctttaccatagcagctaccaaattaggaattatctttccaaagtcactggctagcgatggttgttgtactaccatgaaatcagtttattttttacttttattcaagttaaaggatttccagaaggttttaaaactgattttcttcattatgactagttacctaatccaacggatgaaaatactaggggattcacttctggcatgatggaatgagatggtcagccgggcgcggtggctcacgcctgtaatccgaacactttgggagttcgaggtgggcagatcgcttgagcccaggagctcaagaccagcttgggcaacatagggaagagcccgtctccgaaggtggccgggctacgcttcctctcccaggaccggcgtgactgctgcgctcgcctttcctccagcaagtccttctcccgcctccttcctcctcctccagcttgtgtgtactttttaaagattcactatatgcacatgcaagcacatgactttatttctcttgctctccttacatacatattttaatatattattgcctttttatttaactgaatagatcataacatatataatttgacagcttttgttttgcttttcattgagcaatgtatcttggacatctttcattatcatatcagctcatatcattctacctttttaatgaaagcccagtattccatgttatggatgtcccagcacttttcagtgagatccctcttgatgttgttaaggttgtttccagtttttctgctactatgaacacttataaaagtgtttctgaaggataagttccctggaaagacttcttggtgaaagggtatatgcattacttgtttttttttaatttgctattgcacattttcaaaatgattatttattcattaaacatataggaactaataaataagaaaacaaaaacaggccataattgaattgcccagatagtgtactgatatgaaaaataaaattaatatacccacatcatatccatatatcataagtaaggcacaatgaaaagacatacaattaaaaggctcccttacctcctattattctctacaaaggtaatcatgtgaatggtttcttgtatatactactaattatttttgttgtgaatataagccactttataaaatatataatttaaaattttatacaaataagatcatgttctacaccttgattttttccacttactaatataccttagtcagctttctaatttacatatttcttccgattaatctcattctttttaatagctatgagtgttctattattcaatgaaaaacaatttgttttaccagtgcatggctgatagacagctaggtagcttcattattttgttattataaacaatgaggtaataaatatcatctaacagtaagttgttgagtaaaggatatgaatgtcaaattttgataggtatcgccagactgcctctaaaagtgtagtattaatttatatgccaacaaataatatacgattttcaacttcctcacactcttgtaatagttacatatacctcgacatttgactttttccattctgataggtaaacaattttatttttaaattttgtgtttcttcaattataaggttaagcatcttcttatatgtttattggatatttgaatttatttttacataaaatccctttttatttattttgctttttttgttgttgttgtttaggcagtttgctctttcaaaaaattatctgcaaatgaagaatgttattgttccttcttaggtaactattacaaatattcttagtttgttatttgtactgttgtattttaacttttctttcgtacattatttcatatcatagatagagtgaatttttaaacatttagtgaagtcttatttaatttccttttcttttttggctcttaagttttagattatattttctcttcaccaatctatttaacaaattacccatgttttcctgtagcaaactatagtttaatctttagccatttaatccttaatcaattggaatatactttaatgtttgatgtgagaaccaagtgaacagccacaatttcttggacgtttcctttacagcataagatttctacatgtttcatcattctagtcatcctctgaattttttttcagtgcattaagaaaactgcatggaaaaatgggaaggaacaaaggatttgcagttagacaaaacgggttaaatctcaagtctacctaggtttcctaggtaacctggggaagtcacttaacttctttgaaccttagcttccttttctataaaatgagtatacctacctacctacctacctatcagggctgttgcaggtataaacaggcattcagcaaatagtatctattattattgttttagcatttcttcaaagagctgtgattataagtgatgaaataaaatctaatagaaattaaccaacacagagtgcaatatattagttacttcatgctttttttaaaaagaggaacacaacattttaggagtagaagagccttagaaacttgtttgtctagcacttatacattagagatgaaccccgtaaaggaagggactggcccaaagtcatactgaagttagcatagggataggaccagccaagcgctcctcttgccaagcccagagttctttctagtttagcagatgtgctctaatatgtgagtttgtttctttttcactggaccaataataaaatcttgttcattttaggcccaaatctacatgggcctctgcatttttggagaggtttgttgctgctgttatcctgaaaaatatcatattgcccttgttcctgttgatttcttccctggttttagcaaacatgttcttctccagtctttcaaacttttcaagatcactttgattcttatttctatccctgaggtttgagtttttatcagtaaaccttgaacaaataacattttcaagtattcacagtttacatcattgatatgacattttaaaataccaagtgtgacacagcctcatatatttactattggttttttttttttttttttttttttttgcttcagtttgaactttttcacctggatgcatggattctgagagttctatttagagtcctctcctctccaagaaaaattcttttcttgaagcatacattctcaaagattggatgccattaattattgttgagattaataataataattgttaacattaattgagcatcaggtatgtacatcagagatagttatatattatttcatttaatcctcaggagggtgggattatttttcccattttactgataagaaaactaggctcagagactcactgacttactcaaatttatatggtggaaagaggctaaggatctaaaataatgtaactaatactcctgagttcctaactaccaatttacactgtaatttaatatcctgtctaattccgagggtctacgcctacaagattctagttctgaaacctgtctttcaagggcataagtcaagctccctgagactggcagcagatgattgggtgtgttttgccactctgctctgtggtggtccaaaagcaacctgatctagaaattatggcccaacttataatgattagatcatgtagggctaaagcaaaaggcattgtcaagctagaacaatttcatttattgctacctctttatgtatatgacttttattggatcattaaaatatttatattccggccaggcgcggtgctcacgcctgtaatcccagcactttgggaggccgaggtgggcagatcataaggtcaggagattgagaccatcctggctaacatggcgaaaccccgtctctactaaaaatacaaaaaaaaattagccaggtgtggtggcagtcacctgtagtcccagctacttgggaggctgaggcaggagaatggcgtgaacatgggaggcagagcttgcagtgagctgagatcgtgccactgcactccagcctgggggacagagtgagactctttataagaaaaaaaatatctatatctatatctatatctatatatctatatctatatctatctatttgggtaagttccttaatcatacacatatatattccatatgttttggcatccttttcacaataatattggtaatgaatagaaatttgagcacttttagttgacttctagttgtgttgctgctgctgtttttcacatcttaatgtgaagatgagtggtttaccattcccaaggtcaaattttttttctttttgtttttaagagatgatcattatatttgctacttctcccactaggggcatttattccttgaataaatgatgattctctggaaatatttgtctatttcttagtgctatagaatgaatgatatcagaatcagaggatttcaaaaatggaggaagtcttgtgatcttcttcaaccccaatttatatcattaggctgattcaaacacattcttatacccttgtccctcaccatgttgaccttttaaaatttctctgattcagccatttctgcatttatgcacatgctattttccatatctagaacatagcttctcactctttcctcatctggaaaacttcttctagttcttaaagactcaattcaaactgagttgtgtaatgtatctatttataagctccttaaaagtcagatctctgcttattggaacttgtgttcctggcatagggtcaggcaaataataggtgcaaaagaataaaagaggattgtgagtgaataagtgagtggatgagtgaataatattttctcactgcattatcctaggcaaatgatcatctaacctccatgtgacactggatcaacactaatgaagaactcactgcctttcaggaaaatccattctgtttgggtcagctccagtgattaaaacaaacaaatgaaaaaaaccaaaacagttctttgtgttgaatctttctttccacctcttggcttcagttctgccctctgatggctcacaaaacaatatcatttcttcttctatatgatcctaatatttgaacacatttttcacttttccagggagtgatcccactcccttccgcatcccttcatatcattctcaccaagtgaccatttgcttgtgcttgcatacctcctgtgtcagggaattctccttccctagtttctaaattctattttttgttatctcttatgggtgttatttccagcatcttgatataatgtaatatctcattagagactcagataagtgattgtgagatcaaatatggcaatatggatgcttaccctatggttcactgtactatcttttaatgtgtgcctaccgtagtgcctagagataaacacagtattgaaatatatttgttttttaaaaagtatccacttagttatttcactttccagtttaagggaagaatgaactagagtgacacatagccattgtcaagcaatgtgctgttcattgcaggacagtgacagctaaacacatgattaaatgctgggcggtaagtgctagcacaaaaaaagtcagaattctgtggcgtacagaggaggcattcctaccaagggatgaggaggaatgagctttcctggagaaagtgacattgagatgaggtcatgaatgttagcaaggtgaggatgggtggaggttctcacagagggggagattggggtgaggagaccagtggcaagagtattcaaggcagaaagggaggcacatatggagggctggaggtgagagagggcctgcacatctgaagaacaggaagcagttgttactgaagggtagatacgggaggaacaaatgtgagaaagaagtgatgaaggaaaagaagaagaagaagaagaagaagaagatgatgatgatggtgatgatggtagctgacatgtacataacacttaatatgtgccaggcactgttataagcatttgatatacagaaattcccttagccctcataacaactgtgtgaagtaagaacacacaacaatccccattttacagaggtggtaactgaggcacagattaagtaacttgtccgagggtacattgctaacatatgacaaagtcaggaatgaaacccaggcagtgtggtttaagtgtctgcattctttttttttttgttttgtttttgtttttgttttttgagacaaaatctctctcttttctcccagactggagtgcagtggtgctatctcgctcactgcaagcttcgccttctgggttcatgccattctcctgcctcagcctcccgagtagctgggactacaggcactcgccaccatgcccagctaattttatgtatttttagtagagatggggtttcactgtattagccaggatggtctcgatctcctgaccttgtgatccgcccgcctcggcctcccaaagtgctgggaatacaggcgtgagccactgcacccggccgcgtttgcattcttaaccatgacatagcctctcaaggatctggtgatccagggcatgataagccattttagtatatttgaccataatgaggagtcattcctcagcttaaaattgagaaatattattttaacgtcattcttgtgccccaggagtgcttacaggtagagagaatgcacaggaagggaatatgcaggaagcatgtgcttatggccagcctggctacaggactctgaggttggatggacccccttggagatgctgcttagaaggcagagcaaatgctcatggctgccaaggttttccaccacagctcatgtcatctgcctgctctgaaagcagtgtcctgggaagaatactgggtttagacccgggaaggccaggattcaaatcttggtcccttcccttaccagctctatgactttgggtaagttccttaatctctttgaacttgtttcctcatatgcatcaaaagatgtgaacccttcttttgttaggctgttatcaggattattagagtttaagcaaataaaatgcttaaaataatatttggtacatggtaggtacttactaaatagttgctatgtgtattatagcatatccattatctatgtgaccaggacttttaactggcttttattagcaataataaaaccaaagaatatgtttggtagaagactatcttaggataaaagtaggtaagaactacaaatttaacagaattattaactgtgaaaaaaatacaaaggagtaaccaaatgggaaaaggctagataattggcaccacatttcaattaaaatgagacaggtacagaacacaggggactgtttcaagccaataatttcacagttgggggtctgggtgcaaggtggcagggggcagcagggaagaaattggtgtaggatccaaactatctctactttattcagagagaccatggataggaagatgaacagatgtattacagtgtattaaatacatgtagaaggctcccgttctttttcaagagggaaaaaaatctattttcatttttcctgaagtgatgagatgcaacgaagtgaaaatgtaagttctgttgccaactctgccatcaacttattcaagccagctaaggagctgctctgaaaaatgaaggtgctgggccacaccatctctagggtcccctgtgttgtaaatttaattatttctatggcttaaaaataacatctcaaaagtatttcacagttagtaaactgcttccccacctcacatttgttactgaacaaggtgatacataaactaacaaatagaataaacaaattcacatgtattaaatgatcttaccacatacttatgtgggtaacagggaaactacagatatcacattcaatgttgaattgtgagcagtctgatggctggcatagaacatagatagggagaaagaaaaaatgctgccagcagaagtagaccttgaatgccagggcaagaagttttgtcaataagtggctatggaagggttttacagaagcatttaacacaattggacctgtgtttatgggagaacaactctggcaacagtgagaaactggggttaatgaattaagtgaggacagggtaggaagtatcccagtagataatcggatgtgatactattgaagtgttaccaatgatacaaataattaaggcccaaattaggcaaatgagggtggatttgagggtgggagatgtggcacaaatttgagagaggaaaacagaggaagattctatgcagctattctcctcaaatacttctggaagccaaacagagtttaaataatatttactgtgttgagcagattgaaaatgggaaatggggaaggtgtcaaaaagctttaggatgattggaggtgtgatgataccattaatcaagacaggaacacaggatggagagtgggtttgggtgggaggataatgtattttgttttagacatgttgactttgctatgtctgttggatatctacagttttgcagacagttagaaaatatctacctgaagcttagagaagtggccaatgttcaaaatcattttagatttcatattcctgtggtcagtaccctggtcaaattagacacagatgtagaagaagcttgatatacaagatggggataataagagtaccacatcacagagttgctgtaaggttagattagttaatacatgtaaagcatttagaacagtgcctggcatctagtaagggcatataattattagctattgttgaaccctctcctgacgtacacaaagaggatgacttgggagagtataaaattatctcaatgcaggctcatttgaccagggaaaagtgctagggttgaaggcactgaaacagaaaagcacaatcctaggagtcaggagtgctgagttccagtcatgctgttagcttatttgactttgagaagccccttcatctctctgggcctcagtttctttatctagaaagagagcctcatactaaatcacagaggtaccgtctaatgcttaataaacaaatatattctatgctcaaaatgtattttgttgacaacttgagacaaacagatcattatgcattaaatttttcaaataccctccagcatgtttcagagtgagtgaactataaattgtatttgaagtggaaatttctaattaagttcccttcccctcctggaggctgttatactttgtggagagtggtaatatttctgacagtatatgcattacagctcaagactagaatccttctggagcagaggcaaagtgaaaaattgatattgaatatttatgtatcttagcagttaaacattaacttccctttaaatttggattcctgatgcaaaaacaggcttatagttaaaaaaaattagacctttaaaaatgttttggattaccaggtcatttctagagggatgattattttggaatctttaaatgaaaataataaagtataacttggctgtccaaacccagcttattaaaggctgaaagacagtaagatctagaattcatgcatttcaagtaaaaagttaactatctttataagaatatataagcaaaaaatagttgaaaccttatacaaatattatacaaacacaagctgatactagtatctccaagctctgatttttacattaactccagacttgaaatctatctgcttacttgacatctgcagatagatgtgtaagacttttcaaactcatcgtgctcaaaatcaaactcaaaatttctcccaaacatgtttctcgagagttttctcattttcagcaaacagtactaccaccattctcctctcaaaccactgaatcaagaacctccattcatttcttaccctcccacctccccatgcaatcccttagttcatagccatattctaattccatgcattttctctaactccaccccatccctctaggccaagctatcattttccctgggaatactacagtagcctcgatgggtccctccattgtctctgtggcccactcctcccaccctcctctatccccttttgactcggcagccagaatgatctcaaactctgtatcagatcatgcctctcctctgctaaaatctttcttttggctccttgttagactttgaatgaaattcaaactcctttcctcgggctctgcctatccctcttattccatcttattccactctgtcttctttactgtttgctggccacaagggccttcattctgttttgcatcagtccaagtttcctccagtcttacagcatttatgccagtggtccctttgactggagtgctcttacctagcttttctcatctttgacaacttattttcataagctcaaatgccaattcctcaaagagctctttgctgacaatcacattgaaagtagcctcccagcctatctctaattcatctggttttactttcttacagaatttaggcccacatgttattctgtttattatctcacccaccccgagaaaagcttcccataagtagagaccttgagtgtctcttttaactccatacttttagtgctgactacactatgtagatattcaacaatattccttaaactaatgaatggttataactattaaatcacataactttatttaaatcattaaaatttatttgacaaccagttactgtgcacttgttataagccaggtactaattagagtccttttcagaaggcatttgtcctctagggggagaatggttgatgaaactgaactcactgaatcagcatctttgagggtgaggcccaagactttttttttttctttttttgagacagggtcttactctgttgctcaggctagatagcagtgacatgacatgcaccattatgcctcgctaattaaaaaaaaaattgtagagcaaccaatatgttccttgaagcaccaatatgtcttaaatgtccttgcaaacattgttaaacaaccacctccacttcatccaagcctctaaattgttcaggcagtgtcagactctgggctgaaggctaaattcctacccttcaagatctgctttgtggcttctcaactcacccaccaaatgttctatcctgagatgagatgtgtgtgtgctgctaggctgacagattccctttggttagggttaaatttgaagctgagatcctttctctggtggatggtggtaagaaaaaagccttctgaatttgctcaacatgttctcccttttgaaatcagtggactaactgaaagtgctctattattctttatttaaacttagtttttttgtgatttctgggtttcaggtattaaaatatcactatttaatctactgttaaaacactatcaataataaattgattaaatagataatgaactattcatataatggaatactatgcagtcattaaaagcaacagcatacatgtctaatattttgaaactaaaaaaaagtcattatctattgctaaattaaagaaaagcaagctgtagaactatatgtgtatctagtttgtttgtttcaaaaaaagaaaaggatgaatgatcttatagagaatgcctgcaaggttacacagtgaattgataacagaggctttaaggggctatggtattgtggtggggaggggagaaatgctgaagaggagagaatgggttacatttcattttatagcccttaacagtatgtgaatatttttaagtaaatatgttgtatcataacaattttaaaagtcatacaaaaaagttttaactactgaatttgaggtttgtgttaccttagcaataaaaggcaaaaggggttatgtaggcaaatttaaaatatgataatatttatagaaaacatgagtcctagggtaatcaaattttcaaacattgcattaatccattcaatacatatttactgaatgccttctttgtgccagtcattgtgctatttttgggggatggattggtgaagaaagcaatggttcagccctaagtgacttagaatctaacagtagttctcaactgggtatgaaaaggtgtctatttgtgaggggggatggtattttctgttgttaaaatgtccaagtcaggagtcagcattggcattaattgtagaaggctcatgtgtgttaaatgttttgcaaaccgtggcacaatcaggcatagtgaaaaaatgtccttccaaaggtgcaataacacctgcaaaaggaaatactgaatcaataccatttttcacataaatgccctaattcccagtgaaccttattattttgttcaaacaagttcagttggctaagttctgggtcaaagttattaactaggaatttgtctaaatagtatacagatttgaaagcaataaggatgttcatttctacatatcctataatattcactaatttggtttagtttacataaactaatctgagtgagattgtaatgtaagtgaaaagggttcttgtttccttttttcctcatacacaattaatcttgttcataagctttggaatcaattttaaaggaaggaataatgctgcctccagagacatatctgtcaaacagtccactcctaaaacatctgaaaggcttgagcaggaataatatattaatggaattaatcttggtcaaaatctgttaatgcaaaactcaaactctggctgctgcatgtgggactcatctgatgtttttttcatcgtagttcctcaagttgatgacattcttttgtgtttgggcttatgtgtatcttggcatctggctgttgcccataattacatcttagtatttctttgacttattcctcatctaaaaataaggtaatcatctcattgcctaaaagctcccaagaaacaggttttgtgagtttaggcaaactgtgtcaagaactcttaagtcccctcttcccaattactttcatcaaatcttcccaattgcaatcagtcaaatctttttgggaagtcaaaatcttcccaactgcaatcagtcaaatcaagaggaggagatctgaataaacagagatgcatgaaaatcaacttgtattcaccactatgaatgagaaataatatttattaaactatttctcttcaaaatatctgttgcttttgttttttcctttctaatttactatgctagttctaagcattgatctgaactattgaaacaggccctgtttcctgtttattttgaaaaatttcaaattatagaaaacttgaagaacattataataaaaactcataaagattcaacagttcttaacattttggtacatttgttctccctctcttcctccttctcactctctccacttacctacctatctgcctagcagaagacacacacacacacacacacacacacacagacacacactttttctgaaccatttgaattatgttgcagacgtcattccactttcaatctaacatatcagcaaggcatcttcccagtgtaaagacattttctgtataaccacaatgccattattactccagagaaagcaaacaaaactaatatttctataacatttaatatattgcacctattcaaatttcctccgttatcctccaaatgtcttttacagatttttttcttaaatccaggatttaagttttatgcattgcatttggttgttactatgtctttagtcattattagtcttgaacattacctacatttttctttaaataaaatttactctttttttaaaaataatttcagtcagatgcttatagagtgttctgcattttgaatttgtctgattgtttcttcagaatcaggtgaaacatttttagcaaaatccagtgtgtaatgaatgctgtgtatttcttactgcgtcatagcaggaagctcaaaatacatggaccaccagatctcttcatttaaaaggcacctttctattttgcaaataacaatctataaggtggtttatttgagaccatgtaaatatcctttttccagtcaactttaacccctaattgttttagcatctatggattatgctttcttgaaatagttattttgtagcgggttaaaaaatggttattttataaattctttatttattctagaattattagctggtattattttgtgcaggagagcttctcccatatatatatataatttttctctatcattctggatttatttttgatatatcatgacataattttttatatatcatattagaatgtttttgatatataatattgttctttttgatatatcatatatttggttttttgatatagcatgatattatatctcattaccatgtggtagacttctaattgatgttagcttttcctctaatctctgtctctctcccatcctccctctcccttttgtctactctcaataccttgatagtcatcttgtatatcacaaccactctacttttctttaaatactgcctttcacattttatacatgccacagatgctcatattcatctgtgttcctaactgcttgtaaattatgtgcaaatttcttagccctatatttaagccctttcacaatgcagcttttaccacaaccctctctagtctttttaagaccagatacttctctgatatgagggaacgttagagtggattctgtctagtcctcccatatcattggtggaaaaagtgaggcacagagaatgaagttattttccaaggtcactcagtgtatttgtagtagagtccagatgagaatgctagagttcaatgtcctacattacacgcctcctctcctaagcaaaccctctgctgctgctagaagcttcatgtccatccctagcctaatgttattcccttgggcctaacttcctcctccttgttttacttcctgttttcctggattctttgaagtcttggccttctcccttgtccaggtcaggttctatcttcccagacctcctgtaatcatgatggtccgtgacacttacttggccatcagccccacaacctggcagcattacatgaattttggtccttctttactcttttattattatttttcaggtgagcagtaatgcaagctcattttaaacaactaaaacaatacaaaaaaacagcaagtaaactgtgaacatctttctatcttaaccttcaggtaaccactgataataaactagacaaattaactctatacactttctctacacatatttacatatccccagctacattcccaatgtctaggatagtgcctggttcctgtcagtgagtgaatatatgtgagtggaaaaacattcatgtttacctccatatatagtcattgttttaaagaatgatcccataataacacacgatgttctgtgatttgctttctttttctatttacctttttaatgaataaatatcaataactagactgtaagccccacgagggcagtcccagccactgtttcaggcttcttgttttcccaggatgtggcacaaatcgatgtcctcatacattattactgagggtgactacagctttacgtgcttgatgaatctcttcctcaactctgaagaagccttaaggttcacaaagactcctgttcctctaaagaggaattattaatcagctcaccaaggatttcatggccaatttcagtgtctaatagtgaaaacgatgtaaactagaaaagaaagtataagcgaggagaataatatagcagacaagcaggaccctagaaggtggcaaccaactttgccaccttgaaaggcataattctctatactggagctgccatcttgaatgtggacttttgtgggaagtattaggcagaccacataaatacagccttaactccaagcattactgatttcaaaaaatgcttctagacatttgggaaaactagaagcagcaacagaatcatttcaaaactctcctgaaaagacaaactccatacaataaggagtgagaaagagtgaccatcgtctggaatcatctctccttcatcactttcctttgttctctgaagcatatatcaagacttcataaaagcagtcaaggctgtgctgaatctttcactatcagtcccaagtggatattataagcatcagaaaaattttccatttacacaggcagggaggtattttcagtaatttatatcttttctaattactaaccaattctctctttccagcctcccaatttagcacatagaattgctgctccctgcagaaaacaactctccagcaaggtgtgagtttccatggttagttgccagagcttcagatgtgaacggagctgcaaagccacaatccattcagtagataaaaacatcaagaaataaagttccactgcattcgttcagttcctagcacaaagtgaatgctcagtaaataataggaaggaggggaaaagcgaatcaggagaacagaaaagaaaaggagagagggaataaagggagaagaaatcaaggcaattgactttcaaactgtttgtgaccaagaatttaactgtggaaggagatcactaataaagataatactagttactgaatactgaacaagagggtattgtgttaggcttgttattgttaatcctcccaagaactttgctgaggtcaactttaagatgggaaaactgaggcacagaaagattagatgcttcgaaagtagcagagctaacataagagatacggtctgtgtggtgcacacactgtgtcctttctcccctacttaatcttccctcttctcttataatacctgctgtctccagccttaggtctgcaggtaacactcctatctttgacagtcatcaatgttgctatgtgcttccaaatctacttctgctccccacgcatacacattcccttccccataatatcacatgccttctaacagcagcctcgtgccggtcatcacaatgggccactttgcttttccatctcagtaaacagccccctccaggcatactgtagtcttggtgtctacaggctgtttccctgtttctttagggcaagcttggtcagtgcagggaccagctttcctcaacagctctgccactttgggtattagagagcacaacaatctcccagagcattttaacgtcaaacccttttaatattcctgtggccaagttcagtgccttctcacccagctccttccttgaattatgcttcagcctatattggggccagttctgtgagaggctggctgcaggttctgatcagcggtgggctctgccacatcttgtgagaccaagaggcattaagtcagtaagcacaagggcagcagtcatccagaaggggaagaagcactggaggctgcctgaaacagaggacctggaactctcaaactccattcactgcactaacagttgccagcaacagaataaaatatatgtgactagcccttgctgttcttggcacgaggagttccatgaaacccagacatataattctgcattctttaaatcatcatcctctatcttttccctttccaagtttgcattgcatgcagtttcctgttgcattgttttctcttttgtcaaactcctaccacctggaaaagttgccatgtacactgcactgtacaccgtacaccatacactgcacactgcactgtaaaggtgtggtcccttgattctcattttttttcctctctattataccctcaccctttcctcccattctcccctgcagggtctcacctctgtgatcctctcctgatctgtctctctgcatctgtgactagattcccttcacttcttccttccttacctttcctctgcggctgggctgtgtctatttcctcctcctgcagctggtctcacttgctttttcttaccacctccctctgagtgatctgcctctactttcctgctgcatcctctcttctcttctctggttgatttatcgtgctttattgggaagacagcctatgactggctgtttaccacctaatttctggaattgtgttatccttttgaagtccaaactgatgtgctgtgaaagtctcataattagacttataaaaataaatctttctcattccaccatcaatacaactaaaacactgggttagctgtcaaatacaggcaagccagaggagcttgctcctgaaaactaaaatagcaaaattatctgtgctagcatttggaaatgctatcttaggctgtgttgcttatacataatgctctgtgactctaagtcaaggacaagcctcaagttagggtttttccatgtagggcttctggagaaactccttaggatttataggtctctggagcttcttcaaaatccacttgttcctgtctactatagagacctgctacatatcaaagaaccaagtgaatgttcaacccccttcttaacaccatcattataaactgaatgttctaaattctatatttgctcctgaactgacccttagtccttgcctagaaccagtcagtcaacaatagctcaactttgggcttttgggtatgtatgtagctcaaggtttatatcatctgcattgtaacctccatttcttacccatcctttgccaatattttcttccctcttaaaagtatgaaataagtactgaaatgtttcaatttttgtatggccctaagatacaaaatacgggttgaagaagcactaaggggaaaattcacatttggagatgtgaaaaccatgaatattatattagaagacagatgcatgcatgccatccatttgcagagaatgcatcattgctaaatattgcttctcttcaaagttatgcataatgagaaagtcaggtaaaccaggaaaaagtatggatttttggatgaataggagactaagcaaataactatgcataaaaagcataaatcactcaccaacaaattgtataaactacaatgtgttttccaggataaagtgtgtgaaggtatctgttgtatgaatacaaattcacccttcttttctttctttttcaggcttgtgagtgtttgacaatgtaaattattcttcctgagaacaagtccacctgaggattagtgaatgggtgtgattttcaaccaaaaaaacttgtatttagctgccttctttctcacacctataagttcctggctaatgttgatatttatcaaatgctgtgtgcaataaaaacaagtatttccctaaagaaagtaaattgtgctgcaattgtttatgtgtgtgtgtgtatgtatacatgtatatatgctgtgtataaaaatataaataattttggtaattattgatgagtagataataccttagcacatttatgttcctaaaggaagaaaaatccagggataggtatattttcaagaaggcttggtagatttggctctggcttgtgtcatcatttagctttggaattttgtactttagttcctttgtttattaaataaacaacaaacaaacaaatattgtacaagaggaactctggtattccattcggagttatgattctgtgattctatcttgtggttttaaaatacctacatactgtaagatgtttgattctgcaaagagctatgaacctattctgccttttcccatgcaaaagtcattcttttgtttactcatttattctagaaacatttatttgtgatttactatgtttatttatgatttacaataggttctgtgccatgtcccatggattcaaagattatttagatagcctctgttcttgaggagctcagtatatataagatgatctcctactttatagaattttttctcaaagacctaactgtagaaagtcaagctttctatgcaaataactcaatatgtacccataactccaagtcctgacgctaactggtattgtattttggagaagtggtttatcttctgtgttaaatctctgaggtagtgtaatagaagggaaagagtgtgggttttgtccagcagactcaggattggaattttgactctgtacatctattaagtgatgataggaatatctacttcaaaatggttgcagagttatattgagaactgaataaggtgatgcagatgaaaacccactcaatgaatggtagcttttgcttttactatgggaaattgaagaatacttctgctttgtttaagcacccttttcaaatcagtaaaccaataaattcattttttctggactaaattctttgaagactcttttcttagtataatctatggctgtaacctctatgcaagagtctgtattaggttgaaccacacaaaattgacaatattcaacttgacctacagaaatggcaacttcatatggttcagcctaataacattattaatatcactaaaagaaaattttaatttctactttttaatgtaaatagcatgtacaatttcaatttttttctagaagagtatttcctcactaaaaagtatgtttagtgtgtaaaattcacgacatttgctgttttgattaagaaaaataatgttaaaataaatcttcctggttctttttcccaaaatagttttaggaagtttaaatttgagttaaatgttgtgaaaattttagcctcaggaaatgtgaaaagggacattaaagtcttatgtattgttggctatcagggaaaagagtaaatctttgaccattctaaaagaacaacattggagttgtcagctaatgagctgaaagttgttctgtgatatattactgagcaaaagattagaggaaactagtataacagagagaaagagaaagagagccctattttttcccctgctgtatatgtggcagagactgaggactgggagtgtgtagaagtgtgagagaaaaatgtgggagaagtgtttaaagtgttccaaggaaactaaaatgaagacaagaatatgtatgctggggttcaggttttcaaaacaagctagcttctacctagaacttgtcatcaacaccctttactagtagcttttgaacttccatctgtctactgagctggaaacactcttcttcgtagccacatgtcatgctgccacccttgccttgggaagctcaattcaaatcctacttctcctatgaaattctccccagttacagggcattttctagaagaactgttatttcctctatccttaacactaaagcaaaatacttctatgtcttccaactctcccatcccaagtgttttatagatggtttgtggttgtgtttaacagtaatagatgggctaagaaatatatttgtccatctgatatggcctcaagactatctagtccacatttattgaacatctacaatgtgccaggggctgtgtcatgtcatgtactgaaatcaataaaaataagacttgggtttggtatgaagaagatcacagccttatgtagccatttttgagatgtataaatgaataatcctatgaagcacttatgatgtttctgaaattctttcctcataaggtttactgggaatcctataatcccaccatttgagattcactgttttggtcttaaacttagtagatatactgtgaaaatctcgatatagttagttaaaataatgctttgcctgtttcctaacattcaacctcagtgtgaactccttcatctgatttctttcactgaaggacagacaagaaagagcatgaggacactagacccctaggtaccatagagtgtgaggagggaccagaattgtgggaaatgtacttgaggtcagcttttatctggcaggagttgcacaatgttacagagttgaggagatgggatgatgaccagaaggccaatgcccattcctcttagagttgaagctcattcttagagccttgagcactgggactgttggtggcactgtcaaagaaggcaggaccacttgctttgtgtcaggcaccatgatgggtgctctataccccttggcacatttaacccccataacaatcctttgaagcaggagtcattggctccattttataaataagaagactcagtttggggaagctaagtacttgtccaaagtttgcacatctagttgatagtaaagcagggttcaagcctcttgctggttccaaagccatactttttcatcttcttaacctttgagaaataaaggaatccagttaccctcaaaaggcaggtactacttcaagggaaatacttttgaatgcaagtccatttgaggaccagcctcgtgccgtatcagaggaagacaatttcaaagtgagaacaaatttcatttccaacattttcaagagcagaaacaaagattgtttataggatcctctgagatttgataaaaaaattccatcctttgcaggaatgctttctcccaagccctctaaatgcctgcagatggtcagctggctcctgcttgagtaactacaatgcagtgacacaaggccttttcactccacccacagtgcttagcacagtgaacagacacattaagtcctcagtaacatcagaaaatggagactgagtaaggttgagtgacttgttcaagatcagttaggcgatacatggtttagtatttaaaactaaacctgttacgaactcttgcttttagatgatgcctcttttggttctaatggcattttctagggcaacacaaataagtctaccttcatttctgcagaatggtcttgcaagtgctttatcaacaaaaacaacagcagcagcagcaacaacaacaaaaataacagccaacatttatcaaatccttccaggtgcgaaatgttacactaaacaccacatgtattatcaatttctcctcataacagccctatacgtagacacagtcatcattttattgataagaaaactgaggcacagagaagttaaataaattgccgaaattcacaattacaaacaacagagtcaggatgcagactcacttttttttctttatgtgcacttttatttttacattgtagagaaagtaatgacttctaaaaagagtatgtaaatgagtataatataagcccatcagaccaaaaaaatattagaacgtatttaaaagaatcaggatttctataaaacaataaacacctagatcatacattcttttggaccaaatggcaagtgcatatacatacaaggcaagtactggcacatcagacgtatcaaaaacaccttctttgatgcaatcgcttaggaattgtaaaaaataagtatcattcagcatctggatgctaataataaaagcgatagaggctaaataaacagggccgttactctactccctttcctatttcctatttttaggaattcaagtttattcaaaaggtttatatataatcccaaaactgctatttctcttcttctataatttcagaatgatagctttacacaactttaaagcttgagcttcttctgaattcccaaagtgtttctgtgctcctttacaaatgggccacatcttcaagggtcagctttacctgtgtaaggtctgcaagaccattctctctcagatacgaggaacactgaagaatacatcattcattccatagaggcccttaattatgtggaaactgaatgcgctctcctaggattctctaaaatgctttctgttcaatctgttacagatgggccaatggcccaagaagtataacctttcattttcataatttcataagcactggcaatcacttctttgtggacattttcccccttgctctagatcttgatcaattcctttatctgagtttagatccttcagagggacaccagcaatgttcactccactccacacaggaacacttgagtccccatgctctccaaagatccacccatggcagcttccagagtggattccaagcacttgcacagtcaagaaatggaaatgggcagtgtccagattacagccatttccaataatatgggttttgaaaaatgtactcaatttctaagctacataaattaagatatccactggactggaaactatcaatttgcagcaggactatattgagtaatattagacatcattaatttaacgatggccacatttagactgactaaattaaagtgtttcacctttttcctggcatgcacctgatgtgataatcactaggttggagtttgcagagatgagataatctttgctggaagcactatctggcagttttaggaaaagactgccatgtttaagatccattgtctcacacccttcaattcaccattatcaacagctacaaaggcaacttcatccctcaagtcttttaataacatggtgattgcacgggccatgctaactgatccagttcttataatggagaccttactgtggtgaataacctcctctgaagcaaaattctcaataaattcattctggatagttaccatcacgtaaccagaggtgggaaggttggttaagggccagctgaccctgtgatgtgcgttctctgttggtgacacagatttatcctggggccaagaaaatttactcccatagtgcctacgctccagctggaccacagaactcctgcagcccaccttggggatacacacacaagaggtggatggagcagagaatggaagaaagtggtgggcaagctgcaggttgagcttgctggggcaagccgaaagaacctgtttgaatgttcagtgcctttcactttacttcagctattgcagttaccaagcaaggccatgcttagctccctgcacacaggcctcatgggggcctctggaaagtgcttctgatgtctgctcagattaaagcagtaaaaaggcttcttctttagctctgtgtgaatcctggagaatacaaacaagtattctcttcaatatctgacatggataagaggccaacccagatctctggaattactcatttcctgtttttagtaggtatgccaagtcggacccactctggctcctgagcctatagcttaagcatcactgtgtctaattccctctctttctctctccttctttgggacatttcactttgcccttcaccctctaatatatcatgtccaggaaccttaatcctattctgtggcttcttgatatctttataaaaatgcagcaactagagtggaacatatagcttagatagagtctaaccagtgtggagacagaaggatgtctccttcccacattccaggactacatttccgtaaataggctccagcctattagcctattggcagcatcatcagatggctacctaaaaccacaagatcttcttttaaggagctgttgccatatgtctccattctaaactggtacaattaattttggaacctgtattttcccagactgtctgtcttagcagagaattttgtatgcctggtaaatgtaagtagttaataagtatttataggatttgtgtcaatattttgctaccttatggctacttactagcttaatgcctctgaacctcagttttttttcactggaaaatgggaaaatagtatattccctggtagtgctacaggaggttcatatgagataatacatgcagtgtaaggtgatgttattatcacagagaatctaggtttgaattccacactagaaaggtaattataactactaaacccataatcacagaaaccacagcctacaggtcctataactatcccaaacataagattatatgcccagatttcaatcagaaaacattttacaattcctttcccccaaaggatgttcaacgtttgctttcattgccctctagtggttgctatacaaaagatataactacattttgtttgtttctcattttgatttttgagatgtcagacacaatatcttataaatattcttcaagtttggttaggttacacacattcctgtcagctggaaacctttaaataatcagcctatagggacagtacctaacattgtgtcctgcgcaatacaggtgtatactgcccatgcattgttggccatgcatttattttactagatctttactcagaatctactgacttaaaatagtaatctagcttcattcattcattatatatttataagatatattatatgtcaggtaaacaagacaagcattgtcctggcttacaatagagtaaggaaaatggagtactaaacatgtctttaaaaattaacatggtaagtgctgtcataggaagagtatgggatatacaaagcacattaagaggggtacctaacttggaggtgcttctgtgtgtttttggaaggtgaagtgggaatggcaagagaaggcatttagagaatataacaatctaagatttgaaggatgaatagaatagaagagttattcagaagaaggtggggtggggaaagttttcaggagaggatacaatgtcagatatagttacatgacagagaaaagactgacttttagagatatggctggacaagttaagagaagctatatcgaggaattgagactttatttggatggttaagttataaccaatggactctgaaaaaagtatgaatgtatgcctttaattttaatttctgattttaaaacttttattatttaaagggaagtcttaggctgggtgaggtggttcacacctgtgatcccagtgctttgagaggctgaggtgggaggactgcttgaggccaagagttgaaaaacagcctgggcaacatggtgagacccagtatcttagaaatattttaaaaattagctgtgtatggtgatgcatgttcatagtcctagctatttgagaagttgaggtgagaggattgcgtgagcccaggagctcaaaggtttagtgagctatgattgtgctactgcacaatctagcagcagtgagaccctgtctctaattaaaaaataaataaataaaataaagggaagtctttattcataactaacatacgtttagtcataactaataaaaaattaattgttcaaaaacccttcagtgcatcctttttatcacacaaagttctctcaaacacatacattcctagcatattggagctggaagggcctttaaagatcctgagtctccgtcttttcactttacagaggagtgagaagatcaggagtttgttcaggttgtcctgagtaactgaattgttgctcctgggagctatttgcttttcctagcctagcccagtgcttaaactcctcatcccgtttattcagaggccaaatagtctcctgcatctggtgtcttgttggtctgggctgttgataattcttgagcactcctgcttttcaaaacttctgcattggacttcatgttcttcctttgtggcctgatgaaaaaatcgtttatcttagacttgcagtgaggatctgggaaggtctttccattaccaaggaaaacatgaatcctcctcagaatacctggtgaggttttgccttttctatggaactcccttgcctcactgtacttttcttatagtataattcggggtggacctgcttattacttctgttagactataagcatcccaaggacatgacacatggcttagtcatcattacattccacatagcaaggtgacataaacacagaagcccctatcaagttcgttgtagacagggatgagaggatacatgaataaacagaggaatggagtggaatatcttatttcctgacaggaggtttaaatctatgttagtaagggtatgaaagctatatatattttttccttcagggaaagatggtgagccacccaaggtgaaaagagaatctctgacaagcaagcaaaaattaaggttgtactctttgtcataagaaatgactatgaatatgaacgtaaaaagacattagagaagaaaagtcaggaaaaggggaaagataaatttgggtagcataagagactgcccaaaggactttaaaaccagagatacctgacgttcatttttaagtttttacatgtttatgcaaatccactgccatctttttgaggcataagtcctgtctgctacacacaaaggagatgctaaggaacacttgcttgcctttatgttagaaacagaaacagtgtgattttttctgatgttctcaattacagagtctactgactcaggtctatatgtgcctgatgatgatcacgagccccatcaacaaagggagttcccgctcagcatggaggcagaccctccgccaaatgaaagaaaaatgtaggccaggtgtagtggctcacacctgtaatcccagcactttgggaggctgaggcaggtggatcacctgaggtcaggagttcgagaccagcctggccaacatggtgaaaccccatctctactgaaaatacaaaaactagctgggcattgtggtacatgcctgtaaccccagctaactgggaggctgaggcaggagaattgcttggacctgggaggctgaggttgcagtgatccaagatcatgccactatactccagcctgggagacagagcaagactctatctcaaaaaaaaaaaaaaaaaaaaaaagaagaaaagaaaaagaaaagaaaaagaaaagaaaaatatagtcttcattcttcttaattctatcataaatctgagagtagaataataaaagtacatgaaaaactacccatagcttagtatagtttatgttacacacaaaacctgagagatataggcaataaatgttcctggaatatgttttacagcaacattggtccatcaggaaagtttccctccaggaaagattctgaacatagagaaataacaagaaatcaaattataaggaagattaactattgaccttttcctgacccctctatttctccccttcaagcaggagaattataggtcagtccaacgttgaagaaggagtaacatttctcattttgagctttctcaagaaatcttggctatcagagctcccagctgattcctagtggtttcttatgtttaaatacaggaccctcacaataataataataataataaacaaagtcacaaatgttactttcaggtttgaattccacttgaattcattgagttatattttaaaaagctatcattatgataaccagttttaatactgtgatcaaatacaatcactagtatgaaaactgggcaaaaggccacattccactagtgtctccagttcaatgcaaaatcttttactgccatcttgtggatttttaggaaataatcccagtcactacatattatttattgtcttacgggaacaataggttcataggccagtttatgaaaataactgaaaaaaagtataagaaaagagcagctaaatagtcaggtttccatctaacattatcactttgtattctctactaagcatctctgaggcttggtttcttcataaaaagttgttattataataataccatcccctgcctgtctcaaggttgccataagaataaaaattttaaattgctccataaatcaaaagtactattcagaaacaaccaattattatcaatgctatcagccacattattagaatgacgatacctaagcatttcatatgtaacaaggtaaactatggttcaggctgaaaagtccagaccttggtacctgctttcagagtgatttgtctcatcttttatggctttcagggcaagaaaatggatgtttcaaatgaaaatattccctggagatagttgttcctggggcagaaaatactgtgggcctgacaactgaggaagggaatatttccttttttactgattcactgatgagcaagtgagccccgacatttgaaaagcacagcaaatatgtagtataggaacagctttttccagtgaaaaatgctacccctgggatcctatctactgatccatatttagttattctctggtaagttattcatccaggatttctctcttccaaccaaccgacacttaaactggaaaaccaggcaataggttggctcatagatgtcacagacaacttaaaaaagaatcttctgagaatttcagggaaaaaacttagaacaaaatctccaaaagctttcctttcccattagcgaagacttcaagttctttcatctaatttattcatcacctatgaacacctgtgtgtgcctagcactgggttaggttctgggatgcaatgatgatgcagacataacgcttatgcttactgacctccatactagctggaaagttcacatctcataactcatgatatctgctgcttcaagctctgcagttgttcagaacctgagcagagaaagggccaatgctgcccttgggaatttgaaagagagaagcagctcatgtatgagcaatttgctgttagaggacgctcatcgactctccacttatgtcagctgttgagagcggtcattgcatgtggtggagtgaatggtgtcagaagtggtgatggtgatgatgaagaagataagatgatacttggaattaagaaacttattatggattttttttagatgaatggattttaaataatgtcagcgtgagaagaataagtcatagtagttgtttctttttatcaatctgccatgcattacgaccatgttcatatcttatgtctccactaagctatcagcccctgaaggtgagaacaatgtctgatatacctctctatttcctataaacactagaataatatttgacagtcatgttttcattattgaacacttataaagtgccagatacttttcaaaactcttcgaatacagcaataaacaaaataaatcaataagagatattcaataaatcaaataattaacaaataagagtcacagccatacagccaaagtgttttccacttcttccacttaatatacatgtatatgaattgctaaataaatcaccaatttccttctctctactgaatcatttccatcaacatataaacactgttacaaaaaacaaactctaccctcaagttcccattctattgcattcctctctagagcaaactcaaaggagataactcttctccttgtcattaaaagagggaatttggatggaaaggcaggaggaacttgtcgaaagatattaagtggaggagtaacatgatcaaagttgatagaatctatggagttggtgtgaaagatgaaaaaaatactgactttgaagctgggcagacctagagtccagtccttttactacagtctggtcttaaccaaattatttaacctctcagaatctcagaactttgacctgcaagataatagtaatcaaaccatttgaagttcttactaggtaggaagcacacaatatgtctctcatcctttgtcttcaattcttctccttttattctctcaggcctaggctcctcccactagaggcttctctctgaaataatttctattgtttaagaagcacttatgatccttaagatactagacctaaaacattcctcaaatagagctcagtgagccaaataatccccgatggtcatttatcatttatctacccagtgttcagatatgcttcttatttggggacaattcaagacaggaaggaggcacagccttacccccattagagaagctggagggggcagctattcccttttcccacccctcagcagctacaacagggcaagtcaagcagatgttccagttgggaatttagcatccccacactaacgtgtaaggtgcatggagaaacagagatttttcatggcagtgtggtttggctataagtggccagtggtgacagcccagcacccttagtaggaggatttcctccttggcctctgagcctggttcctcaggcttcctgaagagcttgtagactatctgttatttctccaataaattcttttttttcatataagttacctggaactgacgtctgttgtctggagtcaagaactccaggaggtaaattcaccaatcaagctcccatcaggtatattcctagagtagttagcgttagaggtaagggagcttgtcatgaaagaaggaggcctatacctagagtcaaacaggctttgagttagaaaactgttgaacccttcagtttcttcttgaataaaacagcagcatgatcactttcctacctatcctgaaggtaccctatgaggatcaaatgagataatcacagtgagatactttatacatatatatggtaatgcaaatctaagggttattagagattagctaataaaataggttattctgaggcccaaacaaattggactaaaaatcagtccactttttgactcaaaagagatttcaggagggatgatcaagtcgatgatcactccttctttaaaacttgagaactctttgcacgatttcccctttatctgtgatcagctgttataccacagtttagatgtttacatagagaagacactttgaaacttgtataggaagtccttgctacccaaattttttggaagaagagaatatgtcataaacatattttaaatgatcatcaagtatttagcatttaatatgtaatagaatagttaattaacatttttctgatctataggaattcctcttagtcaattaggaaatgatctgtctgaattggaaatatattccattggccagaaatctaaaagctttaatgtattctgaatcttcaggacagaagggattaattggccagagcgcgagatgaataaaactgagaggggtcctaggatttccaactgccttcagagaagtgggcaaagatgagtcattcattcattcattcattcattcattcgttcattaaacatttgctcagtagctccgttctaagttaatcaacaagggagcagagatgaataaaacacagtttcatcctcaagggaagcttcaaaggatctgaacgttgcttctaagtgcctcaatcttacagccttcgtatacaatggcttcctgtggtgactcatatgtctccttttaaatgctctttttttaggcatttatgcttttttcattaactagactttgagtatggactgcctcagacataagtaaactgccaaattcaattctttggtgaaggcctgcatcgcagaaagagcatagctttgaaatcagaagcaacagtattccaaataccaccatcattactgattatctgtgtgatcttggacaaattatttaatttctctgagccttcaatccaacaaggttgttaggacaattcagtgaaatcacagcgcagtatccagcaaaatgctttgtgctgagcatatattcaataaaggttaggcattttatctccaattctctactggttttgctttctaggggccctctttgttgggaagtttcccctccagaatccttcttacttccccaggctgagctaaggatggtctcttctttacgcccatgtggtccctggaacttaccgttagcatttccatgttatattggaaataatctatttatttgtctgtctcccttcatgaggctacatgttcactgaggacacaatgatttttttcacgttgcatccttagtgtctagtagcttttggtactttgtgaatgtctctgagctctgcaaacaagattttaaggtgaaaatttacttccgtcaaataaaatacttgcaagaggttttctggagattatgacagaattttcaaaaaatatgtttcacttgatagtaatttatatccaaagactaaaaaagttattttgttaaataatgttaaaaaacactttatcagcatttaaaaaatttgctgcaggacttctcagatctttcattgaattatgaaccttttttatgaagcatttcacacatccgctattatacacagttttggaagtaccactgcgagaaaagctggtgttttactggtgcactgagttaagtttcagacttttgaaagctgcttacagttaaatcctttgagtagtgatattgtgagtcaggtgttacaagtctgatgttaagtacatggttcccaatgtactattttcactgcaccttgctaagttgtgacatatagtatgtttatgacacattgaataagcaagacttaaggaatataactggaaaggagcaatgttaattttgtttccctacacagtttgctgagtgcccacagattttattgtttttctttttgttgttgttgtttttgttttttatatatacacatatatatacacacatatatatacacatatatatagacatatatatacacatatatatatacacacacacacacacacacatatatatatatatatatatttttttttttttttttttttttttttgagatggaatttcactcttgttgcccaggctggaatgcaatggcatgatcttggctcaccgcaacctccgcctcccaggttcaagcgattctcctgcctcagcatcctgagtagctgggattataggcatgcaccaccacgtccggctaattttgtatttttagtagagatggggtttctccatgttggtcaggctgatctcaaactccccacctcaggtgaactgcccaactcagcctcccagagtgctgagattacaggtgtgagccactgtgcccggcctaattactgcttttctttaacatatattatacagccggattctatgtcagacaatggggatgctgtttaagtgacgcttggggcaattcatgagttctctggtcccttttagataatggagggtttttccttgtctactccaagttccttttcgaggaaattcagtgaacaagatggaggtaggagggagctcagcacagaggggacagggctgctgctccgtccccactcagtgatatggctcttcctttttgtacaacagtgaaacacacttgtgtgtggtttgttagtaaataactgctgtcctgagccctcctgagtgacccacaactctggctccctagaagtccccactgccctgctgtctggcatctgtggcactacggccattcattgtgtggatgggtgccagggttatgccaaggtgtgaaaattttgaatagcatccctgaccataggtaaagaaaaatccagagtggctgaagcatcagtgagagtaggggaagtattgtggatggggcaggctgtccaggcaggcaggggccagactctgcaaaattctgtgggctgtgttaacaattttaggctttaagaacagcaggacaccattgaaaggctttaaagagagcaggaaaaggatatgattagataggctttttgtacagtttcctctttccaaaggctggaagtctgtatgtgatgggtgatgtttatatgcactaggcaatcatcaggaataaagaactctgcccatagtcaggccctgctgaatacccacactctggtggctgggccaggaggtacagcctggctagtggggctctgaagccaaggctgagcaagagtgactcccctggagcctcttcacaagccatatctgttttcatttgaggtggtcttgtgatcaggtgagcagtgagttctgagctgtgcaggaagaaagatccagtaaggtagggagaagtctaaatgggctctacaattaagagaggcaaaagccagaaatgactgaagagtcaatgtgtctagatgcagtgggttagagagagagagcaaatgcctggaacaagcatgctggtttggagaggcaacttccacatggtttctggaccagaactctaaatttaactggtcagatttaaggcaataagcttttacctcctcaaaaacagcatcaactccacttagttggatttcacttcaaagtttaagagtatgtcctggctgatacagtaccttgaaatttctgaaaccttactgatactttttcctgaagggagagtagtggttttgctggagtttgggtgactccaagttttgaagatgagagaagagaagctgaaggtgtggcttaggtgaaaggtttcataagatttctgatttaagctgtttcacttttggggacaaggtgaaataatagcactgagatgtggagatgagacttgtccctaacactgcataggccccagatcctctttagtatttcagagcgtgcttgtttcaggaacacacagagggagagagagtttcttaggcagagaacatcagtactgaaaactaggaaagcaaggttccttcatgggaccgggaaccagagccagagaggaacggcacggcaggtatggcatggtgactggaagggatgaggtctggcggctcatatgaggaccacttcaggaaatcgaagaaataattttggacatctttactggggatggcagtggagaggtggaagcaacaacaccagcagagatttagaaatgttatttgaggtaacaatataaggtgaccttatcagtaccccaagatggagaatagtctgtatagtgctcatattctgtttaattaacttgaaaatagagtcctggcaaatcaagtccttcccctctgcacgtttctaaacatgaagataacctgaaaatttttgaaatacccatgtcagctgtgactcatttttactctttttaaatcaacaatgcaatttaaattctaatttggaaatccagttacctattataccttcacttcgacagctgcagcatttcacttctggcaatacatattcccaatcacgtatcttgaaacacactttgttaaatacttaaagtccatatcaagaatgagctttggagttagcaagtcagctggggtgatcatttttggatgcctgaggaatgaataaactaaaattgcttggagagacaggaaataatctctttctaggggtattgcttctctgtgctctgtttcacattttttcctaacaaatcactgaaacaaataataagagaagcatttctagctttccttctgcagaaagaatgcctgaggaggcgactgcactagttaatgtgactgcatgctgaatgccctaaattctcctccatgaatacatcaagaatatggttcaattactgaattccgttctgcaacaaatccctgagaaatagaatacataaaagagaaactagaaaagatcacttataatacatgtataggatgtagcccaaggtgacaatttctttgtctttgagcatcttaaatatttaattttggaattctggtggggataaggggtaggcctggaaaaaaatccctataatggagcttcaggaccctccatcttcaggttgctaagtaatgtgttttgacaatgcatgaacactagatggcacccataaccttaaaacatagtaaaacgttacttcccttttctgtataggcaagaatgtaggaatcagtcaattatggggattataaaaattagctgggcagagtggcaggcaccagtaatctcagctacttgggaggctgaagcaggagaatcacttgaacccagaaggcagaggttgcagtgagccgagatcacgccactgtgctccagcctgtgcaacacagccagactccgtcacaaataataataacaaatctactcgagcatttcccactactggtgtcctgtaagttactccttatgtaagggtttggtggtcaaaatgtttttgaaagccatagacttcatctgctctaggagatttccaatggacacaggtaaacatgttttttagaagttcttcattgaagaagcctgtacaaatgaacctattacagtagcaacctattacaatcctgctgtttcagtgttctacgaaacacactttgggaaatgccaatctagtccaatccctgtcccaaagaaggaacagcccaaactatccaaaagaggccctccttatacatgggtatctgaacctttttaaaaaacaacagatacagtcttaaagcagagttgatagtaatagcaacacttattgaatatgtatactatgacatgctgtattttaagtgttactgtctcttctctttcttcagtgtgtgtgtatatatatatatgtgtatgtatatgtgtttatatacatatacatacatatacaatacctggcacatagtaagccattaataactaaattacctaggaatattctatagtctgtgtgtgagagtaggaatggacattctgcccctcattagaaaggttattgtctattatgcaagtctcttacctatgaagaacaattgagaccaaagacatatcctccagatcccttccctggggattctacttcctttctctgaaactactacattattgttaacatgacttatttgcaaattaatcttacatgacctattaatatgtattgaattttatttagctttttttttttttttttttgacagagtctcactctgttgcccaggctggggtgcagtggtgtgatcttggctcactgcagcctctgcctcctgggttcaaccgattctcctgactcagcctcccaagtagctgggactacaggtgcacaccacgatgcctggctaatttttgtatttttagtaaagacagggtttcaccatgttggcctggctggtctcaaactcctgacctcaggtgatctgcccgcctcagcctcccaaagtgctgggattataggcatgagccactgtgcccagctagctcttgattgttatttagagtttttgctttgcattttccaggaaggttgcttgcccctgtatgtccagtgcaagttatagatgaaaatattttatcttccatattccattattagtaattcttctgtgccattttgctttccacattgtaatgtttgagcttctcaagactgttcttttctctcaatgttaagcaattaaattccaatagtgaaccttgaagctagccattttcttatttatttatttatttatttttattattatactttaagttctagggtacatgtgcacaacatgcaggtttgttacatatgtacacatgtgccatgttggtgtgctgcaccctttaactcgtcatttacattaggtatatcccctaatgctatccctccccacttgccccaccatacgacaggccccggtgtgtgatgttcgccatcctgtgtccaagtgttctcattgttcaattcccacctatgagtgagaacatgcggtgtttcgttttctgtccttgcgatagtttgctgagaatgatggtttccagaagctagccattttctagctagctacaggtgaaatacattttgatatactaaggaaaaatgttccctcttctttctcaactgaaaaaagcagataatattttcctcatcatctgtatttgcaaatgttatacataaaaacggatatgctgtgtgaacttcaaagattgttgttatattctgtgaattataatatctaagacgactataattctgattggttgccttatttactgtgtggtcctggtaataatatttaaatggataaatctatttttgaagcagaaatacttgcgagttttctttgtcaagccatagagtatcactagatcacctttttcctctcacatgtatggaggttaaaataaataaagcctatggcttggtggattttttatttaaacagagttagagagtctaatgccatctctgtagctcaatttctttatccttaatatgaacataacaaggcatagtgttgttggaagactaaattatttatgatagtgactgactcaaaagtaccatgtaagtattagttctttattgctttatgtgttcccgaatgtgatgtgcacacagtgcggtgtgcaccaagaagatgtgccatagagactgttgacaatattttgaaaagaaagtgtgctgagaggagaaagaacactgacttgagttcagctttatagtcagtagctgtggagacatagacagatcatttagcctctccaaatctcttttcttctgatctggaaaatgggagtaataataataacctatcctgccacttagaatgccttagagaatctctagaattaatgcatgtgacagtgctttgtgtctgggaacatttaatgacgatatgaatgctgattgtaatgaaatgacaaagtggtccgcaagtatacagaatgtaagccaggatgatgaagatacgttagtatgctttaggtagaattttagaatcaatcttcaggctatagtgacttcttaatgtaccaccatatttattcaacactttttcattcgataaacacttcttttttgggagactgctatgtgccaggcattgtgctaaatattgaggatataaaatcatataagatagagaatttgctttcagagaccgtaccacctagtacagaaagacagacatgtaaacgtatatgcacaataaggtttgatagctgccagttatatcttacatatcatgaaagtattgaagaagtaggtaagggaagtagtttaaggaatgatgctcagctcttggatggcagaacaaggtcctggtgtgggactatacgctgtatctcccatactcaacatccttccagagaactgcacctgatgagtaggcagaggccttcatatgtgagaggaccacagtgacacatacgacaaggctattcatgcaaatttccggacaccttactaaagtcaactgactgtatgatgttattcaggtaaactgtgtgtgtgtgtgtgtgtatgtcagagagagagagagagagagagaaagagagagagattttcccattttttgaagggttggaatggtggctaacaaatataaggtaaattataagattctatttataaatcacagccataaaatgaaaacaaatttttctaaatgcacaatgaaaaccacaaactaagtgctttgtttagttatgaactatgaaccataatatcagccataagtactggctccttatgtaaccctccgttattattttcatgattagtaaaattaaaatataggcaggaacactcacaatggatttaccctatcatactaaggaggaagcttgacatagtagaaggagacagccaataaatatttgaataagttaaaggaaacaggaaaagaaaggaagaggaaagggaaattagaaggaagggggaaagtggcaatgagatggaagaatgaaaagagggagggaagggatatggtaggtgtaatgggcattaaaatggaatacttaaatcccagctctgactctctatagttaggtaaactttgacaagctggaagtttatcttcatttgaacatgaggcagtacctttcagagtgattgtgagaagaataaataatagttatgcaagataagtcagaggtccattgaacaatgtgtgcctatagtcaccaatactgcttgcttaaacatttgctaagatggtagatcttatgttaattgttcttataacaaaaggaaaataataataaaaaaagaagagaacaggagaaaacttttggagtgatggttgtgttatggcatagattgtggtgatggtttcatgtgtgcatacatatctccaaattcgtcataagtatgtacaactttttctacgtcaatctcatctcagtaaagtacccttgaaaattacttacaaaataatgccctttgcaccaatgcagatgccactggaggctattatcctaagcaaattaacacaggaacagaaagccaaataccacatgttcttacttataagtgggagcgaaatactggatactcatggacataaaaatagcaacaataggcactggggactcctagagtggggagggaaggaaaagggaaatgattgaaaaactactgggtactactctcactatctgggtaatgggatcaattgtatgctcaacctcagcatcacgtgatatacccatataagaaacatcgtgtgtaccgccaaatctaaaataaaagttgaaattattaaaaaggtaaaaaaaaaggtgcttaatacattgttgctgataattcttgaatttagttgaatggtgccactgctacaacttagtaccatcagcaaactctatatagcattatcttatgcatttttttgtttttacatttgcaccaaactatacacattataaaggtacagtgtttagagtatggttatgagtttgggagaaaagtctgtttttttaaataaaataagtaatatatcatttttaaaaaggcatgcttctcaacgttctgttggatgcaaatgtgtctcagaacatctagaagaaaacattagcaccttcgcctttatttgagggaagtaagtgccacaagcatcaaggacctgaacaccatttaaactgtgacatgtagaccatgcttgatggctcatgcctgtaatcccagcactttgggaggctgaggcgggtggatcacctgaggtcaggagtttgagaccagtctggacaacatggcgaaaccctgtctttacttaaaatacaaaaattagtcggatgtggcggtgggcagctataatctcagctactcaggaggctgaggcaggagaatcacctcaacccgggaggcagaggttgcagtgagctgagatcctgccactgcactccagcctgggcaacagacagagcgagattctgtctcaaaggaaacaaaaacaaaaacaaacaaaattgtgacatgcaccagaagtcgtgatgctctcatccactttcctttgtaattaaggtgcttttggtatcataattgaaagttatgactttttcattgatggcgtcagatatggagggaataaagattaaagaaacatactcaccgataggatctggtctcctctctggagctccccacttaggtctgctggtccaccagccagaatgaaggacacaaaaataccttctccatcttccccaccgacaatgttgaagcccaggccagtggagcctttgtgcaggactaccttgcgaggctctctgcagaaagaaatagagaacacagctcagagggtgatccatttaagatttacgttgcttttactttcaatgggatatatgatatcagcaactcactacttgtaaaattgtttctcaaactaagataacatttgcacatcaagaaagaggctaatatcaggacagatgtttgagttccccactgcaacaactaccaaaataccatgcaaaaaatcattccttcattctaaaaaaatttcttaaactacctttacttctacttttcttttgtttaaaacatctctttttgtatcaagcaccacagtagtactcagtatgacggatgcacacaaaagcagggagggatttttgggaagaagagactaaggttgaatgcccagatcatgaaagatcttacaagccaggttgtgggtttgttgtttgcttgactgttaattaaaatttactgtgtaggccatggggctcattagaagattctgagacattaagaatacttaaattcattttaggaaaattaacagatggtcctatggagggctgacggagaggaaagcacagatatgatcggaggtgggaaaaccatttaggatgttgtctaggaatccagctgtgaggaagtcacagcctgaagaagggtgacagcagtgagaattttaaaaagggcaacatgagagaggaaatttgaagggagaagcagtaggtccagagatgactcagacattggaaaaagaggagagagagcatctaagtaactagcaaaaggagagatgagtggaatccagggtcatgagaatgagtatgattttgacacactcagttccaggaaatagtgagatatccaggtggagatgttctgaagcagctggagacaaagaataggaatatgggccttcagagaggactataaatacatatttgaggatcatcaataaaaaggtcagagatcaaatcttgagccaatagttcactgagtttgtgtacagctcagaataatatggaattatagaatgtaaaaagtcttaaaatgcatttagttcaattttctgtatcagtagttttaaaaagtgtttttgcaagccttaggtttgaccaagttgtcatttgcatcacccaccctcctctcccaaacatctcagttcatcttctattttccagctcttaatgatgtaagaatgagaaagagccatcccatgtattttatactaatggctacacaaagaatttgttacttgctatcacatttccatgcataaaatgatgcattatgtatatatgccttattatgaggaaaggtgtaaagtgcacctcacaacttgaactgtaagtaataaattatgtaacaatgcattaagtcagaggtaaagtgacatagagttaactcatttcattctacaaatactttgtaaacacctactgtgccaggaaggtgtttcaggtgctcagaatgtttgcaaacaaaacaaatatccctgtccttgtgggcttacaatctaatgaaggtagaccactaataaacaatagatgcaataaataagttcattatatagcacgttagaaggcaaaaagtattttggagagaaaaaaaggcagagcagtgtaggagggataggttgtggtgaggagggcctgggtaggatggattgagaaggtgacattttagaaaaaattgaagaggtgaggaaactagtcatgtcgctataaaaaggaagaacattctggccagaggaaaggaacagccaaacagagatcctaatatggaagggtgcctggtgttgtcaaagaagaactaggaggccactgtggctgaactgagtgaatgaggaaaggagaatggtaaacaatgaagtcactgttttagttttctattgctgaataacaagttaccacaaatctagcaggttaaaaccacagccattattctctttcagttctgtaggtcaggagtctgggtggacttgactgtgttgcctacctatgctgaagtcaaggtgtcagccaggctcagctttattgcaaatttctgtggaaaaatctgcttccaaatgtatttaggttcctggcagaattcagtttcttgtggttgtaggattgtattagtcagggttcttcagagaaagccaacatgagattgcacacacacacacccctatggtatatacacatacacacacacccctatagtatatacacatacatcataaggaattggcttatgtagttgtggaggctgataaggcccaggatttgtggctggcaaattggagaccgaggagagccagtgatatatattaaatagttgtaggctgaggctaagcctgaaggcagatgaagactgctgatgtcccagcttgaagacagtcaggaagaagcagcaaattcaccctctcaatgcttttttattctattcaggccttcagtggattagatgaggatcacaccccttggggaaaacaatctgctttacccagcctattgatttgcatgttcatctcatccagaaacaccctcacagacatactgaggaaaatgtttaaccaaatagctggacactcaatgactcagtcaagctgatacatgaaattaaccatcataaggaataaggtacccatttccttgctggccatcaactggggcctctctcagctcctataggccatccacattcctcaccccatggctctctctatcttcaagcaactaatggcacattgaatcctcttcacatttggaagctctgacttcctcttctccaactagctgaataactctttgcttcttaggggtttatgtgattaggccaggcccacccagataattttcctatcttaactgattagtaaccttaattacttgcaaaatcccttttcttatgtaagaacttaactgtgggagtaacaccaggaggtagatatcatgggtccctcttagaactctgcctaccactatcagagagacaacggtgcattaatcctgcagggccttgtagatcattttaaaagctttgacttttactctgatagaaatggggagcctgtgaggaaatgaattgacctgacttacatttgtaaatgattcctttgatgtaaaatagagtcctcttgcagctgggtgggcatggcagttcagctcccccttgatcacagaacagcagggagggagacacagagcattcacctcattctacctcattgccactaggtgggagtagaagttcagctccgcgcttggatccactaacaccaatcggggagagaagatggggtgctgactagcactgccttgaaccaccttattctccttacctttgcatgggggtaggagttcagctcctcacagggccctgctgatactatcctggcaggcagagtggttttccaactagtactgatttcctctttctcctacttcattgccactgtgcaggggtggaagttaagcttcttgctggttcccatcaatattaggagtaggggaatggaatgccaactaacgccacctcatttcagcctgttgctgctgggtaagggtacgagttcagctccccactagaaagtggagtatcgactagcatcacctcgtacccccttgttctgcctatttgctgccaggtggggatggaaattcagttcttgttctgtctaccaacaacagcctagtggaagaagtgtaaggccatcttagagttgcctctcctggctgccgctggtagagccagaaacctagctctcggcatagcactactgacactgcagggttgaggggacagttttttctttggtgtttggctagagtaggtcagtattatcaaaagttttccggttctattagtctacctgtttttcccagtcatttatctaaagggagcaggttttacttggggctgtttttgtctgtacttattggcggttccaggctgcaggttctccagtgctctgtccaaatacatagcaagcaaaaaaaaaaaaaaaaaaaaaaaagaaaagaaagaaaaagtcctgggaactcactacagtatccttcctttcctagccagtttgttgcctcctttccaactctaaagtcttcctacatttgtgtttttctactcaaggttatttgttttgttttgctttttaaataagagggtggattagagagaaatggggatacattttaaacgtagaggccaacagaattttcatgaaaaggttattgtcgaaatctccccctttccccagaataaacacacgtatagacattcttagtgggtccaacaacactgaagctctatatagtacatatagatggagggaagagagtgattaggactctgacatttgtccctgtgctagatattgtgcttgatgctttatatgaatcatttgatttattcctcaaaaaaatgaaaggtatactgattttgcaactactttaaaacaggaacagaaagcaaaatagattgatgattggatagatgggtaggtatgtgatagagaaagtataggaaaatgttaatagtggaatctaggtgacaagtacacggatgttcattgtaacatttttaaacttttccttatgtttgaaaaatgtttataatgaaattatgagtaaaataaataacctgatgaagaaatcattagggcaaatgtttagattagtgaaatgagactacttgtctaagcttttaactgagtttagtaagcagcaaaggcaggattaaggacatagattttctgtctcacaatccaaaagtctagaatacggtatataccagagattgcaaaccagcaagtcaaaggctgaatttgactcataatatttacaaatgtttgaattagctgcccaagtttaaaattaggaaaatttgcatgaaatatggatttgtggcttcacatgaaaaaagtctggcattccatcaacactagctcccagttttgctgtgaggcaacacttggtttagagaatgggcttctttagaagggtcattcatgctctagtttgccatagtcctgacctctttctcctgttcccagacaaaaaaaaaaaagctgtcattgtaccacatttgcacttcttataaaattaagaggaaagtatttcttgtactcatactcctatcaaaaatgggaaaatgaaagctttatggagggaatcatattttaataaaaatgggagagagtaagattcctatggaagtaaagattattcttacatgtttaatatgcaatgtgactttatgcaggaagaatacagctttcaaaggtcattatgaaacatcattgcccattacccatttatgttacccatctgggggcattttgttagtgacctttgcactttgacatactgcttcctgtctttaaaaacagaaaacatataatgtttgcatgacagtagattttatttattttacctggaccccattgatttcaaactatcaaaacaaatcttttaaaatatattatttggaatttttgaaactcagaagatttaaatgccttttttaaaaacagaattttatattatagttaattatgatacttactttaatagtgaagataaatgacaaaaaataaatttgtaaaatggaatgcaaataaaatgtcctaagcacacttcaaatgatttattttttctaatttaaatttcttatcctaataacctattacagcaatctgtagattttaaagcatttcacatatattttcctgttagaggatcaaagccctttaaagtattacaagtcctattttaccgatgcttaggtaaatcggcttgtctacattcacatagccagaagcatcagagctagtctctttgctgtaagttaagtgtttcatccatttgatggagagggaacttaaacaatgaaaatttttaaaaactaagctaaaattcaagtatatttaaagtatagtagtatacattgaagtatatataagccagaggaggattcttaatttaaaaaagggattacgatatattacagaatatagtttccaaaaccattgacactcaaagattcactttaactgcccttagctcttatcatttgaaccacatggttcaataccgcattccatgctgccttgcactcttctctctctgaatgtcatggtatctactccaaccccttcatcccctctaattcaggttttgacttttaggataaactcccaacttgaagtctccttgatcctagtttcaatcttccaaatacattctcctccctaaaatacaaatcagatcaccttactaccctgcttaaacgtctccaggcaccctatgttccagccacatcaaagtccctgtgcttccctgagtttgacatgttgcttcatacctctacgttttggctcaggccaccttaaaactcagttcaaccatcacttctctgaatccccaggtacatatgataacttgttccttgggtccacactgtgtcttccacacatgcatctattgcagcatgttttacagtgtgtcataattgctcataccttcttctcaagaaaatgtgaactcctagaacccaggcaccagcatttccccagtaatagtaagatgcctggcaggtagcagaaactcaggaaataggtattaaatgaatggataaactcccacagtgattaaggtctccatttcatattataattaattacacgaatgtctttccctcttcctagattttaaccaggtatgtcaaaatctaaattccagagatatagatcacaaaacacaaatgggcaaagcaggatgagaaggaaatatagcaaactggaagacacatttcatctaaaagggggctgctgctgctcaactctggacaatcgctccaagcaggaatgtcaagcaatcttgacagattctctaatttttaaagataagccaagaatctagatatttatataaatttcccagaattcaaatatgacaatggttaaaaaaggtaaaagcatggtgcaggtcaaactaaagatgtctgttatgcatccagctatgaactgccagtgtgagactctgccttgttagaagtttgatggtgcatttgacatctgcttcatgtttttcgcttccatggtgctcagaatggtacttgactgatggtcatttaatattccacatttagcccatccttttcttcacttttcagtttctcccattctgtaatacccttttatcttactgtttcccgtttgtcttttttttccttttatattacagctgctcaagacccatgatcttcatgataaaccattctcaaacattttgagcctagctgcttttgcatgcatactgctgaggctaatgactctgggtctgattaatataatagcccacatttctaagaactgttttgtgtgtgagggcattgtggcccccagtgagatcataatatcctggaggtgaggtatcatggtttactttctaggtatacctaatactcatagaacagtgttcagtcaacatctgatgattgaataaataaacacaatttataaataactcaaatactttttatactagaatgatttggggactctgatttcctattttattcatcatccagaattcatattgctgaaggctctgttactaatcattattatacatcattatacattgacagtggaacaaaattctatctctcatttctcattctgaaattagctcagggattgtaatcttctagaaattttccctgatactctccttagtctctctactctaggctgggttgggtgcttcacctagcaatcttttcatgtatctatcataatgcttattccactggattggtttatttgactccctttctagctagagtgagcaacttcagggcagagacccatacaaaacgacatacgttggcatttgctttttgtctccaatacctggtacataagaggtgctcactgtcagctaatttcatattatgttttaagtatggaatgtatagaagacataatttggtcactcacaatatcagcagttttaaaaacaaagttagatagctacttaaaaatatgtatcttacccatccatccaacttccaatagacaagcatctatggagtacctatgttgtgttaggcactgtgaatacaaagattaaagagcctggggtaggaggagccacatgtaaacaaacgcttatagaagcctaggaagtggacaagtgctatgacagaaacttgtgagcaataagctaaagtagccaagagtaaggagcggccagccttcttcttaaaaggtattattcttttaccatcatcacttagatgaaatgtgctatattcatttatgcagtttttatttttctcttaatattatgtaaaaagtctttaaaattataaaacctttggatgctgagcgaatggagaaatgccagcctgacctgctgcaagctgtgacagatcatcagcagcataatcttactcagctggagtctcagaggatcctctaaactagtcaggatgttttgaggagaaaggaggtgctgtaggctttctctctttacggcagatggtttaagagtgttcatgactcaaaaaggaaaattaccgccaggcttggtggctcacgcctgtaatcccagcactctgggaggccaaggcgggcggatcatgaggtcaagagattgagaccattctggccaacatggtgaaaccccatctctactaaaaatacaaaaattagctgggtgtggtagcgtgcacctgtagtcccagctgctcaggaggctgaggcaggagaatcgcttgaacctgtctcaaaaaaaaaaaaaaaaaaaaaaaggccgggcacggtggctcatgcttgtagtcccagcactttgggaggccgaggcgggtggatcacgaggtcaggatatcgagaccacggtgaaaacccgtctctactaaaaatacaaaaaattagccgggcatggtggcgggtgcctgtagccccaggtactcgggaggctgaggcaggagaatggcgtgaacctgggaggcagagcttgcagtgagctgagatcacgccactgcactccagcctgggcgacagagcaagactctgtctccaaaaaaaaaaaaaaaaagaaggaaaattactacttacactgaagtctttctcatggccattcgtgggctattccttgaactctgagcgtctgggggcttgggaagttactccagtcaaatcctacaacctccatggtgagaggctgtattgggtagtgggaattaagatataaatatgttttcattgatctttctaaagaacatatcttaccatgtttctctcttgctcaaaagccttctaaggatctgtgtaccttttaggataaggtctaaacttctacataggcattcaaagcttcctattatttgacctcacctacctctccaccacttaacttcattgtgcccctttgtatttcatatttcagccttacaaagttgccaaccacagcttctcatcccaggttgttcctccttgtctttgcccaggctgtttgctgtttgctttggctagaaggatgcctgccttttcctgctattctcatctatctaacgaggtcctacttggcctttaagactgaggccaggtacaatctcctctctgctgtcccctctaccctcacctccagaagaactgacttttttgaaaccacattgtcctttcattgatcacaccactatcactgcctttactgttctgaaataaatttatttacccatccatctatgctgtcaatctgtatggtcctgaaagacaaagataaaggacttttaggtccttgttttgtgtaattttggaagcgggtacaggctgagcatataagagacatacaaacaaaaatattgtttcatgaacggaaaaaaaagtgagtggttgggaaaaatgatactgagttctagttctggctctcttgggatatgtgggaagccaggattgtcctctacaggtcgggttccttgcttgggtaatggagggaataatgtttgtctcatggggaagtgttgaaattccgataagacaatgaactaaaggcatctagaaaactgagaagttttaaagaaaattaaatattgagatgctatttccagtaatttggcatattagatattctgaaaacccctttcattacaaagcagctaaaaattctgaataaaatagttataaaatacttttaaatgcttggctaagcttgcaagtaagagaaatcttcagaggatgaaaatgaagcagaaatgcaaactcagaagaaagcaagtactgagaatagcagcagactgaagagtgatgagctagtgtgttagtgtctagatttgatggctgcatgaataggactgtgtgagcccagtggtgggattagatcagagacacctgagcaaaattaggaccctgtgaggctacaccccaaacaaaaggataaagtacaaaaatattagcacttcaacaatatccaggatacatatctatcctgattttggctcatagggtaaaaaaaagggcctgggggccaggcgcggtggctcacgcctgtagtaatctcagtactttgggaggccgaggcgggtggatcactagaggccagaagttccagaccagcctggctaacatggtgaaactccatctctattgaaaaaaaaaaaaaaattagctgggcatggtggtgcatgtctgtaatcccagctacttgggtggctgaggcacgagaattgcttgaacctgggaggcggaagttgcagtaagccaagatcgcatcactgcactttagcttaggcaacagagtgagagtctgtatcaaaaaaaaaaaaaaaaaaaaaaagggcctggggaactaatcaaggcatgtttgaatgtcaaataagttacacttgcaaacagaattgataaaactgaataaattgggagaataaaggagggagagtccacctgagtcgtagaagaaagatcttcgcaatagatctccagagctgtgaggtcgaggtgatctccagctccagctgcaggtggctaacataaatgtgctgtcctggtggtaggggtaacgtatgagatgggctcatctggccatcctagctcaatgacagtagtcattagggtcacttgggtggctaatttccctctcagagtccaggctcaccaagcctccagctcattaaaaatataatttatcctagtgtttttcctattgagagcaatgtgctagttatagcacattctggtatcttgagtagttacattttgcatcatatattaaaaacatggtattacagcatataagcttgattactcctggatacactgacaaaaactgagttccagagactgtagatggaaggcccagatctagtataacgacaacccaaaaagggtctattacccgtggaagtcatatgggaagtctacagctagtcttcctgaatcctttttccttcatttctctattaaatgcaactacgttcacgtgaacaatgttattaaaaagaggagatacttgtaggagatcaaaaagatctttttagtagaatgagaagacatgtattaggaaacttgtgaagagaggggcataccaaaggtggtcacatggaagacaacaacagaaggcttcaaagctgctggttgattacaaccttcttatatctaaatgagctagctcctcagaaggatgcagtataatgtgtgcctcatatttaaatagttaatttggtcagttagccaaataatcagtcaaacagattattgggcatcatacagatacacaaagatagagggttttgttgaactgctatttgaggacatgttattaaaataatagaaagaaatctgtcatcataaggggggatctatgcattaaatatacaatatagagcaggctgacttcagcaaaataataaccacactgatacagagtttatactaaacatactgtggttggtactgtgtgggataaaacaaccctactagagggggatggtatgggatactgtgatattgggaaagagtatgggcattggagctacatagatctaggcttgaatcataatcctaccaataaatacttgagtaaccttggtgtagtttcttgaggtcttgcttttttggctataaattgtgaacagtaatatctattttctggcattgtgaagatgaattgaaataacataaaaatactagaatcacacagcaagtgcttggtaaatgctaactcatttcctttccctctagaaagttatgacctttgaaaggcaaatagtcacacataaagtaataaatcaacattgcaaagccacatatgttaagtaccaaatgagtattgtggatgaaagatctctgtgttaaagaacaaatattaagtcatatagaatgtacaatctgaactagatcttgacagatgggtagaaattaggaaagtggaaaggaaagtagagggtatttccgtacatggcatgagcctagggccagagcggagatatgcaagatgtatttggagaatagtgagtatcccagtttgaataatgtgcaggattggcttcaaggaaaactagaagactgaggcagactgggaaggaacatggatgccaacctaaggaattcacactttatacttggataatgtgaagacattgaatgtttgtgtactcaggggagactttgtgaatgcaataacttctatttgtaagccttaagtgtttatgttacattgttctgtttctacagccccccaagtttgcctgcaatgaggttaattaataattctaaaggtctctaaagacacttctgctgcaaagtgaggggctttgattgaggctgtaacataaggtcttggatttaactgctaagatctgtctgagttctttgtaaaactcttttccttctcttctctggagtaaatcttagaattaggcacacatctgagactacatataacaaccttggtaaatggaatcaatcagacaaattaaaaaattttcttctcgcaacataaatcaactatagatcaattagtttgatttaaaaatatttggagtactttcttatccacatatcaaacatgataatctaataaccaagttccacctcaatttgtttttgtctaaatttctcaagaaaataaacaaagaaccaattttatgttgctccacatacgttctcacttttcataaccataccttctaatcattatctcccaagccaaaaaaaaaaaaaaaaaaaggattacccctctttttcttttatttcataatgttttggttgccaacttattttttaagttatatatactatccataataacaacaatttgcttttgctccctgttgcattttgaagttttaaagataagttaattataaaaggaatgttttttgataattataacaggaataattttagcaatcttgttaaactaaataaaagtaaaaaagtaaatatctattgtacagagttatttttcatagttgtgtcatttgttctcaagctctcatgactggtgaaataatgtctgaaactattatgaagctggggcattagcaaaactaatattcaaaaataggattagagaaaaaaactctgcatattcttcttgaaggcaaagtacactttatgaaagattttttaaaatgtctttcgagttgaagcattatggtattatgaaactccaattaattatcaaatgttcaaaccctctacaattagtgtgatatggggaaaatggcttgaattaaagtgaaataattgggttcaagtatttcatgttttatcttaactctgatttggatatatccatattattgtagaaaaaactttaggctgaggcctgttttctagtcctgactccaatattaatgcctgagtgtccttgaaaacagcctctgaacaagtttccatattgtataactaggggaggggtgaaaaaggcaaaccagaatcgccacgatcccttccagttctagcatttcacatgcttgcttaatgaaaatcagaagtggggcgttcccatttctaaaaccacaattccacttgatgatttaataaatatttagtactcaccttcaagaaagtggagagaacagaaatggctctattgttaggtcctctccaacttggcctctcttcagcttttgacattataaacgttcctctctgtatttccgtaattgaaattttgggaaatgttctatgtatctgtttgcccaatatcgtagctaccagtcatatgtgttagtaagcacttgaagtgtggttggtgtgatggagaaacttaattctcctctttttcctttcctctagctctttcttggaggggtcctttgtctctctaggtctcagtttaaattgtgctctgtgaccactccatctaaactagtcccccacaccttttttttttttttttttaatcacggcatcttgtaaggacacttatcttacagtaaattaattgtgtttgtttgtttgcttgttgcccatctctcactagaatgcaatctctatgagaactacaacccccttgggcctctagcatctagtctagtgcctggtacagattaggtacagattagtgcctggtacagatattttttgaataaattaataaataggtggtcttatcctttgctatattgataatccactaattcatatctctagctcagatcagtcttctctactccaaatttctattcagttgctccagaatgaaatcattattttctcccagaattttttttctcccttttgttccttatctgggttaattgtgtctgcccaattttcaaatcagaaacttctgcattttcttctctactgctcatctagtacttccaatcatccaacaaatgcagtcatctttaattcagaaatgcctctcacgtcatcttagtattgttgccttagttcaggcccatgacatctctgccagggatccctaactaggattctcctaacaatatgaagtaactattaatttgggctccatggacttcttcaatctcaacttccaatacattccttctggcactatacctatcaattatgcataaattcctgtgtggccctcatggtcagactctcctgtgccatttgtgtgttcttcctctgtttggaatgcccatctccagatgaaccagtttatccttcaacaattccacaggcacatttagccatctcctgggcagtgttcccagagcattttatttgggggcattatagcactatcacttaaaaatagatacagatatacgtatctgtcctctaccaactgggaattctttatgcacaaaaaatatatctattcaattttttgaagaatgacttattcctctgcagtagttaattacccagctttggtttcagacacacatctaagtttaaaactgagatttgccatttattagctacaagactttggtcaatttacttcatcttgttgaacctcagtttttatatcccaaaatgggtataatggtagtacttacattgtggtttttgtgaggattaaatgggataataaatgcaaattcctggaccatattaataaataagggagataaataaatataaataaataatatatataataaattaataaataataaacaaataaaaaattgcaagctcttaatagccattcaaatgtttatcgagcataaacatttgtcaagtattgtgttatagatgaagattattatgaccgacttggtcctcatagaatttctaatctagaggaagaaataagacataaatatagagacatagatatttgaaacgaaatgtagaataataaaagagatacataaaaattgttatgagggcctgggatagaaagaaataatttctagatgggggtctatggaaggtttgctgaaggagatcacactttaattacacaggaaaacatggccagaattatttgctttgtgaattacttctctcagcatagcatgtgctttgcaagggcagatgcaggttttatgtggtctggaagttttacaatctggagctccttttttttttttttttaaaaaaaaagcataaaatattacatttataacgcgaatttcttatttacccagaatgctagtgcctgacatctaaaatgtgcttactgtaaatgaactccctttcccccggccttcgtgtctccagtacccagcaaaatgtctagcaaacaaggtacaagagcttgaagaggtccatgtaattgaagggcctagggtttcaaggtaaatacacttctggtgctgtgcttggcgctggaaatataactataaatacaatttaggtcctgacttaatgggctctcatcctagggggacagggaggtaagtaaaaataactaattataataacattcattcatccgtaacatttggggtaagtgtgtgtgtgtgtgtgtgtgtgtgtgtgtgtgtgtgtttttttacttgagacggagtctcactctgtctcccaggctggagtgcagtggcgtgatcccggctcactgcaacctccgcttcccgggttcaagagattctcctgcctcagcctcccaagtagctgggattacaggcatgtgccaccactcccggctaattttttgtatttttagtagagatggggtttcaccgtgttagccaggatggtcttgatttcttgaccttgtgatccacccctctctgcctcccaaagtgctgggattacagtcatgagccaccgcggcagcccggggtaagttttctaatagataggagagcactgatttgatatagagagatggggagtgggataataattaatgaataaggaaaagcataaattaaggaagtcagggaatatgtggtgtttgaaggaaagcaaatattttcactggactacaatgtaccattctagcaggggtgtggtggagacatgaaggcagaggccagatcaggaagaggttcttagacagggcaaacagagattcaattcttaatactcagaagaacagagcagaatatttgcatatactttcttcattcatttaaccaaggtttggccagcagctactgggctcgaccctggctgagccttgcacatacaaagctatacaagagctctctgtccctgaaaagtttacactctgcattatgtgttgaattttgtgtctccaaccctaaagaaattttgaggccgggcgcggtggctcacacctgtaatcccactactttgggaggccgaggcgggcagatcacgaggtcaggagatcgagatcatcctggctaacacggtgaaaccccgtctctactgaaaaatacaaaaaattagcctggcgtggtggcgggcgcctgtagtcccagctacttgggaggctgaggcaggagaatggtgtgaacctgggaggtggagcttgcagtgagctgagaccgcggcactgtactccagcctgggtgacagagtgagactccgtctcaaaaaaaaaaaaaaagaatttttgaagtcctaactgtcccaataccccagaatgtgacatgttaggaaaggattgtggcagatgttagatgttaagaagaggtcacagtggagtagaatgagtcccttatccaatctgacgggtctccttataaggagacagccagggctgggcggggtggctcatgcctataatcccagcactttgggagtccaaggcaggtgaatcacctgaggtcgggagttcgagactagcttggccaacatggtgaaacctcttctctactaaaaatacaaaaaaattagctgggtgtggtggcaggcacctgtaatcccagctactcgggaggctgaggcaggagaattgcttgaactcgggaggcagaggttgcagtgagcggagatggagccattgcactccagcctgagcaataagagtgaaactcggtctcaaaaaaaaaaaaggcggggcgtggtggctcttgcctgtaatcccagcactttgggaggtcaaggtgggtggatcacgaggtcgggagttcaagaccagcctggccaaattggtaaaaccctatctctgctaaaaaaacaaaaattagccgggcatggtggcgggcacctgtaatcccagctactcaggaggctgaggcagagaattgcttgaacccaggaggcggagattgcagtcagccaagatcgtgccactgaactccagcctgggtgacagagcgagactccgtctcttaaaaaaaaaaaaaaaaaagacagccatgtgaagacagagatacaccaggagaatgccataagaagatggaggccagtgttggagtggtgcagctgcaaaccaaggaacactcgaggttgctggtaaaactccagaagctaggaagaggcaaggagagtcccctacaggtttcagagggaccagggcctgctaacactttgattttggactctagcctccagaactgagagacaatacatttctgttgttttaaacactcagtttgagtagcttgttatctgagacctaggaagctaatacgttctggtaggggctacgtgagccaatgcacaaactgacatgaacatcacctgcctagaggggcaaaaggagtcactgaggctgactcaatccctatgacctgtcacttcagaaaatggatttgaaataaaagtataatcataccagtgcagttttgggagctgttaccaggtgcctgggcagaaagccttatattcaaatggcaaagctttccataaacctcattaatagaatttcagaagttttcatgtagttaagatatgtatgtaagaattactgtggaaaaaaaagacaaaggactaccatgaatgcatcattaattactattactgaaattcattttcaaagataatatgtaaggaaatacaaacatcttactaacctttagctgtagttgaactctaaaaattctttcctttaaaagaaacattcaactgttctcttctctgggggtatcacaggtgttgtcctgtataaatgtcctgtataaatgttttaccagctacaagttctgtttttttgctaattctaggggaggctttacataacaattagttcagccctgatgagttttctaattccttcttttctttatcaggaaaaaagaggaagagcattgcttcccatccttgctttctcaattgagaaatttcattgatcttactgacctactttccctttctacccagactcctgcccttagagcagaggttagccaaactcttcttgaacatggcattcttaaagttattcattaactatttcctttagtcacagcaaaatctgaaagccaactttggacactgataagaatgggaagtgatttttagaagaatcatcaaaatttttcctctaaacaaatatgtgtagcctcatcttctgacaaaccctcaaaaatactctaaattccaatcacataaaatccccttgattttctccgaattcctagcttttctttaagtggactctttccctcaccttggtctttccatgtatagtcctttctgccagcagttggcttcctctcttttatatacctaggaaactttccctcattcctcatgaatagttgaacaacatttggtctcctcagctctccctaacactagttcctctaggattctattgcaccaaattcatattgtgattatcctaattatcacactctatctttttatccatttaacaagtatctgttgagggtctactatactcctggagggctccactgtggctaggattattaccataaagcagatggtttctgctcccaagaagttcacaacatagaggcttattagaagagtaaactagaaattataagccagaacactaaagttataatcttgtacaataaaaatttatttgcatacttgcttttctcacttgactctgagattcttgagtattttatttactttgtgagttagtgtctgatatctaaaaagtacctaataacacccattgaaaatgaaaactttcagtaaactaggaataggggaactcctcaacttattaaataatatctacaaaatccctacagctaatatcatgcctaatggtaaaaaaaacttgaagctttcccactaagatcagaaacaaggcaagaatgttccctttcaccaccgcctttcgtcatcatactgcaagttctagttaatacaatcagacaagaaaaggaaattaaaagcatacatattaggaaggaagaaataaaactgtctttgttcacagataacataatactctttgtataaaatccaagataactgccaaaatctcctggaactaataagcaattagagcaaggttgtagaataaaggattagtacaaaaaagccaattaatttcctatatgctaatgatgaaaaagcgaaaactgaaattacaaatataatgccatttatattagcacccctgaaaatgacatacttagttataaagctaacaaaatatgtacaagacctatatgaaaaaaactacaaaactctgatgcaagaaatcaaagaactaaataaatggagagatagtccatgtaaatggagacctagaaatactcaatattgtcaacatgttagttctttccaacttaatttgtagatttagtgcaatcccaatcaaaatcctagcaagttattttgtgaactttatatggagaggcaaaagaccccaaatagcaagcaaatattgaaagaaaaaacaaatttggaggataacactacctagcttcaaaattttctataaagctatagtaatcaagacagtatggtattggtgaaagaggagacaaacatggtgctagaacaactggacatccacatgcaaaacagaaaaaaataggtagacacagacattataccctgaacaaaaataaactcaaaattcatcacaaaccaaaatgcaaaacacaaaactataaactccttggagatactgtaggagaaaatctagatgaccttgggttttgagatgactgtttggatacaacaccaaaggcatgattcatgaaagaaagaactgataagctggacttttttattttattaaaatagaacatatgtttttaacatatgtaaacatatggacagtttttattttattaaaataaaaacagtctgctctgtgaaagacaacgtcaagagaatgaaatgacaagctaaatactgagagaaaatgattacaaaagacatgtcagataaagaactattattaaaaatatacaaagaactcctaaaactcaacaaacaaacaaaatctaaaactgacaaacaactcaactaaaaatgggccacagaacctcagacacctcatcaaagaagataaacagatgacaaataagcacatgaaaagacgcctcacatcatatatcatcagagaaatgcaaattataacaataatgagataccactacacgcccattgaaatggtcgaaatccagaatactgacaaaaacaaatgctggcaaggatgtgtacctgcacttattcattgctggtgggaatgcaaatggtatagtcactttggaagatagtttggtggtttcttacaaaactaaacatactcttactatatgatccagcaattgtgctccttggtatttctccaaagaagctgaaaacacatgtccacaaaaaaacctgcacctgcatgtgaatagttctagcagctttattaataattgccaaaagttggaagcaatcaagatgtccttcagtaggtgaatggataaatacactgtggtacatctagaaaatggaacattattcatcaccaaaaagaaatgaactaccgagccacagaagtacatggaggaaacttaaatgcatataagcaaaagaagccaatctgaaaaggctacatactgtattattccaactatctgatactctggaaaaagtaaaactatggagacactaataaaatcagtagttgatggggtatagggggaggaagggatgaattggtaaaagaagatacaatttttaaaaaacttttaagttcagggatacatcaggaggctgaggcaggagaatcgcttgaacctgggaggtggaggttgcagtgagccaagaccgtgccactacactccacctgggtgacagagactctgtctcaaaaaaaaaaaattttcagggatacatatgcaggtttgctacataggtaaacttgtttgttgtacttgaaggtttgttgtacaggttatgtcattgcccaggtgttaagcctagtatctattagttatttttcctgatcctctccctcctcccaccctccaccctctgtcaggccccagtgtgtgttgttccccactatgtgtttatgtgttctcataatttagcttccacttataatgagaacatgtggtatttggttttctgttcttgcattattttgctaaggataatgacttccagctccatccatattcttgcaaaggacataatctccttttttttatgtctgcatataattcatggtgtgtatgtaccacattttctttatccagtctatcattgatgggcatttaggttgattccatgtctttgctattgtgaatagtgctgcaatgaacatatgcttgaattttctttataatagaacaatttatattccttggttatatacccagtaatgggattgctgggtcaaatggtatttctgactctaggtctctgaggaattgccacactgctttccacaatggttggactaattttcacttccaccaacagtgtaaaagcagtcctttttctccacaaccttgccaacatctgttgttttttgactttttgataatagccattctgactggcatgagatggtatctcattgtggttttttgatttgcatttctctaatgatcagtgatgttgacctttattttcatatgatagctggccacatctatgtcatcttctgtaaacttttcatgtcctttgcccactttttaatggggttgtttgtctttttctgtacattcctttaagtttcttaaaggatatttgacctttctcagatgcgtaatttggaaatattttctccaattctgtaggtggtcagtttactctgttgatagtttcttttgctgtacagaagctctttagtttaattaaatatcatttgccagtttttgctttggtgtaattgcttttggcaccttcatcatgaaatctttgcctgtgcctatattctgaatggtattgcctaggttgtcttccagggattttatagttttgggttttacatttaagtgtttaatccatcttgatttatttttgtatctggtataagaaaggagtacagttttaatcttctgtatatggctagccagttctcccagcaccatttatggaatagggaatcttttccccattgcttatttttgtcaggtttgtcaaaatcatatagttgcagatctgtggtcttatttctgggttctctattctgttccattggtctatgtgtctgtttttgtgccatgcagttttggttcatgtagccctgtaatatagtttgaagtcagctagtgtgatgtctccagctttgttccttttgcttatgattgttttggttattaaggatcctttttggttccatatgattttaaaatagtttttttctagttctgtgaagaatctcatggtagtttaacaggaatagcactgaatctataaattgtgttgggaagtattgctgttttaatgatattgattcttcctatccatgaacatggaatgttttttcatttgtttgtgtcatctctgagaaccctggtaagatacttaacaagaagatcatccccaagacacataatcatcagaatctccaagttcagataatttttagggcagggaaactattttgtatgacaccataattccagatacatgtcattatacgattgtccaaacccttagaatgtgcaacactaaaagtgaacgctaatgtaagctatggaccctggatgataatgatgtatcaatgtagcataatcaattctaacaaatgtacttctctggtggaggatgttaataacaggtgaggctatgcatgtgttggggcaggacacacatgagaattttctacattttctgctcttttttttttttttactatgaacctacagctgctctgaaaaataaaatctattaaaaagtggttaatgaatacaagttctctttgctcctatgtcctaaatacctggtaaaatagtaggcacaaagaatatgatcaatgaatcattatggaatgaaaacctaaaagacatctaaatctcagtgcgaacaagttgatcctaagaactgattttgataaaaggaagattgcagcactggggaccaaaaacaaaggagggtggttaagagatgaagacattcgatctagcacaatgaagctggggcaccccaaatatgcaacgtgtctgttttgctgagtacgagttctgatctatgtaaggccaactcaggactcttcccaagccctgcttgctgctgaaaattacatggaaggaattcttgctgtcagacaagaaaaatggcttcttgggtatgtcagggggtcaaaaccacactgcaaaaggtgctttcttgcatttcatacctcttcccattatttctccactgaaatcattccagtttccccataatgatcccttcttctggcaaaataagtcaaaaggcatgaggaattgaaaaagaaaaaatcagaggaatgaagactctagttcactctcattatcctccagataaaatggagctcctggtcagaaaattaggaggcctgacttctggtcttgaatttgttgtggccttggaaaatcttctgcctgtctcttacccttagatcattttctcacaaggaggtggacattataatatccttttttgccccacaatggctatggcccttgagtaaattgaaagaaggacattattataaagcagctctccatagtgatgtgtgttttactgacacacaaggccaggtaatgataatgatattttcttctgcaaaaaccccatgcactctcaaacacaaggcttgatctttgatagccatggttctcttagatgtcaagggtgacaggtactgatgtggcttatagtttttttgtaagcccaaattatttgctagcattgacatattggaatacacaaacacaaatgcataaaaatgatgatctagcactcctataactttgtaatgatttcaactctgatatggtttggccgtgtccccactcaaatctcatcaaaatgggaatttccctgcacaggctgtctctttgcctgctgcaattcatctaagatgtgacttgctcctccttgccttctgccatgattgtgaggcctcactagctatgtggaactgtaaatccattaaaactctttttcttcccagtcttgggtatgtctttataagctgcatgaaaatgaactaatacagtaaattggtttggggagtgggacactgctgaaaagatacccgaaaatgtggaagtgactttggaactgggtaacaagtagaggctggaccagtttggagggctcagaagaagacaggaaaatgtgggaaagtttgggactccctagagacttgttgaatggttttgaccaaaatgctgataatgatatggacaatgaaatccaggctgaggtggtctcagatggaaacggggaacttgttgggaactggagcaaaggtaactccttgttatgttttagcaaagagactggaggcattttgcccctgccctagagatttgtgaaactttgtacttgagagagatgatttagggtatctggcagaagaaatttctaagcagcaaagcattcaagaggtgacttgggtgctgttaaaggcattcagttttaaaaggcagagcataaaagtttggaaaatttgcagtttgacaatgggatagaaaagaaaatctcattttctgaggagaaatttaagccagctgcagaaatttgcataagtaatgaggagctgaatgttagtcacctagaaaatgtggaaaatgtctccagggcatctcagagacctagatctttatggcagcccctcccttcacagcactggaggtttagggggaaaaaatggttttgtcggccaggcccagggtccctcttccgtgtgcagtctagggacttcttgccctgcatcccagccactccaaccatgactaaaaggggccaaggtagagcttgggccacagcttcagatggtgtaagcctcaagtcttggcagcttccatgtggtgttgagcctgtgatggcacagaagtcaagaattgaggtttgggaacctctgcatagattttagaagatgtatggaaatgcctggaagcccaggagaagtttgctgcaggggtacagtcctcacggaaaacctctgctagggcagtgtagaagggaaatgtggggttgaagcccccatacagagtccatactggggcaccacctagtggagctgtgagaagagattgctatcctccagaccccagaatgatagatccactgacagtttgcattatgcgcctgaagaaaccgcagacactcaataccagcccatgaaagcagctgggagggaggctgtaccctgcaaagccacaggagtggagctgcccaagaccatgggaacccacctcttacatcagcatgacctggatatgagacatggagtcaaaggagcccattttggagctttaagatttgactgccacgctggattttagacttgcatgaggcctgtagcccctttgttttggccaatttctcccattgagaatggctgtatttacccaaagccagtacccccactgtatctaggaagtaactaaagtgcttttgattttacaggcttatagatggaagcaacttgccttatctcagatgagacttgggactttggacttttgagttaatgctgaaatgagttaagactttgggggactgttgggaggcatgattgattttgaaatgttaggacatgacatttggaaggggccaggcgtggaataatatggcttcactgtgtccccacctaaatctcatcttgaattcccacacattctgggagggaccctgtgggagataattgaatcatgtgggtgggtctttcctgtgctgttattgtgatagtgaataagtctcatgagatctgatggttttaaaaactagagtttccctgcacaagctctctctttgcctggtgccatccatgtaagatgtgacttgctactccttgccttccaccatgattgtgaggccttcccacccgttaaacctctttttctgcccagtctcaggtatgtctttatcagcagtgtgaaaatggactaataaaaattcactaatatatgccatgaattaacaatgaaatcggtatcaggtatatgaaaaggtgcttaacatcactgagcatcagagaagtgcaaatcaaaactacaatgagatatcatttcaccccagtcaaaatggctatatccaaatgacaggcagtttcaaatactggtgaggatatagagaaaagggaatccttttacattgttggtgggaatgtaaattagtacaatcactatggagaacagtttggatgttcctcaaaaaactaaaaattgagctatcatatgatccagcactcccactgctaggtatatacccaaaagaaaagaaatcagcatatcaaagagatatctgcactgctatgtttgttgcaccactgtttataatagccaagatttggaagcaacctcagtgttcatcaacagatgaatgataaagaaaatgtggtatgtatacacaatggagccacaaaaagaatgagaatccagtcattttcaacaacatggataaaactggagatcattatattaagtgaaataagccaggcacagaaagataaacgtcatattttctcacttattcgtggaatctaaaattcgaaacaattgaactcatggagattgagagtagaaggatagttacccgaggctggaaaggtagtggtgggaggtaggtggggggaaggtgggatggttaatgggtactaaaataaatagaaagaatgaataggacctactgtttcatagcacaacagggtgagtaaagtcaataataattgtacattttaaaataactcaaagagtataattgcattgtttgtaactcaaaggataaatgcttgaggggacagacaccccgttatccatcatgtgcttatttcacattgcatccttgtatcaaaacatctcatgtaccccataaatatatacacttattttgttcccacagaaattaaaaattgaaaacatttttaaaaactaaaaatggaactactacatgattcagcaatcccactactaggtatatatccaaaagaaaggaaatcagtatatcaaagatatctgtgctcccatggtgattgcagcactattcgcaatagccaagatttggaagaaatgtaagtgtctaccaacaaacgagaatggataaagaaaatgtggtacaaatacacaatgcactactatccagccataaaaaagaatgagatcctgtcattggcaacaacacgaatggaactggaggtcattatgttaagtgaaataagacaggcacagaaagacaaactttggatgttcccacttatttgtgggagctaaaaatagtaaaacaactgaacttatggatataatagaatgatggttaccagaggctgtgaagggcagtggtgggggaaatattgagatggttaatgggtacaaaaatatatttataaatttataaagaatgaataaaatctagtatttgatggcagaacaggttgattatggtaaacaatattttaatgtacacttaaaaataattaaagtgcataattggattgtttgtaacataaataaaggataaatgtttgaggtgatagatactcccccactccaaaaaaaaagagtggtggcagcagcattcataatattactgtctacaaactttaaaactctgtacaactacagagagagagaaagtgatgactagttggcttatctcccttagtgaagaaattggctagaagtggagaaaattggtcacttagggaatataattccccttattccttaggtcatagtagaagcaggaactttaacaagccatcacttgttgaatatggtctgtgcttgggagactgcccagtaattacatgatagggtaggacctagcagctaccctgaaggacttttgcactcagtcgagagaaacttttcaacatggaaaaaggagaaaactacaggcattaaattgtgtggcagagatatgatctgttatataggcaatcaagaagagatactggcattgtgtatgtaacagtgtccaataaatattttgaatgaaacagagatcagtggagaccccagatatctggaaggaacctatgtgtgttcacatatttgagctagcacataatgtgcatgggctctagacttactcttttgtgtgtaaataaggaggtaaggtgtggtgacattctacccctaaatattctttttacatctactactattcctgaaactctgctctgaagaaatcagttttggggggtgtagaaaacgtttgaactcttgatgtctctttctaaatgaggcttactcactccactatctgtttctttaccatgtgctgtgttctgtcttccacattactgattgtatctcctcagggtgtgtgagaggtgcacaggaaatgttttgttaaatggacaatgaatggagactttgtcaattgagtcctggcgtggaggaggaagaaatgggttctagcacatgagaaagaaaaagggcagatgggatataggaagagagatcagagagggaacaaatccctacttgtatctactgtttgttaagtagtatggtaggccatttatagacttaaaaaaataaactgtcaaaaaaatcctatgtagcagatattaatctccacttttagattaaagaaacagagactcagaaaggtttagtaacagctcaaggtgataagactagtaattgcggagccagaatttaaatgaagttacagatatgccaaaaggccatcttctttaaattataccaggctgctataccaaggagagagacttgaggacaagcaaggacttcagggatgcagtgaaagcactgtaagagaagggatgctcacacattttattatcaggcaacattgatattgaaatgcaatttcccatcaatgttcataattaatgcttgaccacaggagaattctcctttgcaaaactgaataggctgtgaagaacatggctctgttctatacttccatgtagctcttacagacctgtgcttaggagaaaaaaattcccaactcttgatatcagcccatgtaagcatgcaacttctttagtttaaagagggtgttcatttacccttcaggtttggtaatcacctgataaaaattactgaaattccacccgaacagtgctagtagcttccctcaaatcagctgcttgttcttttgttctgtaattacaaagatataatcacactgaattactataattttcaacattctgtcaccctattagtctgagttcttcaggggcaaggcttgggcctttttcttcttgattttctcaaatatctcaccagagtgcttggcacatactagacattcagtaaatgcttagttgaacaaatgcataagaagttaatcaatcaaatcaatgactgaatgaataaatggtgcttgtcccctgcaaaatcctctttgagcagtctaattctctatgtaataagcaggagcctttaccaaatgtgatccattggtcaataaaggttgctgactgacatcttaaaagcatacttcggtggaataaacatttaccagcactgaaagtcagcagagagattaaataaaggataaacatcgctggctgtttccctggcaataaaggggcatctggtctgtggcataggatacagacgtgctctttctttaaactctcttataattggtcagaagaaggaagtaaacagaaatcctgatggaatttaagagtctctgagggattgaaatatatgcagaaaaaaaaaccagatttcatttggatatataaagatagatgtctcaagatgagtaatataatgaaggctgacaaatgatacctgaggcaatcctctttgtttttggttcttgttagccatgccaccttccaggtcacagccaggcaaggtaccaacagaatgaaaatcattatttataagcagttcaatccaaggtcaaatttattgtcccgcaaatattcatcagataagactaaggctgtttctactcatgtgatggatgagccaccagaaaacccctctgaccacgacttttgtctagacttattttcatgaaagataaagacaagacggaaaaggacttttgtcagtcagactaaaagacgtgattggaatgtatgtgacatttctgttaaggcaggatggtctagtagtgcaggagacagccatctaggttgcagtcaagaatccttcccttcccagacacatgaccttggggaagtcactggtcctctgtcatatctgtagacaggataaatgactcttacccaaccaccttacaaagctgctattaggatcaaatggaataatgtccctgagatgcctttgtaaattatattgcactatgcaaacataagcctggtatcttcatggtgaacagcgaaaaaaaaaagacaagaataaaagagaaaaaaaagaaaatgaatggcaaattaagactaagagaaaggaggaggagaaagtttctgtagagaagggaggggaaagggagaaaatacagaaaataaaaggggccaagggaggaaccggtagaggagaaggaaagatgcagcagtggcaatgaacgatctcataattctggcacacaggtagataaataggcaaacaaacacataaacataaaaccgaaggaacagcagaactggtcagccatgggatttagaaaatcatgtctatgtcaagaccacagagctctgataagcaagtggaagaccccatcaggcagcctcttaggaggagacagtgagtcaaccatgagtcagcctccttattataaatttctaaatggaaagcactactgagttcatgttgttctcatctgtgctctgctcagtcatacactcagacagatttgtaatcattgtgcagccattgataatgaccttttctttgcctagtcaaggtctattggtcattcagataagagccttccatgacctccctgaccaccccgacaaagtcagatgccctattataggtactcagagcatcacagtcccccctttttttttcacagagcttgacacagtaacagatttatatttatttgtgtgattattcaattaatgtctcattttctcccccagactgaggacagagtcaatgtctgctttgctcatcattatattcctaattgaatttattggttggcatcatcataaacagaatcaagttaaaaaaggacagtattcaaagagaggtaatggtgcaaatgtcaagaagaggttggtgctggggctacagttagaaagtttgggacagataaaatctttttgatagtttaagcaactaaatcttgtcatggaataatggttctggttttcattttcataacagacttatgactgggtgcttttttgctcctcgttggttaattcagcatattaactagctctttagtgacatctcagtcaatgtcatgggtgagcatattattattagcattaataactgtgagtactgattaagaggggcaattttctagttggatattctgcagcacgctgttttggatatatttaattatataacaacgaggagaaagtttattcacaattacattgagaccatttttaaacccatttattaaaactttaaaaggttttcaaggaagatatacacggtatgataagtaatcatgctgaaactcaactatgtccagaaaatagggagtatttaaaaaataaacatctctaacttcaattgcccagtggattctgtggcagccctacaaggtcaatactactggcattgagcagcccgcagtatgtgagtccactaaacagggcagctcaataattctcataacgagactcctgacctgtgacttcccggcttcttcctagtcctgctgggcaaaccagaagcctacagtttggagatattattcctccattttttctaattcggtacatttcaaggtgagtggaatcattatacaagtttgttccccatttaataacatttttatttgaaagtagatttttgacaatgattctagttaacaaaaaactccaaaacctcagaaatcatattgagctctactttgtattttaatgtcttactcaggcctccaggttggccaactcataataacaaaacacatacaagtttggggaggtaggaaagggtagtgacttaaaaatgtgggctcaaatctcagttctgctacttaacttctccaagctttagtgtcttaatccataaagtgggttaaaggtacctaaattgttattagagcaaaatgagagccacataaaacacttacaacacatatcagttactattaaattaaaatatacaatatttaatgttatatttttagcccttaaatatagaaaaaatattctttttgaactttagagtctgtgtgttttcaatacctgctttaatgatacagtactctgtattcttcgatttatgtttatttttcttcattttaaggaaggctttcttttatggaacaataatgatgatagtggataacgtctatacaagtatttacctagaaaatctagattttctatgtcatcttgcaaaatatttttgctattttgttagtccttgaaattccacgtttggaaacttctgtctgttctaaacaagaatcaatggtttgtttatgtatttatttatttttacacagttgttatttgaaaagcagatggcaacagaaatccagtccctgtgagagaattagaacccatgtcttcatagcccttaaatatttcctagctctccatagtctcagcattttttcaacactgataaatttgggagactccttaaagattgctgtgatgacaccttttatattttaagcgctacacatgtaaggaaaaagattataaggcctagaaaaggatgtcttacggagtaaggaaatggaaaaaaaaatctgttcaccctttgaaatgaggctaaggaaaaggagctgacagctcaagtaggaggagaggtggaaattccagggacacaaggaaaaatgaaaaggaagcacgtgatgctgaactggggggacagcgatggtcagaggaatttgctgctctgacagattcctaatgaatcccctcgtttttaaactctgaagatctatctcccccacccagggatggaaggaaggcctgcaaactttttgagtccttccaaacagttaagatgtttttagcaggtgacctggcagcattaataaggttgggactctcaaccaaagctttcttacccagaactttcttattcaggagacaggtctgtctttattggactataagtcacaaacataaatctttttggggggagcagtttgatttcttccgatcatttctaaaaatcaaatgggtgctcatctccttacttttcccatattctttataaataaactcttcagctgacaggaaagcaaaataaagagaatgacacatacatataaatacatatatacatatgtgtgtgtatatatacatatacataaatacacatataaacatacacataaaataaaatgaatattattttaatacattctaaaaatagacaaaaatcctttgccctttacccaacttgcttctctgttttgatagagtcacttaaatatctgtgataagcaaaggctcagattttcgaccagcgaccctagcaactaacagcttaaaaaaaaaatctcttccaagtttcaaagagcacttccataattcagtatatttatcagcatgtcaactcctccctgtccccaacactacttagcactacttttgaaggtcagggtgtgctgaaggaagttgagcattcacactgattacaaatcctgaggtacagatggatctctgaatgtgtggatagagatgactcaagccaactagcccaaagggccagctacctaaagtccaacggtcccttaaaagtttacgctccataactaggaatattcctagaagtccataagccaaaattttgtctccaaaatgttagatttggaaggcatctaataccttgtttatttaactcaacctgatcacttcgtatatgagataacagacatcttgccaaaatcacacagtaagaaatgttagatctgggttctatgtactgattcaaagatgacctggtgattttcggatcacattctgccatgatcatatattttggaaccaaacatctgagtacttagaggaaaaaaagacgagtcttttaggtcagcatcatcctgggaaatctgaagcacattagctttaaaaaaaaagcttttcccacccaggcaaaaggagtaaaggagagaacaagagagagaataattccattagaggtcttgtttccagatgttccttggaaaggatacctgagctcaggctcagaacaccagagtctccccagccccaatggagccatggtttcatgagcctaggtggccttaaagtatgggaagggtgtcttttgtgccaaacagtggtacatggctgtccctatggagttaggcctgccctggtgagaaagtacaatagcagtatcatcacaaaccagttaacttgaaaggatgggttcccttagatctgtttataagtaaaactactttttgtttttctttttgatactcatatacttctggatttgggagacatttttggtggggttagttagacaaactatttattccataaaggattccttgaagaatttccctgaaggtggtcatttagtttccttttaagtgctacttgtaaaggctggccaacccctttcagggcagctgttttaccaatgtgaaaatgctactagaatttgtactagaaaattctgccattaagtgtgtcactaaatgaccttgtaaggtaacataaagtgccttctcctagatgaaagaaagctttctgagtagctgaagatacttcttactcttagcagtgttaacaaaatgcttctaggtttttgcacgtgattttattttctatttttttaacctctgccttgctgcagacacatcccttaaaattcaatttgtgccacctcccctgagaatcctcccttcctttccagaggcaaatgcttttaaccatttcagcttttaaaaaatttgtatacatttaagaggtacaagtgcaattttgtcacatggccatattccacagtggtgaagcctgtgcttttagtgtatccatcaacagaataatgtacattttacccaccaagtaatttcgcactgtccaacctcctcgaagtatttcactctattgagtctccaatgtccatgtgtatatattatttagctcccatttataagtgagaatatgtggcattcgtctttctgtttctgattgtttcacttaagataatggcctccagttccacacatgttgctgaaaatgacatgatttcattctttttatggctgaatagtattccattgtgtatatataccacattttattcatccagtcattcgttgataggcacttaggttgattaggctttttaacggaaaggtttgaggttaagccagaaaacatgaaactgtgccccaaactagcacactgtgaagggctcagctgtgggggccaactctcaaactagctcatctaggtgctacagaagagtgattcaattttttctgagaagaagcttcttttttttggtattcagcggtgtgcatgctaattgggggactcttcattcctattctcagactctgctttcaatcccatctgttgtcactaccctaacgtctctgagttttccgggtttggctaggcagatctgctctttgctgagctgtaggccccttcacatagtgctactgcactgtggtagggcttcttgtgggtggcaactcgggagacataatccgaggaaatgtcattctaatagaatgcaatgtaaaaggtaccccctggagttgtacaaccctgtttccataggtgatcaaaggctgagattactttgtttttcaccgatcaatacccttcaatcagctttctgttgcaaagaaatataatgaaaccatttggcctttgatgcccccttctatttccttgatcactaggagactgtccttttaaacaaatattattatcccattagcttccttttaatagggtctcaggagaaagaggagattagggtgtgggctgtgtctgtcaacttgaaactgaaaccagaacttattctgctaatagggatattattcttcctcattttgtctggcataattatagatgattcagatatcaatttaaaaacagcagtgactctatggtagaggactcaattagatagttttgttgtctcaatggatcaaattaactggaaatctgaaatatctccacttattttatgtcaagtaaatagcaacttgggtgaaaattatataaacatatggccttttaaactacattcatttaaaaaatatcctatgtagttgcttttcacaaaagcattaggaaggagagttttcaaataatgggatttgcaatttcagttgattgcctacactgagcagtataacactttaatgggaaacctgttaaagacccattggcctatgtaagatgaaaaataactttcccactatgtgcacgttatctcttcatctgacaaccagctgggcatgtatagcacaaatttttgtgttctggactttgtagaggattactgagacttcgccttctaaatatttcagtaatgctaagttatttctacctgaaatatttcattttatatccagaagtgttttacataaacaaatacatataaacatatttaaaagcaagtgttcaaaataagtcttcaaactaatctagcctataaaaataaattttgttttttttcagaacacttagactaagtgtatatttaactagtacttattgacggtccaatatgtacctgatacttttatttttaaaaattggtgagtttgggctgggcatagtggctcacacctgtaatcccagcactttgggaggctggggcgggcagatcacaaggtcaggcgtttgagaccagcctggcaaatatggtgaaaccccgtctctactaaaaatacaaaaagtagctggcgtggtggtgtgtgtctgtagtcccagctattcgggaggctgaggccggagaatcgcctgaacccagaaggtggaggttgcagtgagccgagatcacgccacttcacttcaatctgggtgacagagcgagactccatctcaaacaaattggcgagttgtatactattttcccttttagctgttgaggaaacccatgcttagagaggtgaaggtcgctgatcaacaacaaatggtagaggccaggactcaaaccaaattctttgactctagagtaagttttcttccattcttatagggaatagaatatattgtgttattcactagatataaggcaaattgctttatgctagttgggacaatagatcactatgaagtttatacagtttgctatttttttgtaaaaggagtcactctggtgttttgaagttagggtaacacctttacatttttggcctcatcagagaagaagaaatggtgattatgtcaactacagagttcctctaactcaagtggaaaacagtggaaattgaaaaatattcttagggcaaattgctaataagcttttgctaataaaaagaaagaaaacaaaagtttggagatagccttagaaggaaatgccattattcatcatagttgaaggaagtctactttgtgctgatggccaaaatgtgaaatgatagccaccctgagccctgccaagagaggtcttcaaaaggaataataaagtgaggtagagacagtggtaaaattagtccccacacccttacctctactgcaaacaacacctcagctacatagtatgcacatggacctctagtaccatcccaaacagcaggttattgattctatttaaagatttttaaggttagagtcattctagttcttcattatttttttcacacttaggaaattctgcacgatgtctaacttagcctgaatgtggtttatgaattgtacaaccagtgctctccacctcaataaagtcttttcgtaccacattatagaggacagagccacacagtggagtcaagcttgatttcaagtccaagctatgctactttctatacaagtacacttgggaaaattacttaaactctctgagaatcagtgttcagaaaaaaaaatacctatcttgtaggactactttagaaataaaatcaggtaagacaggtgatgtggtttggctgtgtgtccccacccaaatctcatcttaaactgtactcctacaattcccacgtgttgtgggagggacctggtgggagataactgaatcatggggcagcttctcccatactgttttcatgacagtgaataagtctcatgagatctgatggttttataaggggaaaccttataaaaccttggctctcattctctttcttgctgccatgtaagaagtgccttttgccatctgccatgattgtgaggcctccctagctacatggaaatgcaactccactaaacctctttcttttgttaattgctcaggctcaggtatgtctttatcagcatcgtgaaaatggactaatacaacaggtgattggtagataaatagatagagcctggcaccaataagcactcagtaaatgttagttttttttcttcccttggaggaatatttatgaacttgtgctgttgggcaaatatccatgtatgcttcagtcctcagctcaagagttacatcttttcaggaaccaacatgacctgctccctagtaccctttggatgaccatttacagttaggtatccctcctggattctccattaatcccttatgcatatctcctatagagtgtaatgcttacactgtatcacaagtgtgtgtttgtatttctatcatttgtactagacaatgaagccctctggagggcaagaagaaatcttgtttgacttattaaatctagtacctagcacagtgcttggcacataaggtgagtttcctagatatttgctgattgaaagaaaaaaagagagagagtgtgtgcgtgtgagagagacagagaaagaagagtggggaggtagggaaggaaagaaagaaagatagaaagagaaagagagaaaaaaggacaaaagaaagagaaagaaagacagaaaaaaagaaagaaagaaagacaaagaaagaagggaaggaaggaaggaaagaaggaaggaaggggagaaggaaggaagggaggaaggaaggaaagaaggaagggagggagggagggaaggagaaagagagacagagacagggagagaaaggaagacttcatattccaaggctgcacagtttaagaggttctgtattattatcttacccttccagggagacggcccgttggagagtcattgaaggctgacgagttgcggtgctatgttgggaatgactgcaagaaaagacagaagaaacacacatcatttatttattttttatttttttatttttttattatactttaagttttagggtacatgtgcacaacgtgcaggttagttacatatgtatacatgtgccatgttggtgtgctgcacccattaactcgtcatttaacattagatatatctcctaatgctaaccctccaagaaacacagatcatttatttaaaatgtttttgaacattttaatcggtcctattgtcaataaccagtcttgaaagaaatacagtagagattaaatatttggtgataggtagaaccctccaccaaaatatagtactctaccagataagagttaatttttttataatttgattttaatatgtattattcaaaagtaagcttttaacgataggtgaacattaaaatgaacaaacatatttggaaaaggtaattttttgcccttggaatgagataacacagagcataaaaacatacatttctttatgatgcaatgtattttttaagctgcagaataattttttctaacaaaattttacacagaacctaatctgtaaatcaggtaaattatatttagttagtatagatgtatttattagttcaaatttgcaacacttattgtaaaattagttaataataattgagctatttgatgaacacaaaacttgaaaaatgagacttccagctgcatatcaatcttcaaatttaatgtagttctagattttgattacctgtaacaagaaaagactgattttgtagataagtaatataaataaaatgataatatctaacatttattgagatctgaaacacttttctaagtgtttttaaatttttatgtctcttatttctcataaatgtatgaggtatgtcccattcaacagatgaagaaattgagatacagagaggattagaaagttgctcagagtcacatggtaacttcctgtgcctgaaatggcattgagactgtttgattctagagtcattttaaattcttacaacaatttttcacatttttaagaattcatcttggaatcttagaatattctttagaaagagatggcaagagaatctttcatctgagataggcacaataataataattcaacagccaactttactgaatgtgtaattttagtttatagtattagttaaatattttggttgaaacactatttacatatacacataatatatgaacaagtgtatatatacatatatgtataaaagaaacctgagtctaggatttctcagcacaaacatggcaaatgctgacattgccacagagaatcaaactacaggctgcagagtctttcattcagaaccttggtcaccacaggtgggaagaggtgttttcctgtgacacgtagataatatttgtctaaggttgagggtacagaattttgagaccatagctgaaacctacagaatcatattcaagttaaagactgtgcctcttcaagttaaagactgtgtttcctggtatccctcacagtgccaagatattcattgatcatgttttcaattgactagttgaaaagcatcgtagtattcaggacttggactatgtagccagactgcctggctcaaccacatataccaatgtaaccttgtatatattacttaaatcgctctgtatgtcagcttctcatcttataagactgggatagtaacaggactttcctcacagggttattataagaattaaatgaatacagtatttagaacaatggctctcacatggtaaagctatataagcatttgttaaataaataaaccattatgatttagcagagcgtgtactttgagatgtttagtaccaaataagaataattactgtatttagaccacttcagttagtcatacagtcagtgccacaaggtgtatatttctgtgtataactttagtgataaatatcaaattaaaatatattttctattacaaaaatatcataaatttacaagcatataaaataaaacattttctattaaaaaatattacaaaattactggaaataaaaatgagaaattaaaaatattcacctatactcctattaccttctttcacattttaccgagttatctaatgtagttcttataggagtcctctaaggtagatataagtattcccatacacaagaaaacaaaacatatagaatttaaaatgattttcagaaatcaacagcttgcaaatgtggagccagagtccaaactaaagcctaccttatcaccaagtgggtgtactttccattctatcttactgactctctacgtgtccatatgtatttcacatagttgtatatatatacagaaacatatgtaacttcatatcctctgcttttcctaacatttaagcatttctaatatggtctctataattattattttggagttacataacgttacttcctatgaagatataattaattaaccaccgttgatagttggatatttgggtgatgtttacggctttaatattataaacagtgctgcaatgaacatgttgatatcaattacttttttcttattttacaattttcttcagatgcgtttcccaaaatggaaatgcttattagtttcttgatttatgttattaattacttttcaaaagctttgtatcattttattgcctctaaaaatgtgtatctgtactagtttccccacagtcttaaaagcactgacattataacttttaaaacaccctaacaatttaatagatgaagaatgatgcatcagatttgtaatgagcatttctttgtttattagtgagaatgaccatttttttccgtatacttattggctaattgtatatcttttgtgcaaaatgtctaatcctttcctttaccatttattttccactgatctagaaagtaccaacagttcttaggcagctcaattatggtcactaaccaagattaataagtaactgtaatttctgatagctttctcatcattagctcagcccaaaattaaaacaaaaaaaattcagtaatctcacttcacttatcattaccttataactaattattttgttattctactctattccaataatatcctctttaaagttttagcgacaaagtaaatgcaaatggtaccctgaggtgcacagagaatttgactccttttatattacacatgcaaggttagccagtttctcctagcatgtagatttggaacaaacagagccttttccaaaatgtaattatcctttcactctcttctaagacaaatacagtgaactaagataaatagagtcaagacctgtggacacaaatgaatttttgttattcccaaatataatagtaatgtccaagctatacttgcaggagggatgcttgtagtggatgtttggagctacctgatggtgactacaactggtattttaaagaacaccaaacatttttcccttcggaccaagtaggttctatcgtttccacattattggctacataaacaatgtggtgtagagttaccatcgctaagaaattacaggtaaccttttcctgtctctttcacctcctcaggaagagaggccagtcagatggaattctgagaactgttgtagaaagaaccaagggaggaaatcacagctaaaacatgctgctctgttctgccatctcattttcctacatatccataatagcacccagggctatgaatcactaagatttattcacatgcccatttctcctacaaagtcatgtgtgctttcagagcaaagtattgggtttcttcatctatacattcgcagctcagggttggcacacaaaagacccttcatcaatgtctttttgaatgatgaataccatggattgaattccatctatctgtaaggcccccatgacttcttgcttttaaattctgcaatagcatcaagaactaggtttcatccccattttcaagggaaaaaagtgcttgctcctctgagacaaaccatattgttttataaaaagttgaaatcaaagctctgtgactggtctatatagagcacctgaaacacattgttagaaaatactgaactcccactgagtaacactgacaaattctttttttctttggtataaataccacccattatttttaccacatatgctcaacttccacgtcagtgacttttgaagatgatttttatgaagatcacttaataaaggaacttctctgtcccacccacaccacctcattagtaagtcatgaacattcatgaagatttaagtgacaatgaatagtgggtgggtagaatgagcatgagggaggctcagcatcatgctacaacatggatgctggagaagaagtcccctgtcgcctggtagaaaacctgtggcaccaattccctagttaggtagcttggctgaggtactaaattgggcaactgtggagataaatattactaagcctttttaagattcaaagagaggtataagccctattgcctgtccaaatgatgctgtcattaaataaaattgaggaagtgcacaatagagtttcctttccaagaactctctgattttttccaagtaaaagactccaaactgttgcctaaaaaatgaaatttgaatggtgctgaaagatgtattcccattgctgtgcttaattaagaaatttttgagcatctgaattgaaattgttctattacacatggaacacaaaggtcctagctggtggtaacaaatggcttttaaattttctccttctctgaggcaatgagaggcaggataagtggtttttccaatatgttgtaatattaaaactatgttattctaatggacagcacaaaaagttttttgtgtactttattaattaactgataacaataaagttacttaatgtgacttgtaaagtcacattcatcattaacatatcttcttatggatattcaatattgcctatttttccacttctaatgaacttgcatttatccttgtcatatttaactcttcatctctctcttgcatatttgtatccatcatttatttaatctaccttaatatttctttcttctctttttctgtctactttccttctctcttaatatagcgcatgcattaaattgtcactattcttaaaaagaagagtatgtcttggatatccaatcagtacctcaaatttaacataattaaaacgtcatcaccttcccacatgaaactggatagtcctccagttgtttcattgacacttaacatgaagtgtcttgtacaattacttatatgttgtagttatacccaataaatgttaattgggcacttattatacaccagggattgtgttaggtgcttgggatgactctttcattcctcaatattgtagtactcaataaatatctggtaataaagagaatgatgaaagcaaataaatcatttggcccatgtccaaataacatggatagcatttttcaataaatccccaggcatatttaattggcaaactacctaagctatgtttggaagaatatataagtattttaaaggatggtgaaggaaaacaagacattttgagactcatgaagagcatgaccaagatcatgaagggtcaaaaatatgtggtgtgctctggaaacttgagtgtcttggcttggccagagcagagtggccaggggtaaggtcaggaagctgactgtggatgggcaatgagggacaatgaataccctgccaaggtctggtcttacacctgttggcaatggtgggctctccaaggttattaagtggggggaataaaggggtcaagatggagataacagtgattcagaaaagtaaacctgaaactattctgaataatgaaaggaagtggaggaaatctatagtcagggagactaatagtaaaccatcagggtgaagaatattaataaatgcctaaacttgaataatgcagtaaaaattaagaaaagagaatgtatttaatacatttagaggtagaatattcaggaattaataagaaggagctaaggagaagacactttgattccagtgatctggctgggtaggcatttctcctcctgaaagtgaaattatcctacatataaagggccctgtttttcccagggtataggaagagttgtgctctcttctgtgacttttaagcaagccttcaaaaatagacagactctggtgttaggattgggggaggtgaggaagaatgaatggagaattccaccattgactgaaaggaccacggctctattaacagaagtgcatgtgtgtaaaggaaagtgcaagtgtggatagaaaaatataattgaatttgattttgtacaagattagcttgatgaacctgttacacatgtgggaaatatgatctatagtggacatctataattattaaaaagttcttccttctcttggcgtgatacccatctgtccacagtagccactggatgactgagatattccttgcatcttcaacccttacaaataaacattcataacacttttgattctttctttatgagatagtttcaaggttcttagttatctttgcttgtatgtgcttacatttttcttctgatatctattaagttggtgcaaaagtaatagtggttttttccatttttttaaaaaaaatgataaaaaccgtgattacttttgcaccaatctaatatttaaactgcagaatgtagaaatgaactcatagttccagatgtgttcagatcagggaagagtgccatgagatgctgacttttctccatttggatcccatactcctgtcatagcagcccaagataacatggacttttacaatttgctgaattttattgctaagcttagagtccactgaacctcttatatatttgtgacctcaaatgattaaaaatcaaatctatcatgtacttacacattggattttgggacccaatatagttaccacatgttaaatttaatggtaccgattttgatctagattttaagtttgttaagctaacattcagttatcaatttaattcaataagtatttattgagcatttaagatgtgttggccattatagaatttcactatttcatctagctttatatcatcaaattttacatttttatttaagtcattgattataataaggcataaggactgtgcattgtggcaaatcatcacagatctccctccagtgtaatagttagtccacaagttgcgctgttgagctctcttaagcagcatccttttaatagactaaccaatcttctccactctgtcagtgacaggcagaccaatgtccacagcaagcagaatgtttatgtcccataaatttccattcctttcaggtgatttgcatactaacaaagaatcaattgtaattattcttaaatctgtttattcttattgcatttgtttttataattacataattaaatgttgcaaaaatgaaatgtgtacaaaaaagccttgtctctatcaagagtaagttttctgatcttgaaaatctaaaaaaaagtatgtattaatagttaaaaatattgctgtcaaattaggtctgagagagataagatcaaaaaatattataaaataaagaatttttcacttagttcacttttaattcttacctacatttaaagaaatccagcatggaaagtatggatgatggattaagttataatttacgtaagaaaaatgaaatagaacttcagaaaaaaaatgggtcccaggtttctggccttacaagtcaatttggtatgccaaatattttaaagcaattaaagaacaatttagacattggaaataacaccatcaaaactgtggccagacgttgaaaattccagaaaaaatcttgaccctcacatataaaaaaaagatgaaggaacacaatatgttaactgttctcaaattaaaagtgtggatgacttatagaaatgcaaagtgtaagattgtactaatgataatttgcttaaagttaaaattgtggacaattaagaaatcaagcatgttgggacaaacagatggatataagtatgaagaaaaacattaaatcaaatttagagcccccaatttttcattccatagccaaagatactcaaaatgtgcttttactttatattaaatggcttcactcaacagtcagcaatgacgtggtgactcaaaaaataaattggatatgctttattgggagaaataccatttttttcttttaaataccaataaaacactcattttattatgccactatacaatcatatttttaaaacttaaagtgaagtaattaagacatgcaggcagttttttaaataaatgaaatgtttaaatccaaactttagactaacaagtcaataactggttctggatgtgcagggtaggaaaagttctcttatatgaatgtctaataggattatcaaccaggtattagttctttccttatctttaaagaatagcatgggagaatttggagtcttcttataaaggagaattaggttaagttgcacagccagaatgtggttaaggtgagatcgaagacagatgcaattctcagcccttggttttctccatcctgtgccactgcgacccatattcttctctgtgacaacagttaaatgacgaacatggcagcccaaacactggccaatcaagcatgtttgtcccagcatgcttgatttcttaattgcccacaattttaactttaaacaaattatcattagtacaatcttacactttgcatttctataagtcatccacacttttaatttgagaacagttaacatatcgtgttccttcatcttttttttatatgtgagggtcaagattttttctggaattttcaacgtctggccacagttttgatggtgttatttccaatgtctaaattgttctttaattgctttaaaatatttggcataccgaattgacttgtaaggccagaaacctgggacccattttttttctgaagttctatttcatttttcttatataaattataccttaatccatcatccatactttccatgctggatttctttaaatttaggtaagaattaaaagtgaactaagtgaaaaatctaaaaatcccactcatcactgttaggtagctgagagactctgagagtacacttcaaatgctgaactaatctccatgaaaaactctttgctttaaagcaataatgagaaatctcagcattttgcccagtggactgactcaaatggattatgactggcctcaaagcctgaaacaccaggagcaaaatatagtgttttaacacagcgggcatattcctgcctttactcattttgttttgggtggctagctatacatcattcttctaggcttttgtagtataaaagctgcatctcagaaagcaataaggcacttagtaatgtatgaacatgtatacaaaaaaaaaaaaaccctttccccacagaccattcttcacaaagaaaatgaaaaactgaatttattatagcttaaatcaggtattagatagttccataaatgtagctacttcaaaaaggaaagcaaattttagttagaaattttatagagctggtggagccaagatggccgaataggaacagctccggtctacagctcccagcgtgagtgacgcagaagacgggtgatttctgcatttccaactgaagtaccgggttcatctcactagggagtgccagacagtgggtacaggacagtgggtgcagggcaccatgcgcgagccgaagcagggcgaggcattgcctcacttgggaagcacaaggggtcagggagtttcctttcctagtcaaagaaaggggtgacagatggcacctggaaaatcgggtcactcccaccctaatactgcgcttttccgacgggcttaaaaaacggcgcaccaggagattatatcccgcatctggctcggagggtcctacgcccacagagtctcactgattgctagcacagcagtctgagattaaactgtaaggcggcagcgaggctagggggaggggcgcccgccattgcccaggcttgcttaggtaaacaaagcagctgggaaactggaactgggtagagcccaccacagctcaaggaggcctgcttgcctctgtaggatccacctctgggggcagggcacagacaaacaaaaagacagcagtaacctttgcagacttaaatgtccctgtcggacagctttgaagagagcagtggttctcccaggatgcagctggagatctgaggacgggcagactgcctcctcaagtgggtccctgacccctgactaccaagcagcctaactggaaggcaccccccagtaggggcagactgacacctcacacagccagatactcctctgagacaaaacttccagaggaacgatcagacatcagcattcgcggttcacaaaaatccactgttctgcagccaccgctgctggtacccaggcaaacagggtctggagtggacctctagcaaactccaacagacctgcagctgagggtcctgtctgttagaaggaaaactaacaaacagaaaggatatccacaccaaaaacccatctgtacaacaccatcatcaaagaccaaaagtagataaaaccacaaagatggggaaaaaacagaacagaaaaactggaaactctaaaaagcagagcgcctctcctcctccaaaggaacgcagtttctcaccagcaacggaacaaagctggacagagaatgactttgacaagttgagagaagaaggcttcagagcatcaaactactccaagctacaggaggaaattcaaaccaaagacaaagaaggtaaaaactttgaaaaaaatttagacgaatgtataactagaataaccaatacagagaagtgcttaaaggagctgatggagctgaaagccaaggctcgagaactacgtgaagaatgcagaaacctcaggagccaatgtgatcaactggaagaaagggtatcagtgatggaagatgaaatgaatgaaatgaagtgacaaaggaagtttagagaaaaaaagaataaaaagaaacgaacaaagcctccaagaaatatgggactatgtgaaaagaccaaatctacatctgattggtgtacctgaaagtgacgaggagaatggaatcaagctggaaaacactctacaggatattatccaggagaacttccccaatctagcaaggcaggccaacattcagattcaggaaatacagagaacgccacaaagatactccttgagaagagcaactccaagacacataattgtcagattcaccaaagttgaaatgaaggaaaaaatgttaagggcagccagagagaaaggtcgggttacccacaaagggaagcccatcagactaacagcggatctcttggcagaaactctacaagccagaatagagtgggggccaatattcaactttcttaaagaaaagaattttcaacccagaatttcatatccagccaaactaagcttcataagtgaaggagaaataaaatactttacagacaagcaaatgctgagatattttgtcaccaccaggcctgccctaaaagagctcctgaaggaagcactaaacatggaaaggaacaactgctaccagccactgaaaaatcatgccaaattgtaaagatcatcgaggctaggaagaaactgcatcaactaacgaccaaaataaccagctaacatcataatgacaggatcaaattcacacataacaatattaaccttaactgtaagtggactaaatgctccaattaaaagacacagactggcaaattggataaagagtcaagacccatcagtgtgctgtattcaggaaacccatctcatgtgcagagacacatataggctcaaaataaaaggatggaggaagatctaccaagcaaatgggaaacaaaaaaggcaggggttgcaatcctagtctctgataaaacagactttaaaccaacaaagatcaaaagagacaaagaaggccattacataatggtaaagggatcaattcaacaagaagaactaactatccaaaatgtacatgcacccaatacatgagcacccagattcataaagcaagtcctgagtgacctacaaaaagacttagactcccacacaataataatgggagactttaacaccccactgtcaacaatagacagatgaatgagacagaaagttaaaaaggatacccaggaattgaactcagctctgcaccaagcagacctaatagacatctacagaactctccaccccaaatcaacagaatatacatttttttcagcaccacaccacacctattccaaaattgaccacatacttggaaataaagctctcctcagcaaatgtaaaagatcagaaattataacaaactgtctctcagaccacagcgcaatcaaactaaaactcaggattaagaaactcactcaaaaccactcaactacatggaaactgaacaacctgctcctgaatgactactgggtacataacgaaatgaaggcagaaataaagatgttctttgaaaccaacgacaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacatttgaaagctagcataaggcgagaaataactaagatcagagcagaactgaaggaaatagagacacaaaaaacccttcaaaaaattaatgaatccaggagttggttttttgaaaggatcaacaaaattgatagaccactagcaagactaataaagaagaaaagagagaagaatcaaacagacgcaataaaaaatgataaaggggatatcaccaccgatctcacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtggcaataatcaatagcttaccaaccaaaaagagtccaggaccagacggattcacagccgaattctaccagaggtataaggaggaactcgtaccattccttgtgaaactattccaatcaatagaaaaagagggaatcctccctaactcattttatgaggccagcatcatcctgataccaaagccaggcagagacacaaacaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacggaaccaaagacaaaaaccacaggattatctcaatagatgcagaaaaggcctttgacaaaattcaacaacgcttcatgctaaaaactctcaataaattaggtattgataggacgtatctcaaaataataagagctatctatgacaaacccacagccaatatcatactgaatgggcaaaaactggaagcattccctttgaaaactggcacaagacagggatgccctctctcaccactcctgttcaacacagtgttggaagttctggccagggcaattaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacattatcaatgtacaaaaatcacaagcattcttatacacaaataacagacaaacagagagccaaatcatgagtgaactcccattcacaattgcttcaaagagaataaaatacctaggaatcccacttacaagggatgtgaaggacctcttcaaggagaactacaaaccactgctcaatgaaataaaagaggatacaaacaaatggaagaacattccatgctcatgggtaggaagaatcaatattgtgaaaattgccatactgcccaaggtaatttatagattcaatgccatccccatcaagctaccaatgactttcttcacagaattggaaaaactactttaaagttcatatggaaccaaaaaagagccctcatcaccaagtcaatcctaagccaaaagaacaaagctggaggcatcacgttacctgacttcaaacttgtagtatactacaaggctacagtaaccaaaacagcatggtactggtaccaaaacagagatatagatcaatggaacagaacagagccctcagaaataaagccgcatatctacaactatctgatctttgacaaacctgagaaaaacaagcaatggggaaaggattccgtatttaatacatggtgctgggaaaactggctagccatatgtagaaagctgaaactggatctcttccttacaccttacacaaaagttaattcaagatggattaaagacttaaatgttagacctaaaaccataaaaaccctagaagaaaacctaggcattaccattcaggacataggcatgggcaaggacttcatgtctaaaacaccaaaagcaatggcaacaacagccaaaattgacaaatgggatctaattaaactaaagagcttctgcacagcaaaagaaactaccatcagagtgaacaggaaacctacaaaatgggagaaaattttcgcaacctactcatctgacaaagggctaatatccagaatctacaatgaactcaaacaaatttacaagaaaaaaacaaacaatcccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatgccaatcatcaaaaagtcaggaaacaacaggtgctggagaggatgtggagaaataggaacacttttacactgttggtgggactgtaaactagttcaaccattgtggaagtcagtgtggtgattcctcagggatctagaactagaagcatgccatttgacccagccatcccattactgggtatatacccaaaggactataaatcatgctgctataaagacacatgcacatgtatgtttatttcggcactattcacaatagcaaagacttggaaccaacccaaatgtccaacaatgatagactggattaagaaaatgtggcacatatacaccatggaatactatgcagccataaaaaaacagtgagttcatgtcctttgtagggacatggatgaaattggaaatcatcattctcagtaaactatcgcaagaacaaaaaaccaaataccgcatattctcactcatagatgggaattgaacaatgagaacacatggacacaggaaggggaacatcacactctggggactgttgtggggtggggggaggggggagggatagctttcggagatatacctaatgctaactgacgagttaatgtgtgcagcataccagcatggcacatgtatacatatgtaactaacctgcacattgtgcacatgtaccctaaaacttaaagtacaataataataataaaaaaagaaattttatataaaaatagagaggtactacaaaaagcaccaattggaaaattagaaatgggaagattttcgtatgccagctaggattttaggcatctaattcaaattgccctggatatcttttcatttcacataggaaagaaatttttcagaataacacactctgatttttattcttcgacaacattgaaaaggtagagttttttttttggaaaaaagggcagagatctggatgtcagaaatgtggtctttcccccatgctcataatgaactcagtggccctagataagtcacttcattttccttgttttgatttttccttccattccttttcagttgttactgtcctctcctactttattgagtgtagatgggagacaccactgtgatggggaaggagcatgggcttgggaaccaatggacttgggttaagaatttctcacctttcttaatgaggttcttgacaatctcaaaactgaacattttcatctgtagtcctgtcatcatataatgtaaataatagtaccttttcacagtttgctctgatggggaaaataaagcagtgtatgtaaaaaaagttgcaaagtatgaagcatggaaaatagtaaattgaaattacttcccaggaaggcagagtgacgtgggtataggtgtctctaaatgctgacctgaacctgaaataaccaatgggtcgaaggaaggaaaatacggctagagctaagaatggaatctgcaggatatggcaattgcatgtggtgtgtgagtgaggaatccaggacaacttccatgcttctagctggggtgactggtcagcagtggtgctttatactgagaaaggaatataagaataataatagatttgagggaaatacaattattccaatattgtatctgattagtttgagggaatatgcatgccatcaaggtagagatatctcattaaatagatattacagtttaatctcagaagtcagtaatggtctaaaaaggtacattttggagtcaatattgtataggttcatatgaagccatggatattcctagaaaggttgtgatggaaagaagtgaaaactgaaatgaagacttagtgataggaaacattataggatgagtagcagaaggtaacacagaaaaaaagactaagaaggagagaattgagaggatgcatgagggtaaagaagagaataagaaggcatgtcagccaaaaacgggagcaaggagatagttttagtgggaagactttagtcaacagttgctaaagaccttaaagccctaaacatgaaacagggagtactgctctttggagtttggaatatattctgtaggcaaagaagaggtcatgagcgcttttaagcaaaattaaaacatagccacttttgtagtttagaataagcctttcatgatcctcaggtttataaaacagctggaaaagggttagagacagtcaaggatatgtggagagaaagcagttctgaagaagactggcatgaattccaagcctttctgttctagcattttcagggaccagtccttacagagccattctgtagagcaaatagaaccctttaccctgacaggggaatgccacatttcccatggcaaccgagtgtgggttccaaggctaagaaatgcagaacacctcctattattttgctgggttctaattctacaatctactttccttattgatttttcatgcagacatccaaataaatgtaggatgtttgacttcatgggatctgttagtctgtttgtattagcctcatggaaaagccccagctgtataatgaaagaggagatgtttcacttgacatctgcaatctgaatcttccttacaatggtcatggcagagtaattccttacagtggtcactgtagagttatcaccctcattgtaccaataggtaacagaataaaaggccaattgttcagttccctctgccctactatttatactccaaaggtaagaatcgcctctttctctggtattcttttcggttgaatatgttccaagtagtcatttgttcacctaatcttctacttattaccagagctctagtattgaaaagaagaaaaagtaagttggaaattaagagcccaacatgataaatgcaatgctttctaagattttaaatttgatccagtaaagtgaaactagtcactgggaacaaactccttccatttaaataagttagcgctttcctctgggattaattttctgacacaaagcaatttttgcaaacatttgtggctgtaaacagcttgataatatttagtattcatagccattagattaccaatataaggcaaatattaaatgtaaaatatcaatataaggaaagtatctaaacactaaaatgttttgtctttggatctcaatgaaaatcttccaaatgaagcttttaatgaatttcccattaatgaaaaatgactacttattagcaactatattgtatgcaagttacaactttgtgaggatgcaagtgagaggatttgaaagggcataaaggtaacaatttttaaatctatgatagttttcttacccttcacatgtcttaagatttgcaaagaattaaaaaaaaaaaactcacctctagaggccaaaagttttatcatagtttgttaagttaatagaagattcagacatccattctccatatctcggcttcccaatcacctaactggccaatacccatttgttaccacctggtatatgcaaggaattatgcctggtatgacaaaggaaaaaataaagcctaaaataaagaccatgatcttcaagcatatataatctaacttgcgagaaaggacatttatttggtcattccagttcattccctcccatgtcagtttggcctacaatcttcctttctgtaaatagaggtaccgctcactgagttcagttgaaaaatctaggcattttcaatgatttattttccatcatactccatacccaatccattaacaagttgttttacttctaccacagaaatacaccctacctcttcagtgctaccaccttaatggaaacaatacgctctcttagtagactgttaaaacagcgtcccaactgatttttctcctgtcctgcagttacttctcactgaccaagattgttttcaagcataacatcaggtcataagttgcccaactcacagaaaacctctcaaagacttttccattgcagttagaataaaatacacagtccctttgagggatatcaaatcctgtggccactgtctgtcttttgttgctcattgctccccactctgtctatcactccctaacctagccatgctggccttcttcctgcctctcagatattttcgctagttctctctaagggcatctgcattcattgattgctttaccccaggttttctcctggacacctccttttcattcagatccctgagatgccttccctggtcttctagctaaaggtgttccattcccatcccaggtattatatagcctcctacatttctccatatcactgattactcacggaaattatctgtttattggttcaattttgtatttgttgacttattttccaattgagagtattgcttccatgagttggaatcaggtaaacttactgagaattctttaatgccatgattccagtcaaaaatcattgttttcatattactactgcatgctgtgtaccttgcagaagtaatgctttcttagactccacttccccactgccttggttctttgaaatacctgaggaaaatgtgttgacttcatttaacaggaagcatccagtcaaacaccctgctggaaattattatgttactcaacttcatgtcacattttatactaaatataccattggtttgtaattgctccaaatcctttctcccacctccaaactttatcaaggcatatcctcattcatccttatttagccaatgtttactgagcaccacatatgtgccaggaaacaaccaatgtattccagaattcactttactcagtcgtctacctcatatttgctaaattattctccttgttgccttcttgtaaccacccacattctgttataggacatttctgtatctactgaaattcagcactgtgctaggtagtataagagttacaaataggaagcaagcccagttcctgttactaagaatcttacagtttatatagagagatacataagtaagtgatagtgatcaattaaccaaaaacaaaaaggaagaaagaagaaaagaaagagaagcaaaaatagactgaacactattagaacagaggagatttcaccctagcctagaagtttacagagccccaaggaaacaaaaaaggaaacaaaaattttttaaagattttgtttgccctaaaattttgagaaagttttccctctgaattaaataaagttaaaattgatacataatggttgtacatatttttgggtacaggtgctattttaacacctatatacaatgtgcaataatcacatcagggtaactgggatatctatcgcctcaaccatttatattttctttgtgtcgagaacatgacaaatcttctcttctacctatttttaaatgtacaacaaattattggtagctataatttccttactgtactatggaatacagaacttgtttcttccatctaactatactttttttacctttaaaaaacttattttccccagccccttctcttcccagcctctgataactacattctactctctgccttcatgagatccaccgttttagctcccacttatgagtgaaaacatacaatacttgcctttctgtgcctggcttattttatttaaataattacctacagttccatccatgttgttgcaaatgacacaatggattatcactcagccatgaaaaacaatatgaaattgatttgcatttttaaaaattttcttctgggccttgaagtttctaaatactttaataggatcattttaggaataagacaagttataaataatgcacatacatgtgtatcaggaaacatcatattactaagaactactgtcttttttttttttttttttttttggagatggagttctgctcttgttgcccaggttgccaggctggagtgcaatggcaagatctcagctcaccgcaacctccgcctccagggttcaagtgattctcctgcctcagcctcccgagtagctgggattacaggcatgtcccaccacgtctggctaatttttgtatttttagtagagagtgggtttctccacgttggtcaggctggtcttgaactcctgacctcaggtgatccgcccgcctcggctttccaaagtgctgggattacaggcgtgagccaccgcgtccagccactactgtcttttttaacacagtagtggaaacattcattaggtgagcgaaacttcataactacagccatttccaaacatcttttattttgggaaaacctcagccattttcttcacacagggccctttaaacatgatacttgacaactaggcaaaactccaaaggaagcactaagatgatttcaagagccacagtccctgctattgttctttacccagcctgctgctattcattcttcaggacttatctcatgcacactcagattcaggaaaagaatttgcaagctctcagctttgtttccacagcacccaggcatgtcctcatcaaggcatttcccacatagcagtaaagcactattttaaaaatgtctttttccccagctaggctgtgaactccctgaaggctgcaaccataacacattaaccattgtacccccaaccccatgtctagcacagttcccatctattgaactgaacactgtaatgctagttatatcatttccattgagttcccaagcaaaaatactcacttttatcaagacgaaccatttgtacttgcatttaatgaagtcaaatgaatataccagggactctcttatgtatacagtacacttgacaaggggtgggggaaattaatatataccctctattataccacaaattcactaaaaaggacaatataaataatggaagaatccatttactgccacttgagaatacagtggtgaaacttaattttggaataaaatatgaaaacgacaataaatagattctgctctgctccaataaacttatatcttattgaaggtatctagttgaaatagcagccataaaagttacagaggtagacgatttaagcaattagccatggcaggacattatagggtttactgctgtccgtagctggtctgcttaaacaaggctgaaagccatcaacgcagctgagcatgaaattacagaatcttaatctgcccacataaagatgctcactgttattacagtcaaatgtcatatttaagttaattttgtgaaagatggaccagccatattttcttttgtgaaacaaaacaaaaggaagaaaatagcttgaccccgtaaacaggcacaagtctgactacattctcttacgactgagttttttattaattaatgaatattaaaaatacagaggttaatcaagaaaatgcaattttatagagaaaatagtttagtggttgtctggggctggggtgggaaaggagattaattgtaagtgggcatgagggatttactgggggcatgaaagtggtttatcactgatttatggtgatggatgtaacactgggtaaagttactaagcattattgaattatacactagaaatgggtgaagtttattgtatgtaaatatatgatgtgaaattatgtataataaatcagtctagggcaaaatataaagcttgaaactacagtacaagattttttaaaaatcatgtgtcattaagcagtgttgtattttttaagctctaaatttctaggttgtttataaaagttttcatctgattccatactagcagaaagcatcacttttaatagatgctggtcacctgataataacactcatgttattcaataacatgaattattcaataatactgataataacattcatgtttagtcacgctttcctctccagctttgaaaccagagaagcagagagccactgctagccagcagagctaagttcaatgtggtggatacatccaacagtgtggatgtgattttactgttaattggctttggttagttactcctatttgggccatagctgaattacaactcttggatttgaatctttgtggcataaaaatattaagaaagaagcaatgaggaaacaaacaaaacagaaaagcattgattcaaagggaagaacacaaactacccttaaggggatactttgttttccaatgcctttaaccactaatttgaacctaaactgatactgaaagaaaactaccaggacccaaattgtgtattctataaaaactctgatattttaaatgttaaattacttgaaacataaatttctttgaatctctgctctctaaataaccctctaaaatttacttgaatactaaaatactatttgttactatacagggcagcttgataaagtggaggctgaattattcattaaatcaatcacccattgatttattccacaaatatttactgaatgttctatgtacaagtactctctaggacccaaagataaaggagtgaataaaatgaaaaacaagacaaacaaacaaaccctgtcctcattcagcttgccttgtcatggtgggaactgatagaaatgaaaactaaaataataatgagaatacatactacttatttagaaattactatgttgaatgtgttttgttaattgctttatacacattatcttatttaatcctcctgatggttgtatcatccccattttgcgatgaagaaactgaggcttggaaaggtaaaatactttgtctcctctagtcacaaaaactagtaagagataggattgccccttagtctgttaaagtccaaaggctgtgcttttacctactgtaaatgttgcctatacaaagggccttgggaactttggggaattgactgactgccctcaaaatttgcagataaaagtatcctttaggaactataataaataatagagatctatgtgtaaatgtgagaatttttgaatcataaattataaactaaacataaatatatatttataaacatttgcagagatacatctaaatgcacacatatgtatgtgtatacctatatattggatatgtaaatataaaaatgactttattacattcaggtaaatataagtttccattacctcaagaaaactataatgactgattttctcatgctagggagctttagttaatactttgtgtctaaaattgtaaattataaatttgtttttgtatagactcagaagatagaaaagtcataacgacattttcttcatttactaataaggctattgataatggagactttttcttttaaatactttcattagtctatgctagtattgatcaaatacattaaaggactgttttttattcttttttcatttttctattattactttctatgagatattatttaaaaaataaatctcattggcaagagtattttttccaataatcaacttaacatttatctgatacaattgctccaactacctctatccttctccaattactcctacatagttgtaacacaaggtatcctcttctattttagctaaataaatcttgtctttctcagatgttaacatctttcaaatatttatagactaataacaaggtcctattaattttactatttcatcaaactgcacttatctacttattttcatatccctgtataattcagaaaaaatatgactatagcataatatggataatattgtccacattttattttaacaaccctaccaagtatcataaatatatgagagattatttctgttctgataggtgaggattaaacagcacagctcccattaccaggtgtcagatggctgaatttatactgtctgtggagtactttttgcatacagtgaatgaggatattttcaagttaaatctttggataaataaatgtcaaaggtaatcatctttgaatacatgacttactcttgttgctaaatctgttctggggaaattagcctatcaagggcatatccattaattcctgagatttttctccgaaactttgtagtcttaggtagagtcaccagtctcacttcttgaaaagagacttttcagtactgcacttggatctctgtctccaaacaccatcctgtcttcttgatctcacaggccaaaaagctcagtcatgtaggatttatccctctcctgcatttctggaggtgtgaagtgatgttggttctacttttagaacattttcacattggtctctgatatggattagctctgtgtccccacccaattctcaccttgtggctcccataattcccatatgttgtgggagggacctggtgggagataaatgaatcatgggggcaggtctttcccatgcctttctcatgacagtgaataagtctcatgagatctgatggtatcaaaaatgggagtttccctgcacaagctctctcttctcttgtctgctgccatgtgagacgtgcctttcaccttctgccatgattgtgaggtctccagccacgtggaaatgtaagtccaataagcctctttcttttgtagatttcttagtctcttgtatgtctttatcagcagcatgaaaatgaactaatacagcaaattggtaagattagagtgcattgctgaaaagatacccaaaaatgtggaagcaactttggaacttggtaataggcagaggctggaacagttcggagggctcagaagaagatagggaaatgtgggaaagtttggaactccctagagactggttgaatggctttgacaaaaatgctgatagtgatatggacaagaaagtccaggctgaggtggtctcagatggaaatgagaaacttgttgggaaatggagcaaaggtgactcttggtatgttttagcaaagaaacaggaagcattttccccctgcccaagagatttgtggaactttgaacttgagagagatgatttagggtatctggcagaggaaatttctaagcagcaaagcattcaacaggtgacttgggtgctgttaaagatactcagttttataagggaagcagagcataaaagtttggaaaatttgcagctgataatgggatagaaaataaaatcccattttctcagaagaaattcaagccagctgcagaaatgtgcataagtaatgaggagctgaatgttaatccctaagaaaatgggggaaatgtctctagggcatgtcagaggtcttgatggcagcccctcccatcacagagccagaggccaaagagaaaaaagtggttttgtgggctggtcccagggtacctctggtgtatgcagcctagggacttggtgccttgtgtcccagccactctagccatggctaaaagaggccaacatagagcttgggctgtggcttctgagggtgcaagccccaagccttggcagcttccatgttgtactgagcctgtgagtgcacagaggtcaagaattgaggatttggaacctccacctagatttcagaggatatatggaaatacctggatgcccaggcagaagtttgctgtagaggtgggggcctcatggagaacctctgttagggtagtgtggaagggaagtgtggggtaggagctcccaccttggggcactacctagtggagctgcaggaagagaaccactgtcctctagaccccagaatggtagatccactgacagcttgcactgtgtgcctggaaaaatggcagacactcaagccagcccatgaagacagctgggaaggaggctgtaccctgcaaagctatagggccagagcttctcaagaccataggaacccacctcttgcatcagcatgacctggatgtgagacatggagtcaaaggagatcattttggagctctacaatttgactgcctcactggatttcagacttgcatagagcctatagcccctttgttttggccaatgtctctcatttggaatggctgtatttacccaatgcctgtagccccattgtatctatgaagtaattaacttgcttttgattttacaggctcataggcggaagggacttgccttgtcttagatgagactttagactgtggacttttgagttaatactgaaatgagttaagaatttgggggttgttgggaaggcatgattggttttgagatgtgaagacatgagatttgggagggggtaggggcagaatgatatggtttgactccgtgtccccagacaaatctcattttgtatctcccagaattcccacatgttgtgggagggtcccagtggaagagaattgaatcatgggggtgggtctttcctgtgctgttcttgtgatagtggagaagtctcacgagatccgatggttttaaaaactaagtttccttgtacaagctctctcttctcttgtctggcactatgtaagatgtgcctttcaccttctgccatgattgtgaggttttcccagccatgtggaactgtaagtccaataaacctatttcttttgtaaattgcccagtcttgggtatgtctctttttcaccagtgtgaaaatgactaatacagtttccatctgacggtactaatacagtttccatctgctgttgtcatagtgtagcaaagacaaagtcagaagacctggatttgatccaggatccaccactgaatagcttggttaccttggtaagtccacttaactaagccttaatttcctcatccacaacatgagaaaaataagtcttcatgatttttttttgtgtgacatcaaacacaatgtatgtagtatatattatggaagatatagtaggtactcaattaatcactaaatattattactattattactttcaccattattaactacttttccactattcaaggtatttttttttcttgaattcatcctttaaaattttatcaaagtaatcgtgctaaacactaattcacaaatgtaattcgaaagcctttcatgatccaccatttagccttatgtccctctgcatattctataatgtattcactctgggctactcagcctttctcaaacatctcatgttctttcatgccactaggcatttatatatggctccccttgttctggaatatccctcccctatctcctatttcttgctgtacttgattctgtagtacccaccacagattactagccttcattggaaaataaaagtttagagggttcatttgaatcaagattgaatgaatcaagattgttatatggatataaaaactgctacattaacaaaagtagcatcaagaacaagggagggaatatttacactcttactcaccaatcagcctgcacaaggggtactattttggattcagaaacaattactcttcaatctgaagatcagaatgataagtgattttaaatcatgccaaatgaaaagcaacagaaggcactggaaatgtttaatctagaaaagggaaagctctaagcaaattgtaaacatgtgcaacctcctcatctgaaatgggcagtggacttccactgtgtggtcccagaaggtagcactaaaactaataggtattaggaagacagaaatgcatcccaagggaacccttcctaatccccaggaatataggaaggcagattggacaatatgaagagattcagtttcctgcccctgaggataaaaaagcagggtatggggaactggaaatgatgctgaagagtcttaaacctctaaatggatagtgggcaagatgagttgttatgttcctgagatgtggtgactcaaatgctcagcttccttgagatttttcttacgttctcagtcaggataattcacacacatttatttttttccattgccattgttctatgatcatagcaccgtccatacaacaaatcatatctccattttacccaattttatgggtaggtatttctggatgagaaatgtgttatcgggcaaccacagcctctttaatacagaagatgctcaataacaggtattgatttaattttataaatatggacaattcatttatcttttcaatgagtttccttagcagtaaatatgagctttaaatttgatgatctagtattctaactaatgctatatagtaaactccctaataattagacatataaagattactctctactaggtaacaaatatgagtactaatctaaaaattaatttttgaaataagtaggaaaaaacctatcagacccattttatatcaagaatatttgaaggtagatatgtacagagcttcatctgatagagtattctgttactcctgaccttctctctgggtagaatttcatagaatgaagttcttatggttttataaatagtattaattgattctcagtctcagaaaatgtttctggtagaagtagaattgttgtatgtttatcctgagcactttattgaaatttattgtaaacctttgcaatcaggctaaaaatattcctttattaacaccatcccttattggaaactgggggcttaggcaaattggcagcatcaagcaattcttcctaggccatttgtactgttatttccacaatgagtgtagttgctttatattttcaaccaattcacatcttaaaataagtgttcattggtgatttccagaaattagaagcaaactaaacctcctgtcattcaagaatagctacataaattattgtggattatattattgatatgcagtagtcccttcttatcttcagtggaaatgtgccaagattggatgcctgaaactgcaggtggtaatggaccctacaaatactgtgttttttcctatgcatacatatctatgataaaacttgatttataaattagacacagtaagatattaacaacaataactaataataaaatataacaatgattacaatatgcccacatcactactcttgtgctttgggggcattattaagtaaaataagggttatttgatcacaagcactgcaatactgcaacagttgatctggtcactgagatggctcctatgtgactaaagggtgggtagtgtatacagcatggatacctggactaagggattattcgggtcctgggcaggatagtgagagattttatcatgcttcacaaaatggcacataatttaaaacatataaattgtttatttctgaaattttccatttaatatttttagaccatgattgatatgcaaaatcatggacaaattgaggaccactgtgctgtataattataaaaattagtgttataagcacaatgtgacaatttgaaaaaaaaagtttatgatgtaaaagaatgaagtaaaagatgtaaaattttacaaatacttataaatttaacagcttaaataatgatcttataaaacatcagatctgattatataattcttgggagacatttatgagcctcttgcatttctgcacatgttgctagcagaagcactgactgtctttgttctgggctatgttttcaaagatatttgtatagtatacagccttgaaagatagacacagtatctctggaactagttcttttgtttactttttttttttaaccatccatcataataacaataatgcatttctccatagtaaagaccaggcaggattactgttcctaataaaagattcaagttccctacacttggggttcttttcctataacacaaccacttgcatgtgcaggcatcacctggccttctttgtgttgcactgtgggaactggagctcagggaactgctgaaaatgcttttattctggctacagctattattataagtaataaagtctctgattcaggagtgaagaatcttctgtccgtatccagtacagtgtaggaggcttacttattagactgaaaatgaagtaaaaaatctgaggtccttcattgttcttgacattcattcccttgcttaaaccagcttaatctactttcagtatcatcccatgcatttaggataaaattgctagtaataataataataccctaaaacaacaataataatggctaatatttaatgagtggcaaacattgtactaagcatattacatgtcatataatcctcacattgatcctattgggtagatgtgattgatatcaccacttagtaggtgaggaaactgaggcaggggctcagtggtttggaagaaataagggtcatgatacatattagtccaactgttaagcagtttctctcacttttgatctgattcttacccatcctctggggctccattaaatggaacttccttacaaaaaccttcctttgaccttccctctagtcttatttcctcaaggaactctggtcttttcctttgcagcacttatcacaatttatgttaattgtatgactaactgaggaatcctgtgatggcttatatatggtatgtcttccatcttacagagacccacagcaaagggatgaggtctactttgttctccaaagcttttagcaaaacagatgataagaagtgtagtgaataagcagacatgtttaacatggtcattcttgcttacatatatgttttatggaccacttattgagaatcaactaagttgaaacattttgcctaatttattgttaagcacttctactcactaaattccctaaatgccccaatgaactttcattatcatcttttgatgggttgttgctttttacatcttaatggtctaattcacctttgacgtaagccatttgtacattatcaacatactgttatgcagctgtgtgatagggtgggccaaataaattttaatatgcaaatttcccctttaaagaagcaattttagtaaaattatattgttttgcactataaaagctcacaaaataaaagttggaaatagttttgtgaatagctgtgttttgttagaagtaaattcaagtttccagcttgctaattggaagattgctatatcagatgtctgtctgtctgtctctctctctctctctctctctctctctatatatatatatatatatatatacatatatagttttgcactataaaagctcacaaaataaaagttataaatagttttgtgaatagttctgttttgttaggagtaaattccagtttccagcttgctaactggaagattgctatagtagatgtctctctctctctctctctctctctcacacacacacacacacacacacacacacacacacacacacacacacacacacacacacacacctcggcctcccaaagtgctgggattaccagcaccagccaccacacctggccaagatttcaataattaataaagacatacatacatagttcgggagataggggagcacggaagtataataggactatttacaatatggtagaggaggtaagcctcataagaaagttgatcactcattcattcatccatctattccaaaatattattagcatctacttttggagagagtagtgtgatgtgggtagaacacaaaggataccaacaatatcatccatgtatcaagtgcttactgtgtaggcaatgcaaagcactttatatgtgccacttaattctccagataaccttcgaggtaaacattatttccccactttacacatgaatctcatcgaggttaagaaacttcaccaaggtaattgggtcaatgagcaaaggtactggaaaccaacgaagaaaacaaaaaccaaccaacctaacaaaaaaagcctaaaaatatcccctgtcagtatggctccgaaagttaaccacttaataaccacattatcagggcttactccttctgcaagggactttcaagtttatcggtaacataaaataagcacagaaattaccgtatatacctaatataagataaaagtactataacagaggtaccagaaaaatactatgaaattgctaagaaggaagagccagtttcttccaaggtctgcagaggaagaatcagaaaaagatccatgtaggagatggcatttgaagatctcgcactgaagttgtcaatgtgaagactgttttaaacagtgaacacttaatatgggagaaacagcttgagaaagaagaaatgagagaacatttaatgtgggagaaacatcttgagaaagaaggcatgaaagaaactagaaggatcacattgcagaagaattagaatatagttaatcaccaaacacttactatatcccaaacattggggaataaaataggaataaaacagcacagtgaggaatatgggcaggtaaacaaattactatttagtatgatagcagaagtatatagaaaatacaaaaataatagagaatagaattgagaatacaagatcatgtgaccttcctttggttcacactgagtaaattaggatgatagcatccctggagtgaacgagagttattttcaaatatccagataccctctctaagcttcactatttttgctttttaattctgaaaaagaggacaataacagcataataggatgggaaggataatgacttacttgataggatgcttgtgagatcaaatgagctcatgtatgtaacaggtttatcccagtgctggcccatcaacatgctcaataatggtcagttattattattaatattataattattaattctttctgacactactggtaaaggaagaaaaatcacactcaggaaatgtggcaagaagtttataagcaagcctgagttccttcctgccctggaatttaaggccctccattttatatacagttctagtttatggttttggccttgtctgctgctgctttgcacacaccttcaagctcatctagacaactgccaccagcacctccactctccgttcccaaggcacccttgcctaagttcaactgaccatccctcctcagcttcccaagtagcttgcctccattatggcaactgtcatgttatattataatcatcattttataagcaagtttattggtttctaaagtgcaattcaagtacctgcaacattggcatctcctgagagctcattggaaatgttgcttcttatgcacagtaaagtgttagaagtttggtctagagtatgtatcccctgagatcagaaaacatttttttcatctaagtatccgtatacttattgccatctggcaaagaataagcttttaatgaatggtcactacatgtatgaataagtgaatgagttcatagatgccttctcatctctattcctttattcaagttatttcaccttcttttttttttcagcctcggataccaacctttgtcttcccactatgttaaccttcctctgaacacttgagatctttctcttctcagcacctcctgaagcaccctgtattgattatgactgtctttttttctctctctctctccatacgcacatgagcatatatgcatgcacacacacgagcatatgcacgcatgtacatacacatacacacctacaaaaacagagcatatttttcatctgcctcacacccacgattagcatttgtcctagagatcaaatatagtgtccttttttatcttcccacaattgtctaactgagccattcctagcagagtaaacactatttgcttagtaagtatttgttgaattaaagattattgcacatgactgttagagtaggccactggccaaaggaagggactcaatatgcagcatttttttttttaagggacagggtcttactgtcaccgaggttgtagcagagtggtgcaatcacagctcactgtaacctcgaactcctaggctcaagtgattctcccaccttggcctccccagtagctaggactataggcctgtgccagcatgcctgcctatttaaaacattttttcatagagatgaggtcttgctatgtgcccaggctattcttgaactcctagctcaagcaattttcctgtctcagcctcccagagtgtgggatcacaggcatgagctatcatgaccaccctcatatgcagctttttagcctctgcagactctgcatccttgcctcactgagtatcatcttgaaggaatgaaaggaaatacaaggttttatgccatatgctattcaagagatttcagtttaggtgctggaatgacaattggcgtgaaagcagtaagacccttgttctagtagggcatttattactaagttgctacacaaccttgggcaggccattttcccttttgtgggactgttttcccatctgtacattatacactgagcactgaaacaaataatgtctgagactcctttcagtgctaacgctctttgattccatccagctgcaaggtttttgcaaatagtaattaatcagagaaatgagtataataattcgtggcagtaaactgagtatcattccatgctagactggtagcactgcaactgacaatggaagccactgtcaaagacctcacttacatccactctggtgaatagcaagaaagcagagtaagtttgggaaaagccgtaaggtcatataatgtggcagtaaaaagtaagaaggcagagaaactacggattgttataaaataaataaatgtttaacttttcaaaattactgatgtccatttcaaattttaaatttatgatgaaacgaaatggggagaaattaaatatctgaaaaaagagagacttatgctggacccaagggtcattaattgttatgcttcatcaaatgattactggttgagggaaaaggactttgatccctggagacagtattgctcaagggtttgaatatatcacaggcttatcttctgttccaatcttcctctgagacatttgatacaggtcaatacaaagaaagcttgggaagactcttcctctactccagggaagcagcctcaatgtctccatgtcctgttcctgccctagaaagtgatccactggagattctaattaaatttgctatctgaagatgtgggagatgtgtctaattatgctaggctctaaaaacaggatggagaattttatctgagtcttttgttagtcattaaattaaatgaacagttcagtaataaacccagcagagtaaatcaaccaagtgaagtggagtgtagactacattgaaaagttggactgaaaaggtgtcaaacctgtaggagaactgcagctgctgagctctgtaatagagtatttgagaagttaatgtgcattgcaaaagtgtggatacactatgctgtgacacaagaagtgtggttttaagggagaagagttttagagtcatcaaattgacataaaatgacctcaaagctgacaacttttggaactaagaaaatattcgattaatggtcagtcagtgttttcattaaagtttaacttttcttctactaaagaagtcaaggtcctgtgaaacatgaacatcaaatgaacggtcctggaagcaccgtggagaacttgttttctttgttatttcaatttaatgtcctgtagcatggtagaatgactgcatttaacaataatacatagtttcaaatagctagaaggaaaatattaaatgttcccaacacaaagatattataaatgtttgagatgatggatatgctaacctgatcaccacacattacatgtatcgaaacatcactgcactccaagaatatgtacaattattaatactttaaaaacttaaaagattattcaaggaaaaagtacagctattttaacttagagaaaaatgtggttttcatacaggtactttgagaagacatttcagttgctcttcatgccccgacagctatcattgtcgtgatgattattaaagatgacacactgaacatttgagaacccactatgtgtatggcactattctacttttatggggataccaacaaattgatatcaagggcctctatattcaagaggtttacattaatatagttaatgagacaagaccacagaaatgaatgatttgccgattacacaaagtaatctttaattgagcaataatagtttggcctaaagtaggcaaaacatgatatgactccaaagaagataggcactcacaaaggtagaagtgctcaagaaaaaaagtgatgtaaataataaatacttgagctagattttcttatactgatacagttatgaaaaccaaagaaagatgggaaagtagctcagtgtagaggaatagcaagggcagaggcagagagaggaaggaacaggggaatgaagctgacaatagacagaactgcctgaattgagaagtcaaataatgacaatctaaggcaaaggtgtaggtttgggtataacaaaatataattatcattctatattgcttttaccgtagttattttttccttcagggtacagtttcatattagcaaaactaacaggctaaacttataattttctactcctcatgtaacttgtcttagattgagtgtttctatgaactaaggtttttttttctttcattattttttaatgtgtgggatttttcctttgcagttcagatcagctcctctgtatacacagtgttaatgactgacatttaagaatgctggttttacagcaaaattgtccatctcatgtgttactgctagcttctgttgcctctgtaattctcaactccatttcaatgttagcctcataacatttaataatatggagttattaaatcactttatttttctatttagcaggatcagagctacaaaaagtgttctctaataaggctagcgttgtataatgaatcagcgaaaatagtgagggattaatttagaggaaaaaaaccttaggaaataaaatgacattctttatgcctgttactaaaagaaaagcaaaaggtttttttttgttttcttttttttgacagtgcaattacaaaatgtgtttccttattttggtgttttgaaagctgtacagataacttgttaattcctaccccaaaggttataatataagcagtttagagcaatggaaaaaaaagaattattgaaacagcaacaaataaaacacaagagcaaaaatggcaatcatattttgcacttatatactctcacttgctgaggggctatcagcatacaagggctgtcatataatgcagctatatagaaaaaaagaaaacaaagaaaaaaataaaaatgtcatcaaaattatataaaatttttgtcaaatggagacatatgtcaaatggagacatatgtgatgtcagggacatcacaaaaaccaaaaagtaacattattgatgacgacttgtatatatagtaatcatccaacttatgactgggttgttatctttaagatgtcttgtttgggtccccaatgtgtctggactacaggctgcaaaacctagatccaagggcttttgaaaatagtgtccacagccaaaactaatcagatgttcaaacacagtgtctaccaaatgttgtgcatgagtgtacaaaaaatggcaccgtgaaaagagtgctagctgatttcaagagggtgactgggggactgcatcaagaacacacagtggcaggaacgattttaatgaaaaatcctgaagacaaatccacgttttagttttttaaatgaagcgcgttaacataatatctactatctatcatcaccataatttcataaaataaaatatttttaacaccaaaattaaagggagattccaatctcaggaaggattcctcccaaggaaggacaatgggcaacccgatactgatatttgtatgtgtacattgcaaagttcttcttttctttctttttgccccaggccagcagaaatttggccatgaatcagctcaactctatggactcgaatttgggaaaacactgagagaacatccatgagtgctggaattacacagatagaatattttatagtatgcccgcggctttgtcaaaggttggggaagagcttaaggagccaatttaaatagtgggaagaataaggcagtgagggctataattatgtccaagaaaggtttctatctctattttaattcaaattgaatgcagtcacctgaccccattagttaatatcccacagacttctcagtgtcaatctgtgtgtttgtgtgtgtgtaaacatcccttaacttctctctcattttaatcatgttaataaattaacatattccattcttgataccctgtcagaatatgccctcgattatagcagctttgtatggaatgctaattgttttcctgtctgctatggtctctgttagattgggagtctcttcaggaaagagctaagtctaatttatctttgtattctcagttgatggcacagagcatttcacaggatcaccaaatacagggctcttatgggagtaaataaatgaataatgatttaaatatattttttttattgcttaaaaaaccaacaactcaatactttccaggcacattgctggcactagggatagaggaaataattaaaacagagtccttgaactcaagaagctcacagtctagttgataaggcaaacatggaaatcaagtaattaataataataataatgtaggctaatttctataactttggaaggatggaggaggtcccctcacccatgctgagaacttcagggaggggtttctggtggcaccaccaaaaacacatttcttgggcttattaacagttactcatgtgaacagacctgtttgtgggagctggtaatgaggtggccaggtgaatggtacatgtgcccattaagagagggaggaggagtttcaaaatggaagcataagcaaggacctcaaagaaagggagacttttgttttttctgtgaactgaaagaactgatatgactgaaggacaggtgatgtggagattggaagattaatcaggtcaatgacaaccagatttgcaatgcagaatgctccacatgggctacagtgtggataatgaattgcaggtgcatatagacagactgtggtgaaaaccagtgggtaaatacttcagatgagcagtgattctagttggatgtagactggagataatatggaaagactgcagaaaaatcattcaagagatattaaagatatatggatatgatgcttggtgatatagtttggatatttgtcctttctgagactcatgttgaaatttcatccccagtgttggaggtggggcctgggagaggtgttttggttgtgggggcagatctctcatgatggcttggggtcatttttgggagactgagtgagttttcactgttagttcctgcaagatctggctgtaaaaaacaatctggcatctcccttctctcttgctctcttcctctcaccatgtgatcctggctcccctctgctagaagcagatgctgacatcatgattctcatacagcctgcaggactgaaagccaaataaacctcttttcttataaattatccagctacaggtgttcctttatagcaacgcaaatggaccaagacacagagatcaagttataacaccaagatgtttttctagattcctcctactgatttgccttaacttgatctctgatctcttttccacagaagtacttagcttaccatgggccaaatgcttttcatgtataaactcattaaccctcattattatcctatgagatggatactttttaaaaaattctcattttatggataaggaaactaaggcataaagaggctacacggctagtgagtagagccaggatccgaactcaagcacatgcccttaaatgctaccccacactgttgatggtcattagacagtggatttaacaggagacaacaatctgaatggtaagtgtaatgaacatactttttgatgtgcttcagagcatttgaggatcgatatccggtaggtatgtatgtctggagccaagatctaattgtagatatagagacgagagacataggcacatagtttaaaatcagatctgtgggtgtggatgtgttccactcaggtgggtgtgcagagtaggaagagaaggaaggaatcactgggtgaaacagacacataaaggatgaggagaaaaggagatgcctaatgagacagagaagaaaaagtctgagatgcaagcacaacagtgagcctggaaacaggattctggaagtttaaaaaaagttttaggaaggagcaggcaacagaggcaagtgtacaggaaaataagattagatagggactgaaaagtttccactggatttagaaacaaagaatcttggcaaccttagtgcaaatgaattcagtggagggctgggggcagaacttaagctccagttctctgaggagtaaatgggttataagaaagaagagatagtgtagacaactcttctggctgggaaggagagtattaaggattagttttatgtaatggaatgatgattgtagtgtagcaaaagcaaacaaaactaggttgaaatctcagctctggtagctatcatctttatcagtgaaatagaaataaaaatacctactgtatagatttattattaggattagtgattatttttgcaaaacaccaaacaaaaagtagttagtaaatgagaactatagccatgttaaaaatgtaaaaatctgaaaaccttcttctgaataatttatttgaataacctttcatagacaaattaaaactttttaaaattattttttattatttttatctgaatatttgacattataaggacatagtattaatgtcactgtggctatataaattatttaacttttaagtaagaattttaagtaagctttattgagatataatttacctacagtaaaatcacttatttaaagtgcattgttcagtggcttttagtatatttacagaattgtgcaaccatcatgatggtcaacttttaaaacattttcataatctcccaaagaaatcccatacccatgatcagcatctcctaattcccatagcctctccctctagccccaggaaatcactaatctattttatgactctacagatttatttgcctattgttgacatttcacagaaatggaatcatgcaaggtgtggctctttgcgattgtcttcttttacttggcataatcttttcatggtttacccatgcgtaacacgtatcagtacttcattcttttttctggttaaataatattccattgaattataaagacataccacatactatttatccattcatcagctgatgggcatttgggttgtttccatattttggctatattatgaacaatgctgctatgaacatttgtatacaagctttgtaaggatgtatgttttcatttctcttgggtgcatacttatgactgaaattctgagcctaatgggagatttttaaatttagggttttttttttgttttttgttttttgagacaaaagtcttgctctgttgcccaggctggagtgctgtggtgtgatcttggctcactgcagcctctgcctctcaggttcaagtgactctcctgtctcaacctcttgagtagctgggattccaggatcatgacagtatgcctggctaatttttgtatttttagtagagatggggtttcaccatgttggccaggctggtctcagactcctggcctcaagtgatctgtccacctcggcctcccaaagtgctggtattacaggcctgagccactgcacccagcctaaatttagtttttaataacaaaacttaaacatgcttacagacaaaacaatttaaaattgtataaagtgaaggataatttctttccccatcccaatcatacttccctgaggtaaacactgttaacctgaggtaagttttatttccttccttccggtcttgctctatgataggccatgtttcttaacatgaaacattatggtagattgtgtttagctgaaattacaggctggtgaatgagaaaaagcactaccacctgaagtctctgacccaactgctatatccgtcacagactactggtgtgactgtgtgatcttgggtgagtctcttgattttgctggagttattttctcaattttttaagtgtttgggtggaaagttttctgattcaggtcaagcattatatgatttaataatactaagggtcctgaggatgcactattagctttaggcttatttgcaatgtgtttttctttccatttctttttacttatcattggtagaaggaacttcagagaaaggcaatgacaattaccctcaccttgccaaccactgacatttgcttagcatgctaaacaaactttcagagttactggtgttgaaaataaagtccttttgcaggtcttaatttgtttcttttcaatcttctaagtttgctgaatagtttttgttttattaccttttacagagtcaatcagagtggctgagaattttgcttgctatgtaccttgattctacttttcaaagtctagtcatgctcattacaatgacctaacctatgttagaggcatccacatatggtgaaacttctccagagcatctgatattgacacatgtttagtatagatgaaaaagactttaacaaaaagcagacactgttatagtacataatagatgggttgatgaaaatcagtttctgtgtcctaactctgaaatcaaaaaatcccaggggaaactatgtgcatcaccatcccccaagagaacaaggatgaaatctgaccctgctggaaggacttccctctgtctgccagttcttccgcacatatccttgagcctgaagaagagcttccattaaatgtgaactcttcctttgagctataagactataaatcacagtcgtaggtaaatacccaccacttgtcattccaatgaatgtctactacgtgctcatgtgtcacatgataacatacagcatggttcctacctttaaacagatgacagaaatatattctgttttcatagttattactagagttacacagttattactagaggaaaatctacaattcgattctggctgttcttgaagttcattattcccttaggcattatgggatgaaagtgcatgaagaagaatgaaggattgtttgcaagtccccttagtagctgattttgaacctaccaagcagaaaggtagggtctgaaaacagtaataatgtgagaaggcagatgtcccattacaaagagcttggatcttgaacacatgtgaatttctacttgttgacctagggaaagagagagggctccatggcattccatgaaagaggtctcactgtgggctaaagcaagaacatgagatacattagggggccttttacagagaatggaaagaagaaaccaacagtatacgtataggtgagaactcaggagagacaactagcattgtggagctatgatttacagcagaaggtctttgatcggaggttcataggtgctctcgacctattggataccagtagctgcctgaggcctcagtggccaaggcattcactcacacctatcctgatttcctacagttgccatccccattcttcctgtggtaattctttaacttcagggttttaaaaggtatatcgtcttctaagaaaaggtttgttgctcctgaacctgaatgttaatgctacttaacaacaacagaaacgtccatgtttgtcttttttgtttctctgctgggaaaagtgcctgaattagaggctgactttatgagtcacaagaatcccagaggaaaaggctccagtatgaaaatcagggcagggaacctggccagcacaggaacagagctgctgtggaagatagaaagtgaagtaaagtccctgcctgaggaaagaggcctcagctgaccatgggtcccacacggcgcctgtcaaagggcagagtggggatctcagtgctgtaacatgagactcccctctgtgaagtcacagcccaaggtggaaaaatcttggtcaaaaaaaaaaagtctttgtaaaataaattgaaggcttctcatcttgcctctgccagacactgcccagttcttagaagtctagcgtcaacatggagctccagtgtggacaagagtgggaaaggagatgcatatccaacataacatcactcaaagcaattgggacagtgacaaaggtgagaagagtaaggaagttcttgtaagtgaggagatttctatgggaaaacaataaggaaagtgttgtattgtgaaagtgtggaaatggttgcctaggacatcttgtgattcaccaacaggccctataaggagggaaagaataaccacagaactccagcaattataatggtagaaatctggtagaggctctgttttatatttcacagctgctttcctcatgtccagtgtagcttagggtctacaggtaccataggccctgtactatttcactgatggtgagaatagtaagaacttaccaagtaactggtcagatagaaaggaaaacggggctactatctgaccttcaggtttcccatgcagagtctctgaatacccagcattcaataaatacaaatctatatatagctatggaaaaaaatcaggctggatccaaaataaataaggcagaagctgattaaaattcatacatatttgaaatattctatccataataaatttctagaccttttattttcttatttctccttttttacattacaggtggctgttgactatatccacaaaagaaactctctaggtccagtggtccctaaatcttctgagaacaggggtcagccacatctggattgcatatcctcagaagtgctaaccttataatatgaatttaatgcctgtttggggtctgagtgacagtttcctcatctggaaaatatagaggttggactaaactgtttagtccaatctttgtacccaaccatctctgaacctatgttagcatctagttatttttttcccataaggctgatggaataatatctttacaattatgccggaggcataggaaagaaaacagagcatgaattagatgaatttgaaggagatctaaataacacagagaaatgaaattcttattcatatcctgatatccatcttcatttgggtcaatttattatgttaggcaggttgctcaaagaacacttggtcacggggatgagttagggctgaaatctagtctgaatgctgttcaccatgccacagaccctgacacagtgcgtgccagaagaaggggagccttcgtaaaatttggacaaaggctttggccgcttagtagtggcccagtgtaccctctccttttaaaagcaagccataaaattcctctttaccctctaaggtattcatttcctctggcatagagtgatcttaagttttagtattcaatttggaacacacacacctactgactttaaaagccctcttcaagagatcctttaaacctcatatgagctgaaggtctacagaaccaaattaaagggttgatagggaaggtttattttctcttctctgagaggcagattttaatcttttaattaaaataaaattctacattctaaaatatttagatctctatataaatacaggcaggcttgcacagcccttcccccatactgccaaccctaccattcatctcccttcacaattcactggactcactattaagttatgaatggaaacagtcttttataacagtcttttgaaaaaaaatcattctcacctcagcctgaggtatctattgggggggtcacaatacatcatctcacatatacaaatataatgatagctaaaatttatggagcacttcatatttatcaggtattgctctcagcactttatataaaacctcttgaaatccttataggtaccccatgagattgatactacaataattgctaccttttagaaaagtcccttgctcaagtttacaaagctagaaagttgtggaggcaaaattcaaactctaatattttgtgttctagagtctagtttcctaaccatatattcattgtctgtctatctatctatcttcatatatcaatcagtcatctgttgatatatcacctatctactaaaaagatgtgactattgtttaatggggtgtacttttctctgaagcagaattcaatacttgaagaattactactataatattcagtcaatatttattaagcacatttaaaaacacagactctagtaccagcctagttaggttcaaattctaccttagaaaggttagctaactgtttcatcacctgcaaaatgggataataataacacatacctccctgggttgctgtggagattaatgagttaatttgtataaagttctgctgggtaggtaacaagatgataaacagtgattgttgtaatcattatcctcatagttgccatcatcatcatctgtattgtcattgttactattagtactatatgccaggtacgatttttggcacagggaataaaatgataaataaaacaaaacttctgctcaaataaaattaatattctaagtgtaatttctgatgacctcatttgcaactatctcatctcattgtttccatttgtttctcaaaccatgtaccgtaatatttccataaaattgggatgatcatagctaccgcataagtcattataaggttaaaatgagttggtacatataaaacttctggaatagcgcatagcacctaagggcacccaatacacatcagtggttttaattaatatctacgcaatgggtgttatggtttaacgttactatcttgattctgagtcctacaatttgttgccatggtgatttttgcatagaattttctcataggtagtttccttcacaaaggaatgcttttgaagctgtgcttattctctgttttcttattgctacccaataatttgatggttactaaagtaaatacaaagattgctcccaaaacacaaacagacatactaaaactaacagaaaatattcacatcatctcagatagagatattatctcacttttaacttttttttaaaaagctaatcaattaaatttagattgctttatcacggagttatttgaacgtcacagaataggaattctggagtaaaaccaatctggtttcacttcccaactctgttatctcaaggtatttgaccctcatgaagcctcctgactctacctgcctgggttgttgtgcagagtaaataagagcttttaaaacagggtgagttccttgttttctgttgtcctttacattacaaaatgttaactgtgcttttaaaacaattattgaattcttaatgaaagaatatcttcccgctagtatcaaaaaatagtgagggacaacaatgaatgctgtaaatttaagaaattatctattgagacaatgcattaatataaaatcaaggggtatttctttccatgtaaaccctttcacagattgcattgcagaggaaataggctataaaaccaaatgtagcaagagtggcctctgtcactctgggagtcaattaatctctccttattttccttaattcatattgggtttagtgatcacctacttcaaaaagggagtgacagcgtttgaaaaataagctactacataaacttagaaaggggctatgccttgtgagtcattctcagagggctcagtctcttggttttaattaaaagtgaaataaagaattctttaagattatatcagccttttaagggcataagaaggtcactgatttgtaagcatcttctttctttttctaatggtgctgtttcccagattgaatcgtgtgaacaaggctcaaatttcctttcagaatctacagattcgtggcagagtggatgtgggaagtggggaacagagtgagaagctacagtgtacagagtgaacgtgattaaggctctgtgagaagatgagcttggatgtgagaatgccttgggtacagcccagattcctccaattgctagatcaaaacacacactttgcaaaattaatgagattattagaaacaataaactacctatgtaaagtgcctggctactgatctgtgtaccataaagcggctattattttgtccacactcctgagaagaaacatgtaagacagaaataccactatgagtagatagaaaagtatctcatataagtataaaatcacatatgggattagacacatgctgccatttacagggagcctataaacgtaataataaaaggaaaaatatgtgacattgattatgatgacaagaaggatggctgctaagaatgatagaaggtctcagcccaaacagctttcttatgacctcaggggatttgcctgaactgataaacattttctacctgatttgtgatagcaacaaaaatcaatatacatgagttcaaggctttaaaatagaatacacatatgggaacaattaataatgactaatgtggctagtgcctggatgaaaattcatttgctcaatttcccttgatcatcacagcaatcctatgaggggaacagcacagatacaattattcttctcactttctaatgagggaattgaggctctgagggtggtaacatgtttagctaaaatgcacatgattagtatggccaaatgggaggcttcagacctagacagttcgggcacaatccttagctcctctgtgacttcaccttgccactacctcaaacaagggacccgatatattttgtctcccttccctcccattgttttctaaagagttttatgtttaagtgtacttattgtggacaagagtgctcattctgtccaacaggggcaaagaatcaccctccagtaaatatcccaagccagaaaattcttcccctgagtcagtcaccaagtaccacctgttttatttaataaatagttctgaatccatttgtacctccctatctcgatagtctcagttcagttcttcattatttcaaccctgctctataatataatactaactagtttccctgcattcaaacttttcccacacaggtggcagagtgatctttttaaaaatgcaaagcagcttgtgtctttgctcagctttaaaactcttcaacagctccccactgcctataggataaagtacaaaatcctcagcttggtaagtaagatcttctatgatacacagctgcctttttctccaaccttatcacccacccaatagccctcagccacacaggtagtctggtagtcccagaaggcattgtgtgcctttatataacacgatgcttaacttattcctatttcttttacttggaacacatctcttccctaatcctactgataagctcagtgtcttcatgaaaatgcccagaaaaacaagggcagagttaggtaattcctcctatgtttacctttagagacttacatgcacttctattagagattagttttggaatttgtatttgattttgtatttacagactttgaaacagttaaaacattaaaggcccagtaaattttctgccactctgcaaggaaagaaagcttgccaaagataagttttagtattcaatttggaacacatatacctgctgactttaaaaactcatttaagggatcctataacttcatatgggctgatagtctacagaactgaattaaagggttaaaatggaaggtttactttctcttctctgagaagtaaattttgaagccttaatgaaaacaaaatggcatgttgtaaaatacttagatctctataaaaatacaggcaggcttgcacagcccttcccccatactgccaaccctaccattcatctcccttcacaattcactggactcgctattaagctatgaacggaaacagtcttttataacagttctttaatacaaattaaaattcattctcacctcagcctgaggtactattcaggggcttaccataactctggcatatgattgaggtcttataaaataaagatcttgctctgcatcccaaaactaagaatggcttgaggctgccaacgttatgatttctacaaaggtggtaaattataaatgtggattctctgagcccagcagagaacagttagaagttagacctatgagaagatgagtgtgcatttttcatagataatgcttcttatacatgattagaaattgatggctaggtgtggacggggccatttctttgtgtatgttaatgcctctgcagaaggaacagtctgaggtcatatttgcttccaacactaccgcttgtaataatctgattgtagttatgctaaattaaataagcaggaggcccttaggttaacgctgtctccatactctgagttcccacataacaatctgaaacctaacttagaagtgttacacagagtagcgtttcagatactcacaagcagctgggtttcagtcaattgcaggcagccaactcatcacaccgtgcccaaataaagcagatgcctagctgtagcccatcaggtgatttctctgctttgcttctgtgtacaggctataaaaggttgcttctcaaactgctcagtggagctctctaaacctcttctggttctgagtgctgcctgattcatgaattgttctttgctcaaataaactctgttaagtttaatttctttaaatttgttattttaacagctacctagagattaggtacatttgagaaactgaggccttttagcagatatatatcacatggtaagtaattcttcatttatatgtctgtgagatatttaaggggagagaccatgtttttttcacctttgaatccctaacattaaggatgatgcctggtaactagttgaagtcccatgaatatatatatccttcagtgagtgaagatgttttatgacgatatagtgcttcacagttcatttcccatccaaaacctgccaatatattttaattagccttcatctggtttatctcagcctctgttatcaactgcaaaataacaataattaggaccttttatgtaaaaggacaaataaatgtatgccataaatattgataaaacagccaagaatactattctccttgccctagaaatatcaaaagctgaaaaacttactctcccaaagtagaaaaaccaattaaaacatcaaaattaccttttttcaaagaaaaagagatgtactagataagcaggagtcccatagaaatcctatttgtttttcaaattttagtttgatttcaggctctgcacatttcttgcttctgcaagcattaagaagtcaattcctccaaacataatctgcagccataggcactgtgccaagtaatttaaagtgctttcctaagaaaaactaacaacttctctgttttcttttaaacggtcttacagaagtaaattgtgtgtacaattaattcatccctgaatgtttgctattaattcaaagagctgagaacttgggtattcccactgaagctcagaaaatacagaagactgactcaggttgcttttgctgactaacctttattcttctaaatgtggattaggaattaaactgatgtaaatgtaaggatggtttcacatgctaacttttccagagctagtgcatattctaatctgaagccataactgctatatcaatatgggcaagtttctggaatagacttcaggaatttttcaaaagctctgaacaaaatatacatcattatctactgcatcctaaaaatcaggcatttcttcaacatttttggctttttcaccttgcacctttgtaaaaagttgtcccattatagtagcatcttgcactttgtggatgatccttgataaggcttagctaaataaattaatagatatatttttataatatcttttttagggcaaaagattctagaatatttatatttaaccatgaggtgtaataagacgtagactgtgaagatagtagattgggttccacaacattactagagttggataagggtttttctatctaattctaagttctcatctacttccgagggtctatatgttattcaagaacacagagaacagcacacaggtgatggtgtcaaaaatggaaccagaatattttactttgcccctgaattattggctgcatttcaagatacagtggcttggagaggtatttcccattggaaaaataaataatatctgaaatgaattactgagtcctcacgaagaactgacaggtgcctaatggatttataatgtagacaatcaccatagacatagtttatggtgaaagtacgacataaagtaagttctagttattatttgtttctatgcatggattcattcattcatggagtagttttatatacctactaagaactaggtaaagcgcagcttgagcttacgacttgttttcaaacaggtaacagtttgcttgtttgcagattttatttccatgtttatgtattcatccaataatcctgagctcctgctagccagatactgtactaactgttaggaatatagcagtgcccaaaaatacacaattccactcattgcgcttacagtgtagcaggtgatacagtcatgaaaatcacataaataaatgtacaattataaattgcttgagtcttatgaaaaatagaaagaaaatatataatgggggcctgattttctgttttagagagcttctctgaagacgtgcaatttaagcttggatctaagatgaccagaaattaatcaggcaaagtgtaaaaagagctttccaattccagggaaaagcatatgtgaaacacttgagactagaagagatttagtgcattttgtgaataaaaagaaggccaacatgaatatgtggtcagcaaagggaagagtgaaatgaggtatccaagaggcaggcagtggctaggtcatgcagagcctggatgctatgttaatgacttcgcattgcatcctaatgcaaaaggagatctgatctgtattttttacagatcactttggttgcactgagaataagcctggaggtcaacagtggaaatggtgagaccaattaagaagctattataggtgggagatgatgggggcttggattaaagtggtggaaatagaagtaaagaaaagtgaataaatctgagatattttggaggtagaatcaacaggacttgaagatgaattgaatggcagatatgagggaaaacatagtaaggatgactctcaagtttttggcttgaacaatgcggtagatgtgtgtgccatttactaagttgaggaagtatggaggaggagcaaagtggggtgaaattaagatttttggtgtcaatgcactggtagtgacaaggccactaaaatagctgtctgtgtgtttttgtgtgtctatgactgtttttctacaaagataagataaagaataagataatggaaaaagaaaaaaagaaggagaaagaaggggaccaaattagaataaattgaaaatagaatacccaaaaaggggaatggtggatgggggttggggcctggtgcatatcagaattagggtgtgtaatttgaaaaaaaaattcaacattgtactataatgtttttatttgaaaaataaataactatggtattcatgatacagatgacagaaagcaagctgaaaagaatcatatctggcaggtgcacatagaggtgaactgttatcagctacttcttcgtgaatttttcaggaaggatgcttcaaaatccccattggaatggaaggaaaccaatgtaacttttacattcataaaaaaggaacacaggataaaaagaaaaaaaatatttactgacacagagccagaagaagggaaggaatatgagaagtcgggataaagatagggaaaggatagaaaaagagaaatggggggaaatttttttccagtgagcaaaaatggctaatggtctgccaggtcagtcatcatctgggtttgaatcccagctgtcacttactaatggatgatcttgggcaagtcaggcaacttatcaagtctcgattttctcatttgtaaaacaaagataataataacatctacctcaaaaaattattgtgaggattaagagaaataattcataagaagtatttaacaaaatgcctggcacagaagagctcaataaatgttagctacccttatgtagctgactataggtacataattactagcaagtcattacaggtatgtggctcttctcacttccttacggctatggtgactttgacctttcagctttaaaatggcatagttcactgtatcaacaaatagttttaatgatttgttaaaaatataggtggacttaatgaatatttataaagtattctgaaatattagttagactttaattattgcaaattaataaaaaaatgccctagctgatttacatagtcaaaaatgtgttttctcatttatttctggaaatgttagatgtaatttaaaatttgttatttaactctcctagagagaacagtaattgacttccaaacttattctttcaaagtatcaaaaaataaagatgatattcttagcagaccctcttgatatatccatcttcactctgaatcgttctaaagtctgtattttttcagctctaacaatattatgaagatattcctgtctgaaaaaataactatatagacaccccattctgtgtaggaacattacaattgggatctctgtttagactgaattggaactaccttgtggaacgctgaattctatttttcttgctttcctctctctccaactcaggctactatgaaaagaggaggtcttttttgttatttatcatatataggctttggaatactaacacagaattgtgtccaactttcagacttagaataatttctttacaaagttgttgaaagactcaaaacattctcaaaacattctaaggtcaaatttggactctacatttattggcaagatcatactgagggcaatacctttaaccactctgaacttctatttcttaaaataggctgggagcagttaaataagagaatatatatatatgtacatacataggatggtaacataatataaacattaattttacgttccgtgtggtgagatggaaccaactaatcctgtagttttggacaagttgcttaataccttaaagactcagttaaatggtgatattaatctaatattttagttaaaatattaaatgataatagtgcatatttcttaggccatgttatgcctggagcatagtaagcacttattaaatattatttaaaaatattcaacaaatgttctctttcatccttctgtatgagtgaaatggtgttaagttccaaaattaattcttctggaaaaatataatgaatgccttattaaaatgtataggaaccaggaacatgtggagcatcatgtgatcaatgtctaagtgctctgtgatcactccagggaataaaacaaaacaaaaaggcaatgttcttaatttctcccattgcaccaagggaacagcagaacatctctccactttggggaagatgtttagtgcaagagaagtgagcagaggcggattctacccatttatccttgtggaagcacatgcagttcgagaagatgaagtgaggaagcgcatgcagtacctggtcatctcagagtcaggtagcaggcctaggtggtagtgggaatagggagctgagaggaggaagcttttgtcacactcaacaggggaatagtgcctgggagaagcaggcttatcacatagtttgttcacagtgctgtaaacaggttccggaggcctggtgatacaagaggaagagaaagatatgcatggttagtacatacaaggaacacctgtgcaaccagtagcatctcagcatgtgcaaaagtaaaaacaatgccattttatcttgatttgttactaaaagaaacccaattttccacttgtaacttttcttataataaagactttattcctcagactcttctgtgggtaaaagtggccccatgaaaatgttcagtccaatgtgatgtgagtgctctgaagtattttgtgaactagaatagctgcttataaggaagctcgtttagccagaattcttgaaattttgttctctcccatttcctccgtttacttacctggaacacagacatgatgggtggagcttcactggtcatcttagaccatgaagcaaacttgaggataaagccaaaaaatacacatagtggaatataaagatagaacctgtgtcactgataatatggagtggcactataccaactctggactagctacctttgaattccttctatgtggataaagataaactgtgttgttcaagctaggatcatttttttcttatataaataggacctaatattaacagatatactcctacaaaatttaagactgcacatctaatacaaagaaatagtataaatagggcctactacaaatgctaatatatttaattatgtttggagtccatctaatatcttctgtatacataggaaatgtaaagaatgttattttctttccatataatttggtcctatgaccacttggagaaatttctgcatcttaatttgaaaatattattatacacaaaatggtagctgatctaaactgccagcacagaaccttagaagaaaggattcaatgacttcttttagatcataaaacattctcatgataatgtcatttcggtaacattgttgtttctgcctgggagggctgatccaattttctcagtctgatgttgactctacagactaagaaaatgatgtttccaattttctcctagtccttttacctcagtagcaccatattctgagtcacattttcacaatcaaagctggctaatggagatcttttaaaaattcctggttatattgtatttaactgaattctttattcagtttctctttgaaaatattttactttctgaaaattacaataaattcaagccaatgaaaatgagatcctgtattttgtccagggttgaactcttgaaacttttatttgaatcttttgggaaccattttgtgaatataatattatcgtttgattcacatatttaatagatttggtgtttggagcaggctttaatacctcggattttagaagaaggctcttatttctttgctttcagtcaccttcaggatggtttcatagtggactgatatttgctaagcttaattcttcaccgttcaaagtcttatcaacacagagaaacagttactgatatcgcaggttcattttacctttgtttcaccttctatttcttacctatttatttacttgttattttgtacattcactggctaaagaatagagatatcacatccagtttcttttgttgattgtgagagcacttaatatctcagaagatgagtagatgaaagtataccaaaacataacaaaccacttgacaaatttgacaaagccttcttgcaatactgacaaggttctcttgcaatcaaacaacaacattaaaaatatcagtaaaaatcccctttcaagtggcataaaaatggggttcacatttgaagattttttttttttttttagacgtaatctcactctgtcacccaggctggagtgcagtggcgcaatctcggctcactgcaaactccgcctcctgggttcacgccattctcctgccccagcctcccgagaagctgggactacaggcgcctgccaccacgcccggctaattttttgtatttttagtagagatggggtttcactgcattagcaaggatggtcttgatctcctgacctcatgatctgcctgcctctgcctcccaaagtgctgggattacaggcgtgagccaccgcgcccggcatatctaatggttttattacagcgctaggattctgtcatatattctatcatatagtatgtatattatgtactagagcacagtacagtatacagaaagtacaacataggctacagtctgaacacagaaatggcacatagtaggtatttggtaaatgtttgaatgaatagataattttttttttttttagccattctttgcagagggaaattttaaaaaaccttctggttctttcaagggagccataagctactctaaatttttcaggccattataaattctcacaggttataccagaagaaccagaatcccaatgttatcatgaactgagtggctttaagtacttaattatagcatgtgcgcatggttcatctgccctcaaagggataggtttcttgtgcgtttgagtttagccactgaaatgcctgcccatagttcctgtgagagtcgctccaatgggcacagtgggctcctcacagacttctcggccctgagttccagaaggcctaatactgggagccagcattcttagtctttccctgcagttatattctgtgtgacctctgcccatcagacaaacaagaaatgccgttttataaaccatcactgaaatctgggtggcagaacagatgccactatcacttcccatttagttggtaaggaagtgccaaggggaaatgacttttggcagcgtgaatcagccagtcataattgaaagggcctgcttatcctattataaactgccagaatggcctaggtcagaaggtagtgaatatgaaaatccaacccaagaggcctatctgtggatgcccacagagggagggaaaagtatttgaagatattggtacaatctctaagtgaatttataaacaaatcatttctcttgctgtccatttataaagagccatagataatgacgttgtagctcatctgctgagccatcagcatttatttgcacatctatgggtttataattgcaggttcttatagcatataattagcacaccctggcccttggtgatctctcttttctctgaactccattagcacttgctatttgttctatttccttgtcatttttaattgctaatccacaatactggtgtatgttggagggaggtgcttcatctataccttattcttaggaaaactactttgcctataactgctccttcccatttggaccacttgcactatcaaattcagtttcctccctaaacaaagcagtttagaccattggattaggattgggcccctcaccttgcaaccatgatctgtatggtggggctcaaaaaaaagaaagagagaaaaaaaaggcctaggccatttggattctcctatggaaggtgaataatgtgaataaaggagaaaaaattttcagttaacagaaaaaggaaaagatgcaaacatggagaaggtagctgtagctgtgtccactaattatagagcaccagagtgaagctctatcaaattttgttgctaaaatgtctagaggttccttgagtctagaataactgtctgggttcattcttacagcagggttatgagagctcatgctattgaatttctttgatgattcccatatgacattagttgtcaatcagctacccatctcccaccctgttcccttattggaagttagatctgatctcatgtttgcaatcactacagtgaaaataaaacaggcaccttgtttattttcacatctctttcatatcacctcaactagactatgcctcccaaagccaacagacaaaaccttgggcctctatgtaattacatagtacctgagactaataccagactgactctatctttaaaagtttgatattttgttcattataaattcttttgcattaattttattttctaaaatatttcattaaagtatttttgtcttaattgctgtttctcggtgtccccttaaattttgcacccaacatgagtacctcactcacctcactatagtccctgccctgtatcagagataatgtttaagacagtgataataatgactgtgattgtaaatagtcttcatctgtgtagcacctgaacctacaaggtcaaaggaatatgactctcttctctcagagataacaatgagagtgacttacactttattgagttttctaactccctaccaaagagctctcaaagccttcaggctgtctcaggcagggacctcacctcattgcactgtctttattaattcacaatgctctctccttctctagaatattagaccctggaggatcaggaccaaatctcatgtgtctttgtttccccattactttcctcaatgcaagaatgtattactgaagtactgtcatagaaaatgaaaggaactgtgaaatgaaaagtgatcagtaccttttattctcttttcccgagccagaactaaaaggggacatctaaaattacaaaaagatggatttgggtcatatatgtatatgattttgagcataaatttcttcatcatatagactgatatggctaaatctgcagaactttcagattctccaaaggttatcctgctatggttttcttgggttgccataataggagggggcatccaaccgcatgccctgtatttgcagaatatagaaccaaactgcattaattatagcagctgggacgtcaagggctcagatgcctaagtatctaatatattgccagatatcatttgaggaaaaaggattgtaactttaaaagggtgcctcatgctcctctttacaaataatacactgtttattgggccaaggatttggaaaagtataagaggattgaattccagtcctgggctaatagctcttaagggtgggattttgggaagccctaaaagtaattaggggataaaagagaattagtatcaggctgtgaactatgtggctcaacatgtgaaatgacattataaaaatggttaagaaagaggctgacttctcttatactgaactttaagcagaaaggtattagtcacttgattaaggtgttatacaggccttaaagtatgatatagagacatctaggggagggattgatctaggtgatttgtaagaacctattcgctcccctaattccaagcaccactgaattgggcactcaagaatttccacgggggcagttggagtagatgcctatttgcgccacgcttacttaactcttacaaatcttagctttctcatttatagacctaaaataatatttaaaaagatttttctgtttaccagaaaaattataaattgcaaaattatgcacagacctaaattattatgagcaccatgttaagtacaagcaaaccaaactaggtttagatctggctctttcaaattctaccttgtatgaccttatgctatttcttaacatcctcatctggaaagtgggaatagtaatatcagcctaaagatgattgtgagaaataggaacaatgtgcataaagcacttagttcagtccgtggcacttactcagagctcaccaaaaaggagccattattattatcttgattatcactcttagacactcgagctcacaaggatgcataacctcagaaaatgttggtcccctttgtgagaattcctacaaataatattcttcacccactcacttagaatcagtcagttcacacgatagcactttcatgtaatgtgaattctctacaagagggttgaaccaaggaagtaacaatcgatggcttttagtctcgcaaaaggtactgcacaggtgccttctaaagactcacttttgctctgtatatttaaaaggtaattgatcctctttaatagccctggaggttgatgaccactttctctgtacttctcaattattttcactgcctctaacaatatagcagccccaactctaacgcccgatttgtacctggatctttataatggtttgctttcccgtatggttcacagctgtggtatcacatcagattgttgggtcataagtaatttgttattaataatagtttagataccacagtctgcaaatacttactatttaaaagtagaaattaggattggttcactattttttctatgtaaacatcactctcagttatattttactgtgtttattgaggagtttattggaagattgaggagacaaagggcagagtaagagctgcatcatttaaagttgttttgaatattaagatgctttatttccttaaaaagtgtttgggtttcaacaaaattaggctctctcacggcagtgggttgtaaatgggttatggagtgtttcattggaataagaagttgaatattaatgaccttgacaatggtgattgtaacaaaagggagagggatctctgtttttggtattgggtgagggtgtccagctatagtagaatttttgtggctttctgaaagatgtttaaacaaatatagtctaagagtcacagggtcaatattatggccagatcaaggccgttgagacatggatttgaattatttgaggaaggttcaatatgtcctatactagtgtttaaactcttacacttttgtaaacctgcttttaaaggctttgtattgatttttaaaaaatttttaattgaactcataggataaatatagatctacaaaatgtcaggttagtagttactaagaatcgtgatggaaaaaaaattaagcatgaaataaataggaggaatcacataaaagatgagagatttgactacataaaaatttgaaaccagccgggcgcggtggctcatgcctgtaatcccagcactttgggaggccgaggtgggcggatcacgaggtcaggagatcgagaccatcctggctaccacggtgaaacccagtctctactaaaaatataaaaaattagccgggcttggtggcgggtgcctgtagtcccagctactcggggaggctgaggcaggagaatggcctgaacctggaaggcggagtttgcagtgagccgagattgtgccaccgcactccagcctgggcgaaagagtgagactccatctcaaaaaaaaaaaaaaaaaaaaaaattgaaaccactgaagcaagaactcataaacaagcaataagctggggaaaacatttgctcaaatatatttatcaatattttaaagatgctcctacaactcaataagaaatgcaataacattttagtaaaaaacaaagacaattagtatccaatcacaagagaaaatacaaatgacaaatacacacacacatataaataacctcactaggaataaaaataacacaaattaaatgatacatcccttttacctatttttaaaaaaaggatcttgaaattgacaaatcacaatttagttgtggtatgttgaaacagacactatattgctggtgctatggagtgtaaaacctccttaaaacatttcaagaaagcaatttggcaatatatttcaggagttttagaagtaatcctgtcttttggttcagcaattctactctagtgtgctatctgaagaagaaaaataaaaaatatgtacaaaagtttctatagaaggaaagtcattgtgatttgttataacagcaaaacagaataaaacaaaacaatcaaaatgtccagcaaaagaagggtatggaatataagacacattcacatgacggtttattgtttaaccattaaagttaatattcataaaacattttaatgagacaggaaaatgctttattttataatgttgaataaagttaaatacaaaattgtatatggggctgtggggacagcaggaagtgaaagcacctaattctcttaccatttcagagagagactgagctaagaatatgtgaaagtaaacactgctgagagtagcaattctagtgcaggtttgaaagagggtgaaagggtgaaagagggtgaaaagggagaaagagagtgaaaggggtgaaagagggctttctagaaagtggtaacagcacgtgcagatttaaagaggaatctgcaaacatgttccatttagggagtttgttaatggtttgagtagataattgaaaagttaggcaggtcttgagtacaattttaaaatccatagttgataagaagttatggaagacagtgttcttcctactagttggaattaaatgagtacaatcattttggctattcatttgtacattcattcattcattcattccacaaatatttaccaaaaacctactttgtggcaggtatatagtaaaacaatttaaaaaatggtccctttgtttgttgaacaaacattttgtttgtaaggaaatctgattgcaggaacagagacttatttaatctactttaggtaacaggacacatgtgcatagaaacccagaaaaagctgtgtgataaatacggaagagtgagatctaaggagctggatctctacagctttcccttcaagataacgctgtttcttttgtgctacttgttccttctgtctcaaatcaccactttgacctctaatttataattgagatactttctacctgatagcttcttcttgccctcagtttctgttctgtaatgacatcagctggcattagactcacaatggatcatcgggcctcctttacatcataaatcactagcttcccctttcactgatcattgcctcggttgaactgcttttcaattaaacattcctaactgagtatttgttggacttagtacacctttttgagtaaaccaccttattggttacttgttagcctctggattggcatcctttgggccaagtacactccctgtctattcagctctcgctagcagatgagtgacctggtccttatgagtttggtttgctttttcagcagaccggtgggcagggcacaattgtttaagctgggtatcccactggtattttcaggtttgttctgttgagtatactccccacatcttcatattcttagccagtactatgaaaccacagtgtagagaaaaaaagcaaggccattcctttttgagaaaaacttggaaataacaaaagagaaaggaaagtgtgaggaacattacaaaggcccccaaagagaaggtctgaagcttaatatcacctacaatttctttctttttatcatggtgtcaaaaatataatattacagaataaatactctacctctaaaataattcttttctttcctcggaggctcgaggatgattgacattagtaacacctaaagttgccaaatctgataaagctttgggttttaaaattcacaccccccacaagaatttctgaatatatttagcaaaatcacattttctaaagtagaattcaaaatgtttattcatctatatacttctgtaggccaattttacattactaagacaaactctacaggggggaacactcttatacctttaactgaatagatgctaagactgaatataacagcagcttcctagatggcaaaataatgttcagatataattctctacttgtgaacaggaaggataaggtggctttaatcgaatcacttaaatggatttctttcacattccttggaagaggtacatttccctctgtttcatgcagctgtttccatttagtcttctgtgcctgttactgtaaacaggttatgaagattgtttggtggccatgagggaaggataagacatgcataagaacaagagattgttgtagcactgccttgctctctttagagaaggctttttgctaagaagcacctttacatatattggtccttccttccacccctaaacattagaaagtccctggtttctatcagggtctaactcctactttctccataaagtctgttgagtacacctgattgtagatttttctctcttcttaactcccatacagtatttcttcatgattgccacttggttttgtactttgatgtattttaaataataataacaactcacatatatcttgagaacttactatgaagctggccctgtgctacatatgctttatatacccgatgttattaatcctcccatgaaacctaagacatatgcaatactattatctgcaaaggttggcattaacctgcccctcctcacatacctgacttgtgagtggtagcgcttggctttgaacccagattgtctgggttcaaaccactaagtgttctgttgtcattgttttaaacactttctgtagtatatacttgccctcagtgatctgattatatttcttggtcatattagcaattatacctcctattttaaaggcaatagagaataggacagaggaaacaaactgtgattctcactatctagattcaagtccggccctattcctttaagacatgtgatcttgggcaggttgtttacctctatgcctcagtttcctcccctaacccaggaatagtgcttgggtcttagggccttacgagtattagacgaaatgatgcatgaatagcacagtgcctagaagacaatcagtaaatgttttgactactatagatatttaaataggaaatctggctgtaggccatccggtttatacatctctcttgtcatgtctgtggatgtgaattcattcatgagagacgattccctcttatgaggacaaaaccatgtttctggccatgtctagggttacaagatttagctaataaaaatataggatgccccagttacatttctattttggaaacataacaaataattttttagtataaatacgtgactattacatgaggcacatttatactgaaacttattcattgttgattattatttaagttcaaatttaactgggcatccttatttggcaatctgccagccccatcaccttgcaagttcccatgcattgctagtaacctgccttccagcatatacatttactctgtaataaaatttacttgtttactctgactctccctttagtttgctatgttcttttatttgtttttaaaatttatttatttaattaatttttttttttgagacagaatcttgctctgtcacccaggctggctggagtgcagggttgcaatctcaactcactgcaacctctgcctcctgggttcaagccattctcccatctcagcctctcaagaagctgagattacaggtgcgtgccctcatgactggctaatttttgtatttttagtagagacagtttagtcatgttggccagtcttgttttgaactcttgacctcaggtgatccgccggcctcagcctccccaagtgatgggatgacaggtgtaagccaccacacccggtctgctacatgcttttaaatcagcatatgtgcttaattttgtattttcagtgctcattaagatgtctctatttatatctatccccatatacacatctatactcaaatctatacataagcatgcagatagataattttaaaataaaagttgctcatattatacatattatgccactgcttttatttttaaatttcacattggatattagacgtttttctgtgtcagtacacatggcaccggctaccttttctttaatggctgcaaaaacactctccacacactggtgttggtagtataaactgctgaacctacagttcagaaatgttacttccagaaatctgttctacaaaactgagtacaataggtgttcacagaattgtcattgtcacagcatttgtagaagcaaaccactggaaaaaatatttatgttcattagtgctgaatatagttttaacgtaggcattaaaaacattcctgtgtaagtaaatttgatgacataaaaagacagccacaagatattattaagtgaaaaaaattcattagcattgaatacagttttaatgtaggcattaaaaactttcctatgtaagtaaatttgatgacatataaagatagacacaccatattattaagtgaaaaaatcgagttaaaataatatatatacagtttgattcagtttttgtgaataataaaaaatattaagtacgatcccaattttacttagtagagaatgagattaaaaagagtctagaagcatacgccagggaatttgttcaatatcatttatgaatgatatgtctacataaaatttttatttgctcccactatttcatgttttctaaatgacattaagaattattaatgacataaactgagcaatagttataaatctgtatatatagtttgatgccaattttgtaagaggcatatctgtacatctgtaggttaatatggaaaagttaccaacatgttaatagtgctttctctgaatggcgggattatgggtacttttgatttccttaaatttttttttgtattttaaattaattttttaaaaatattttttgtaccccataaggggatagatcttgaatgttatcaccacacacacaaaaaaggtaactatgtgaggtaatgaatatgttaattagcttggtagtggtaatcatttcacaatgtgatatggtttggctgtgtccccaacaaaatctcatcttgaattcccatgtgttgtgggagggaccctgtgggaggtaactgaatcatgggggcaggtctttcctatgctgttctcatgatggtgaataagtctcatgagatctgaaagttttataagggggagtttccctgcacaagttctctctctttgcctgctgccatccttgccttctgccatgattgtgaggcttcctcagccacgtggaactgtaagtccattaaacctctttcttttgtagattgcccagtcttaggtatgtctttaccagcagcatgaaaatggactaatacacaatgtatacacaagaaaacatcaagttgtaccccttaaatatataaaaatttgtcaattatacctcaataaagctggaggaaaaaactattttttcttgtaactccaggggaggactgttagggatatgtattgggtacttttcaattcagccccaaagatccacacattcttaacccagaaacagaaaatatgtattttttcaaattagtactgtttccttattaatgagcaacttttatttctatgtagtgcctaggtactaactaacatggcattatgagaatagtgaaagttcattataaataactggttatgactaacaagatggcttaactggtatcaccatatttgctatttaaatttgtcaatctcaaatgtcttcagttatgcaaatatattctgttactaacaagattctacttaaagtttagtctacttcggggaaattatgtgctagctacagccattttatagaaaagatgacacaaaattaaagcaaatttacagcaagtatagtcttttttactggtgcatctattcactcaacatatttactgcccttagaaaacacattgggaggctatgaacatggtggaaagagcgcaagcttttgggctagaagatctgggttcaaatactgttcttccacctatctgtgtgactacagggaagtatctctattgcctgaatcttggctgccttatctggaaatggccttttaagatctaccttataggactgctacaggattaaatgagataatatacgcaaagccttcacaaatcacctgccatatggtacatactcaggaaacaactatatttatataccagatactaacctatgtgatatggaagataaaaatctgctcttgacataaattcttccctcaaccattacttcgtcttggagatgcgtgtatgtatttgacaaaataaagctaaaaatgactaagcattatgggagggaaatagacactcttccctcactgacaaaacacattcttaaggcaaccatacatatggctttcccgtttatgctcttttaaagtctcagaaatcaccactaaagaatgtatttatataatcaaacactgcctgttccgccaaaaccttttgaaaagtaagtaaataaataaataagagctgttttcttgtacactgttggccaaagtctttcatgcaggttgagtaagatcacaaattaaactgagggacagatgactagtcatgaagcccaagaaagacagcattaattgcctattgtgaggatctagagaaaactgtgctttattaccgatcctgactggcccagtatagccgatggaagtcagaggtgctgttaagtgaactactggaatgaggacacagggaataacagaactagatggaagagattttttagaaagactagcaatagagccaaaccttctgtctattatatctaaccaatccggaatagattcaacagatgagagaagttttaggacaatacattccaatcacagcttagatagacaccaggcaacaaaactgctagagttgtaataaaagccaggcacagtgaaaagtaatggtcaaaatatcaaagagccaacgggctccacagaatcttgaggtcagcccagaataactccgtgcagcagggtggtatacagaatatagaatttggagcaaagtcaccccattatcttcccttttgtctccttaagaaatattctataaaatctatgtgatttgcctaaaatctggaattgggttttttagatggtgaagtagaggagggaaatggttgaattctagattattacaagaatggagggtccccaaatttctcagtcactatatggtcacaaataccatcacctttaatctgtacaacaacaaactttcacggtggatattacatatagcttttgcataatggtggcacatggtggcgcacgcctataatcccagccactcaggaggctgaggcttcagaatcgcttgaactcgggaggcagagattgtagtgacccaagacttcatcattgcgctacagtctgggcaacagagggagactgtctcaaaaataaataaatacaaaaataagtgggagggagtaggataactgaaatattaatgtgagttttgagcttcctgttttttcttcccaagtgtgaagcagataaccagacctttatattcccttgcctcagtagagatctgtaatacagaagaaaagcagaattttcccaaagacttctctcttccaggttttcgttcctcaaaaatctgagctcctaaactgttgatgctcagggtgagctctgagagaaaaggcaggcaagatagagcctattattatatatttggatttaaagaaaataaaataatgctctgtcaaaatgcatttatagagtgaagtgcatatccgctacaggtgtttttaaatagctgatgcctttagttataaaatctaaatactgttgtacaaattctgtgtttggtaactcttgctcaggagcaatgattttctttgcacattatcactagtagtctcagtggtttagggtcgtccgctattttaatgaaaatttatcctatgagagaaatgcctctgtgtgtgtgtgtgtgtgtgtgtgtgtgtgtgtgtgtgttttctaatgtgcttttactttttgcattttgctgttacttctggtaacatgattttccttctctttccttctttccttccttccttccgtccttccttccttccttcctttccttccttccttttctctttctctttctctctctctcttttttttttttttttgacagagtctcagtctgtctcccaggctggagtgcaatggcacaatcaaggctcaccgcaacctctgactcccaggttctagcaattctcctgcctcagccgccggagtggctgggattacaagtgcccaccaacactgctgactaatttccgtatttttaggagagatgtggcttcaccatgttggccaggctcgtcgaactcctgacctcaggtaatctacccgccttggactcccaaaatgctgggattacaggcttgagccaccacacccagccaacttctggtaatatgattttctgaggtcaaagacacaatgaatttaagacagtgattcccaaatctacctgtgcatcagaatcacctgtggatattttagttctgtttttgacacttatgtcccacttccaccctggacatccagatttggtagatctggcatggggctaaggactctgttttctaaagagatttcacaggtgactaatgggctatcagagttgagaactacaattagacccgctctttttgaaaaaggtcggaaatagtcacatttttgaatgacattaactctttcggtactatagaatacaaattattgtgctaacttattatgacttaattatattccatggataaatgttaatatttgtagagtgtaaatattaagttcttttttcaagggaagacaaaaaattgtgactttcattatttcactggcgaatacacacacgtgcacatacacataatttttaaaaaatttttgttagcagaatttaaacaaatatttctctctaagctgcagaaaacaatggttctggggatagccctaccttgctttagtcaggcagaccacattctcactgtgagtgccacactcagttgcaactccaacatagtttcccttagttctcacaaatttaaattcggtataaccttattagagctactctcaatattatatggatttagatgtatactctgtatgaaacttcgacagtatatgatcgaaactaatattatgcagtgaagccatggaattaatgccactcctaggaactggaaagcgtcatgatagatgttgctatgcatatatttaatttctgtgctcatataatgatggtctacaaaaataaccactgcatttactttttaaagtttatgatacctgaatgggaaatctgaatatttggggaatgcaaatatttgtgattactcaacattctagattttttttttaagtttttaaatgaataatcagtttctttaacatagacttttctttttgcatgacttttacaattaggcctggtttttgacagattcttcttaattaacatcagtatatgtttttaaaaggcattgaaatatagagaaaacatcactgaatcaatataaagtcacaaaatctattcttaatacaggtacaagtgtagtgtaaatgtatgttttattaggctagctgtaagagtgtttcccccgcattcacttcttaacctcactctaccactcccagctagctcaactatcatcacagcggaagccagtcctataatgactatggtttcctggactaaaagtcaacattaataataataatggccaccctgaatgtagctcattttgtgccaggctctgtttgaagtgttttacatggattaatttatttaatcctgataataacccgtggcataggcatggatggggaaactgaggcacaaagaagttacataactcatccaaagtcaaatagctagtaaatggtgagcccagactcttttgagtctaacatctgttctcttaaccaagatgttatcctccttctggcttctggcttctgagtttgtcacttactttctaattgtcaaaggcgaaatcatggaatctatcatctcaggttccaaatctgtacaacagatataatggcatctctccgtccattttgtataaagtcataggaattaaaatgagaaacaggaaagtatctgtgcagtactagatagctgtgacagtttactagtactattataaattcagagcaaggcttcacaaaattggctttgaaatatttgactatcacatttatttcagctatttcgttttgccttcatctcttatctcaaggtggaaaatgagactttagaaaaagattaaagcaaaacaaaaaataaaatctcaggctccaatggatcagttgataacattcccattaggaaggagtatacatgagaaaggactcacattgttctacttcaaggtcaatccaatttttttaaagaaaacctaggatgggggtggatatttaaatgtttacatgcagtgagacaccctcacaaccacagctaagttctttcagcaaatgcttattaaggcagccacatggggtctatgtaatggccagaatgacaggcattaaggactgactccccacccagcactccatggaagttgattgctttctggaacaggttgtgtttctgggaggaggcaaccacataaaactttagttctacctttctaagtaaaagaaaaaccaagactagcttgaaacagagagaaaattctagaaatcttaaagttaataatgctacctatgtagtactggaaaaaaaaaaaaaagccatacttgagttggtctgattcttgaccttgttatataccaactgcatgttaatagcataaagatatggattttggagcccaactgcctatgtttagacaccagctttgctcattactagctatgcaggcaaggacttaactgctctgtgcctagatttcatctgtaaagtgggaataaaaataggatttacctcatggagtgatgggaaggttaatgggtttatatacttagagtgtctaacacattgttatgctagacaaatacttatcttttcactaatctttcttgcttctgcttactcatgcataaagtgaaaataataacaccaatctcaaaaattaattgagatattttatggaaaatacttagcatagactggcatatatatggtagaaattcaataaatgacagtaattattaacattaattcaaaatgaatttttacattttttctaatattgttgtccctatggtctccagtgttgattagaaataatttacaagagagtatgaaacattctttttctctaatgggtttaaaagcactgtagaaaccaagtaaactaactgagattgtagactaaatgtgataatatttgaaaggtatccagcaccaagcagatctcaataaatggtgttcctttcccatagctctttaagattcaataccatgttgtatgtgataactacacaaataggttttaactctaatgatcttttcccttccttacccccattttcttggattaatgtctttttagattatcaacaataaaaaataagaattgttgctcctatgaggatggggaaggaggaagcaatttaacatacgttaaatgccagttatttgatttccacatggtatctctatttttcaacactaccctgccaactaagttattatctcttaattacaggtaaagaaaccaagggataaatagtgcaaggtcatagaactatttaatggcagagcctttaattaatctttagcaaatttctaggatacaatgtagtattattaactatagtcaccatgctgtatattagatttgtagcatttactcatcctgcataactgaaactttgtatcttttgactaatatcttcgtgtttcccccttgacatgtgcctagacttatccagttccaaaagtcatgctacttccttccacttaccttcctgcctctaaaaaaataaatatcttagaaatactagagttgaaaaaaattgaattacacaagattatgggtagggccttcaataatggacctttaaaaacaactgggattaatcaccataagttttataagttataatttggagactagttcccagatgttaagcctaatctatttacctcttattttctatatggactgtacattttatataatgttttatcgcttgtagcttccatcacttaccagctgagtcagccttgggttagtcaacatcagttacctcacgtgtaaaagggggtaattatagctgcctcctggaattactatgcaaattaaccaatgtatatcaaagcactttgtaaactgaaaggtattacacaaatatcagttatcactattaccacaattcttatgaattctaagaagtatttaattaatatctgcttataactgaggatgttctggccctgaatattgtttgtaaaaaatacaagcaaatggccaggtgcagtggctcacgcctgtaatcccaggactttgggaggctgaggtgggtggatcacttcaggtcaggagttcgagaccagcctgaccaaaatggtgaaaccctgcctctactaaaaatacaagattagctgggcatggtggtgcatgcctgtaatcctagctacttgggaggctgaggcagtagaatagcttgaatgcgagagacgaggtttcagtgagctgagatcgtgccattgcactccagcctgggcaagaagagtgaaaccctgtctcaaaaaacaaacaaacaaacaaaaataagcaaatggcttgggccacagaatgaatagaactcctgcttaagtatccttgcatgtaacttttacaatattgtctcccattataccctggaccctactgaagctgtcacaaggaagtcttagatactagtggctaattcctattgttcttttccaatctcagtcaccccctggaagaagctgttcctgactcatcagtctggattagatgccttttctgagctccacatagctttcagtactgctctccaacacagcatgtatcacctctattatatttttgggtttatttgcctgcccccccctccacacttccactttgctgtctttttgaagatattacacactggcaaatatttgttgaataaatcaaagtatggaaagtgaaagattgaataaatgaaacgagagattaacaaaataaatgaaaagaaatgtagaggaaaaggagaaagagaaaacatgggaattaaagataaattaagagacataagcatttaaattagatacagtattaaaacaagcatttccatatacagctgatgggaatgtaaactgagaccaaaaaaattcaaatcaatctgatagcaatatcaagagttctgtaaatgttcattaattatattatattcagtacacaaatgtttactgagtattatatatgttccaggcactcttacttgtgctgggactaatcaatatacaaaacagataagtccctgagccataaagcttatagcccagtacaggatgacagacaacaaacaaatactcaaataaaaatgatgtcaagcaggaataagcactagagagaaaaataaaagggaacacaggacgaaagggtgatcgtggatggctcatatttatctgaggtctgagatggcctctctgataaaatggcttttgaccagagaggtgaagaaagaaaagcaaaccatgtggacatgtggatgtggaagggaaaaacattcaaggcagaaggaggggcaagcacaaacttcctgaagcaaagtatgcctactgtgatcaagtaacaaggaagtctgagtatcagtgaagggagtggtgggggatgaggtcagagcagccagctggagtcaaatcataaagagtctcataaataagggctttagatttcactccagatgacgtgatctgaatttaaaagagtaatgtatggtgcagcatgagtaacaaaggcaaaaatggaagctgtttagggagctattgcaataattaaatgatagatgatatgaattgactagtgtgctggtagtggaatgtggcacattgtggatgtattttgaaggtaaaacccacagaatttgttgatggactgcatatagaatatgaaaggcggaaaaaaagagaaggcaaaccccaaggtttgtgacctgagcaacagctcccatagaaccgtcatttattaagaagaggaagacaagctgggtgtggtagctcacacctgtaatcccagcactttgggaggctaagggcagggggatcacttgagcttgggagttcgagactagcctgcccaacatggtgaaaccctgtctctacaaaaaatgcaaaaattagcccagcgtggtggcatatgcctgctatcccaactacttggaaggctgaggtggaagaattgcttgagccccaggaggctgaggctgtagtgaactgagatcgagccactgaactccaccatgggggaaagagtgagaccctgcctcaaaaaaaagagagtaagactatggaaggacagactgggaataaaaagcaagagtttgtgtttggacatattaaatatgcaatgtttataagacaaccaagtgagatgctgattaggcagtggaaatttggcatttatattaaatacatatataatcaagagatgaaggcagaaagattgtataagcacaataagaaaatcctaaaaataaatgtctattaataggaaagtacttatgtaaattatggttcagttatacgataggctattatacagctactaaacatgtttttgaagactaagaacattagaaaattctcaagatataatgctaaagcaaaaaataaaagcaaaaactctctcattgcacatagtatggtccaaattacatgaataaacatacagacatggaaaaaactcaaaggaaaatatttcaagtaattatctctctgtggtaggaaaaacagtaattttagtagtttttctttatatttttattttacagtttttctacaaatatatattacttttataatcagagaaaatgaaattagacaaaaataaaacattgaaagaaaaaaattaaggagggctataaggtagatcagtaggtaataaaaagcaaatggatataaagatggaaaaaatatctggagacatatataaagcagtattttcaagatgtgtttttacacagttatagtttgccccattatctatattaatacaattacctagaagtaaaaaatgaacgacataacccaaaacttatgaaatttataaattgatagtgtcgtaagaatgtctttggaatgcaatgattgtatctcacaattttcctatattttgttcaggtaattactaatattaatatagtaaactcacccacagcagctaatgatataggacaggagtcctcaactggtcaggtctatggcctgttaggaactggccacacagcaggaggtgagcagtgagctttactgcctgagcttcccttcctgtcagatcagcccctggcattagattctcaaaggagcgaaccctactgtgaactgcacatgcgaaggatctaggtcgcatgctctttatgagaattgaatgactgatgatctgaggtggaaccatgaaacagtttcgtctggaaacccatcctgcccctgccacctgtccatggaaaaattatcttccatgaaagtggtccctggtgccaaaaaggttagggaccactgatatatgagatggcaggaaatcacccagggattgcaaagtgtcatggacaattgctaaagtatacatctgtgggcaattaggaatcagatatcttcttgtcctatattatcaccttatggatgtatgaacatgaaaataaactcctagaagaacagaccatgtctattttcttgagtcacagtataaatcctctttcagtgtcatacagattatggccagaaataagcttcacattgtgttcatgatagtggttaacttgtaagaggatagggaccaactgatggttggcttctacagcggtccctccaaaattctccattgcctatcatcaatccttttttgcatcaatgaactaaagaatgaaagcaaggatgaacttactccattaaaaatgtaatgcaacattgattaaattactattcaaattttacatgtatagcaacaatagctatgtatatgcaattaccatttccataaaattatagagcatagtgttgtgtgtttatgtctggctaactcatgagcacataggaaatgataaatatctataggagccggttttaaatttctcattagtgttgcatttttgctaatatttatttccttgaaagcaaacagcagcttaacgtgttttctaatatatatttggatgttccccttgaattaagatttgttagattcgccattagcatacccactctctctgcttcctacttctagtaggatagttctatgaatgattcttcatggtttatataagtaaacctatgtggtttaaagttttgtgtggtcagttttctctttattgtttatttacattaataaagagaaaactctccttgaggcttccacataatgatctatctgtctcactagttttgtctcactcccccctttcatttctacactttgcttcaaaacatacattatagtaccagtctctatgttggagaaatcagaaatgcaacacagagcaaaacaaaatctcagagacatttgttcatgaacctttaatttggttaagttttataatgaactttgtaaagtctgtaaggagtctgatgtcatgttttgcagaactttttaagggaaaagctacctagagttagctattgagagtcactatgaattttttaaaagggcaaaatcaacaaattttccatcaaaaaatcatattttagccagagggaaaactgatagactagtttataccatatttgcttccactgatttctgtattagattttcattgcagctggtattagatattcattgtagtcataaaaattaagattctcaataaagcagtcagactatatgactctctgtaataaaatattctaatgtgttctacaagataaataagttgaaaaatccatatacgtagattacaacatgtttgagcagctgcgtaatattgttggctacagttccataaataatttgaggatatttgccaaaaagtggttttatttgtatcacggttcatcttaaaatccttgttttttcaatagtattaataacagctaacaattatcaggtacttatttttgccaagcacgttacatgtactaactcagtttattgtcacaacaaacctatgatgtagaaagtattattttgccccttttataaacggcaacacagaggcaaaggggagttacataactgattcaaggtcacacagctaggaaatggtgtgattcaaacctaagcagggtagctccaggacccacacacctaatcactctgttattctactgtaattctaaagccgggtcagttgcctgcttagggtactctagctgttttccaccatacttgactaaaagtgacagtgacaggaggcagccaaacgcctaggcagataggggtgggtaaccagtgaaaccccaccttcaagcaaaaataacagcctgaaacccatggcccaaagtgataacttctactcctgttcacccactctcccctgattggttctttctggataatgcctttttaccaatcaaatgttgccttttccaaaactacctatggcctgtcctgccctcatcctatgtatataaagactccaggctcagtcaataattagtgaactgggagatgcagaccctccctcaattggagtggacaccatctaatcagctgccagtgcagctaggataaaagcaggcagaggaacatggaaagactagactggcttagtcttccagcctacatctttctcctgtgctgggtgctttctgccctcaaacaatagactccaagttcttcagctttgggactcttggacctttgaccacagactgaaggctgcactgctggcttccctacttttgagattttgggacttggactggcttccttgcctctcagcttgcagatggcctattgtgggacctcaccttgtgatcatgtgagtcagtcctccttaataaactccccttatacatccatctcctcttatgcatccatcctattatttctattcctccagcgaaccctgactacagcctgacttcagggaagaagacctgttcttcctgtcccctctctagctcccctccctgctgagagacgttttcatcgctcagtcaaattatccgccttcactatcatttaatcatctgtgtgacctcattcttcatggatgctggacgagagcttgggaccactgagtgcaggtactcagaaaggctgtcacaccagaccttgccaccaccagaggagggcagccgccccacaccatgaggcaaggggccaactgagctgctaacatactgctgtctacaaatggcagaactaaaagagtactgtgacaccctctctggggctatgggattatgggcaccctcacctggatgccaccacgctcccctccaggagacatgccttgtctggccatgggccccacacggagcttgctcctgtgccagtgcctgaagcaaccagctggatcccacactcactcactcacatgccccctcccacaaggggttgagcacggtgggccaagtagacagggtgcccctaccgcgagtccagtgaaggggccaagagaaatcctgcatcaaaagcatataagaaaagatttctttcctgtataagaagaaacttctagttcactcagaatggttttaagtcattaaatgtaaactaaaaagaagagaggctagaacatgcttgtactgtactctgatgaggtgttgtctgatccttcgagagcttgttcctaatgggtaccataaaccttgagccattattaagggacagtttatataaaacacaattaataattggcaagtttgtgtaacttagctcagtgtttctcaaacttgggtacttaagtgtaccttggggtttgtggtatttgccagggattactaatatcttcagaaaacctttctggtgtgtcgacttcattttaagactcggaagaaaaataacgtagtttgtaataagaatatttttactttaaagcaaacaatattctgcaagcttttgtgataaaatatacaagattttatgtgtttttatgcttgggcagaaatcttcatgttctacctcagagcctgaggagaacaagtttattttctaagttaagggcatgtgagtagaaacatttgacaaacagtgggctggcttctaaccagttctaatccacaaagttaaacaataagagataagaaaaacagaacaaaaagaaacaaataacagtggcaaatacttatgctgttcctgaaagactactccataggtaataaaaactataaaaatggtcagtagtcaaaacagtctgactaagccaggtctgctcttcacgtggaacatgggctattaaaccttgctctgagatatagctcggatttctctattcctcttctcttccattgctaccctcacttcagtcccaggtgtcataatcttttccctctttttttccagtggtctctctactccacacagcagccagaactttttttttttttttttaaaaacataaatcagatcagttttcctgattagtactcttcaatgaattctcaatgaacttaaaattagacctacactttctcattacctgtgaagtcctacttctgcttcctgcttccttatctaacctaattttctgcctgctcccattatctcatctctttctggccaaactggactttatgttgcaggaacacagtaaacttattcctgcctcaatgactttggctttgctattccctcttcttggaatgctatttctctgatctttaatcatcaccactttctactttttattcaggtctcagtccatatgctatctcctgagagaggcactgcctggttatcctacttcatattgttctcttccccaatcactgctcatcacattatcctattttacttcctttgtagcacttagcactaactgaacttaatgcatttatttatacatctcttattcaatatactaaaatgtaaattccatgagggcaagcaccttgaccagtttgttcaccattgtgactatgttgctaataactatgcttgacatgggtagaagctgaatattcactgaatgagcaaataactgaacgaaggagaaaaggcaacttgaatatatattagatgacatggctagtaagctagtgttctataattcggagacaatagagtagatgtggactccagactgatgagattatgtctgttcagtaagtgacagagtcaaactggtgaatattagagttacagtttggggcagttcttgtaaagtgtctgtggacaagaaatctttattgaggctttttttatatgatgctttttaatgaactaaatgatgtgagggaccaataagtagaggcagccagaaagacacactaaattcacagctaggtaaacttggtttctaacactgagaaatatatcttttacagttataatttaggtccctgggtttcataatgctatttatcacattcataacttgggaaattaggtccctacatcttgaaagagtagttttactttgcattaccaatttttttgtttcattttagtactgtttgcatatcctaagtattttcagccagatagtgatgatgtgtggtttgcctctcttctgagtaactagggaaaacttggcccagtaaagatagaactcatagttaccggtaacatacaaaatagacactgttaccaggtaatccttgattgaagatagtttttcataattgctactttcttactccagccaaaaaaatagtgcacatatacatgggctctaaatctgattatactacttacaaatactggaccagggaaagccaacaaatcactctgggccctgtgtctctggcccaaccagaaagagagattagactctatatttacttatggccctttctattctgacagtctataatgcctgagacaaaaacaatctcagtattgttgtaatagctttattttccaaaaattgaaaatcagatatctacatcacaatgaatgccgatttatagggactcagtgagcatgctactaagagattgtatccaaaactttttttatttgtgacttttcttctaaattcatggaaaaataaaacttcccagtttatgcaggtgtacatttctttaatagaaatagattaaaaaatctacctaggttattgtagaattatttgaatcaaaattgctttaaaattcttaccgtacatccataacaaacgtgactataaatcaggaaagtagagaaacatttattacaatagattaagatatgaatacatggaacaaaagttttccaatttgatgtgattttataggttatgggaaagttcccatttcacagacatgtttccctactggcccaagttccgttattagagatttattttcttgatttactattttaggaaaatacaaagtaggtctcaaacataagcacctaaatgaacttagaataataatttacagagccttctaaaaatgacaacattcgtgcatgttaacatattaaaacttcacaattccatgaagaaattagaagatcctttatagcgaatctacggatgagaaaatcaagactcacagagatgaactgacttgttcagagttatctaggtagtaagtggtaggacgagcactaccaaccagggatgcagggatggggcctttgaaaacagacagacctgaattcaaattttgattctatttgattgctgtatgctatgaggcaattacttaacctctctgagaattttttaatctgtaaaaatcaagaataagaatatcatataaataatataggagcaataatatatattacagcacttattgttaacggtgaatagtaatgatccttttgtttttattactctatgtattgttaatcttacagctagggtgcataggagagaaggaacaggaatataaagatgatccaaaggtaggtaccattttcctttgtgagtcttatatttcaagttctaattcttgctttcattttattctatttcacattcttctgtgagtctgcacaatctatcccactaccacaaatgcccttcctcatctcttgactctctgaccaatgcctacacagttttcaagtactaattagagtcatatcctctttaaaactttctttgatgccataggttattcctatggcattcatgtaatactcatactcatttagcagtatttcctaagtgtctcttgtggtgttagggaactctgctagtgctacataagggcactttagagaactgaccctacttttgcttgcttgcttctgttagtaattctcagacttttgaattttacagatagttaacatttaaaaaatgaagactaacaaaaagttgccaatttttctcttctaagtaaaaacataataaataattgccaaattcttttacaaaagaaagggcattttgattacaaaatatataatctcaagattttgaaaaaaattaataaattaggctttgtggaaaacttcatggagggggttctgcataaattagggaacaggcattggggaatccattgatttacacattttttttttttgcctcaattgaatagttcttagatgctatttcttattcatttgtgcatctctagtgcagcaccaggtgtcttataggaagtattcaattaatatttatgaatgagaaagtgaatctgcctctgagcaaatacctctgagacccatggtaacgcctacagtgtgaagcacctatgagagaacaccaacaatggtaagagagtggtggaggggtgtgtatgtgtatgtttatgtgtgtgaactaacataatttactttaacagtttgccaggcaccaaccattctgattttgtagggaaatactagtgagactgtcctctaggggaacaggaaaggaggcaggggcaggatctaagatattgaggcatatctcacgtgtaccgtaaaaatatttcatgtgacatctgaagtggattaagattacagtaagtatagttactgtaaatagataacattcgttgagtacttataatgtgccaggcacctttctaagttctttgcattcattagctcacttaatcatcacaacaacctattgagatagactcactttctattcccttgtacaggtgagaaaactgaagcttgcagaggttaaatgacttgcccagggtcacacagtcagtggtagaggtaggtttcaactatggtctagttgtttttagagctcatcaaaactctgaggtccctttctagccacatatttctatgatgaacatagttttatatgacttggttttcatttttaatattagaaaattaaaacgttttctcttagctaggattttaaagctgttaaggcactcagtttttctacttattaataaaagctatgtgaccataagcaagttccataacctctttgaacttcaatgtctacatctctaaaatggagatgaaagcctttttctgtgtgtttttcggaggattaaatggatagtgtataaaaacagctagcagagggtctggattatgaaggggcttgaataaatgttaattcgctatggggcctagtaacataaagtgacatttctaaattaaaatcatatcaaatattagtaataggatgagagcaaagagatcatcactctggtggataaaggtgcctgtatttacagaattccttagagagccgtgaggattatctttgccgcagccctcattttaattaagagcatagagatcagacatttcagcataggaagaagcttgtatttgatttacatggatgcacattttcagcgtctaaacattccattccttggctaaagatataaagagctacttcagcaaacctgatattgcaaaataaatggaaaatgcttaatcatttaaaaagatacaccaaagaacagaaagatcaaagcatccacatataccagtgaggaaagctttcctctccggcagaaagtctctactttttgaaaggctgacaaatgacttcagttagacaggcagggtataaaaccaaaacaacccatctatcattctttacacacaaacacatatcgaaattaagcacacatatgtatacatgtaatctcatttttgataaaagtattgttcatggagaaaaattgtggaacaatgtgtaaaacataaactcattttgtaaaaataatgtcaggccccacgtatatctgaaaatacatttgtatatgtttgtaagaacatggagaaggtatgaaaggtttatgccaggtcgtcaccttgggtaccctgggacaggtcactctggagggagtttgggggaaatttttgttccttgatcttctttgtattcctttgccaaatgtaatgaccagttaaagacaaaaagtttttacatttacatttctttattattcatttacccattgaattccactaaccaaatatataatattggcatgctacttccttccttttgaatctcagcactatcttctcttctcaagtattaatacttaccttacactatggctgtaaagcttaaatgtgatcagatatagaaagtcttaataaatggcaaagtgatgtataagtgtatcttactatttattcacaaatattttgtgattttgctgcctatcagaggacaatgacacagttgcaatgcacctgaggcaaaactacaataaggttgaatgggacccagaagctttagttagcatccaaaacaacacctgacatgttaggcaaatgtgatttctttctggtaataagagcaaatccaattaactaacaggcatatctgacctggtgtagtcgtcgtcaacaagcatgtgctttggaattggtgagtaccttcctggagagatgggtggcagggaggttttatattctaaagtgccattgttgccagagagtagatggttttccattggtggagaataagctaagaggtgggggaaaaagagaaaagaaacctgttatgtgggtgattcaatgtgtcatgctatacttcagaaaaatgtattaaaaacagaaaggctttgctgcatgccaaggtttttcttgtcctcccagaggggggagttgcagcttatttgcatttaatatatacaagcacatggtgacctttaggataggaaagacttaataatagttaagtctgtaatgccagttagtctaatttggtgaagagaagaactggagaagagatccagcacacatattttcagaacaatgattaattttctattgaaataaaatgttagctttctaatttcagagctcacattgttttcacataattaatatccaattactgagagtaaaagcctcctaaggatcaggttctcctgtgagactttctcccaaaatatactctattcccatcccacaaaggccaagaactctggcctttctttttcattcctccttcctaatgtatctcccttttaggtgactaaaaacacctcctaactgggtctcttgctcctttctctctcctcaaatccattttatatgttgagatgaggtaaaacctcctgaaattcagcttgaccacactattctcttacttaaatgttctccattgttgttatgtatttaatatagtataaactctcctctttgccattcttgcaagatcaatcaattttaataccccccaacacatatcctatcatccgcaaacataggctgtgcttcctgacatctgtacctttgttccactgtaccatctacctagaatttgcctctcctacctaacccatctcagatgttgaaatctcattctgaagatgcaactgaaatgccatcctatgcatatttttctgatgttccaaagacagatgatgtatctcttttctttgagttcccaaataacatttatattcacctctcccatggcatatgcatacctcttattctgccaaatattgcttttatttatatatctgagttagccttcctcccaacaaagctctttgaaggccatgattctatctcctctgcatcccacatattaccttacaatgtgccttgtacatactgaaattactcaatacttatttgttaggtttattagagtcgttttctcccttttctgtctttgacattgaccttatatgccctgcatgaagtggctcacagactatcagggctgattttgctacattcttccagtttgaaaaactctgaaagttaaaactctttcatattctaaggtaagtctgatctcaatttactgccagcttgaaaacatacatattttggaggtaagttgtttcagaatcatcattaagaaaagcaatagctaatgcaatgggcaggaaataaaattgttcaacacatttctctcaagagaaacatgtaagtctgagagaacttgaacaatttgcttgagaccatagtactaattaatggccagttctgaagacgttccaagtttccagtctcacaaatggactctcaacatttcagaatgagcaagcttactactgttgacacaactatcccttacatttacataacaaagtaaattgcttctaaatctagtcttcaaagacagaaacttagttaagattcgtgttgacctattaagaagaggagaacatatgaggcttatgcaacagtggaaatttgaggaccccagcatagtctcattagttgttagttgttgctgcagaagtcccacttccagctcacctctattgccatagtgactgataattttctccagcttacttgccaatataacaaattcaagtaaagtaaaagctatgtgatggtgattgaggatcataatttcgccattcaattgcaagatcccctttttcaggaagaatcatagagctacctctggtctatttgccagtctcttttctaatctactactacagagatctgaagttggaagaaataatatgatggcatgagagtgatcatgctttaggagcttgagaaatagcctttcaaaatgtattgcccatacactactttaatcacactgtcctcaacattaagcctttccataatggtgggcatgccaactcattaggagatctcatcttcaaacaggaggtaagggcctgcaaggcaacataggagtggagtttaggatactccctctgaagtatttccagaagttaaccaagagggaaggtacaagtagaacactttgtcaacagttttatagaattccagttctgcaagtctggcatgctatttgaagatgacaatggtacttacagtgagtaatatcaggtggaccataaggatcagtcatataaatggtagtgggtttgccaacttttaaataaactacctctgatgtgttctttaatattgctactgcctcttcgtgtgttacttcttctaaactgtagttgtttacctgaaagggtgaaaaagatcaatattagagttaaatctatggagcagaagaaaaatattcaggcaagaagatacctggaattataaattgtgataattactgtccagtatccttgacataacagatgaattaaatgcattagtcaaagcagataagtacaatcaatgattctataaaataaggttgcttctgcctttttttaaatgaggaagtgatatacagtaatggaattcagaatagtatttgtgggaaggaaaataaggagtcaaatgccttttttgttatgctatagtttctatgatagaaaagtaacacatattagtggaagaaaacttaaaaaagaagaaaataaaaatcattcatcatctccctacttagatatattgccttaaacaattttgactttattatacacattgttttggaacctgctttttaaacctagagtgactagttgtttgtagcagcaatgtagtttaacaagatgacttttgttttctgcagagcattatgttgcatgactacagtataatgatctaaccagtttcttactagcgcatgtttagtttgcttctaattttttaaaactataaataatgttgcactaatcctttttctatatttgtgcacaactctgataatatttctttgatacacatttacccatacaagtgaaactgctggaccaaactatatgaacattatcagggcttttgatacctagtgtgaaaatgcctgtttccctctggaaagatgaaccggtttactctcataccagcattatatgagagccctcatttccttatagcttcgccaaaccttgattttttcactttaaaatggttctcatcaaaatgtcatttaatatgagtctattcagaacacgtcttttcaggtgagcaagttcaagggtaccctattgtcattgtgttaacagaaatgcctctttctttattgcatggaaaagcctgtgatacaaatgatacactgacttcatggcagtggcattacagtgggtctctgcaccacttctctgaaatgattttaagataatctctctaaaaagacttaaactttgaggaaattagaataaacgttaattcaggaagtatttcaaatacctaggttatccgtatctggctactatataaaaaaataaattttgttgtgtatatttcaggttcacagcatgatgttatatcacacatatagataataaagtggtcactatagtgaagtaaattaacatatccatcatcatagttataattttttgtgacaagagcagctaaaatctacttatttcgcaaaattcctaatataatacaattttattaactatagtctttatgttacacattagacctctagacttgttcatcctacatatctgctactttttatcctttcatctgtatctccccattttccacctccccctgtaaccactgttttatcctctatctctgtatatttgacttttattttttaagattccacatataagtgagatcatgcaatattgttccttctgttctggcttacttcatttagcataatgccctccaagtctacccatgttgtggtaaatggcaggatctcccattttttaaggctgaatatttcattgtgcatatataccacattttctttatccttttatccactgacaggcatgaaggtcgttgccatatcttggctattgtaaataatgctgcattgaacatgggagtgcagatatctttacaaggtggtgatttcatcttctctgggtatataacaagaccagagattgctgggtaacatggtaaatctatttttaatttatttaggagcctgcatactgttttccataatggctacaccagtctgcatcccaatcaatagtgtacaagtgctcccttttctccacatcctcactgacatttgttattctcatctttttgataatagccatcctaacagttgtgaagtgatatctcatggcagtttagatttccatttccttgatgattagtgatattaagcacctttttgcatacctgttggacatttttgcatcttctttggagaaatatttattcatgtcctctgtgcatttttaaaatcctgttaatgtttttctactcttgagttgtatcagttctttataaattttggttattaacctatcatcagatatatggtttgcaattttttcccaatttgtttcattttgttgattgtttcctttgctttgcagaagattttgaatttaatgtagtcctatttatttttccttttgtagcctgagcttttaacgtgatatccaaaacaacattgtcaatgacaaggtcaaggaagcttttcccctatgttcttttctagaaattttatggttttaggttttacgtttaggtcttttagccaaattgagctgatttttgcatatggcattagagtccaatttcattcttttgcatgtggagattccattttcccagtatcattcattgaaaagactagcctttcttcatcatgttctcttattttctttgtcaaaacttagttgaccatatatgtttgaatttatttggctactatttctttaatgacataattgtttaattactttccactggtataatgtaaaattaaaataaatgtcccaaaagcattggactgaattcctatagtacacattatctatactatctaattagcacttcagctataccatactttgcagcactactattcgtaatctttattattttgctccatgttgctatgtaagttccatgtgctagttaatccttggtgatgtagcccaggttagggactgtggaactggagagaattgaacctgactgatgtgtttgaatgctggctgtgagttctccattaagccgtaagcttctctagcacctctcacatttctcttctagataagacatgttcccttaaatcttttttcatttcagtgtctggcatttgtttattcactgatcaaatgtttactgcatacctgttatgtgtcagactctgggccagatattagagatatgataaataataaaaatgataatcaataatcatagtaaacacatatagcccatattacatgccaggcactattttaaagtattttacatatattaacacaatcaaactttcacgataacttatgaggtagctattataattaccttattttacagatgagaaaagtgtgtctccaagaggttaagaaacttgccccaagtcattgatctggtaagtgtcagaggcagaattcaaagctagacagtttggctccagaaaccatgctgttaaccactcagctatactacttcttccagatagacaaggtccttgctttcatgaaacccacattaataatacacaattgtttgtggaatgaatggatagaagaatagactcatgcagagagggagaatgtagaggaacttcaggtatggagaacatagttgataatggcagcccttaataatacagaaataacacgataataataataactaacatttatttaatacttgcatgccatatattttaggagtcctatgtcacatattttgacatgaatcatataacttatcatgagaagagctccaggaagtagatactattaatcaggcaaattttacagatgagaaaaactgttttttaaagagattaacttgcaacaaagaggtcacactgcctccaattgtcaaagccatcaattggatcacaagcctccttacgagatgaaaatgagattatatttgtatgttgattcattaaaagctagggctcatatcacctgttctttctccctttaggagaacagggtttctttccgagtttacatataaaagtagaataaattccaaagtattataaaagcttgaggaatcattatatttcctgcttaatccagtggtaatagtatactgcatcatcctaatacactgaccagtcaaaaaataaataagtaaaatggaaagcagcttaacatatctcactgatctcactgtctcttcaaaaccttcttatacatttgattaatcatttattttagggccattaccacttgtgcttagataatgatttattttttattctttttatttttttgagatggagttttgctcttgttgcccaggctggagtgccatggcgtgatcttggctcactgcaacctctgcctcccgggttcaagcaattctcctgcctcagcctcccgagtagctgggattacaggcatatgccaccactgccagctaattttgtatttttagcagacacagggtttcaccatgttggccaggctggtctcaaactcctgacctcaggtgattcacccacctcagcctctcaaagtgctgggattacaggcgtgagccaccacacctggccgataatgaatatttacatgtgatgttctatggtttaaaatgtatatgaaagtgggtgtttcctctaaaaaaaaaaaagattgcctaaggcagcttttaatactgtgactatggcccacaaaaacatctatactgagagaacagaagagaaacagtatctggtggcataacacagggggaatgagaagtcaataataattaaaaataaaaaccaaaggctagaaactaactggattagattataagtgacagcaaagctctgtttctgacaagggctcattgtctctctcctcagagtatggaaactacacagctcattagattatcagtgaaagagaaatgtggtcagtgcttattaaattgcaccttttgccatttttaaggtgggcagtgaaatgatccagaaaatattaccttcaacaacattttcatagagtgactttgctaacagagtcttcagaccacgaggaaaatttttagaccataaagcagaagttgagggaaaggtagtggtgagaaatggggaaagaggatactggggagaataataatagtggtttaaaatagtggtagttcactcagtttctatttggtgactgaaatattgaaaaatttacttagatttcagtcacagaacaggtggtattatgatactggcaacagaatgtagtgattaaaagcacatgcttttgagtcacgcatactgaagcttagaccctggtgcttcctagctgtgtgatttggggagacttgtttaaccttgtaagctttagttttgacatctgcaaaacaggaatgatagcagttactgcttcaaaaggctattgattaaaatgtgttggcctatataaagtgacaggcacaatacagttcttaatgttagctcttatcactaatactattgtcatcatctgtaagcaggatttcttggtgaaaattttcgctgatcattttcttataaacatctgtgaactgatgagtttaattagggtgctgctgatgaagcttctgtgtggtctttttaaaaattcagaatagtaccggatttggaccaaaaagtgctcttttgtgctgaagtcttcaaaatgttttccacaaaagtgagtttgtttgggttaattatgtgtgtgcattatcctatgaactctcaagataaagggcctacagctggagctgattgtatgcaatgagaagggacattacactgattggctagttgctcttgtcattgtttgtcattgtcttttttattcttttttttctcatttgcatcaaatatctgcctataatggtgaacactgagcaactggcctggtttcaaggaaaaaaatcatgtgaatttgattgaagtgctctctgtggggtgcaccacacagacggggacatatgtgcagcctggctgtgtgtttgctaataggaaagaggactgaggccaagaaagagaggctggaggtgagatgactcattctctcaaacagaagagggagcactgaatttgaacatgatgcagacaaaggaaggcaaaccagctgaagaaagaggtgccaggagacttgcaaggagacatggcaagttttgtgggaattcaaatgtgtgtaagcaaacataaatgtaataatacaaaggtgggaggtgtgggggcatgagaatataataaagaggaatgagcaatatagagatggcaagatactgacctttccatgttcttgcaggaatatcagtatggtgggatgaactgggaggtgattacagacattaaggttacctaaggcatagtacaaggaaatgtggaactctagaatcattggtaagaaaactctaaagttaacttttaaacaggaaacaaagtggctgatcattaggttgtaagataaattaaaaagcagaccaatccaatgtagtaatgccaatgctatgaaaataaatatgcataaaccaaggattaaaatctccatagtactctgaaattaactattataataaaatgtattcaaaataataactattaataaataaaaggcatgttagtaatggttatctttggataataaatattttcttgtttttcatcttttcagaaatgaatatgtatgtcatagagcaaaattaactctaaatgagcaagaacaaaaactttaagaaagaacagaagctaagtacagtggtgtcattatgagacacacacagcagcatctcatgagtaatgaaaatcggaatgggaaaaaagaaagttaatttctcaaggccaatgaatagacttaaatttactagaaataatattcatatgttaaaccttgctgtttctagaaacgaaggcaacttgatacagggagaataattttgaacatagaatcagatcagatctggttttaattcctagtttcacgaatttaagtcagttaacatatttactaagaattcattttcttacatgtaaaatgggaattatacttatttgtagatttgtgtttatgagaaaagaataataccatgaagttgaaaagactctgtatgatataaagtagcatacgaatagaaatcaaacagccataatcagacatcatgctttgttgatcctgctgctgttcagggctctttatgtagaaattatcaatccctatattgtgaaacacttattcctacagtgcctcttcccacctccaagaatgatcttctcaagggcaactgattagatcatattcatctctattcccctagctgatgcaatataaatagttggcacttaataagtgttgaggtattaagctaagttttaaaaaaatgatcgcagaacaccaaaggaaaagcaatcaaaattccctattttatagaaagaatgaagcatttgtgttgcattctattttacatttgtgttgagtcagagagtaaagcaataagaatgaaggtcattcaagcaacaatacacatttattggatacccactctgtgccaggcacaggatataaggatgaaaagctggtacagaatcttagcaccagatcatattagtttataaggtacacagtcaaagctccatcattgtgattctattcttccttcattaatcattaattcatttcttaaccttttactccatataaagaaagagagcaagcaagagtgattgttttgatttactcaaatttcttctctagcagaggtcaccaaaatggacagtatgatatgaaccctagggcaatccactgggtacaagagaaaaacatttgcatttctattaatattaatcacatggatatttatatttctatttccattttcatatgttttaaaatgtaaacaatatattagcatagtaatatatatgtaatttagagtagagaaatatattagtggcaacctttggagtgtgctattaagataattttaaaatgacagcaacatgatacttacagagcagattctataaagagggctattacactgagtataagcaaaataaaaaagagtgcaataggaggttctaacccttaaataaaatatgtcatagcaattacattgtattataacttattacatttgagataaattagaagagagttcaagaaacagttgtccaggttttatcctgttgtttcagaagtgactttaaactcaggggacagaattttgagagtgaactgttctaaattttttttagccaattgcaggtaattgctaaattatactctactggcttgatagaatgagcactaccaccaaagttgtccttaggagatgcagtggtagcagcagaatgggctaggatgtggttagatcaaggtaggatggtggttcttaacccggctgcacattaaaatcatttggaaaacctaaaaaaataaaataaaatgaagcatgatccctaccccagaaatccagatttgattattcagggttgactgaggactgggtattcatagtgttcaagagcttatcttgagattcaaatgtgtaaccaaaatcaagaatcagagatgttgacaaaaccagtgaaaggaatttaacttcaggacatcaaaatctatgtctgaatccaatttcacaatttactagttatgtaatattggaaatccctttgtctaagttctaactgagttctaactttccttctgaaaaataagaataacagtaatgactgtcctaactacctctcaaagatgggggttaagaataaatgaggtgttgtaggcaaaagatcttttcaagatgaaagcaatgtgttgttggtaggaaagagacatgctcagagagttacaggtcttgattctaagatatctaaggttggtataaccaatgaatatgctttaacatcccattcattattcagataatttctacatattcgcaatgtcttcaatttgattttcttattgatacttggatgaaatcaggcaattttgtagatttaccaaaaataataacaatttcagtcatcacaactaatactcattcagaaacttgcattgtttctactcacatttcctaaagtatttcatggctttactctaggatatttattttcaaataaaaataagatatgctcacacatagcacatcctgagtatattccactaaacactagttttaggtgttttgttaagtattactctaagaagaaggctccatgataaaacagatttgttaatcaaaatcaaatcacttacttgatggcaggacttcacagaatttttaatatgctaaaattcattgagaatcttcaagagaattgggatacaagttgcagaatttagcaaacgtatttggtcacagagtctattcacgtgacacagaaaagagaacaatattttaaagcatacttttggaaataccaatctaatataatgctactatggtacagaggccaaaatagaagaccaaagatggatgtgacttgcccaagacagattaggtagaatcagtgctaggtgcctgtgactgaaatccagctttctcatctgagtccagtgtctttccgctcgacttcaatgtctctgttacttttcctgtcacttactacttccctttaaggaaagaaaacacaagaactaattctctgtaaaaggtataaaagttctctcactgacaattttttcttcaaatgtcgagcaggggttatggaaagaagaggctaagattttaaaccttaaattacaatgtgccaaggggctttgtcaactaataactaatgctgtccctgcagagaagacaatcaaattatcctggattcaacatttctggtttatatagaaaaaggggaagaagttaacacttttctaatatattgggctatatgtatcaccttggaagtgcttaataaagccaatatgtgaaaatatatgaaagaatttaaaaatctgttatgctgttaaactctgactaccactgaaattcaaggccaagagaatctatttcatctgagactacaacactaaaccactggtacaatccacaaaatccaatgtcactgtcactttaccatttaaaaaacaaaacaaaattctagtgaacaataaattctaagtgacaaaggaaatttttaaaaatattattttgctaaaaagaacatataccatgtatttgggtgacccattaaacatcagagtggtctgatattatggtcatcttatttaaaataccaagaggtttattgcaaaggtaacagacagagtaattgtttctttaagtagaatatttacaaaggtcacatactatactattacatggaatttttaaagtaggaaataaaactgtaaggaatataaagaagttttgtaataagtataatctatttacagaagataaatgaatatgtgataaaatttactggaagagagagaaaaggtctaaaacatcctaaaaaactgagaagtggagaagtggaaagacatagctctttcaaacatatgtggaagaggaattagtcttcacctttttgttttcaagtgacagagctatgaataaagggggacatttacaggaaaatatattttaacagaattttaaggaaaacattttaatgatacttattacctaataaatagttttcgggaggtattatccatccttaaaggaggttctatgagaggtcagagactgcttcacatgcttgcttttctgatgcaccaagcaagagttgataaaagatgacctttaagatacatacgttaaattctgagatataagaagaatttcagggagaaaaagtacccaatatggatggtatgattcaggtggtgcccaacattatagctattttacttgagaaactaaaagagttattgttattactaactctttaaaaaatgactgtgctctcagtagagggcagttgctaggagacttcctgaattgtgagtattcagccatgaaagcctaaagaaattaatggagttttattttagaccagtttacttacagaactctgagtgaataatatatggtggaatttttcctaagaagtgtcagaaggaagtggtgcaaattgctttagaaagaatagcatatttagagaaaaatatgcagagtgtggtacagctggtacatcatagaatctaaatcatttgtccttcctttgtgggaggagagtagaagagggggaagatacaaagaatatgaatgtagggtagtaaagagaagaggaggtagaaaggaatgacagaaggagagcattaataaatatttttgggttgaagcaagataattggtcttttagggtggcttcagtgattttgtctttattctccttttcagggttattttgcttgcaaagtataaaatgaatcattttctttcatttccagtttcaacttggaagtactaattctgtcttccttacataagagaggagagacctattactgttgaagtttctttaaaaaaaactatgctttaaaactcaaaacaattaaggattatgtcacagctattttcgaaatcatttttttttgagagttcatcttgacttctattacacactagacatatatgaactaaccagagatgtgaatgattctctgtactcttaaaatcacaggaaatatatttccacctccccctttttttctgatattggagtagcatttcagattttggagattagcttaaggcaaagtaaaagtcatggaaggcagtgtataaataacattaattatgaagctacttttcagaagctagtagtaacttgcttagtaataaccaaaaggttgtgcagcgttcacaatgctagtattaattagctacatattttgaacatctactgttactggataccaaagaaagtgggttatttaagaatcttccattcttgttataagcttcctatgatccagtaacttctcaaaggctttgcaaaaagcataagtccttgctttttgagaattttttttgtgcacccaagaaatgtaaacgcaaccatcactgcttcttgtgcaggtgtgtgctttaacaatcagggctgcttttggcatcaagagtatgagctattaagagtttctaaaaaatactgacctaactagtcagttgcctccaccttatatactattcaggcaagccttcggaaagtacactactgtattcctagtccaaaataaggtaggcatgaatatattcaaccttgtttgcacatacaccaaggaagaatttaaatttttgcccttaagtagttttgttttaggcaggaggaaaaacatattcaattttgaggtaggtaatcaacaggaatgagaaaaatacaagacagtctaagatctaacctttgtccgcctttctaggcttatgtcttaatactcccgaagtggcacaagctaggttatttctagttcttaacagactactgtgcttttgcacaatgctctcaagttcagcttaagcaatgctcctctggaagttcacaccctaactcgactgtcactcttctttgttttcttctagaatcctgggattatctgaataataaatgccatcacattctacttttaatacatacttcatctctttcacctagtgcactatgagttactacggggaagaatctgtgtgcctatctttctgttttcagtgatgatatactgaaagaatggtgtaggaatagaaatattctatttaccagtgctaaggctttttcacaaaaccaggcagagatctgctcatttttactctgtaaacttggaaaagttaatttattcaatctctattttgtcctaactagactgatcattatatctacgatgaatatcaacaaaatggtaataaaaaatagtgtagtgcctggaaaatcctttgacagaattatttggagcaagttttttttttttttaaatttggaaacaaaacaaaaaatttaaacaaaacttcaagaaataagcacatagcatttaccatgatggtacaatagcagtggatgaagaaataccagaagagctgcctgcaaccaaactcatatggaaccgtgagtcaaaggtcaaaccagtaactatctaagacagtcattacttgagaacgaaacggtcttcatttttcaacttagcactatgtagaatatggttatcacaatttattctattcccaagacaacatttcaagcaataaagtttatattccagaaagaagttgttcaggtcttataccttaatgacaacctttgttgtccagaagatagaacaacatcataagaacaaacttttacatcaaaaacaaacaagcaaacaaacaaacaaacaaaaattcagaattgcttgagaatgaaagtggtagtggcttcaggtggtaaagcagcccacaactgttaactttaactttgactgaagtcattaatggtatattttttgcccatccagttttctcaagacaaagttccttcctgaatagcagctactgcctgagacacagtaggtgggcagcatgtacttattaaaaaagtaattaatgaatgacaataatgaataaaggaggaaaggaaagaactgactgacaaattcaaggaaactaatgaaaccatgttgcacaagaggcagtatagcttggtagtaatgagtggtgctagccagattgcctcaatttgaaacccagttttgtccattattaaacatatgactatgggcaagtcagaaaacctgtctacatctcaattcttttttgcttatataaaatgtactgctgttagaaatatgttacattacaaaaaagccctttataaaagaacatggaacttagtaaatgccaggtcaatgttagctatcaagattattacaaagatcttatctaacacaaagcttactgaacacaaaggtcattggcaactatgaaattagaccactgcgattaaacacagctctctaaagctgagggaagtaggcaaataaatataaaatttggaggttcaacctccaaaacttgcacaggtcataaaaattaattttctgttgagattgggggttgatcctccccagacacttctcacaaaattgttggagataatggctccttgcagacagattagaagtcctgttttacaagggtagacatgtgactagacagatacactaatcttacttgagagctacctactattaatttacaatattcgattattatcctgtagattttggcatacaacagtaaatggacataaggcagttttattaacacagtcccaaatgctttgttgcttataatcgccttaattttgctttaggttatcatataactccatggttcagaaagactggctgtgtgtcaatgtcaatcactgcctaggactactgaagcatgtgagaagctggcaaatgaaatagctataaccctgtctaaggggaggaaaggaagagatccatttacacatgtagcagaactcagattataaattcttggaagtcaggagctgtgtctatactggttgcacaaaggactgtggaaatacgcttatcagtaagccagggtgttgtttctattgttatgcaaaccccacctctccagcagtctataaatagtaattgctctccctaataggagacacattatgttggaagaacaacagataatctctatgccatgtgtatctaagaaaattaatgaaaatttagatttgttttgaaaatgtcaacaaaatagatacattgtacatgtacttttgaaatctcttactcataaatctgctgtctcttcttttcaatttttgtccaagttctaaattgtggacccctcacaaaatcatatgttgaagccctaacctccctgtgactgtatttgaggataggctctataggagataattaaggttaaatgagttaaagatggtgctgtaatccaataggactgggccttgtaagaggtggctttgtaagaagagaaagagagagacagatctctctctgcataaacacccaggaaaggccatgtgaggacacagtgagaaggtggccacctgcaagtcaggaagagagccctcaccagaaacctaatcggttggaaccttggactttgtagtctccagaattgtgagaaaatagatttctgccattttaagccacccaccctgtggtattttgtgatggcagcctgaactgacaaagacagtcatacactggaaaacaagagctttataaatatacacacagttttgctggagtcacactcaccattagtagtctatctcctacttgcaaccttccatctttttgtgcagctcctccatctataattttagttacataaatgctgttgtctccaggaatgtgttggttccccacacctcctgcaatactgaagcctaaacctataagaaaggaacagaaaatggaaagccttgttttgttgttgtagttgtttttagaaaatgcagttagccacattttaacagtttttaaaaatgaatcctcaacttattgtaacagcaataaataacactaaaaactgtatttcaatctcgttatttaaatatttgaagaattgttaatgcaaatgaggcaaagattttgaagtcaaccccatgtgagtagttttgttctatttccagactgtatgcctaactgctgttcctcagctatcctgtttataagggtaactggccagagcagggatcaggtgaagggtgtggaggaatcctaggtgagccaggaaaaagacaagtatagtcctgctcattgttgactctatgggctcattttcattgctgttgttactctagcatagagaacagaagtactgccaatcacttgggcagagacctggatactcttgatatttcaagatgagaaatagaattgttcaaaaattgcacaaattctgaggcaagagccatgaataagttacactgtttatatacatgtaataatttcagagagaagataaggaaaagaagctagatgcttgcctttcatgttttgttctcttgccaccttgtcatattttatatttcctagcatttattgttattaactgattaactaattgtgagactagtcacacaaaaaagtgaattattccagtatacagtctaaaaaattaaaaatattccttaaaaatattctattggaaaataaagaataaaaagaatgttaaaaaattaattaattaattaattaatttaatttttgagatagtctcgctctgtcgcccaggctggagtgcagtggtatgatttcagctcgctgcaacctctgcctcccggcttcaagcggttctcctgcctcagcctcctgagtagctgggataacaggcacacgccaccatgtctgactacttttttaaatttttagtagacactgaaaatgttggccaggctggtcttgaactcctgacctcaggtgatccacctaacttggcctcccaaagtgctgggattacaggcatgagccaccacgtcctgccaaaaactttaaaatgtatacttaggctatattatttttataacatggcagaatatcaaatcattttaaacatggcgattgtctcttttaagagatgattttcactgtactatggcttatacaatcttaacttatattaaactatgaagcaataacaagaatagaggacagtcatgcactgcataacaatgttttgatcagtgatagagtacacatacgatgatgggcccaaaagattataatggagctgagaaatggctattgccaagtgacatcatagtcattgtaacatcatagcataatgattactaaggtgtttgtggtgatgcagtgtaaatgaacctactgcatttctagtcacatatataaaagtatagcatatacaattgtaaacaataaataatacttgataatgataataaataactatgttcctggtttatgtatttactacactatgctttttattgttatatttgagtgtacccctctccttattaaaaaaaatgttaattgtagaaaagcctcaagcaactctttcaggaggtatcctacaagaaggcattattattacaggagatgacagatccatgctgtaacattttacatgttattgctcctgaacatcttccagttggacaagatgtgaaggtagaagacaatgatactgatgatcctgaccctgggtaggcctaggctaatgtgtgtgtttgtgtcttcatttttaacaaaaagtttaacgtgtaaaaaaaaaaaaaaaaaaagaaaagcttatagaataagaatagaaaaaagaaaatactttgtatagctgtacaatatgtttgttttaagctaagtgttattacaaaagagtcaaaaagttcataaagtaaaaaagttacagtgagctaaggttaattattgaaactttttaaaaataaacttaatctagcctaagtgtacagtgttctttaagtctacagtagtgtacaataatgtactaggacttcacatttactcattactcattcactgatttacccagagcaattttcagtcctataggttccactcatgctaaatgccctgtacagatgtaccgttgtttatcttttattttttactgtactttttctatgtttagatatgttaagttacacaaatagttatcgttgttttgcaattgcctacagtacgcagtatagtaacatggtatacaggtttgtatccaaggaacaacaggctatactacatagcctaggcttgtagtagtctattctatttcagtttgctaagtacgctctattatgttcccataacaatgatgacattgtctaatgatgtatttctcagaatgcatgcccattgttaaatgacacatgaatgtattttaaaaagttattatgagatcattttaaaggaataattaatagactctttaaacgtataagaatttttaaaaatctctttcagaatatgtttgaatgctcattcagtacaatacttgcagcatacattttcattgcattttacaatcataagataattaacatgcaaattactcaagaagacagatattaatcaagggccttttgactacagacataatttctatagcttacttggcttaagacttttttagaaaaaccacacacctagtaaaataataaagctatcattaaaatatttggcattttatacaacaataataaaaaatacttaaaaatattaactctacttcactatacttttattgaataaatattgggtaaggttatgcactcttaagatagcataaatagttaattgaaaaatgatggcatagtaaattataaagcaacatctctggaattatatttgaaatgcaatgatcgttaaattaaccataatagttgttaaaaataaatggaaaattgatttaaattgatagggcaattaaagcaagtgttatctaatttccttgtgatgtgagtaattatttttactgatgctttgccaccccatggaacaatgaatatatttgtttgcctcagatttacaatttgtttattaagcaaatgatgaccaaagagtaaaataccccaaactggcttttcctataaaatttaaaatacatatcagctcatgtttcccaaaactgttactttattatacatgaaaatagggaagttttaaaaaatgtatttacaaaagtttcttagccacgtgctaaggtcaatctaccatatttataaaagtacagaggttattccaaactctgaaaagagaaggctaaaacaaattcagagactccaatttacatccactatgccagcagtaaatgccacggtcttagctacaagaagagctgtagaaataaattaccaccataaaaacgggtaagttcaacaaacagagcaagtatgtagttgacatttgaagttgaagactgcacaaagacaatgaaagcactatggatactgtagatagatagatgatagatagatagatagatagatagatagatagatagatagataaaaatcgagtaacattttttcttgagattgggtttatgtgcttctttttaactagtgactctattcaaggtgaagcaaggtatttttagtaaatgttcctctcagagccagagcatgtttctgaatgtacacaactagtaatttttccaatttcctttactttgacataacatgcatgtgtttaaaaacaattaaaatttatttaacacttaatcatattctaaatattcaattcagatgatgaataaatctgtagtttatgtctacattgagaatttatgtttatttacaggtggaaatatctatctgtgctataagattgcatctatcctcattcatttattcattcacacatccattctttcaataagcatctcctgagtacatactgtgcgttgtattacctgctgctatcgagcacggccaaagtaaatgtaaagaattttttttccatttttaatttttagttgttatggatacataataaatgtaaatagggtgcacatgataatttgatacaagtatacaatgtgtaatgatcaaatcaggataattgggatatccattaccttaaacatttatcatttcttagtgttaggaacattttaattctactcttagttatttcgaaatacacaatacattattaactatagccaccctattgcactactgaacactagaaagatctatttcttttatctaactgtattttttatccattgaccagaaacactgtaataataatgacccaaaagtgagttcatatgagtgagtgtagttgaaacatgtctgaagcaatgttctaaacccagataatgcaagcaatttttggatagctattctatgaagacaaatgtgggctaggaccactgagcaataagaccaaacacaaattacctgggtttttcttgcatagactctgttaaagcaggggcaggctctctaccttataagacctagactggctaaggcatgccatgactaatgcccctgtcccccatccctgttattaatctcacatgtcttcccttcattagctaatttttccctccttcattccactcaaaacacacttgcatccttgacgtttctttttttatttttatttttttgcctttaacttttaagttctggggtacatatgcaatatgtccaggtttgtcacattggtaaatgtgtgccctggtagcttgctgcaaagatcaacccatcaatgtgatattaagcccagaatccattagctattcttcctgatgctcttcttccctgcttccctccccttgacaagccctagtgtgtgttgttttcctccatgtgtccatgtgttctcatcattcagctcccacttacaagtgacaacatgtggtgtttggttttctgttcctgtgttactttgctgagaatgatggcttccagctccatccatgtccctgtagaggacatgatctcattcctttttatggctacatagtattccatggtgtatatgaaccacattttctacatccagtctatcattgattggcatttaggttgattccatgtctttgctattgggaatagtgttgcaatgaaaatacatgtgtatttatctttataatagaatgatatatattcctttggatatatacccagtgatgggattgctaggttgaatttttttcctctaggtctttgaggaattgccacactctcttccacaatgattgaacaaatttatattcccatcaacagtgtaaaagcattcctttttctccacaacctcaccagtgtctgttgtttttttgactttttttttaaaccaatagatttttttattttattttattattattatactttaagttttagggtacatgtgcacaatgtgcaggttagttacatatgtatacatgtgccatgttggtgtgctgcacccattaactcgtcatttagcattaggtatatctcctaaagctatccctcccccctccccacaccccacaacagtccccagagtgtgatgttccccttcctgtgtccatgtgttctcattgttcaattcccacctatgagtgagaatatgcggcatttggttttttgttcttgcaatagtttactgagagtgatgatttccaatttcatccatgtccctacaaaggacaagaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcaagatttatagtcctttgggtatatacccagtaatgggatggctgggtcaaatggtatttctagttctagatccctgaggaatcgccacactgacttccacaatggttgaactagtttacactcccaccgacagtgtaaaagtgttcctatttctccacatcctctccagcacctgttgtttcctgactttttaatgatcgccattctaactggtgtgagatggtatctcattgtggtttttgtttgcatttctctgatggccagtgatggtgagcattttttcatgtgtttttgggctgcataaatgtcttcttttgagaagtgtctgttcatgtcctttgcccactttttgatggggttgtttgtctttttcttgtaaatttgtttgagttcattgtagattctggatattagccctttgtcagataagtaggttgcgaaaattttctcccattttgtaggttgcctgttcactctgatggtagtttcttttgctgtgcagaagctctttagtttaatttgatcccatttgtcaattttggcttttgttgccattgtttttggtgttttagacatgaagtgcaacttacaagggacacgaaggacctcttcaaggagaactacaaaccactgctcaatgaaatgaaagaggatacaaacaaatggaagaacattccatgctcatgggtaggaagaatcaatattgtgaaaatggccataccgcccaaggtaatttatagattcaatgccatccccatcaagctaccaatgactttcttcacagaattggaaaaaactactttaaagttcatgtgggaccaaaaaagagcccgcatcgccaaggcaatcctaagccaaaagaacaaagctggaggcatcttgctacctgacttcaagctatactacaaggctacagtaaccaaaacagcatggtactggtaccaaaacagagatatagatcaatggaacagaacagagccctcagaaataataccgcatatctacaactatctgatctttgacaaacctgagaaaaacaagcaatggggaaatgattcccaatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttttttgactttttaataatagccatctctctggtgtgaggtgatatctcattttggtcttgatttgcagatttgcatttctctaatgattactgatgttgagccttttttcatacatttgttggcagcatgggtgtcttcttttgagaagtgtgtttatgttctttgtgcactttttaatggggttgtttgtttttttcttgtaaatttgtttaagttccttgtagactctggacatcagacctttgtcagatgaatagattatacaatttttctcccattctgtaggttgtctggaactctgatgatagtttattttgctgtgcagaagttctttagtttaattaaatcctgtttgtcaatgtttgctttcgttgcaattacttttggcattttcgttaagaattcttgcctgtgcttatgtcctgaatggtatttcttagattttcttctaggtttattatagttttggcttttatacttgtctttaattcatcttgagttaatttttgtacaaggtataaggaagggatccagcttcaattttctgcatgtggctagctatggatgccttcagctttgttctttttgcttagcaggctcttttttggttccataagaattttaaaatagcttcttctagttttgtgaagaatgtcaatggtagtttgatgggaatagcattgaatgtataaattactttgggcagtatggccattttcatgatactgattcttcctatccatgagcatggaatgtttttccatttgtttgtgtgatctctgatttccttgagcaatggtttgtagttcttgaagaggtccttcacttctcttgttagctgtactcttacagccttgatatttctagagtactccgacatagtcatagactgtcaatttagggtctttgctacagctgttctgctacatggaatatgcttctttcagggctttgttccagtctcaatttctgtaggagctggaacctaagctccctatttaatgctgtcccctgactatatatatttttttccttatcctgctctagttttcattttctcttagcacttattaccttgtaatacactatataagtcatctacatattttgtttatatgttttttatgttctgtctccttggtgaaaacataagctctgtaatgaatggttttttggtctattttgtactatgcaagtagaacaaaaccagttacatacttgcctcataaatatgtattaagtgaaagaatgaatgaacaaatgaatataagaggacaaggaaagtcccatgtctctgagaaagtccccccttaaagatgaaattagtggctttgaatgagcaaggggcagaaacagtgagccatggtagctgcagtcagtaactgtataaggcatcacattgcctcaggtaaactttgatgagctctccatcctcaacctgtacagggtttatggtaagcactgagcaggcaatgggacaacagcagaggcagcttcactttctgattctttcgtcttataactatgcaaatttgagtttccatttctttgtaataaaggagtaagtatatctattatctagcaataatagatacttgataaataaagtgctctcaataaactgtcaggttgttgggaaaacatgacaccaacactttggcataatctgtctggtttggatgagttctatattgctaccagcattatgtgagggaagcatgacttacttcttagaggagaaggagaataattaacagaagtttagcatttggactgggtcttgataggtgaagttagaactgataaaagaaaatgcacatttaaaaccaacatgtcttcagattccaggctggataaatgactaaagagtcaaccgtcctgagttatgtcacacagggctaataaagtcccactttactgatccaaaaattgaagcaaaaatgcctggcaatcaaaacatgtatttatgatacagtaagacagggtagtccctactgaaatgaatacaatgagttcctgactcaaattggatgaagatttgtgtaaggaacacttaaaatggccaaaatactgatttcggggaagtgatagttttgtaacaactaaagaaaattggttaccattttgaaaagaagtgtccatgaaaaagaaatagctctggaccatcacatgatgacaaactagtccattataaaataaagtcagtgaacagagttggtagttctcaccccaaaacgctgattataacaccacctactgtggaatgttgggctattaagaataagactaaacattactgcatgtgggtcataaacaaagctgacacagaaaaatgtaagtaatcatttcacaaaaggaagtaaaatcagtgaatatttcagtactctagtaaaagaaaaaggcatgccaaatttaagcacctaattgctcaagtaattaaaaatgacctgtttggcaatcacttgacgcacatacagaatttcaggattacatcaattatagaaagctgggttcatctttccaattttcttgcatatctccaagcagtgatttctcatgtcaacataagaaatgcaggcataagcacagggaagtctgaacctgattaaagcctttaactgaaagtttttccacacaaaatctttttcccatcctgtaaaaagagaacaccatgaacggatcgtggttcactcttttcccttgctgcccgcctacgctgaggaggaggtgtcagtgagaggtggggcctgaagcagaagcttggcagcagagattgatactgtgctgaagctcagaataaatactcaaatgctttgaaaagttatgattacaatgtacccgaatattctttgcgggtgtagagaactaagccccatgatgtcttataatcattcagtgaattggttcaactttatttcatgtgactttcttaggagagagctctgggccatctctaaacaattcaaaattattaagcatactggtcctgtcagagtttatttaggatctgctaggtaaggtgtttactgctttacagaaagcactagtagttttctgcacattctgtctacatggttttattaaaggaaacacagaatctatcttgaaccctggctggccctgtctgagaaaacacccaccctcacaggcaacttaacttatgaatgtgcataagtttcagctaaaaaacaacaaaaaaacccttccctgtaggaactggtctacactgatgagagactacttgtcatctcttcctttttagaaagaaaattttgctttaacaaataccaaaaaaaagtatgttttattttaatttgagagagtagttaatcacactggcgactgccaatatggttaattaaaagccaaagcattatcttcttactctttggatattctctggattccaaagacaaaatctgaggttgaaagaagtgattctgcttaaaatttctaaggcactgacaaagcatcttcaatcctgcttgaagaactgctcacaggtcacccaattaacttactatagccacagcccaaaactttttcttctattacatatcttgtaatacccactcatacctttagcacattgctttaatacctattttattctgaaaaattcacatttctatacctatcctttctgctttccctttgttcaaaggaagaaacattatttctcttttgtaaaatgaaatcttcccctgcacgttagggctttacttttttcttttttctttttttctctctctctctctagagtattcagttccttagcctcaatgcttttcttcttttatggatttggccattcctctgtcctgtcctgaaaagatctcttcaacctgccacagcctccttaccataataactgaagtttttagacactgatctgtagttccacctctatttctatattacaaaccatccttaatcccatccatctggccccatacaccacaatctactcacatggcatctgttataggttgaactatgtcccccagaaagatgtgctgaagttctaactcctggtacctgtgaatgtaattaaccttatttggaaagaagttctttgcagatgtgacttaagaagatgaggttatattggatcagggtaggattagggtccattgattggtgcccttataagaagaggaaatttggacacagaaataaaaaatacacagggagcaatttatgtggtaagtgacacagcgattagaatgataaatctgtaagccaaggaacatcaaagattgtaagcaaccactaaaagctagggaagaagcgtggaacaaactcttgcatttctaagttgtactccagtagaactaacctgtgccagcctttcttcctctatttaactcattaaacacttactgatgactacttatgtgtcaagtagcagcctaaatattgttgttacatcaataaattagagatctagtgttcttgtcctcatgcagcttattttctactacagaataggacaagtataaaaatcatgaaaatgcagtgtggtaagtgctgctatgagaggaatagtggctatgggagcatataggtgggcggcctaccttgggctagagggggtagtgtcagagaaggataacttcaggtcattatatgcaatctgagacctggaagataacaatgaaccaagaaaataagggagtggggagacatcatccctgcagagggaaatatatactcaaagacccagcattgagagataacatggcttagttgagaaactcagaaatgtttaggtgaaagtaataagtagttttaggcggagtgcagtctccacaaggaaaagaaccatgactgtagaaccatgtctgtagaaccattaatgtacattcagcccttggtacttggatatcaagaaatatccaagtatccaataagtgaataaatgaagataagaggtcactccctccactgaattagaaaaggaggaaaggacagtggagatgaatgctaagattgtaggataataacaggacactaaagaagttctcatcttccatttactctggtaacaagaaaggatgatcatcaaccaagaatgagggaagtagtgaggtcagagaatgaagaaatcacagatgtgttggaatagctattagggaaaatggaagatataattgcttagagaattgcataaaatggcaaagagctgtgttgattgtctagtgagggtttggagactgtagattaataatagcactgttctaggtttttttcctccagtaattctcagaagtctagatataagcatggaaaatataggcagttagattgaattgccttacatattaatctcttatgtgcactaatctttcctttttaacaaaattatatgatcctagaaagtaggggttgcacaaaatagactatgttagcacagtgctgacatatagtaattgttcaataaatatttgcagaaataattaatgactaaattgttcaaagaccaaatggtcacatctcataggtatactttcaaatgtcaagcatcctacattaagaaagatatgtatgctttagttgattgctttagctcaagggggaaaaagtatatgttgagcatttttaatgtgccaactactatattggctggtgaagaattaatgaagagtatgtcagtctcttccctaaacgaacattaaaaatgaccaatgacagacacaattacatttctttactcaaagaactatcattgaccaaattgttttcatccttaaagatcaaatagtcaaaccacaagttgactgcttatggggctgtatgatagaatgtgattagatgctgtcctacttgtttatggactacttcattacacttgaaatggaatatcctccaagcttccatcattaaaatataaccaaattataggcactgcctctagctatcaagcacatctgtctatgcagtttttccaagttaatttttgctgccatgcaaaccaaggtcattaaacactgacctctgaatactgtctacactgtcttggaagtatacagattccagcacacaaagccacaaaagttacatagattatttaaaagatgtaaaaatcatctcacatgttgaagtttgatgaggatgtcccactggcagggttgttgctggagaaagcaagctgaaatatctgaagggtaactcggtggatcttgaaaaatttccattcacaaacgcctgtattcagtaacatctcctctgaaaagttcttcctcctagtcgccactcctttaacttaaaagtactctctctctccactgaccacatctaacggtttatctgtctttatctcatttttagtgatacatcattttctacatagaattagaatatagttatttataggaagggttgatatttagaacatttaacagctggtatgaaatgaacaccaactaatcacaatacgtagctgccataaataactgctgtgatatgcacaaatatgttgtaggaatatctcattcccccacgttggatagttaccactttgaaggtggaggggaaaataacccttttattttgtatgcccaggggttttatggacaaagtagatacttgaaaactaattttttatttttattttaaaagacaggggtctatgctatgttgtccaggctggacttaaacttctgaggtgaagggattcccccaacctcagcctcccaagtagctgggactataggtgagcaccactgtacccagcttcaaaactagtttttaaaatgaattactgaactaaataaaaatcactggatcttttttccataagcatactttaacaaaccatgcaagaaagggatcggggtaaaataatgcagtgagctacttcatcattcattaaaacaacactcaattccaggctatcttagtttcctagggctgcaataacaaagtactaaaaagtaagcatcgtaactaacagaaatttactatctcaaagttctgcaggctagaagaccaagatcaaggcattagcagggttgagtcctcctgaaagctataagagtaaatctattccatgcccctcttctggattctggtgatttgctggcagtacttggcactccttatctcatagatgcatcatcccgatctcagtcttcatcttcacatgaattctccctatgtgcatgtctgtttctgtgtccattttttttttttttttgtaaagacacttgccatattggaatagagtctaccagtacgacctcatcttaacttgaccgttagcaaagaccttagttccaaataaggtcatatacataggaatgggggttaagacatcaacatctttttcagggacgcaattcaactcataatactggaactgggaaacaaaaatatgaacagaatgcagttcctattgtcaaggatttcacagaccaatgtggaaagaattataaataaacagcatatgttagtacattggaaaaaatgaagaaaggcaggttgtatcatgcaaaacttctgaacttccaggagataatgacagtcaagtgcaagtccacatgtagaaatagaggctcatgaggctccagaagtgccatgttaaaaagtttagaccttatattagtggcaatgaggagagagactttgaaaaattttaaccatgaaaatgacttgatcagatttggtctccctccattttccttgttaatacttgctgttgtttaaaaaatacatcaagctatcctaagaaaaaaagaacaaaactggaagaatcacattccctgacttcaaattatgctacagagctatagtaaccaaaacagtatgatactggcataaaaacagacacatagacaaaggtaacagaatagacagcccagaaacaaatctatacatctagaatcaactcatttttgacaaaggtgccaaaacatacactggtgaaaagacagtctcttcaataaatggtgctggggaaactggatatccataggcagaagaatgaaactagacccctaactattgccatatacaaaaatcaaatcaaaaggcattaaagacttaaatctaagacctgaaaccatgaaactactctaagaaaacattggggaagatttctatgacattggtttgggcaaaaatttcttgaacaataccccacaggcaaatacaatcaaagcagttaatggacaaatgggatcacaacaagttaaaaggcttctgatagtaaaggaaacaatcaacaaagtgaagagacagtccagagaatgggagaaaatgtttgtaaactacccatttgacaagtgattagtaacaagaatatgtaaggaactcaaacaactctaagaaaaaaaacaataatatgataaaaagatgggcaaaatatctgaatggacatttcttaaaggaagacagacagacagcaaacagacatatgaaaggtgctcaacatcattaatcatcagagaactgcatatcaaagctacaatgaaatatcatctcaccccagttaaaatggcctatgtccaaaagaaaggtaatgacaaatactggctgggatatgggaaaaaggtaacccttgtacactgttggtggaatgtaaattagtacaaccactatggagaacagtttggacattcctcagaaaactaaaaattgagccactatatgattcagcgatcctacttatggctaccgaaagaaagcaaatcagtatactgaagcgatatctgcactctcatgcttattgcagcactatttacaatagctaagattttgaagcaacctaagtgtcgatcaacagatgaatggatacagaaaatatggtacacatacacaatggagaactattcagccacaaaaagaatgagatctagtcatttgcaacaatatgggtggaactggagatcattatgttaagtgaaataagcaagagacagaaagacaaacatctcatgttctcacttagttgtaggacctaaaaaccaaatcaattgaactcatggacatacaatagaaagtaaaggatggttactagaggctgagaagggtagcagggagcttggtgggggaagtagggatggttaatatgtacaaataaatagaaagaatgaataagacctactatagtccaaaaagacaagtaaagtcaataataacttaatatttaaaaataacaaaaagagtataattggattgtttgcaactcaatggataaatgcttgagaggatggatatcccactctccatgatatgcttacttcgcgtgacatgcctgtatcaaaatatctcatgtaccccgtaaatatatataactactatgtactcacaaaaactaaaagtaaaaaaaaaaaaataaaaaataaaaatacttaaaggggtgaaaaactattatcagacttactgccttatttctgactatacatttaaaaaccttttatgctcaattcaggcattctattactacacatttcaagtgaccatcatgggcacttttaagcacctaacacatttttctttctacaaacctcacaaaaagacctgtcaagaaaatcattctaggtccaacaatgcacagcacctcatgccttatttctacttctttctttatgatagaaaatgtagtcagcctttaacttggcctgataaaaactgtaaagactatgccaaataagaccaggtgcagtggctcacacctgtaatcccagcattttgggaggctgaggtaggcagatcacttggggtcaggagaccagcctggccaacatggtgaaatcccatctctactaaaaatacaaaaaatttagctgggcatggtggtgcatgcctgtagtcccagctactcaggagtctgagggataagaattgcttgaacccaggaggcggagattgcagtgagccgagatggtgccactgcactccagcctgggtgacagagcaagactccatctcaaaaaaaaaaaaaaaaaaaaaaaaaaaaaaaaaaaaaaggtgtgccaaatagtccctcatacaaacaggaaacccaaatcgtttatcaggaaagaagaggtgacaattttagatactgagaatattgaagtacttgccagaagtcagatttcaggctttgggaggccatggcgggtggatcacttgaggtcaggagttcgataccagcctggccaacatggtgaaaccctatctctactaaaaatacaaaaaaaattagctgggcatggtggtgtgcacctctaatcccagctactcgggaggctgaggcatgaagaatcacttgaacccgggaggtggaggtttcagtgagctgagatcccaccactgcactccagcctgggcgacagagtgagaccccatctcaaaaaaaagaaaaaaagaaagaaaggaatacaattaaagtggaggaggagcacactctggtcttggaattccatttgagaatttagaagtgtcatgtttataatttttcaattttgtttgttgttggcttgctgtaaagcaatataaaatatttttgttataaaataaataaaaaatacatcaaatcaggagcagcctaatgatggctgactagaggagttttgtacttgtctcctccacaccaaagaaccaaagtagtgagtagataatcacacttcgtatagttccctgaagagaaaatactggaatgtaataaattcaacagaaaagtgacacaaaatacctaaagcaaagaagaaaaaggaagcaaggcatcctgcttgaccaggatcagctgggagatgagagactcctcaatatgggagaagtataaatgagacatctttagtggtccacattcccactgtggactcctgcaatcctagacatgggagaacccctcaactcttgtgggtcctgaaactaacataaggatctatgcagaaattctgtgatggcactgctccaagaagggaggttgcactgggtcttacacactctgtgacacctaagcagctacagcaagccaccgttttagagtcctgcccccaacagtctgtgtactgccctggaacccagcagtgccagggctaaggtgcaagagaattgtggactgtaatccctgggtctgagccataaggaaggtgtgggctacttcagccagggctcaggcatgtagttcctgaacaaggcatgaactacagctattggggactgaagcataagtaaggtagtggctatcacaacaagaattgaggcatgagtgctgccagggatgaggcatgagtgatgtaaacattcccgccttgccagcagtccaaccttccacagtggcaggacagcagtgtggctactaccagtcacacctgagcattctgctggtggcctgggaatcatgacacctctgcctaccatagctgatgctggcatccaccattaggaagcctgaggacaagcctgcctggcctggctttgtcccttcttccaccctctgggccagggcccagcccagtctatcaccattggtaggtgaaaaaatcctcccatgtgcttgagattgggtctacctagccagccacttactcctcagctggcacctacctgcatgtaccacctgtgggcctggagactggctagcccagcccatcacagccactgccaatgccagtgtataccactcaggacctagagggttgtcctaccactatcactgccattgtccatgccatgccaagttcccaggggcctaataacctgcccacctgcctggctcactgctgcaactactgacactgaataagtcaactggaggcccaagaattggcccacctagaccccctaacattagtgtaaccatacagtatactggggctcaagaacagacatgctcagctcactgctgccacccctggggcccaaagattggactgcttggcatcccactccccagtagaacttcatcgtatcctccacttataactgcactgtacaccaccaaggaaatcacagatgcaaataatgctgtttaaagtcaaaagaaaaatcatacaaagactacattattgcacacaacaagaatcaaagccaaagtgccctacacaaccaacaccatagatacatcttcaggaaaaaagtaatcccctacaaaagcaaattaaaaaaatgagaagaagtgacttataccagatcacacagatatcaatgtagtgacactggaaacattaaaaaaaaaaactcaatatgataatgtcaaagaaacacaataattctctagtaacagatcccaagcaaaaagaaacatgagtaaatcaataaaagaattcatattatcaattctaaagaatctcagtgatatagaagagaattatgaaaaccaatacaaagaaatcagaaaaacaattcaggatatgaatgacaaatttatcaaagagatagatatcatacaaaagaaccaaacagaaattctgaaactgacaaattcattgaatatatcagaaaatacatttgaaagcttcaacactagattagatgaagaagaatctccgaactttaagaaaggtcttttgaaataaaccagtcagacaaataaagaaaaaagaagaaaagagaatgagcaaagccttcatgacacatgggacaccataaagggaccaaatattcaaataatcagggtctcagaagatgaagaaaggatgaaagggttagaaaaactatttaacataatattgcatgaaaacttcccaagtctagcaagataattagacatccagatacaggaggctctgagatatccttacagatacaatccacaaaatatcttctccatggcacattacagtcaaactgtctaaagtcaaagacaaagaattcaaaaagcatcaaaagtgtctagtcacctacaagggaatctccactagactaaaattggtttctcagtagaaaccataccgggcaggaggaaatgcaatgatatattaaaagtttcaaaagaaaaactgccagccaatgatactatgtacagaaaaattatccttaataaattaagaaaaaataaagtcttttacaaagaagcaaaaacaagaaattcaacaccactagaccagctctataagaaatgctcaagggagtcctaaacctggaaggaaaaggacacatctgccattatgaaaacacacaaatgtataaaactcactggtaaagcacacatacaaaggaaaaagagaaagaactcaaatagcatcatgacagaaagctaccaaaccaaaatggaaaacaataaaagaaaaataaaggaacaaagaacatacagaacaaccaaaacacaattaacaatatgacaggaacaaaacctcatatattaatattaaccttgaatgtaaacagattaaattctttacttaaaagatatagactggctgaaaggttacaaaaacatgatccaactatatgctgcctataagaaacatactttacctataaaaacacatgaagacacaaaataaagggatgaaaaaagatattccataataacagaaaccaaaagtgagtaagagtagcgatccttatattggataaaacagacttcaagtaaaaaaaaaaaaacagtaaaaaagagaaatcagaaaattatataatgataatagggaatcaatgcagcaagagaatgtaacaatgctaaatatacatgcacccagcactggatcacccagattcataatacaaatattactagttctgaagagaaagatagattctaatacaataatagtggggtacttcaatatcccactcggcattagacagatcatttacacagaaaattaacaaagaaacattaaagtagactttagataaaatggacctaacatacatttgcagaacattttatcacatgactgcagaatacattgttcttatcagcgcatgaaacattatccaggatagtagatatgtcaggtcacaaaacaagtctcaacaacttaaaaaatcaaaatcttattgagtatattctcagatcacatggaataaaattataaatcaataacaagagcaactttggaaactatacaagtacatggaaattaaacatgttcatgttcttaaataatcattgggtcaacatagaaattaagatgaaaatcaaaaaagttcttaaaacaattgaaaatgaaaatacaacataccaaaatctgtaagatacagcaaaagcagtactaagagggaattttatagcaataaacatcataaacaatctaaaaatgcaactcaagcaattagaaaagcaagaacaaacccatccccaaattaaccgaaatagagaaataataaagataagagtagaactaaacaaaataggtttaaagaacaatataagggtcaacaaaatgacatattggttcttcagaaagagaaaattgataaactaccacctaaaatagcaaagaagagagaacacctaaataaacaaaatcagaaaagaaagaggagacacgaccattgatacatgcattagtctgttttcatactgctatagataacttcccaagactgggatctaccatcctagggtctggaggatgggggccctcttcttacagctcaactaggtagtaccccagtggggactctgtgtgggggtgcccacccgacatttcccttccctattgccctatcataggttctccatgagggctcctctcccacagcaaacttctgcctggacatccaggcattttcatacatcctctgaaatcgaggtggaggttcctaaacttcagttcttgacatctgtgtacccacaggctcaacaccacatgtaagctgccaaggcttggggcttgcatactctgaagcaatggtctgagctctacgttggccccttttactcatggctggaatgcagggcaccaagtccagagatttcataaagcagcaaggccctcgtccttgcccacaaaaaccatttttttctcctaggcctccaggtctgtcatgggaggggttgccatgaagatgtccaacatgccctggagacatttttcccattgtcttggtgattaacgttggttccttgttcattatgaaaatttctgcagctggcttgaatttcttttcagaaaattgttttatcttttctactgcattgtcaggttgcaaagttttcaaacttttatgctctgtttcccttataaacttaagttccaattctgaactatctctttgtgaatgcgtaaaactcaatgcttttaagagcacccaggtcacaacttgaacactttgctgcttagaaatttctttcaccagataccctaaatcatctctcttaagtttaaacttccacagatttctagggcaggggcaaaatgcctccagtctctttgctaaagcatagcaagagtcacctttattccagttcccaataagttcttcatctccatctgagaccacctaagcttggacttcattgtccatatcactatcagcattttggtcaaagccattcaccaagtccctaggaaggtccaaactttctcacatcttcctgtcttcttctgagccctcaaaacttttccaacctctgcctgttactcagtttgaaagctgcttttacatttttgggtgtctttatagcagcaccccactcctggtaccattttcctgtattagtccattttcatactgctataaagaactgtctgggactgagtgatttataaaggaaagaagtttaattgactcacaattcagcatggctggggaggcctcaacaaacttacaattatggcagaaggtgaactggaagaaagacaccttcttcacaaggtggcaggaagcagtgccaagggaaggggaagagcctcttataaaaccatcagatctcatgaggacttactatcacaagaatagtatgggggaaaacacccccatgattcagttacctccacctggtctctcccttgacagatggggattatgggtattatatggattataattaaatatgagatttgagtggggacataaagcctaaccatattaattccacagaaatacaagattatcagagactattaggaacaactatgtgataaaaaactggaaaaagtagaggaaatggataaattcctggaaacatacaaccttccaaggtttagtcaggaagatacggaaaacctgaacagaccaatattaagtaggaagtctgaaatagtaataaaaagtctcccagtaaaataaagtgcaggatcagatggattcactgctgaattccaccacacataaaaagaactaaaaccaatcctcctcaaacaactccataaaaattgaagagaaagaaattctccctaactcactctatgaccagtattccctgataccaaaacctaaggacacaacaaaataagaaaactatacatgaatattcctgacgaacacatcttcaaaaaatcctcaacaaaatactagcaaactgaattcaacagcacatcaaaaagataatataccattacaaaatgggatttataccaagggatgcaagaatggttttacatatgcaaatcaacaaacataatatatcacatcaacagaaggaagcacaagaatcatatgatcatctcatcagatgcagaataagtatttgaaaaactgaacatcacttcataataaaaatgttcaacaagctaggcagagaaaaaatatacttccaaataataaaggccatatatgactaacacacagctaacatcatactgaatggagaaaagttgaaagtttctctctaataactggaacaagataagaatgcccacaaaatactacaccaaaaaactcttagatctaataaattcagtaaagttagaggatacaaaatcaatataaaaaatcagtagcatttctgtacaacaataatagtcaaaaaacaaattcagaaggcaatttcatttacaatggttacagaaaccaaatacctaggaacagatttaaccaagaaagggaaagatctctacaaggaaaactacaaaacactgatgaaagaaattaaagaggacataaatggaaagacatttcatgctcatgggttgaaagaattaacataattaaaatgagctaacttcccaaagcaatctacagattcaatgcaatccctataaaaataccagagtcatttttttttacagaaatgagaaaaagaattctaaaatttatatagaatcaaaaaaaaaaaagagccagaatagctgaagcaatcctgagcaaaaacaaacgaacaaaaatccccccaaccaaaaaaccccaaaaccaaaaacaacaaaacaaaacaaaacacaaaaacaaacaaacaaaaaacaaagctggaggcatcatacaacctgacttagaaatatattactaggcatggtattggtataaaaatagacacttagaccaatggaacagaatagagaagtcagaaatacatccacatgtttatagccaactgacatttgacaaagctgctaagaacatgtactggggaaaggacatccttttcaataagtgatcctaggaatattggatatccacatgcaaaagaatgaaactggacccctatctgatcatatacaaaaatcaactcaagacagattaaagccttaaatggaaggcctgaaattataaaactcacagaagaaaacaaagggaaaacacttcatgacactaatctaggcaaagattttatggctaagaccttaaaaccacggacaactaaaacaaaaataaacaaattggactatattaaacttctgcacagcagaaaagacagttaacagagggaagaaacaacaaattgaatgggagaaaatggttgcaaactattaatctgacaagcgactaatatccagaacatacaaagaactcaaacaactcaacaacaacaaaaataatcccattaaaaatgggcaaagggcattaatagacatttctcaaaagatgacattcaaataaagatgctcaagatcattaatcattagagaaatgcaaatcaaaaaccacaatgagatatcatcttatcccaggtagaatggctattattaaaaagacaaaaaataacggacgctgacaaggacatggagacaaagggaactcatacactgttagtcagaatgtaaaatagtgcagccatttgccactatggacaatagtatggtgatttctcaagaaactaaaaaagaactactatacaatccagcaatctcactactgggtatctatccaagggaacataaatcagtatatcaaatagatactggtactcacatgtttattgcagccctattcacaatagcaaagacatgaaatcaatctaagtatccatcaatgaataaatggatgaagagaatgtggtatctatacacaacagaatattatttggctgtagaaaaaaataaaatgtcatttgtagtaacatcgatagagctagtggtcattatataaagtgaaataagcaggtaaagaatgacaattattgcatgttttcacttacatgtgggagctaaaaagttggcagatactagaagctgggaaaggttggtggggagaagagaggtaagttaatgggtgcaaatacacttagatgaaacgtataagttctattgttcaaaagcagagtagagtggctatagttaaaaacaatgtattgtacatttcaaagtagctagaagagaggacttgaattgttcccaacacacagaataagtatttaagtatttacgataaatacttaagtatttaacactttaagtatttacaataaatacttaagtatttaatacttaagtatttacgataaatacttaaagtggtggatgcctcaaataccctgctttgatcattacatattctatgcatgtaacaaaatatcacacgtaccccataaagatgtaaaatattacgtatcaataaagatatggcaaattatattctgtgtcattggtaatatgttctctttttataataaagcatcatttattccttctcaaatttgccttttttctttactatattcagtaatcactcattaaaaactcactctaggagactttttccctcaattttctctctgctcatgatttactttgagcttttccttgttcccccaacactgactgtttgtcatatcttcttcacaaaaccaaattgtgaaaaataaaatataacacaaaagatgtctgcaatctgctaagaaactaaaagactaaccttaaatttaaaaatttataaacattttaattcaccaaaactgtcaagtgggcattattagtagaagctaactttactacctcactcgatcacccttatagggctctttgtaaaagagataattggaaaatctggactcagcttgcatcctaggaaagagtggaagttatgtaattgaaacaattatacaagcatttctttttgcaaggacatcttgctcactatgaaacaacagagggcttactcattatggttcagatttatgaagtaactaaacaatatttccagtatttattgtatggtttcagacatgccaaagaaggtgtctgaaaccactgggtaacagatgctccctcattatattatgtgacaagtgttaatattttcaattacacagcagttgagttaaggtatctttactttgccataaaatctattttattgcaactaaatatcttttatatcaaatccattaatctttagaacaatctatcctatcttgcatatccaattgtacaaggcttatagcatgtaccttttgtctttatttaatcttatacttttgcccaacttagtttaatttacacaaataaattcagctacataattgaacatctttaatgactgcttaaaagatataatattttgcatgctaaaataataaatggactattggaacaagtcacttttaatggatctgttttctaatacgtaaagagataatatatgacacaagcaccatgtggaataggagaaagattactggtataatccctggttctaccatttaaaaactgtatgaccttgtaatatgttgtttagcttctctgagaatcagttttatcaggaaaatgatatcaaggaggctaatacttacctcataatatcacagtgagaattaattatgataatgtatgagaaggaaccacacagtataagttccagtattgaaaggatatctattccctttgcattttctttcaagattgtaatgagagacaaatgtaatgtaatacatcatacactttaaaccatttacatttatttaaattttaggtattattaatatctaaagcaaaatactagaatataaaatgagttattagacacacaaaactatgtcatatcatggtcactcacatcatctattctcttatattttatttctcaaactctcttaaaatactttcatttatcctcataattggttaatcccatgaaataaaatgagacaaattacagatctgggtataaaaccctatactcttgtatcatcttcttagtgaactccctccagttactctaccttatgcttaaattgtgaattctttaagagtctctatcagtttcatatggacataaatacaatttaattaatatgcaatgtttggcttttgcagcacaattccaaatgtaacagaatgtatgaagttatctcaatgattgatatagttagctcacatgttttggagatggagttttggtaattttggtatgtatctctattcagacagctgttgacagatggaaatttggtttaagaactgttccagaacattcctccctttccaaaagatcatcaaatgcttttaataagcatattggagaagactagagagacagacatacaaaaatatccacaacaggtattttgataatagagagagaagggtaaaaagaaaaagaagaaaaaaagctctgacaagtgaagtcaggtgaattcatacatatcaaaaataaatttgcacattgggtagaggcaaaacaagatctaaaacaaatttgatcctttgggtagaggtaaaacaaggagtactatattaatagatctaggaggaataggggaccattcaaataagagttcctgggatgacccagttgtcattaggtggatcactctcttctttgtgcagttacatctagtgtctgtctttatctacagattttttcttgttttttttttttgttgttgttgttttttgacctagagtgggaatcaagcatgtactactcaaactacctctcttcttgatgctccatacctagaaaatactagactttcaataaatatctgttaacaggatgaataaacaaatcaagattgctgctgttttctttttgtatcagcatcttagatttttgattcctctagcttttaactatggtttcttatattttacttcatgtataggactaatagtataccattttggtcctgattcaggaattttaagttggaatatgcctagaagtttcgaaatgttaagatataaatccctctcacatttgccatgatattttggcattcaagatgcaaaacaaacaaacaccaccttcgatcgcacaaaacctatccccaaacctataggaaatgattctagaggtgaaaatgcagaaatatatccataaagatgctaactcaagcttctaaagctcacatactaaaatgagcatattgtatgcttcctattctttatatggtatgattttttttctgatctattcttcaataatgaggttgtataacttgaagggtgaatttagcaaggaaaagctaagctgcctatttgtttttatcaaaagtgagtttttatttgattcctacaagggtgagcagagaacagctaaagtgaaggagggaagggcccttgggtgggtgaccaagttaatacttctgtctagtttgatgctgtgcagtgtggagttttaaaggttattctctggagaaaataatattgaatgagataacaatattaaatgagggacaataatgattgtttttattatttactatatgctaggtacaaagaaaattacatttcattcactatgccttatctcatttcatctcattaaaataaaaccaatgaggcaggtattataacattttacaaacaagaaaataaagattaaagatgttaagtagttttcttaaggtcaatgatttaacaacctgtgggccaagacgcgaatccaagactgtctggcagcaaagcctttcttcctaagcttattgttctattcagcctcccagtctgtgcactgtgttctggtatcacaaactctgaagcattctacaaatacatactaatcttagtagcagaaacaataaaaatgaatttaaaatatatctcaagaaaaaatctaaatagtatgaaaatactaatatttctcacaccggcatcagctagaactcatatttaactgtaacacacgttgctaaattttagatctatataaagatttctgagaatgacataaatgatcatgaccactgacatttattttgaatgataaaatgaatgatccatgcattttaattgtattattattattattattattatttttgagaccggatctaactgctggagtgcagtggcacaatcatagctccctgtaaccttgaacttctgagctcaagcaatcttcctgcctcagcctcccaagtcagtgggactccaggtgcatacgactaccccagccaatttttttatttagttttattttttgtaatgacagggtcttgctatgttgcctaggctggtcttgaattcttgggctcaagtaatcctcctgcctccgtctcccaaggtgatgggattacaagcatgagctactgagtctggctgatgtgtgcattttaataaaaccaaaagttgatatgctaggaaaagtcctagctcctttctcaaatattgtaccaactgaagtatgacaacataattattaaaaggaattgtttagttttaaatttgataccaatagcaaaatgagagcaatcaaaatacctactgacatgatgtaaacacttgagcattattatcattaattatgtgcttgtgtctttgcactagacagtggctgctgaagtctcgagtcgatcaattaattttaatgtgtaaactgggtatacaactcttgcattatcaaatctttgcacttgaccaaattaaaaatcatctttaatttctaagcaattactttcctgtatttcgaattagttctaatcacaaactatgtaattttctccttcctcttgtcttataagcttttaaaattattttatttactttgagaagcatgaaaaatctttttggccactataaaaaataaaaaataaaacaggttgagtgaacttaaaaatgttgattttggtaatattactttaaatgtgtatttaaaggatacaataagccaattaaataaagacagcttggctgggcatggcattttatgctcataatcctagcactttgggaggctgaagtaggaggattacttgagcccaagagtttagaccagcctgggcaaaatagcaataccctgtctctataaaaaaatacaaaaactagccaggtgtggtggcatgtgcctgtggttccagctactctggaggctgaagctggaggatcacttgagcctgggaggtaaaagctgcagtgagttgtgacagtaccactgtattccagcttgggtgacagagtaaggcctcatctctaataaataaataaataaattaattaattaattaataacaagaaaaaccagctttactcttctaaatgttacagattgtgagaagactcattattgtcagttggcatttttactcctttaagtcagttataattcagggtactttctagggctaagtcaaagctctgcatctaataataaaaataatctggatctacatttctgagggtaaggaaaaagcttagtccttcagtgacagctttgcccattaagaaatgaaacaatgaatgtggccaaatatagcatttggaccatgctatgctctatgagtacaagagagttaaaaccttggcactaaaaaacactaccaccctttagtgctaatgttttctggtcatcaaataaagaaatacatgtccatagcacatttattttttaatttttaaaattaaaaaattacatgtgtttcaattcaaagctataaaaatataatgtggattgtattgtttataaaatccttcaatcaattggattttggagcaatagtttgctagatgaagattgttttttaccctgattaaaatccaaaatgggatattctctgtgagacttacatatatagaaaataacaaaacagatttcctagcatttaaatggatagttcgcttgcttttcaagactaacaaaatctgctaatgctatattttgaagtttatcaacctatgtctaagaataaataatttccacaatacagtagtagctgtcatgaaacattttagttattgtttctctggtctcaggcttttgcaagtgtccttatgtactccagatcattgtgtactatttgtaagacagaagaaatacagatcctgatttttggcaagaaacgcacagagtaggacagaagcagggagtcaagctactcttgacttcctgtttactctaatagcctttggaaaacttggtgagacttccaacatccactgaccttgaccactgttgggtcattcgatggtggcattttgtggcatttatatattgcatgtaggcattactactgaaatctttggaatatagttggcaaatgcagttgggattctctccagtttaccagggagactatgagattgtggcttgtttctgctttactgtcaaaatattcagagtttcaaaacagagtctgtggttaggttgaaggggagaaaagtacatttaagattactccccgtagagtagcacatgtgaataaacaggaggaaagcaggatcagtcagaaaagttaaataaaaaggaagttgagcacttttgcttcatttggccctttgatttaatagtcaaagaatcttataattggaagggatctcggggttaatctaatcgaatacccgctccaggtccatgcatatggtcatctagcctttacttaaatacactgtaaccaaggtggaaccattaacatttcttttttctctatattaattaattggctatgatgttattacttctatcaacaggtctcagatctgtcttttaaaggaaaagagaataagctgggttgtctgtccctataaatgatgtccctttaaataggtagaacaactacctttagaagggattccccagatcatctgtcttacttctctaatttttcagggattaaactaagacctccagaaatgaagtaatttctcagagttacaaagctgtttaattgcagaacctgagctaaaagcctggctcagttacatggaaagcagagattttgaagccagctattatagccaccttatcttctttgctctaagtgaagcagacctagtttcttctactttttctcatggcactaagcttctagacttcatactacacatctcctagtacctactatgggctagggacaagcttcacaaagagaacaagtatctaatattgaggagctcatggtctagaatggaaaaataaataactgcagcatcagtgagaagtgctatatttatgaaatatgtttaaattcctatgtgaacatagatatcagagtgattgcagaacgttattgaagtgatatttcagttaatagaactgatttgacctctttaatagcctacagcaatagtagtattacataacagaagtctccagctgggcgtggtggctcacacctgtaatctcagcactttgggaggccgaggtggttggatcatgaggtcagaagttcgagatcagcctggccaatgtggtgaaaccccatctctactaaaaatacaaaaatcagctgggtatggtggtgcacgcctgtaattccagctacttgggaggctgaggcaggagaattccttgaaccagggagatagaggttgcagtgagctgagtttgcaccactgagctccaacctgggtgacagagtgggactgcgtctcaaaaaaaaaaaaaaaaaaaaaaaagctcccctacttcagttaaaaacttccttaattaaccaaaactcataactgtcttgactggacctggagatgctaacttctcatggctagaaagctgctcttgagtatatcttcacaatgctctgcaaacaagtagagttgtacacttaccaaatagaattgtatacatacctagtagagttgtgtatttatcaagattcatctgagttttttacctaacccatttatctccctttaacttgttaattatgtcagctgctgttgctgttgctgtaattatgtaatttgattaaatattttgtgaagtgataaaatactcatcttaatgtttctataaaatgtaaggtgaatgttttggaaaggcttgtgaaacaccaaatgtttaaaacatgctattaatgtgggcaagataattatgaaaggttgaggagaaacaaagtctagaagtatttggacactcatattactttcccaatgtcttttattatcagtcaattttcttcacaaaaaatggttgagacccatggcgaccattttaaataaaaataggcaatttaatatacattaatgttttaaatgaaaataaaatgtttaaagaatcttctctgtatctgaccaatctggtcaactagtcttgttcctattacacaaatgagttcttattgactacgtaccatgtgccaggcacattgtctgaaagaattgcctgcatagttttatttaatccttgggccaactattactacaacttaacatgtaatgagtcttagaaaagttcaacaacatgtttgtgttcccacagctaataaatcaggaagagggcattccaatccgctgttatgaaaggcatgattttacaatgtactttctctttcacaatccaatataaaatcaatgatgtttcttgcacaggtgcacctgcctacatcctaatcctgatacagacttttttttttttctgtataattagttttgagataaaaaaaaggccaacatctacacagcatatctccaccctcgagaatgttacttcttgttctggaaagtccccttcctcggtttacccatttgaatacatacgtaatttggtgtagatactcattaatttcttccaaaaaattgttcccaaagaaaccacctcacattgattttttcacctttacttttgtagaatagcattcattattggattttgtacatttaatcattcacctattcaataaataagtgtcaaaacatattctcagtactcaataaatattaattagattgattttacaaacaatttataagcagaggctactatggcttaattcattcacatcataattattagttgatcactaaatataaagaagcatgtgccaagtagaaagatgattacgtatgaaagctctattagcactcactgacttagcactatcattgccaggcacttttctaagacttgtgtgtattaaccttttacatttttttgtttaaacttccaacttttattttaagttcaggggtacatgtgcagcatgtgcaggtttgttacataggtaacggtgtgccatggtggtttgctgtacagatcatcccatcacccaggtattaatcccagcatctattagctattcttcctgatgctctccctttttccactccccactctccaacaggccccagtgtgtcttgtttccccccatgtgtccatgtgttcttatcagtcagctcccagttataagtgggaacgggtggtatttggttttctgttcttgtgttagtttgctgaaaataatggcctctagctccatccatgtccctgcaaaggacatgacctcgttcctctttatggctgcatagcattccatggtgtatatgtaccacattttctttatctagtctatcactgatcagtatttaggctgattccatgtctttgctattgtgaatagtgctacaatgaacttacatgtgcatgtatctttataatagaatgatttatattcctttgggtatatattcagtaatgggattgctaggttgaattcttttggccctaggtctttgaggaatcctcacactgtcttccacaatggttgaactaatttacactcccaccaacagtgtaaaagcattcctttttctccacagcctcatcagcagctgttgtttttttgcctttgaataatagccattctgactggtgtgagatggtatctctttgcggtttttatttgcgtttctctaatgatcagggatgttgagcttttttttcatgtttgttggccacacctctgtcttcctttgagaaatgtctgctcatgtcctttgtccactttttaatgtggttatttttttcgtgtaaacttgtttaagttccttacagatactggatattagagctttgttagatagatagattgtaaaatttttctcctattctgtaggttgtctgtttactctgttgatagtttcttatatcccatatgtcaatttttgcatttgttgcaattacttttggtgtcttcatcataaaatgtttcctcatgcctatgtcttgaatggtattgcctaggttgtctttgagggcttttatagttttgggttttacatttaagtcctgaatccatcttgagttgatttttgtatatggtataaggaaggggtccagtttcaattttctgcctatggctagccagttctcccagcatcatttattaaataagaaataatttccccattgcttgtttttgtcaggtttgttgatgatcagatggttgtaggtgcatggtcttatttctgggttctctattttgttccattgttaaccttttctagattgccacatcaccttataagataggtacaattattattcttattttgttgaagaggaaacaaaggacaagagatcaagtaaaacattcccaaggtcatacagcaagaatctagtacaaccaagatttacatagaatctgagtcaaggttgcagtattaattattatactatgttgcctaaataaacagaatgatgagaataaatacaccatactttgagaacatagaggagagtattccccaatggaagtaactttttctgttgaattctgaaggaagattaggagccaacccagtgtggtattggggagagtactacacagagaacatagcatatgcaaagacttcaaggaaaaaaaaggagagagatagcatggcagtttgaggaaacaagtatgtcagttcagcattgtagagaattattatttcaaactgggaagagcaaagagaacaactagccaatgaattttaaaaaggggtatttttaaaattgtgtaaataagcatagccttttcaaatattactctatttgaataatgcattacataataaagtatagtcttctgcctacaaattcacagatgattataaacaaataaagagaagaataaaaatgtactcatagaggattttgaaaccaatgttatatataaattaaatcagtcacaattggaaaggaattctttattaagcttttaaatgaaaatgcatttatttttccatttttaaattgttattctgagatcaaatatttgaaaaatatctcacaaattatgtatctaatcaaagtgaagtttatatatgtgtgcttgaataaagagagctacaaatttcatgcagatattttaatttcatttatttagctagctcttttggaataatatcaatgaaatagctaccatgacacctgggggcctggtgtttcacacaaaaattacattttcttttagaaagtagctcattatattgtccttttaagtactaagaaaaggatgccatattcactcagtggtctctatcgtcttaaagaagaacattgaaaataaagctcataacaataattacaacacttaaaaagtatttagtacctactatgtgccaggcactgttctaagcactttaactttccatattatctttcagctctttaaaaatgccattcaattggcttctaggctctgttgtttctgatgagaagtcaggaataattcttatctggttctctattttataatgcatttgttttctcttactgcttttattttatcattggttttctgcagtgtctctatatccattgtggtagtagtttgctttatttgtttgtatttatcctgtttgaaacttcttggatctgtatgttaacgtttttgattaaacttgagaaaattttagctaattttttttcttttctttttttctggtcattatctcttccctctcctagtgaggatccagttacagatatattaaactgctaggtattactgtacaggtcactgaagctctgttcacttttccttaatccattttttgttcatttcagttatgtttaaattcattagttcaaaataatacttttaataatagtcataataatacaactaattgtacctttcaagatgacaaggaaacaactcattatcttgagaactgggtaagtagtaaaaaagaatcaatcacttacaatgcctttcttatataagctctacaactataataaatgaggataaatggctctttgcaaaattattccagataataaatagaaacaaaattgatagaaatattatcaccttaagaattgaacattaatggctgctaatgtaaaaaagggtgaaaataatattacttgctttattataaaagggcgtgccatcacctatagtctagcaaagggatcacacatgagtctgataatacctctagatccagctgccatttttttttcttttttgaaagagtagagagagacatattgaactatattatgggtatacattagagatgagtagatttggcaaactatataggtctaatggcctgagttcttcagcagataaactataaggtaaataaaatatagagtggaattcaacaaattaaagaagactgaaaagacaaattaagctaaaaaaaaaatgggcaagactaaaatagtgtatccaggaaaacatataggaatagagcatccagcttaaaacataaaggaatagatgaaaagaacataaaggactacttttaaagtcagattagtggttactttcagaaggagagaaagaactgtgattataataggcatgtagaagtgttctggtagctggcaaagttctatttttgttctaggtggtagttacaggatttttgtctcataataattatataaaataatacattaaacaatatgtattttgtatgcttttctgtatctgtgttttattgaataacaaaatggtaaaaaaaatgcatacacaatatgccgttcagtattctctatgtgtgcatgtatttgtgttttttagtaaagaaaattctatgtatttccaggagtttgagctcttaaccaggatattaaaggaaagggtgattctagaaggcagagttttgtgacctcaaggttataagtccaagtttatattgaaaattttaattctgtcaaaataggccccaagaatgaactagaagggtgaaacaaagaaaggtacatttctctacaaaataacagatcatgaattttgaatgtttccctggtagatacatagcgaaaagacgtaaggaggattttttgagagagggagtgttgtgggtttaatcttgttctcccaaaagatggtgaagttctaatctccagtatctgtgactttatttagaaatagggtgtttgaagatgattatgttaagatgaagttattagagtggtccctaatccaatgaaactgtgtttgttttaataaatggaaaatttggacacagaaacagacatgcatacagggagaatgacacgtgaagaccgaaggagaaagaagagtgattcatccctaagccacggaatgccaaagatttccggcaaactactggaagctgggagagagtcatggaacagattctctctcacagtcttcagaaggaaacaaccttgctaatatctcgatctcagacttgtaccctccagaagtatgagacacaaactttgttgtttaagccacttaatttgtggtactttgttatggcagctgtagcaaactaacacagagagagggcatgccagaggaagaagatggcagattctggactacagggaaaagcacatggagaacttgcctgtgggggatggctaaggaacttcaggactagaggtggccaggagacaactgtgagaaatgctgaggaggcactggaggtttcaagctgggggcttgaactctaaattgggatattaaaggaaaaggggatttgagaaggcagagaattttgtacatcaaggttataaatccaggtatatattgaagttgttaatatttaggtattctttatgcctttgagtaaatacatgaggaagacttgcactgaaacagaaaaggaatatgtgtatgttacgaaatatatatagatatagatgatatgtgtgtatatatattcatatacatgcagtatacattcatgttgtcactacatacttacatacatacatacaaacaggtatataaataaaaatgagtccactgtatgtttaattaatattatacacacacatgtaatatttgaatgtgagaaagagaaaatgtactcttcattcagtggcttgtatccttcgcagctgtaaataaaacaagctgaaaggcagctaaaaagatgaaatcactgtcaaggacagacacacaggaaagcagttttatttttaatgttttgaagtcataagagttatttctgcaagtgtactgcttggttatttttccttttttcattttcagtgtttgtctttcatgccttgtgggcaaggacatttgtattgctatctgcatagccccttcacaataatgtcttccattcagctctctcaggacggcatacaaagcccgtaaattagaacgattgccattaaaagattgtgtgggaagttctttcggttataaaattttcaaagccttaaagtgctagagccaattactggggcaattagagggtgactttttcactatggatactactttaagtggccctaacactaagagagctgggcccacacactttcttcctaaatcagtaggccttgggcagattgatgtcccaaatcagcaaacaatatagaaagggtatagaaagttacagaaacagaaggagggactatagagatgagtatttaactctagaacacatataataagaactgccatttgtggaatatctactgggtgcccagtacctattttctagcccctttatatactattacattacttaaaccagaaagccacactttaacattggtattactgttattctcatcttacagaaaaagtaactgagactcagaatttctatgttaatggacatgtacaaataagaatcatatccagcaactgaacctaatctgacaaccaaacctgtactatttcaacttcaccaagctgagaaagaaaaaaaaaaatgatttacaatctgttataagccctttctccccaaaagttcatgtttcaacctattcttgacgaaagagctgaccctggttgtgctgctgcagtagttctcaagagaaggagctgacaggtcttagaacttcttccagtctggtccttaagcagctgctaataataggatactcctctctgatatgcttgtcagcagcaactgcttaggaagtatgagtccatgacagtacctgtgggtggaattccaggtagagaaagaaatcactgccgtctagatacattggatgatatctggtaacatcaaactggggaaataagttacatattagcgaattttttaaacctgagtatattatttcacttttttctcattgttattgagaaaaacaactacttcttttttttttttgagatggagtttcgctcttgttgcccaggctggagtgcaattggctcacctcaacctccgcctaccgggttcaagcgattctcctgcctcagcctcccaggtagctgggactacaggcatgtgccaccacacctggctaattctgtatttttagtagagacggggtttctccatgttggtcaggctggtcttaaactcccaacctcagatgatctgcccgcctcggcttcccaaagtgctgggattacaggtgtgagtcaccccacctggacaaaacaaccgcttcttactgaacacatcaggaaagaagcaaccttcaatgcaggcaccattacagatgaaaaatactttcaagtgttaccaccattatatccacagatgcccttctgtcagattccaggaatttgtcagaaacagcaggactcacaggaaaagcttgttaaaaacattcggggcatccttttctctgaccccaaaacaccaaaatcaaacaaacaaaaccagaatggccaacacatccactatccagcaacagaattcagtctctgttcataaaaagatttgtagggagaacaacaacatcataaaacacaaccaagctcaacaacacttagtctttttgacatttactcctgcaaaatgtgctgggtgagcagaaacacaggaggaagtgttgcacacaaaagcttttgagaaataacagggctctcttctatagaaacaaaagcctcactgggccagccaaacaaaaggactcagctgctagcaggagaggaaaaacctcttcttcattctcttctccaaagaaaacaaagaaatgttagtgaggcagaaatcattttgcattatctgacttttgagcaaaagcatatcttttaatactgaaagaacggttctttttgagataatattttggaaaatgaaaaagtagaaaaatggaggaagaaacatcagaaactttttttggggggagtagggtggtgggaagtagactgcaaaacatgcttttaaaaaatacatctaggggttaaagtatattaaacaagcaggttttcaaaggtggtagccaaaatgttaatggaattcctcaaggagcaataaatctctcctgttataatccaggattcaaggaggggaaacaatgatgtagtagcaagagctgttatttgaaaaggcagctttttaatcttgtgttgttttgagaattaaagcagataataaatgtaagcagtaggatacaaaaaaaatggtgatttatctttatttttctctttttaaaaatactatcaatccaacctgaagatacccatggtctttggggagtggggataaaaactagaagattcaatgagttatttcactactaaaattataaatagtctgccaaaaattaagtaaactgttttgaaataaaagatcaccaaacaaaaaacagttcttaaatgtagtattcaataagttgattcctgaacattttcctaaatgatattgactggtaatgatttcctagctaccataatcaaaagtcgaagtcatgctatttggtaataacagcaataaagacaaacattgagcaataactgggttaattaatcttcataacaaacctatagataatgttgtttctattatctctattttataaaagcttgataatatttaaagacatcacctgagttcactaaagtagcaagtagaaaagccaggatttgaacctagatttacttggcttcacagccaagtaaatagttttatttctacttctactctatataatagtacagttggccattcaataacatgggttcaaattgtataggcccatttatatgcagatggtttctcaataaatatattggaaaactttttggagatttgtgacaattggaaaaaccccacagatgaactgcatagcctagaaatattgcaaacacttaatataaagttaggtatgtcataaatgcataaaatatagggatatactcttctatttattatttaccagaaaatatctcagacagcaagaccaaatccttctcttcatccttctccttacctactcaatgtgaagatgattaggatgaagacctttacaataatccgcttaatgaacaccaagtacattttctcttctttatgattttcttaatattttcttttatctcacttacttcattataagaatatcgtatataatacatataacatacaaaatatgtgttaattgactatgttactggcaaggcttcctgtcaatgaatactagtaggctgttcatagttaagttttgggggaatcaaaagtgatatgtggattttcaattgtgctggtatctgaaccccaaccctacattgtttaagggtcaacaatacatgctttcctgcaaagagaagtctagggatctgaaggcacgagaaagcactgcattcctaactctctcatatggtaaaaaatgcatcaaactctctgacctatagttaataatctcagaaacacacatctaactaaaggtccttatcatctttagtgcagattgagggtcaacagaagaaatacagccttgcagcctagcagcatcacaggcaaataaataaaactaaaaacagaattatcatatgatccagcagtctcacttctgtttgtttacacaaaatattttgaagttagtcaaagagatatcagccacctcatgttcacggaaacaatgatagccaagttatagaatcaacctaagtgtccattaagagataaactgataaagaaaatgtggtttatataaataatggaatatgattcaccctttaaaaaggagaaattgtgtcattcatgacaacatagatggaattggagaacattatgttaagcaaaataagtccagcaaatataaacactctatattctcatttatatgtagaattgaaaacaactgaactcatcaaagcagagagtagaatggtggttacagagggtggaggtgaggagaatgaggagatgatggttaaagagtacaaaatctcagacagggggaatatattttttctttttttttttttgggttctattgccaaacccggtgaatatagttaataatagactattgtatatttcaaaatctaaatctcaaatgttctcaccacaaggcatgttaagtatttgaggtgacagatatattaactagcttaattgttccacattgtgttaataagttataatatcactttgtatgccataaatttatacaattataagttgtcagttgacaataaaaaataaagttaaacccagttttctctgttgaaagaaaaaaagactattcagtgtatctgtttgtcattcacaggaccttttagttgtaggttggttgatgggtcagttggtggttgcaatttatttttaatttattcaggaaaatggtttaatggactcagtgctacatggctggggaggcctcacaatcatggtggaaggcaaggaggagcaagtcacatcttatgtggatggcagcagtcaaagagagacttgttcagggaaactcccccttgtaaaactactagatctcttgagatttattcactatcacaacaacagcacaggaaagacctgcccccatgtttcaattacctcccactgggtccctcccccaacacttgggaattcaagatgagatctggatggggacacagccaaaccatatcagctcctcataatacaatgggaaattaagaatacttgaatatggttctttgaatatatagaaatactcactaataaatgttttattatggtatcatgatttatttgaattgaaaacttttaaaatctcattgtgaatattcttctagaaacatgaatggaaacctttttctccagtcacacgccagtttacaactctgctggcttgaaacctaaaaataacaaacaccatattttattaaagtatttataactgacttttctgttcaaggtgctacaaagcagttgattttttaccatataccataacgtggaacagatattttgtcttctgtctcctgcttttgccagcatttatgagtcaaacagcatccagacaaagaaagaaaggaccaaagccaaattgtgtaagcattcttatattgacaacatgtttccaagaaaaaagagaagaggagagggttggatcagacaggaaagaaaacaaaataaaacaaagtagttaaaattagtttatttttctacttctgaaacttaaaaaaaattatttccagaagaaattgaaatgagtaggctgatttgagggatgaggtgcatagatgtatgatggtatgctgacatgaagagtcctagcaagagaagttataggacggagggaggaaaatagtagaggcaccaaggcagagttgtaagacataaggaatgaactctactgaggttgaccttgcagcttataatatagtacaaaaagctaacggggagtaaaggcttttacctcccactgaagtgacacaaatactgtgcatttaaaggagtcgtgcctggtttggaaaagacctgtgtgtttagcagaaaccaccctagtcatggaattaggaccatactagactcctttaggggaaaggtagttagtataatacaatactgtggccttataacgattagacttgtaaaatcatagagctgaaagagacttcaggacttgcatagtttattatccaacctttacagagaatggaggatcagagaaataagcaaaatatttaagtctataatttattggtaaagaagatagaattataaataagtactgtaaagacacataatgttctgtttaatcacctttacagttccacacttatagttatatatctatagatatagtgcctaactaaattaatgtttgtttattgactcaatgaataaatgaacacacttaaccttccccactccatattcccagtgggctaatgtggaagaaatttaaccaaaaataatccatctaatggaacataggctttggattctaacaggcttaagttcaaatcccaaaattcactattttttaaatttgtgaacttgggaaaattgttaaatcttttaatttttccatctgtaaattgggcatgaaagagttgtgtacaactttggcattaagaaaaagctcaaaaagcgttttatatctgtagaattattatttctattatattccttattattatattttttaggccctcggtcttcttttatattactcttcaaatcaagtgtcaatgggttttagggtgggtctaaaataaactggggtgctaggaggttccccagctacagggatggccactgtgggtaacaaaggtattggagatggtgggatagaactactactcaaaattaactattgaccccaagggcacagggttgtagctaagtagggcttcaggtctctcacttctgcttcaattaaagtaactttgctttaaatggacataggatttggttaagattttattagaaaaataaaagcagagtttccactcctacagtaaagttttggcaactactaactcatgtttgatttgtgcatatatgctgcttacttaggacatgtatcatacttgtgctcatcattcttttcttaattgatagtgaagacaaaggtaagagcaatcatattttttcataatgaatatacaatgatcaaaacatgaagcctcttgaagaaaatttgagacaaatttaaaaaaaaattctttatagctcttcttgcaaaatagctaccatataataagctctagacaattaaatgaataatggataaatcaactttaaacatgaaagtgttataaacatattacttacaaaaagtaagtaatgaacatgcatcgggagaaacaccttttgggataaatgattgatattaccattcacttattaactctcaccctcatctttatcagttggccaatatttaactttgtatattaattcagcaaaagttggatatcacttagtagactcaagaatgatgtttaaaattttactccttcatggcagttcagagtgatattccttccataacacaaagatttgtaaaataatgtaggtctatttaaaattccagagcatttttcaataaaatgtttgtatatttgattttgtttctaaaaatagaaataagaatgtacagaaggacaattgactgccaataatctaccagtgacaacattctgattctgtaattcattcccaagtggaaaagtataaccaatgtattttcttattagttctgtttacttgtccagattaaaaaaaaaaaaaacaaaacacctatcactgtattctagagagagcaaaccaaaatagaagacctcattgtaaaactatgcttttacaataacagcaacaaaaaatctctcttcatttcaaatattaactatgataataatgtacagagtcaaacaaaactctgatcatgacatagagagtcgaacaaatatagagtcatgatttgtgtgtattgataatatctgtccttcatgtgatctcatattcatgaattaataatcctctcaaagttatgagaactaggttattaatatgaattttgactatttggcttgctcatgattaatcacaggaaagaaaacaacaacaaaacaaaactcaatctagtctctatcacattcatctcaaagtgaaactctgtaacactgatccttgaaccatgaaataattttttttgaacatgagtgagtggtaggcttattttttcacaaccttcagagaactcaacagatgcaaacacacatgataaaaaggtttgctgggttttatcattagaccaattacagatgaattctctcttgaagccatataatttaaatgtgcccattcttactccttaccatggcctcctgcctattaaggtctttgcttcatgaaaattcctttggctggagtgcccttctccaaactacttcttgtccctggaaaatctccacctatctttcaagcctcagttcaaccttccttttctcccaggtagcaataacctctccttcttttatgtctcttctatgacactcttcttgattagtactcaaaatgatctaactatttacatgtctactttcccagtagggtgtgagcctcttgaagaaaatttcagaaaaatttttaaaaattttctttatagctctatcttcttacaaaatatctgttatataataagctctaaatgattaaatgaatgaatgaacaaatcaactttaaacaattactgttataaagtaagtaaatctaaaagtcaggatatggcaccttttctaactctacacaggattactgcagtatattagcaatttatacctatatttcttttcaaattagtattttcttttcaggattaaaaactagaagctcaatcagttactattttcctattggaattgtggagtctgccagaaataaaagaaaatgcttcaaaacactgaccaccaataaaaaagatagtataatctcttctttatactcagattaataccctacttctatccaaatcttaatgtaaataagatcaatgttcaattaccagttgaatgctcaccatacagaagcaaaggacacatcatccacatttccttgtcctaatgaaattcacactctttgcagaaatgagaaaaaaaaatctcaaaagcgagcgaaaatttaaggtcatatgctaaaatgggacatgggtaggaagggagtgcactcctcctccaagagagataaatcatagagtattagttggagtggatgagctttaccgatgaaagggaaacaagtgatatgaataatacagtaaaaatacatattgcatatttgagaagcaataataataataaaagtccacacaactctaagtggcaggtcccaggactctcgcctgtcttctggcccacttatctgtccagctatgcctcttgcaacttctctcacacttcactaggtttaggcctgtgctctgttctgaccatgctcttttctactttggggcttttgcgcctgttggtatttctgcatgaagtgttctcttcctatatttcataaggaaacaacatacttaaggaaatattatacataatgactcagtttaatgatcaccttctgaaaaggccttccttgacctctgttcatttcagttatcattataccctgcttttatccttacagcatttcctaatttacaagtaatatatatacacatacatacacatatatctgtatctatatatctgtatctttatctatttgtctctctcacacatttgtttccttacatattaatttaccttccgtctcccccaaataaatgagtgttttgaggacagagatggtgtatttttcactcaccaatataaattgtatgaccttctagtaacttaacttttctgggaccaattttcctcaattatcaaataaaatcataataatcctacaggtagacactattattacattactgataattgaggaaaatcctcaatccacataggattgtttgaaagaacaaattaacataaaatggcatcttaaatataatgcttcctattggttagagtttttgaataactcccccaattttcccatattcaaaagcatagaactataaatagctatgatatacaagttgaaaagaagatctcaaacttgttttgtcagtcttagctgatcaatgcccttccatggcctccaacacatacctttatggaaggtgaagttgaagaaactaaaaaaagaaaattcctttggaaaacattgaattaacaatatttttatctgtactctcttaaaggggaagagagagggatgcattctcctcaacccaagtttagagaaaggggttcaatgggttgactcagaattcatgatatgtttcccagattgcgaggatcataaatccagatagttgcctcctcctgaaaaaatatgtgatagactaaggttagagttcttctacctgaaaacagaaggaagattgggagctgcattggagaggagctggaattcttctaacaacagggaaaatgtatgtttcccatgaattagatatgagttgagaggagggaaactgacaaggggtgctcattaaagagactctattcaagatgactgcctgaatctcaatagaggggtggaccagtggaagctcagggacaagagatagttaaatgtggtcatccaaaggaagccttgcttccatccagaaaaccatagttttgtcagcaggaggagagctcagttctatccggaaaaccatagtcttgagtttgccagcaggaggaactcagatgaacccagaaaagccccagaaaggataaagacctgcagattatacatctatcaccagaagggtattgaaactaaattacaattataccacccataaaactaagtacttttcccatgattgctctctcatctctcctctattccagaaaggtaaaaaaaaaaaaaaaaatgaatataggaagcaaataggttgaaaaaagaattaaatcttattcccttctctgttgtagattttttggcctgaagcaggataaggttggggaaaaggatacattttaagtcaaataagggttcatagtttttattttgcatttgaccgtgttaaacttatgagactattagacttgagtagattttattataataaatgatctgcctgagattgtatcaaaaggagggatgaattaattcctagaggggtttgtgagaaggcagagagaaaacaatgaagttggtttctgcttttaccttactaagtccagcttattcagtaaactaggtatgaatgtatgtacaaggcttcacacagcattgaaagttaacgaatggcaacgatctaaacatttgttacacaataggtgcttcatatgtatgatttctctgctccctctttccagtgaaatattctttcaaaaacatagtacaggcctatctcattttattgcccttctctttagtatacttcacagataccacattttttacaaattgaaagtttgtgctaaccctgcatcaagcatgtctattggcaccatttttccaacagtgtgtgttcacttcacgtcgtgtgtcacattttttttggtaattctcatagtatttcaaaatttttaatgattattatatctgatatagtaacatgtgatcagtggtcattgatgttactatcacaatagttttggggtgccacagaatatgcccatataagatgatgaacttaactgataaatgtgtgtgttcttactctaccaaaaatatgtccttacctgttctcgctccctcttcttgggcttaccctattccccaagaccccgaggctaaataataacccttaaatggcctccaaatgttcaattgaaaggagtaatcacacacatatcctttaaatcaaaatctagaaatgattatgcttagtgaggaaggcatgttgaaagctgaggtaggtagaaagctaggcctcctatgccaaacagccaagttgtaaatacaaaggaagagttcttgaaggaaattgaaagtgtgactccattgaaagcaaaagagctttatcactgatgtggagaaagttttagtggtcgagataaatatcaaactagccacaccagtctcttaagctaaagcctaacccagagcaaggccctaaatctcttcaagtttgtgaaggctgaaagaggtgaggaaactgcagaagagaagtttgaagctagcagaggttaatttgtgaagtttagggaaataagccatctccttaacatgaaagtgcaaggtgaagcaggaggtgctgaggtagagaagttgcagcaagttatccagaagatctacctaagatcattgatgaaggcaactatattaaacaacagattttcgatgtagacaaaacagccttgtattggaagaagatgacatttaggactttcgtagctagagaggagaagtcaatgcctagctccaagccttcaaagaacacgctgattctcctggtaagggtttatggagctggtgactttaagtggaagccaatgcttatttaccaatccccaaatcctggagcccttaagaattatgctaaatctactctgcctgtactctataaatgaaactgcaaagcctggatgatatcacgtctgtttatagcatggtttactgaatattttaagcctactcttgagatgcactggtcagaaaaaaagatttctttcaaaatattgttgctcattgtcgatgcacctagtcaccaagagctcttatgcagatgtgcaaaaacattaatgttttcatgtccactaacacgatatccattctacagcccatggatcaaggggtaattttaatttttaaaagtcttattatttaagaaatactttcagaaagctatagctgccataaattgtgattcctctgatgcatctgagtaaagtaaattgacaatcttccagatgccattaggaagattcatgattcatgggaggcggtcaaagtctcaacaaaaacaggagtttgaaaaaagttgattccaactcttacagatgactttgaagaattcaagactttggtggagaagtaactgcagatgtagtggaaacagccaaagaactagaattataaatggatcctgaagatatgactgaattgctgcaatctcgtaataaaactaacaaatgaagagttgtttctcaggaaaaagcaaagaaagtggtttcttgagatggaacctactcctctggtgaagatgtgaatattgttgaaatgaaaacaaaggatttagaatattgcctaaatttagttgatgaagcattagcagggtttgagaggactgactccaattttgaaggaagttctaatgtgggtaaaacgctaccaaacggtaccacatgctacaaataaatctttcctgaaaggaagagtcaattactgtggaaaacttcagtgtcttagttttaaaatttgccacagccgggccgggcgcggtggctcatgcctgtaatcccagcactttgcgaggcccagatgggcagatcacctaaggccaggagttcaagaccagcctgaccaacatggagaaactccgtctttactaaaaatacaaaaaacaaaaacaaaaacaaacaaacaaacaaacaaacaaaaacagttagccgggcatgttggcacatgcctgtaatcccagctactcaggaagctgaggcaggagaatcgcttgaacccaggaggcggaggttgcggtgagccaagatcatgccattgcactccagcccgggcaacaagagcgaaactcggtctcaaaataaataaataaataaaaataataaaataaaataaaatttaccatagccaccccatctttcagcaaccaccaccctgatcagtcagcagccaccaccctgatcagtcagcagccatcaacactgaggcaatatcttctgccagaaaaagatgattgactcactgaaggttcagatgatcattagcattttttagttataaagtattttttaattaaggtttttttggatgtaatactgttgcatactcaatagactacagtatagtgtaaacataactgttacatgtactgggaacaaaaataaattatgtgacttgctttattatgatattcactttattgcagtggtctagaatgagactgcaatatctctgaggtatgcatatataaattttttcaaaaattttgaagcttttccttgaatatcccacataatatatcatactataataacctttcagtgaatcctttacagcttaaaaacctaggcagaggtcagtcttgcctcaatatgatttagaatggatgagcaatgtggttctgggaagttctttcatctaaaggctgaaatgcaggaacagagtaaatttgcatccagtggactatatccatcatctgataggagacagcaagtagccagagtgcagcaagagaatcaggggactgctgccctctgtaaatcagaaagcctccttatagatacaataacaagcctgtctggtgtcctggaattgagtgtggatgaagtgagaagccacctggtatctttttctggggaacattttgcagattgaccttaaatgattatatctgtgaataaattacctcatgcctctattatccaatcaatcaatgcaagcttttctttctctgccttttcttctccaacataggtgaacacggcttaagagatgacccaaatggagcttccctgtagaacaagacctttccaacctctgcttgaacccttctggtaacagagaactcactacgttacaaagcctcatcctctagagtcaggtactgttcattttttctcaagcttttctgtccgctaagccaaggtctgctgcccagtaacacctactctccctacctctgccttctggaatgacagaattctttcctattacaactctatttttctcatgtatccaacacttattgagtacttactctgtgtgagagctgctttgattaagttgtaggttcttgggggcatagcagtgaacaaaacaaagttttctaccctcctagagcttatattctagtgtacacaaatacatatatttataatacaatgtttggttgtgatacatactatgaggaaaaataaagcccttaataaagagagaaagccacatgaaaagtgtgttacaggcacaaagaatagccaactacaaaagctgtaggcaggaacatacttagaactttgaaacagttgtaagaaagctagtgttattgaaggtgcatgggcaaggggaaattgatggaagatgaagccaaagaggtagccaggggctggcaaactatggtaaggctgtggagtttgattaagtgggaggggaagctagtagatagtttgcagctggggttgatataccctaatttatgtctttaaaatattactcaagctgttgtgtgaagagactgtagagggtgcaaagtgggaacagggaccagtttgagtactactgcagtagtctgagcaagaaacgatatggtttaggttacagcagcaaagcagagttggtgaggatagactaacaggatttgcaaatgaactggatgtgagtgtgagtcagaaagagaaatccgggatgattcttctgtttttggcctaagcaactggatatcatttgatgagccaaaaccagaaaaagctggttttggaaaataaaattaagagttgtgttttgtatacattaatcttaaaatgtctattagatctttatcacatcaaagatgatattaaatataagcataaagaaaaatgtaagcatagggatggaacttatgaaacctgaagcataggtcctgatgagactacctaggagaagaggttgatagagaaatacggaggtaccaacactgaatcttcgggaactctaggctttagaggttaaagaaaaaaaaaagtttgagaacctctgtaatttccttatctaaacttatctacttgtatatcgtcacagataaatcttgggagcacattattggaaaaccaaactagcttcttcccagaatagctgatatccttcatgaaaatgaaatgttgttgctagggcttgagaaacaaggaaaaacaagtaagccagaagctccaaaatgtttttttttattttcaattgattaatgaatcaaatgtttcactctaacagatgtcccatctcaattccattactaacgtttttaactcaaaggcatcatgaatacaaatggcagcaaaactgaagctttcacaatcaactattacattttccatgataccatttctcacaattatgttttcttactgaggaattgcattgatgaaagcccagataatttttatttttaaggttacttaaattgcaagagttttcttagaaaaaattataagaaaatcttccagctaaaagttttaaaacttgtgaattacaataacaaggaattgtaccaactaagctaataggagaagtaactagctatgattcctcactgagtgggtcacagcaccttctgtgaatgaatacagactaatttcaaagtgctgaagtaaatatttagaagagagcaatccaatttcatcagctaggtcggtgtgttgccaaacattcaactttcatatttagcttccaaggactcatgcaaagtacaatgcttctgaagtctgatctaatggagccatcaggaaaaagatcattatcaatcttgctggggccatctgaaatgcttattatcagtaacaatttagggtagaaatacatatgacagataagcaagtgaatacactgctttgctatttgaagcagcgaggagatccatgtaacaggtaatatacctaaaagattatcttttattagtgaatgcaaatgtggagtctgaaatggttagcttcctattaaacaaatgaaaatatcaattctagtctgaatttaagcatggagaaagatacttctgaaaattatgcaccttttgttctaatgtctctctttttaaaaaatcttctccacacactgcttcaattcatcagaaaatcaaagcatgaacacctgggaaagaatagagtatcaaagaagacagctagttgaaatttctaaagacaagactcataaaataaagtcagtttcttttagttagagaataggtttgatatacaggaaaaacaatagctttgattcactttggttaatgtgaatctgttcagactgtttatataacatattgacttaaatgtaaaaaactgtatttcaagacagttctgattaaaggatattctttaaaggctctaataatatatcatggacaatgaaggagagagaaaagtcttcatcatttatgtactccctgtctttagcacatttcctggcttatggtggtagatactaaattaaatgtttgttgaattatttgaaatgaatccacttattcttcctcttctgagccaaatgtctttcaaaatgtatattaaatggtagtttttcccatttctccatgcatttttaacattttcagtttcatacatgttgatgttaatatttctattaactggttataatttcatggtacatagtatttttatttgtatgggcaaaaagtaatcacttttttcttgctgagactacttctctttgcatatctttgctcacctttccatttttaaactttgtgttttctttttttccttttaacttttattttaagttcaggagtacaagtgcaggtttgttatctatgtaaatttgtgtcatggcggtttgtggtagattatttcatcacccaggtattaagcatagtgcccattagttatttttcctgatcctctccctccttcccggctccaccttccactaggccccagtgtggttgttcccctctatggcttctccacaacaaaataaactatcaactgagcaaacagacaatctacagaatgagagaaaattctctcaaaatatgcatctaacaaaggtctaatatccaacatttataaggaagttaaacaaatttacaagaaaaaaaaacaaccccataaaaaagtgggcaaaggacatgaacagacgcttctcaaaattagacatacatgcagccaacaatcacatgaaaaaaagctcaacatcactgatcattagagaaatgtaaatcaaaaccacaattagataccatctaacaccagtcggaatggctattataaaaactttgtgtttttttaaaaaagtatttgcttattaaaaataatgtaatatatgtacatggtagaaaaatctaaaaggtataaagaacaaacagaaaaactaaattttcttcccacatagcttccctctctggggcaactactgttgtcagttacttttcaagatattccagatattatccatattctatgtatatataagtctgttagtctgttctcacactaccaataaagatatacccaagacttggcaatttataaaggagaaaagtttaattgactctcagttcagcatggcttggaaggcctcaggaaacttacaatcatggcagaagaggaagcaaacacatccttcttcacatgatgttaggaatgagaagtgatgagccaaaggggaaaaaccccttataaaaccattagatcttgtaagaactcactcaatatcactggaacagcatggaggtaacttccctcatgattcaattacctcccaccaggcccctcccatgacacgtgggcattatgggaactacaagatgagatttgttttaaagttttatttgttttttaagacaaatcatataacattacgcataccgcccacaatgtttaggtaatttaacaatatacacaggattttgttccatttcagtacattcattttattcattcagtactttaagtgcattcattcatttaatatatttatttcagctcctcatttttttttctagttaattttttttttattattatactttaagatttagggtacatgtgcacattgtgcaggttagttacatatgtatacatgtgccatgttggtgcgctgcacccactaactcgtcatctaccattaggtgtatctcctaatgctatccctccccccgccccccaccccacaacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacaagaactcatcatttttcatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacagtggttgaactagtttacagtcccaccaacagtgtataagtgttcctatctctccacatcctctccagcacctgttgtttcctgactttttaatgattgccattctaactggtgtgagatggtatctcattgtggttttgatttgcatttctctgatggccagtgatgatgagcattttttcatgtgttctttggctgcataaatgtcttcttttgagaagtgtctgttcatgtccttcgcccactttttgatagggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagattccatttgtcaattttggcttttgttgccattgcttttggtgttttggacatgaagtccttgcccatgcctatgtcctgaatggtaatgcctaggttttcttctaggatttttatggttttaggtctaacgtttaagtctttaatccatcttgaattgatttttgtataatgtgtaaggaagggatccagtttcagctttctacatatggctagccagttttcccggcaccatttattaaatagggaatcctttccccattgcctgtttttctcaggtttgtcaaagatcagatagttgtagatatgcggcattatttctgagggctctgttctgttccattgatccatatctctgttttggtaccagtaccatgctgttttggttactgtagccttgtagtatagtttgaagtcaggtagtgtgatgcctccagctttgttcttttggcttaggattgccttggtgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacgcatgagcatggaatgttcttccatttgtttgtatcctcttttatttccttgagcagtggtttgtagttctccttgaagaggtccttcatatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgtcagctcctcatttttaaaaagctgaatggcattacagtatactatatggatgcaatacaattattgtagctattcttttgtcatttagatttttttggttcgatttttgccactggaaacactgttgcaattaatattgccatttcactcataggcaggtacatatataggataaattcctagaagtagaatcactatgccaaagggtttaagcagttataaagttaaagatattttggtattgctctccaagaatatggaacaatttatactccaccagcctccttcagctctcagaaagagcctcttttaccacacctcctaacacagtgcatcgtcacaatttttgaatgtgggcaatttgatagttaaaaaaatggcatcttgtacttttaacttgcaattattttattatgaataaggctgaacattatataaatgtatgataaatttactgggaatattttctccactctatgtcttcctgttttactctgtcagtgacatcatttaatgaatagaatttcctaattttaatataggtcaatttacccaatttcctttatagttgtacgctttcatttttaaaataaacatttatatttaaatatagaaatgttttttgtatgttgatatggtttggctatgtccccacccaaattccatcttgaaatgtaattcccacaattcccatgtgttatgggaggaaactggtgggcggtgattgaattatggggatgggtctttcctgtgatgttcttgtgatagtgaatgagtctcatgagatctgatggttttaaaactgggagtttccctgtacaagctctcttctcttgtgtgccaccatgtgagatgtgcctttcaccttccaccatgattgtgaggcctccccagccacgtgaaactgtaagttcaataaacaatttcttttgtaaaatgcccagtctcaggtatctctttatcagcagcatgaaaacagacttgtacagatgtaggttgtgaaaaagggacacaactgttttttaaagatagatgtccagttttcccaatataacttattgaacaatccattttttcccacttaatcaaattgccaactatattataaactaaattcctttatgtgtcttgtctattttcagaatctatagtctttaactttgatatatcttaatttttattttagttattaaaattttgtatgatgtcttaataaatggtaagcctggatctctctcattattgttctttttataaattttccttgctattattgctcattaatttttcatttaaatttaaaaatcagattttcttgcataaaatttttgttatttttatttaaaatttttagtataaaagtaaaaattgaaattttttgatgttgctcttcttttccaatggcacattatggtattcctttattatatgtctcttggtagcatttgaaagttacctttatatagatcccaaatgtttatcaagtttattctcttctttttaagttccagggtacatgtgcagggtgtgcaggtttgttacataggtaaatgtgtgccatggaatactatgcaaccataaaaaggaatgagatcatgtcctttagaggggcatggatggaattggagccattatcctcagcaaactaaagcaggatcagaaaaccaaacaccacatgttctcacttataagtgggagctgaacaatgagaacacatggacacatggggaaaaacaacacatactggggcctgtagggggtgaggtgcagggagggagagcaacaggaaaaagagctaatgcattctgggcttttaaaagtgtattcttaagatattttggggtattgtaaatgatatactttctgtcattatattttttagttgactactgcttatatatggacatatatgtatatgctattgatttctatattctgattttaaacttggccatcttatttattgcctaaataaattaattaaaaatttattgcttaaatttatttaagcaatttattaattaattataaattgagcaatttattaattaaatttattgcttaaataaattaaataaataaatttaaaaaatttattgcttaaaataatttttaaattatttcctttggtttatcatcataaatatattttttcttcttttcaattcatcatcagatttacatctaaaatgatacaaataacagttttgatgaagggcatattttaggaaagagtgatatgttttttggatttttaatttaatattttattttaggttctgaggtacgtgtgcaggtttgttatatacgtaaactcgggtcacaagggtttgttgtacagattatttcttcacccaggtgctaagcctggtactcaacagttatcttttctcactctcttcctccccaaaccctccactctcaagtaggccccagtgtatgttgtttctctgaaaaagtgatatattttttgaatgcttgactaaatcaatactccttgggccactagctcattttcttgaagctctatagctcctgtttggtatagctttaaagtttttctctcttctttttttaatttttgtgaagtctgtgctcatcataattatctcaagctttgctctttgtcgctattttcagtgacatctattttttcttcctatttgtaacatattcataagttctgtaatggtattatttaggccctttattgggttccctgggcttcaatctttcttttcaccccattttctacctttattttttgtatttcagcactttttaattgaatttattttaagttttcctacagcataaatcatgagcaattaattcccttctgccccttgaactataggttaaactctttgtctccttcctttgctccctccctctcttccttattttcttcttcttttttttagaggttatgaagaccaagatcacacagggttaatagcatgagctctggagccagacaccagtgatttgtgtcctggctctgtcatcatttgtatgattttaggcaagttattaaacctccaaactgtacataaaataacaatacctatagggtttcttaaaaggactaaaatatgtatgcataaaacattagaacaccacctaatacataccaggtgcttaatagattagattacaataatacgcttctttctggttttgattgcggcattcttacagagttactaaattctttcatcctgctcatgattgggcagctcaattggacattctatttgctctgatataacgcatgtgactggtttacctttgtcctttgtgcctagaattattttgttttcccacgccaagttacagtgggagtggaggtctggctattttgtgttctcatcacattttgtgcctgagcaatagctggcaagggtgttggaagagatctcggtagaggctacaggcaagtgtgtcatttttcttgtaagaccccaattctgttagcttttgagattttgttaaatgtcctacaccaagttgcatctaattggagaaatttctctaatttggagtgtggctagagaacatttatttccaccagagaatatcagcatagctactcactttaccccctttagactttctcaatcacaagtttcaactactctttgaaaaagataagcctactagctcagtgtgctcttctctggatttaatggtatcagtgagaagtcttaggattttgtcaatcacccgtacaatctcaggagggaaatgggagtcaggtagcatctgagcctctctaagcctttctgctacaatttccttcttttagtcacaggtttttaagtgtattgcattaagttgtgctccactgcttcttttgtcactgtaggcaaaattttctaatggttttggttgctaattgtccctaagttttactcattttgtgagttactgaaggagaaaataacctgttctcataatctggaaaacagttctttagtagtatgcacattgtgtttcataaaaaactttccctaaggacattatttttatgtttatctttccattatttttataaccagcccttccttatacctgtggtattcacttttatatctatatgtgctgggtaacatatgcacttgccaaattccatcttatttctgataatccaatttgtttaccttcaggttacctataattgatagatgaggaaagggtggtgaatataaggaattgctgagtcactactgagattgatatcaataggtccagatgctaggtgcagtccaacaatattacattcaatagagataaaacaagtgtataagtctacaaatacaaaattattctaaaataaaatgtaatagatctgatagccaaaacttcatatgaaataatattcaattgtcttattcttgacatgaaccaacaaaaagattcttaaaaacaaagctaacacaattttatactacaataacagaagtagagtatggagctcacgtgcacaaaattcactcactatggtctgtgcttacaagcacacaaagggatctgtatatccaattctgtgtattgttacttaggtgggatactgccaaaatttatagaaatttgtagagaaaatttatagaaatttgtagagaaaatttctctacagcaaaataaagggattaaaaatgatgatgaatcaagaatggttaatgaactgggggtcttaatctaaaggaaagagtcctgaaaggagacttgacagtggcctacaaatgtctgaagggctctcttgtgaagagttgtccgctgtagccgtagaaagcaaaaacaagattaatggaaaattttagaggaattctactttcagctcaattatagaaaaaaaaatccagtgatgggcacagtctcccaagtgaacagctaccattagtatgggaaaactttctctccagagtattaaagcataaattgaagacttggtcacggtttcctagaaaaagcctgggcatatatttatagtactgtcacattttacacactatactgtgaccactatttcctttgagggcacaccatgtttctatacccaatttttagtcttgtcttcagagcatgttcaattaatgctttgttaaatattagtttggtgcaaaagtaattgtgtgctttttgctattaaacgtaatgagtgaaaatatatgagtgaatctgtgtattgagagagatcagaatatttgacatcttagaattcttgaacatcaaaattattataattaaaaaaactgctaccacattcagttgattcaaataaatggaactatgaagaataaaattttcattttgactctactactactaaaaactcaatgactatttttaggtccctgggaagtaactattgaactgttgcttcatgtgactaatggcttatactgaacaaatcatatgtatataccttcattcaccacgataaggcactgactcttccagaaatgtacctagtttgtttcctgtgtcatttttactcttcttttttcttaactactctttcttcagccttgactaataattctcaatcttgcctaatatcaacctttattttgcaatttttcaattttcagtgaactcagtgggatctcataactagataacccatagaattttccatgtttaaaaatgcataagctggtgttctttacagatattaaaatagatttcattttatctttcctagtaagttttctatatgcgataaagtacccaaagtatctatctacaattgagttatgttcagagacaaagtctatgtagtacaggcttttgactgacagcttagtggcattaggagtcatggtccatgaatagaaagtactgcaagttttaatgtattggatctcagtgttccatagaaggcgaaaaatttaacggacattggtccatgagttgaggaaccaaaatggatttagtcagggatcatgaagaatttagcatgaagtcagtatcagtcagcagaggaggactgcattatttcagtttaggtaaatgccagtcttctaagaagatacttgggaaaaaagccaaaactactttatttattctcattcctttaatttagcattacaacttccagacctaatatgtttttgaaataaaatatttattgagtgaatagatgattgttttctgtgcatatttccttttaaaaaagtaaacaaaaagaagaacacttaaaatttaattagatgccgatacatacccaatatctctaatgcttatttaagttaagcaaggatttcaacttaggtcctagctccaaatcccagtcttttcatcaaattgctttgctgctggccataaatttaaaaaatttatagttgtatttaccacagcagcattttttttaaagcttacaaacaattccatgtaggtaaatatttaccttgagtaactattcacagcttttcacagggcttgttgtgtgaatgataaaactttaaatgttgaaaaaccaaaagtacatttagtacagtgcaattatttaaatctgaaattttcattgtaaaaataattttgacttcaaaaatttgttcaaggagccattgatcatatattctgttaaaaaattatagatcagctttaaacagcaaataagaaaactgtgaaaagaaacagtggtcatgttatccccaaagggcacatgacaggagtggcatcattcattaatttccaaaaagatttagcaaacataatcatgtgattaattctctcataatgttgtattatacagaacagtgggaattacagtggcaatatttgtagtttgttctttcatgataaatgatttgctacacaatcttaggagagagcttgtttacagacatcattatgaatattgaccaaatattagcttagagaaagagcctcccaattcacaagcatatgtcttatatccagaaataatcagaaattaacaacgtgcatgcacaagaaattctacaggaaaagtacctgggaacaaggtgaatttatcaaatatggtgtccttcatttaataataataataataataataaaagatttgctctctggtagacaggagagcggtaatttagctacaatttatttctaagaagactgtttccctggtttaagacaaatagttcaccactttctttcttattccatatattttattccaatagaaggttgcactatatatatactcaagtaaatttccttgtgtaccccagggaaccattgtggtaattcaaaaggatttaaaaaattagcactaaaaggaaaatgtagtgttttgagaactcatgccaaatagttaaatttgctattcgtgcttattgaacaaatcattgttccagcatggcctttcacctaaaacaggtccacctaccactaggaacttgatcccaggacatgagcctgaataaaaagtaaactgtttcctgtattcagagacatttttgcacatgcattagaaaatgaataaacatagtaatttactccatggcaagaaataagaaaatgcatgaggtcccctgatacagtaaacggttgggtgccagtaatcaaaccagttgtacaaactttgtttttagtttctaccagtggtctggtaaaatgcttggtcatgaactgctgaatttcagataactaatacctttgctaacctaaacatctccaagttattatggttacaagatagaaaatccaacttgttaaagaaaaaaaaacacacacacacactattgacaaagctatccatggacagatcagggaaaaaagaagaattttggtgcagacagtctcggtactaagtgttaagaacagtgcatttaattttcaattaaaattttaattcattcagtgttcattctcaataagacagctctaggcctatcaattagccaaatgactaatgtcaggaaattttcagatgacttcctcacatcaagactggatagttcactttggccatatgggcatcagaaaaaaaaacaaaaaccaggagcagatggaggagtaagaacagatctgataaaggaaatgagtatgataaatagaaaagctggtaaaatttatttaagttagatatttaataaattctcatctataatatcagatgcaagtcaagttgatatttagataagctggacatgaaatttgtcacatcagttatacaataaagtaaaaatcaaatatctagaaattgttttttgattaagtggactggtaagcaatgtgccagatgcctccaatttcttgtacatacaatttctgtaaggagtgaaaaaaggtaaggtgccaaaacatgggcttcactcatacggactcttcgcagttgaaaaactgtcagcttccatctgagccattccttttccccttgccacattgctttgatggttatgatctaccttgcactccccactcatctctgccccaattcttcccatttactacccagaactgggtcacagactggagcttgtactttccttttaagtatcacttaatgcttcaaatttagcattggccaggatagacatcattacattaatgacttagggttagaattagcggtttctttatctccttaatctgggttgttgatattcatccttttcatgccctatgggttacttggcctgataataaaagaatgaacagaaaaggaagaaataaagcacatcagaagttgttagaaatgaaagattgcttctgattgcgtcaattagtgatagctttatggagaagttaacactgaactggctcttgggggatggatatgatgtcagcagatagtggtcacaatagtaagagaagacattcaaagttgggaatgaaatgaacaaaggcttagaggaaggaaaatatggcatatgtttaagaaatggtacacagggcagctcacctgcatcaggagagatgtgaatgggacaatgaagaagagaagactgaaaccaagttttgtggctggaggagaaagagatcacagagtgcctaaaatgctacttactggcaatgaaaaactactggagacttttttttttttttttttaccaggggagaatcatgaacagttttgaatttttggaagattggtatagaagatatgtgttggtatggaagggagggaccagcaatgaagcctattatagtacgccagataagatatcaagaatgtcgacaggctgcataaatgtcttcttttgagaagtgtctgttcatatccatcgcccacttgttgatggggttgtttttttcttgtaaatttgttggagttcattgtagattctggatattagccttttgtcagatgagtagattgcaaaatttttctcccattctgtaggttgcctgttcactctgatggtagtttctttcgctgtgcagaagctctttagtttaatgagatcccatttgtcaattttgacttttgttgccattgcttttggtggtttagacatgaagtccttgcccatgcctatgtcctgaatggtattgcctaggttttcttctaggtttgtatggttttaggtctaacatttaagtctttaatccatcttgaattaatttttgtgtaaggtgtaaggaagggatccagtttcagctttctacatatggctagccagttttcccagcaccatttattaaatagggaatagtttccccatttcttgtttttgtcaggtttgtcaaagatcagatggttgtagatatgtggcattatttctgagggctctgttctgttgcattggtctacatctctgttttggtaccagtaccatgctgttttggttactgtagccttgtaatatagtttgaagccaggtagcaagatgcctccagctttgttcttttggcttaggattgagaagacatttatgcagccaaaagacacatgaaaaaatgctcatcatcgctggccatcagagaaatgcaaatcaaaatcacagtgagataccatctcacaccacttagaatggcgatcattaaaaagacaggaaataacgggtgctggagaggatgtggagaaataggaacacttttacactgttggtgggagtgtaaactagttcaaccattgtggaagtcagtgtggtgattcctcagggatctagaactagaaataccatttgacccagaaatcccattactgggtatatacccaaaggattataaatcgtgttgctagaaagacacatgcacacgtatgtttattgtggcactattcacaatagcaaagacttggaaccaacccaaatgtccaacaatgatagactggattaagaaaatatggcacacatacaccatggaatactatgcagccatcaaaaatgatgagttcatgtcctttgtagggacatggatgaagctggaaaccatcattctcagcaaactatcgcaaggacaaaataccaaacactgcatgttctcactcataggtgggaactgaacaatgagaacacatggatacaggaaggggaacatcatacaccggggcctgttgtggggtgggggaggggggagggatagcattaggagatatacctaatgttaaatgacgagttactgggtgcagcacaccaacatggcacatgtatacatatgtaactaacctgcacgttgtgcacatgtaccctaaaacttaaagtataatataaaaaaaaagaaaaaaaaagaagacaggaacaccataataatggcagtagagattttaaagagaggattaatattttgtaagtggcttccaaaaggtatatgcctgatttattaaagcagcaaagaagagagaaccaaaaggaaaaaaaggacgtccaaggccttttactgtgggtgactaagacaatcgtttgaataaatggagaggtcaaaagcaggagtaggtcatatgggtgaggggcgagtgatggaacctggtgctaaggagatatcataaggctaagttttaatatacttggagctatttctgcacatggcataccctgacacagatgcccaaactgggaaaaccaaagaaaaatcccaaacatatatgtgcattttcataaagcatagagttatatgacacatcataactcaaacctgttagaaacaaatttatatagagctaaagaaaaaatacagctgtacataacatatatgtgcatatacacataacataaatatatttacatattatatatatgcatacatgcatgcataagccaaatatatattggttctatctggaatcgctaaatattaaaagcttttaataaatagtcaattcattaattcaacaaatattctagtgcttttaaaggacctcccccaaatttttttaatctgtccatctgacaaaggtctaacatccagaatctacaaagaacttaaacaaatttacaagaaaaaaaacaaccccattaaaaagtgggcaaaggacatgaacagaaccttctcaaaagaagacagacatgcagccaacaaacatatgaaaaaaagctcaacgtcactgatcatcagagaaatgcaaattaaaaccacaatgagataccatctcacaccagctagaatggctattattaaaaagtcaaaaaaaaaaaaaaaaaaacagatgcaggcaaggttgtggagaaaatggaatgcttttacactgttggtgggagtgtaaatgagtttaaccattgtggaagacagtgtggaaatggaatgcttttacattgttggtaggaacataaattagtttagccactgtggaagatagtcctcaaagacctaaaggcagatgtaccatttgactcagcaatcccaccacagggtatatacccaaagaaatataaatcattctattataaagatacatgcaggtgtctgttcattgcagcactattcacaatagcaaagacatggaatgaacctaaatgcccatcaatgacagactggataaataaatgtggtatatatacaccatggaatactatgcagccataaaaaaggaaggagatcatgtcctttgcagagacatagatggaattggaagccattatcatcagcaaactaatgcaggaacagaaagccagatacagcatgttctcacttacaagtggcagctgagcaatgagaatacacggacacatggaaggaaacaacacacactggggcctgttggaggggaagcaggaggaagggagagcatcaggtactaggaagaatagctgttggatgctgggcttaatacctaggtgatgggatgatctgtgtagccaaccaccatggcacacgtttacctatgtaacaaacctgcacatcctgcacatatacctctgaacttaaattaaaagttgaaggaaaaaaaagaacctctcatagtattttatattaaatattatattaaatacaatctaatcctttagtcccttagtattaatgagttctttgctacttttctttatttccccttctgccaaatatggtaataagagtaaaaagattataagaatttattaagaatttacaattcttatcctgaaaataactctatgaattacatatttagatatagccattttgcagatgcggaaagtgagtcataaagtggttcatatctttgttctaggctcatggctgcttgaagatatccaggaacttcttcattacatatgtgtcttctttaatggctgaattatgaacattataagtgttcattggtatagtaacttctacagtttgtgcatttcatagttaccatttttcctgtacaaaacataaactcacaatctttactacattctcagtttacactgatacagagctctgtaatggcaaaaagtatgtatctatagagatatgagaatttaaaaacattttaaaaaataatggaggagaattgctaaaaattgtcactacctagatttaatcactctttcagtttttattaatgagtaaggtggctaaaataaagctacaagcaagaccacctttggatatcaattaataaaactgtagctttcacatttttggttttagaacttagccttaaaccacttatatgattcctaagcaacaacagcatcttaaaagaagtcatctaatttctcctgtagctttaggcttctttggcccaggccatagaaacaaacagttctgtacttgtttaattatatattaatagctccttggaagttatgatttaatgtgttcttgcgaaagtcactaggaagccttttacagtaaatctatttcctggaaacccacatacacacttcagatttccttcctttgcttgatttttggttgcttggcaagcctaaatggatttgcctaatactttcttcctacatataattacctattttcttctcaattgattgcccacatgcagacaccccaggtgcttacaatgaccaaatctataactgtgatgttagcaaggtttctacctattttgagaaaagacattctaagtcagaatgagtattacccaaatatccattactgaaatatatggctataaatcaccaatgagatgattgattctatctgagtgttgggaagattagctctgctataaagacaaaatcacatacatcaaaggttatctcaaattagtaatttttgcaatagaccaaatcaatacagagtacgaaattgaaaaactgtaaatttaatttgccacaaatcactgtttcacagaatctcttaatgttttacctacagcatacaaagggataaatctgtttatcctctattctgtgcaaaaacaaacacaatccccaaactgaaaacattcttggcattaataatctataaaatctataaaatagatttattaaatgcattaactctttaaaatagctgaagtagccatattcatattttttatattaagattaataaaaaggaaaaaagtcaatttaaaaatattttcccaaacccagatatttcacaaaatatagtgaaaaatcaatatgttaatttggcagggtttttagacagaccttctccagttctgcttccttgagatttccttttcagacacatcagaggttccctctgtcctcagagattccttcataatcttccctacctcacaaatggcaccccaactaaaaaactgaacctcatccttgaaacaccaccatatattttaccaataaatggcatcaagatagctcaaatccatttacttttttctccttcctccaagtaacccctaactgatctctgctctcacttctgccctcttcaattcattcgcttcatagcagccagaatgaccttctaaaaattacatattttatcatgtgtcactcatgcttaaaatatcacaataatttcccattgcatttcaatataaacacaaatcttcaaatatggtgaacaaagctaagcatgatctggcccttgctcatctcagccatatcatttcatgtaattaattttcatattattagactcctagaagttatcaagatcttttcctacactatagccatcacactcacatgcctctacttctatctgggatgctctcgagaccccattctttacctggctaaatgtctgttttaatttatatttcaaagcttagcttaagtgacacttgcttacagaagtctcctttgacccactatttaattggcacccccttaacaatctgttacatttattcctagtacttttcccaatttatattataggtgttttccccaccaggctatcatctccttgagagcaagaactatctgaattttctttgtgaatctctattgtctggatctgtgccaggtacatactaaacaatacgtatttgttgaatcattgaaggactacattaatgtatatctagataactctgtattatatatacataattcaatccagttagctcagttggctacatttttgatgcttactatattgtacccatgtgctcaaggaaggtcagataaactatgcacatgttaagttttttttttcttttaaagttctggaatacatgtacagaatgtgcaggtttgttacatagatatacatgtaccatggtggtttgctgcacctatcaacccatcatctaggttttaagccccgtgtgcattagttatttgtcctaatgctatccctccccttccccacaaccccggaacaggccctggtgtgtaaagttcccctccctgtgtccatgtgttctcattgttcaactcccacgactgagaccatgtggtgtttggttttctgttactgcattagtttgctgaaaattttaaatcctctggaccattttgtctctcctagttatgacgaatcacatcttccactttgttccagtgaaatcatggctcaggctccattatagagctgagttcattttctgttgcattaaaggtagttgacttcaagtgcatctctcccatttaaactttctgaggacagagacgacatctcatttatcttcactccagggtgcataagagtttccactgtatgagttaaacattggtaggaattccctttacacatattgtaattcaaaaatgaagaattataaggtgccaagtgaagttaagaccacgaggtatcatcagagttagtgtaaaatccagtttaagtattcaacttactctgattcagcactagctgtgtttatggtactaggagagggatgaggaatttaaacaatgactaaaatagtttttctgtaaatcagtaagctttatatagagaaacaaatctccatcagtgacctctggacagcgacagtagaaagaagtatgactgactcagcataaccgcaacaggcccaatagtctcacctctctctacaggaatttcgcaagagcctgctttttagggatgcgaagttatttccaacagttatctggttctcctcatctcagtagaccaagctcacttgtaaccccatctcccatacactgtatactttaactgggttattgcctaggtataccaagttgattaatactcacttctccccatttccccattccaggtcccacagcaattactgccccactccgggctcaaggaagaaagcagttcagcatgaagtaaaccagctggagccccagtgtcaaaaataaagatctaaaatatgtgttcttggtaaaattaagttttagtcatctatagcctttaagtgctctggatgacctccagctgctcagctagaagaaggtctataaatgcatgatgttactttctttactgagtggttaaaattagtatttgtcttagggctatgctgaataattacagttaattgaattacagaaatagctacatataatatatatttttaatagaaataatgggtatggccattttgtttggctttaaagctccttgcaatatgattttagtaaatgtgagggttgaaagtctttcataccactagagactgtggcatgaaaatgcttcacttttttttctttttacccagatttagttctatgattttaacacatttgaatttgacccatgaggaatctctgaatattttcattacattaccaaacaattgttacaaagtttaaaaccatatgtagtaaataatagtacagataacatgcatatgtagctaattttgttggtcggtcagtttgtgccaggccttattctaaatactttttgtgaatcaactcatctaatcctcacaacatctctaggagcaagtactattcttatttgcactttgtagatgagaaaatatggcccagagaggttaagcaatttgctcaaggccaaacagctagtgagctgcagagccaaggtactaatctagaaactctgggctgtagagtctgcatcttaaccaccaggctctattgcttaccatgtgccagctattggctaaatgcttaatcctcataaaccctatggattgatgctaccattatgatccccatttaataatgagggagcaggcccaactaagatgactctgctagcaagtggttgaaccaggcttttaaactcagtcctgagatcttaaataccacccactactgcctcctagaagagatggtaggcttattttttcaatctcatatagcattagagattaaatagattttaaagaaatgagaaatgatttactcaaagagtacagtgattatttggtcaaaatcatctaaaatatttaaataatgttaagctaattattagattttttccaaaacattaaatactattaagttactacttaatgtcatcattctgaagaacagagttcaaagcattattcttaaaaattagtatgggccaggtacagtggctctcacctgtaatcccaacactttgggaggccaaagcaggaggattacttatgaccaggagttcaagaccagcctgggcaacaaagcaagggtctgtctctaccaaaaaacaaatacaataataataataataataataataataataataaccacatgcactagtgcatgcctgtagtcccagctatttgagaggctgagatgggaggatcacttgagcccaggagcttgaggcttcaatgagtcatgatcctgccactgcactctagcctgggcaacagagtgagaccctgccttaaaacaaaacaaaacaaaacaaaaaacaaacaaacaaaaattagggtggtaattcatctgtttctgcaactcctcagagtaactataataatctcaagagatacgagaacatttcaagaacataaattttaacttattttggctactgcaagcataaaatgtcatgtaatattgggtacaacacataagaatataaccaaactttaaacatatcacaacattataaaaatataattgttatattagtacagattattttaattattatttatattactattttgccaaatgagaggatttaccatttgtatctgaaaaattagtattaatatgctagctaagttatcatgacccagtaagattaaaaatttatagaaaaacatagatgactgttaatatttttgtttttaaggatgtttctacataaatctactctttccttcttatctgagttcatatttagagtactggtttcctttaccctttgtaaccactactgtaggattttaaatctcttggtaagcactgaatgtcagaggttaaagagttcatcatacgactatcgtggcataaacttcagtcagatggtttgtcactagtgtctgtgagtcatttatattttgattacctttagggcctttgaacagtttgatttccacaacggtctccaaaataggtcgtcttctacgcacatacagccgaacgatagaccctgcttccttcagggcttccaccgctttactgtgggaaacctctgacacatcaacctcattcacccgcaagatacaatcattgaccctgcaaggaaggaaaagagtcaagattcagaagtggctagcaggatttcttaaagaatattattatgtttatctgaccttaagaagtgggaaagtaaagaatctaaaaaattttaaaatatttaaatttggaaggatgcttcaaatgaaggaaatctaaaaaatgtcaaactactcaagcctcttagccttcttcctaaccacttttgaccatactactggtcagttcccatcctaaactccagtccactttgactgggactgcttacacatacggcatagttagaagggcatgtattttaaggcctctgtaagttacatcattattttaattggtttgactgaaagttacaatttgagtggttctcagaacttactaccatgaactatatagacataacaaatacaattatttacagactaattttctcaaatttttaatttactagttataaaagtaataagtaatcattttcaaatatctgaaaaatataaaaaggtagaagaaaaaatatacttgactcaatcatctaaaataaacctattaggttgggcgcagtggctcatgcctgtaatcccagcactttgggaggccaaggtggcaggatcacctgaggtcaggggttcgagaccagcctgaccaatatggtgaaaccccgtctctaccaaaaatacaaaaattagctgggcatggtggtgtgtgcctgtagttcagctacttgggaggctgagaaaagagaattgcttgaatcccgagggtggaggttgcagtgagccgagatcacgccactatactccagcctgggagacagagcgagactccatctcaaaaaaagaaaataataataataataaattaaataagtctgtcagctttctggcaaattatcttccagtgtttccccaccctcctctccacctcgattcatcttacaatattataaatactgaagttcagatttacaaagttcaaggagaacctcagataatcctgttcctaggtgcttactttgaaaactaagaaccacaacaaattctacatcaaactttcctctttttttttttttttcattttcacatggaaaggaataatttgacatttccataaacctttccaggtagtttaaagttatgtggccatcgactccaaatatattttattttcatgataataattagtgataacattaataatggttaagagcacggggcttgagattacaaaaatttctttccctcactctgtatatccattctagtgtccccaatctcagatcaccatgttgctcagagtcaaaaatgaggggcctcctttgcttgatgcttcttttcccccaccaccacgcagtcagttctacctgcaagtatagcctcagtccatctaggtttcttcatcttcattgctaccaccctggttgaaatcaacatcatctctcaggtgaaccacctccacaaacgccgacctagccttcttggattctctcttgttacctttcaatccattcactacacagtggccagcgtacagtgaacatggttggtttgcttactcaacttgcattccccacttcctccttccaaacagtgtcccgttttgttcaggggatctttccttagcaaatatttgttgaatgtgtgaaagaataagactaagttcaatgattgggccctccatttcctaagtttgtaaccatagttaatttccttagcctctctaagccttattatattctcatctgtaaattggatataatagtaatatctatcaggaagccttttggggaagattaaatgagataaagcacatataagcacttagtacatactctcttatgtaatgaacacctaataaatgtttgttattgataacagtgcaatatttgttgatttataatattctcaactattggatactccctataactttgtggaataaaacttattatctacattatagaaatgagaagacttccaagtgattaagtcctctgcttaaagctgtcagcaatttgagcagagattggatttgatttcaggtcttcctatttcaaaatttgagcttttctctcttaggaccacatacatctaatgtgatgaatagtttcatgtatgttgtgtatatcaattcaaaatgatgactacaatgataatattatatgaaaagtatgggaagaattttgtatctgtttttgtgcataacttttctatacctgtttagttataggaactcttgcctcagtaagaacacagagcagtctcaaaatcttgagatggaatatttcacttcctaagattcggcaatgtcatttcatcataacagatgctatggctttaatagacttacacatacatttcctctctgattgacaaaaaaaaaaaaaaaaaagggaaactaccaattaaaatagttttgagaatgtaggcatcatgggtgccagctgccctgcagcagctggtcctttgagagtgggtaattttgccatctcatgataatacaaaacataatgtttaccatcactctatgctcagaatactaattatatcttaaaacactgcttttcatagaagggagtggctgacatttaaaaaaaattctggaggctatatatatctattcaaactctatttttttccttttgtatacagtgggatccttaattgtcaattgctggtgtgagaaaatcatagcctaaatcagatgttcattcctgaatatgtggatcaagtaggcagctttaggactagcagtcaggaggcctggatttgagtctcagttcttcatcatctgtgggaccacggtgaggccactttatctttttgaacttcagtatcccataaaaggagagagactatgtccagagtcagtgagagcagtaactgtactgtatagtactgtgcaggagagtacccatagctgatgtgtggagatgtgtacattgtaacctaccatagatctgaaagttcttgctattgagtggatcaaagatgtgctcaagtatttgttcaaatgtgaacagaatggaaatttaaacttttaaaggacatactatgtgcaatatcagccagtcatttcacttatttgttcttacttaaacaatttataaagtatggatcccattttaaagacagtggaattttactgacaaggtcaaagtgttggtgaaaacagggacataatttcaacctgtttttactttttctagagcttctactgatacaaagatactcagacactcagagttgattgttttaatttttttttttaatggtggtgtttgtaggggaggtggggtagtttacattcaaattctcaaaatagagaggaaagtatgtcaggccaaactagggcagtcaacttcccttcctcccagaaacttgaaatagattttggctagagggtcatagctatttaaaattaatttgctctctttaccagtagataaactttgtgagtaaagccaccaactgtattcattttgaagcatgtaagtatataattagcttcaaagtcaaggaatactttgtcacagtaacaaatgcaggctttatcatatttctgagggacattgttttatgaagccgtgagttcaagaccagcctgggcatcaaaagcgatactccatctctaaaaaacaaaatgttgtttacatatacagacttactctccaatctcactctaccaatctaattaagttgacagtttcactcttagtacttgatgttatacacgtaagtctacagtattcatctgcagcaatttcaccttgtaaaccagaattgtctgtaatatccgcagattaattttaatattctttctagaatttcctttagaaattttggtgcattccttgccaaaaatattttagaaacaaaaaggatagtctatcggtagcccgtattcaaagagtcacatctaaattttgcactaaatcaagtattttctaaaatggtatagcatcactgaaaagtaaaacaatatttagtgagttatttgttctactttgacaatataatttaaagtaacaggtaatatctactctctcaaggtactaaatattttctgcagtgtggctattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactggattaagaaaatatggcacatatacaccatggaatactgtgcagccataaaaaatgatgagctcatgtcctttgtagggacatggatgaagctggaaaccatcaatctcagcaaactatcacaaggaccaaaaaccaaacactgcatgatctcactcataggtgggaattgaacaatgagaacacatggacacaggaaggggaacatcatacaccggggcctgttgtggggtggggggctgggggagggatagcattaggagatatacctaatgtaaatgatgagttaatgcatacagcacaccaacatagcacatgaatacatgtgtaacaaacctgcatgttgtgcacatgtaccctagaacttaaagtataataagaatatatatatataacaaaaaaatttttccgccattgaagtaagatttgtgattttacgcatttttaagtatgttaactcatttaaaatgatcatcaagtcatagtaagtgttaaaaatttaaaaattcccatgcattatgcataaaacacactgaagagaaagatagcgaagttttaatttgggtcctttgtgggtatggagattatgagcgctttaaaaagcacatttctacttttatgtttctttcaaatgttttatactggacatatatcacagcacagaacctaagaacatggcttgggaggcttggtcacagccagatagatctgggatctcaccacagctctaaaacttgggagctctgtgactacagacaagtcacttgacatctcaaagcctcagtttcttcatctgaaaatagggataatgagattgttattgactgattgttactgttattgagagaatgcatgtgaaatacatagcgtagtccctgaaaaacagtaagcatcaaaaatgttagctatcattacgaaaaagagacaagaagcatttgcataagagaatatataaagagactatagtgagggaaaaatactaaagggagaaaaagaaagagctacagtcaagatgctgaaagtgtttttaaaattttgtataagaaagggaggaagagaagaaaagaatgggattttcaggaagaaaaatataaaaatagagcttttacagcaaggtactggtacaaaaacagacacacagaccactggaacagaatagggaatctagaaataatgctgcacacctacagccatctgattttcaacaacattgacaaaaacaagcaatggggaaaggactccctattcaataaatggtgctgagataactggacagtcatatgcagaagattgcaattcgaccccttccttaaacaatctgtaaaaataatctcgagatgaattaaagacttaaatataaaacctaaacatataaaaaccctggaagataacctaggaaatattattttggacataggacctggcaaagatttcatgataaagatgccaaaagcaattacaacaaaaccaaaaattgacaaatgggacctaatcaaactaaagagcttctgcacagcaaaagaaactaccaacagagtaaacagacaacctacagaatggaagaaaatatttgcaagctactcattcaacaaaggtctaatatctagaatctataaggaacttaaatttacaaggaaaaaccaaataacaccattaaaaagtgcataaaggacatgaacagacacttttcaaaagaagacatagacatggccagcaagcatatgaaaaaatgctcaacattactaatcattagagaaatgcaaatcaaaaccacaatggggtaacatctcacaccaatctgaatgactattattaaaaaggcaaaaaataacagatgctggcaaggttgtgaagaaaagggaatgcttataattgttggtgggagtgtaaattagttcagccattgtgggaaggagtttggggatttctcaagaacttaaaacaaaattaccattcaacctagaaatccccttattgggtattatatccaaagcaatataaattattctaccattaagatatatgcacacatatgttcaacacagcaccattcacaatagcaaagatatagactcaatctaaatgcccatcaacagcagactggatttttaaaaatgtggtacatatatacaatggaatactatgcagccataaaagtaatgagatcatgtcctttacagcaacacagatggagctgcaggccattatcctaagcaatctaacacaggaacagaaaaccaaatactccatgatctcatttatgtaagtgggagctaaacttggagtacgtatggacacaaagaggggaacaacatttactgggtcctacttgagagtggaagttgggatgagggtgagcactgaaaaactagctatcaggtattatgcttattaccaggtttcagaataagctatacaccaaacccctacgacatgcaattcacctatataacaaacatgcacatgtacccccgaaactaaaggtttaaaaaaagaaaaaaataataaatgcatattcacctaaatattagagcttaaataagtcttgtttgatgaagtacaatgtaatttccttttcatatttcccttcccttgcccacagtaaaacttatagttgttttgatatacaaactttaccttttatggaagccttggttaaagattctgaccagcacacttaactcaaccacacctaactgcactcagacctcctcaagtttttattcaaaagtaggtgtttggggccgggagcgatggcttatgcctataatcccagcacttcgggaggctgagacgggtggatcacctgaggtcaggagttcgagaccagcctggccaacatgatgaaatcctgtctgtgctaaaaatacaaaaaattagccacgcatggtggcaggcgcctgtaatcccagctactaaggaggctgaggcaggagaatcgcttgaacctgggaggcagaggttgcagtgagccgagatcgtgccactgcactccagcctgggcaacaagggcaaaactccatctaaaaaaagaaaaaaagtaaaaaaaggtagatgttaggtcacagggtctgaaacaactttgcagcagctgttggttattgaagaatgtcccctaattaccttgcgctttactgtttctatcagtagtattctctttcttcaaataaatgaattaattacagaccaaagggccacatcatgaagaaagctgatcaatgtttaatgtgctgtatgaagtgtaaaaatgcatgatgaaattttaaaaaaccactagctaaggaattagactgcatgcacttaaagataacaatcaatcacttaaaaaactttcagtccctgtaatcccggtgctttgggaggccgaggtgggagtatcatgaggtcaggagttcgagaccagccagaccaacatggtgaaaccccatctctaccaaaaatacaaaaaattagccaggcatggtggcgggcctctgtaatcccagctacttgggaggctgaggcaggagaatcgcttgaacactggaggcgggggttgctgtgagccaagaccgcgccactgcactccatcctgggtaacagagcgagacaccatctccaaacaaaacaaaacaaaacaaaaatctcagaatctgttcaaaaggaataattccacacattttatgtcaattataatgaaaacagaagttatgaaaagggtcttgtttttcttctattcctgaagtcattaaaggtaggttatgaacaaataatagaagccaaaaccttattaagacaagtagtttatgctcacagagaggagaaaataatacaccccccaccacacacacacacacacacacacacacaaacacaggctgactcaaatgacttcaaatcataatggcctgccataatacatatacttaattatgtctgcctgttatctcactcttccttttatgaagtacatggaagtgttactggggatctttaaagtccatcaccagttaaggttctcccttgttgaaacttctcaccctaatgatctgtatatttcactgacctcattaggcattattagtttattaaaaataaaaaataaaagaataaaaatcagcataatttagcatttttccaagaaaggaagaggaatgttttagaggcatctgatatgggccaatgtagtaatatctatgaggcttttttttccagcaaacatccacatggttgtaggaggagtgacaagcttatatggcttaacctggttcacttgtcaagtctggccagtcctgcttttgggaatgtggaattgaaaccatgagactcagaggttctatgtgaccagaagaaatagaaacttgagagcttaatattagaggccattttcttccatgttgactataaaatttcaaaagactatctccaaaaagatggggaataaagtagatctataggaagaagtatgggcttcggacagaaggaggaattcctctaacacctgacagtgtctcagtccatggctattcttcccagcgcttaattgtccagtttgagaagatacttcaaatgtccttctaattaattctcccttttgagtaagtaagctggtgggtcttttacttgccaacaaatatttctgattaatacaggcagactttgtgaccaatactttacatgtgttatctcccttagctcattcctttttcccttttaaaacttaattcaagcttatctcatcttctaggatgccatctttggcccagttatttgctccagtgttcctccattaggtacttagtgaaaaatattaatggagttcccagacttagcaaataaaaatacaggacaatcagttgaatttcaatttcagataaacattagtaattattatttagataaacacatacattttagtataagtatgttccattgaaattaaaatttaactaggaattcaaatttataaaaatacagtatttataaaagcactcattatactgagtttatttgttttattcgaatagcattaatgcctggcacctagtgggaaaagtttgtattatatactatgttatatagtctttaatgtaaatagaaacactgaaaagtagatattgtcgccttcattccacagtagaaactaaagttgaaataggtttgtaatgacaggtaaatgatgtctaggaaatctcaaagttcatgccctataccatctacacttctctggtttgttaaaaatgattttgcgacttacttaaggacccactgtcagtcgggtccaggaccatactgtaaaccagtagagccaagccaagtaacaaaatctagatcaatctttctcacactttggggagggcttgttaaactatacattaccactgagcttccccctccagaggtgctgattcagtaggtctagagcaggagagaagagtcacatttctaacacgttcctaggtgatcctggtaatgctggactgagaccatactccaaaaaccactgctctaggttttgaagggtcattctacttggctcatgtatgattcattccaaaataaacagaaatactcaatcttatgtagacccaactgagtatgtgataaaagtcctgagctctgactccaaacccaacccctctatttgcagcttttcattatttggaacaaagcctctaagggaacctggaccaggagaccacagctgccataatgtgtaaggctgtggacatgcaaaccattttccagcactcattttctacctgaaactcttttactgactcccttccttcagctaagaccaactgatagcctcttcattccacatttaaaaaatagggcttctgctctcgtctctaactctgaatgagagtaactcgggtttatgatccatagaagccatctcctacagtgaatgtactgtttttcccctctatttgccacttcatttcccttctataaaatgcttgcaggactctctgcagctgtcatctgggaagcatcacagctttccacaatggggacagaaattgctatttcagcatcagtgattggtcttttggcactttcctggaaaagcagaggccagtaacaaatttcaagctaggctacttaatgggtacaacatggaaaagagacattgaatagaaattccaaagtgagagggtcatgggactggagattacttagcccgctcagttcaatactgtgtccactgacaggactgcttgtcaactttcaagagatgaggtgctggtacctaccacctggattactacagtagcttcctagctagttttcctgatgccaggctaattagcccctctccatttcattcaaacacacaaaaccaggttcaacttcctaaggcaacccttttatcatttcatttcccctctaaattcaagagatttgtaacatatataaaattaaaactgtggttaatctttgtattaccagtgtcaggtacacagttgtcacataagaaaaaattagcatcattgtatgacttctaaaccaaccccctttttatacctcttactgcctgctccagccaggacactatattttgtttcatgttgctttctgtctctcaaacgttcaaccaaagctagcatcattcaaaggcaagttcacactccatagcccatgaaatgtttccaaatcactcaaggctttattgtccataatgtcccaattgcaaatacatggcagattctcatcaagaagctatagatttatttgttacctgcatagaacctaaaatagtgagtactacacattaagaaatacatttaacaatgctggatttgatttcctattttcctctactcaaatctactccaatcccagaaatagatgtagatcaacatatatggaattcataattgtacattttctcagtcaagttcaatttggcattaaattgatgaacatttcagtgaaaagttgagaacaacaaggagcatggcatggtgggaagaacactgggttataagctagatatgaattctaatcctgggtttctgccactttccagttcaagtcaattttttttctctgtgtgtttgagtacagtgatcttaaaattctcttctagctctggtgttctataaacctaaattcaaggtcaacccagcctggcacctatctttacttggaagttgacagtacatctcaaatggagcagagtctgaaattaatcttatctcttccccatagacaaccctttacttcacttttaattctccatcaagacaaataatttcatcaccagaaagggaggagtgttccttcttttttagccacacatccaatctatcacattttaacatatttttattttaaaatttttcatttttagttaattaattactttgtatttatttattgtttttgagaagggtctcattctgttgccccagctgtagtgcagtggcacaatcacgacgcactgaaacctctgccttccaggctcaagctgcctcctacctcagcctcccatgtggttggaactacgagtgcacaccatcacactggctttttttttatttttattttttgtatttcttgtagagatggggttttgccatgttgcccaggctggtcacaaactcctgagctcaagtgatccacccacctcagcctcccaaagtgctgggattacaggcgcgagctaccatgcctggcctgaacctttttatttttaaagatgggggtcttgctctgtggcccaggttgaagttcagtggcaggatcatagctcagcgcagccttgaactcctgggctcaattatcctcctgcctcagcctcctgagtatatccttttcttttactctcatttattctacctaattctagcccttattgtcaatcacctagattctggggaaaaaagttgtaactagtcttcttgcctccagctttttcccctctattccatcttccaacttattgccagaatggtgttattgaaatataagcctgaatgttttatcccatatttaatggtcctcaattgctctccattgtctacatttaaaaaatccaagcaaagaagccctttattaaaatgaaatcttacttagaagtcacacaatggatatttataattatttatatataacaaatagagggagaatttctgtgatttctgcagcatagaggaaaagagaatcagagccgagcctgctgcctcattcgtgacccttcagagggctctgaggaatccagtcagggtgctatatatgactgagcagaagctagtgagtgcagaaagaaatccaggcaaaaccctttctctaagccaagtgccttggcactgagctgtctctgctgaagggagtgtctaatgcacataaaggcttcttatgagttttctaattcacataaaaacttcttatgagctactggtagcactgatcacagggttctgtggaacataaattgaatccacctgcctttttggataaagccaaagtaccttcacataacacccaagtctttccacaatctgattgctattcacttccccagccctgtctcttgctatataagtagtttcttcaaacattatgcaagttcattggtcaggcctcttcctctgcctgaattagccacctccagacccgggttgtctgttaagtacctttaaagacaaatgcatatcctgaagtagcttcacagtttagcaagagagataggaaaaatgctattaaaattcaatataagtgctatggcaagagaaatacagggtaatgcaggagtacataacaggagaaccttatttggtttttgggggccaaggaaaacttggagcaactgaggcagctgagacctgaaggccaaatagaagttagccaagtgaataaagataggaagaagtgtttcaggcacagtttagtggctgatgaggtaaggagcacagatcaagtcttgaaggtcttggtacgacatgttaaataatttggacttgaacttaaaggcactggaaagccattgtactgcttatagctagaataatgttttagaataattctccaggtacaatgtggagatgtggacttgattagatttggtaggtggagttaaggtagaagaaagcaagaattgttgttagaggctgctatataaccctgataaaagatataatagcctgcactaagccagtggcagtcaggataaagagaaggggacagacatggagggctgattagaatctaatagatgtgctgatggattgtatgtgggtagtgaggaaaggaagaaaatgttttgtttaaatgtctgtcttcacttataaatcataagttttgatttgtggtttatgacttgagggataaaatcatttgtcattcatttttgtatttttagtgcctcacagggtagaacagagttggcacagaatatatatttggcaaatagagtgaatgaattttataagtggggaagttagtcaatgacatctttgctgccagtatccacaccttttcctcatcctttccagtgactttgtcccataagaatgctgtcttctcatctcatctctttcctcctggtataaaaagaatgaattcaaatttaatcaccctaacaaacaagctatcattcataggcatattagcattaagaaaaaaaaaaagaactccagtgatagggcaaggcctaaacaaacacaattgatcaccaataataagacctcaaatataagttgagagatatatgtaatccgcacatacatacattcaaccaacatatattgaagacctgccacagagtaccaggtattgtataggcactgaggacacagttgccaacgagaaagatactggcccttgacctaggggatgaagaggtggggatttacaaattcacatcacagggtcagaagcttatgtcacttacatacaaagctagttctacttaagcacatcttttaaactttagcggttaggctttaaattaaagttcttgtttattattctcatgattattttaattctcagagcttaatttccatagaaacaggaaaattaaaccgtaagtctgaactcaagtataccatgtggcaaactgtaatgttgcttcttattttgaactgttcttcatttaccatgactataacaggtgtgtcataagccccccacccaacctccaggaagtgtggagcatcttaaaagccaaccaacatatacgtacgcagggaaaatacatataatttcattgtatgtaattgcagcagtttatgagatgtataaaatatttaagagaaaacatttggcatcttttaaaattcttgtaaatatcaaatctcatgttgttatagagaatatcaaatctcattacctgttacagggaagtaattttcagcatttgtatagttcaacaacaaatgagatacttgtattacttaaatttatttgttttcttatttattatatttccctgcactagaatataagccctatgacagaagaaatcttgcctctaattttccatcaccagtggccagctcaactcctcacaaaagacaccatcatacattcagtttttttgttatcttttatttccttcaccctctacatccaatccattaacaagatttttaatttccttcaccctctacatccaatccattaacaagatcagtagcttctagctacaatatctatcccagtccatcaacttttctccatctctacgactatcacccttgcccaagccactaccaaccacttctacccaaacatgttggctcacgggttccactcctgttttctttaatatattctctagacggaaaccagagtttctaatttttttttttttttttgaggtggagtcttgctctgtcgcccaggctggagtgcagtggcgtgatctcggctcactgcaacctccgcctcccgggttcacgccattctcctgcctcagcctcccaagtagctgggactataggcgccggccaccacgcccggctaattttttgtatttttagtacagacggggtttcaccatgttagccaggatggtctcgatctcctgacctcgtgatctgcccacctcggcctcccaaagtgttgggattacaggcttgagccaccgcgcccggcccacagtttctaatttttaaatttaaatcagataatatcaatcatcccttacttaagacctacgagctcttcctatgtaatttaaattaaaacccaaagcccttacctgccttacaaagtttgagctcctatttattcttgtgctctcatcttctaccactgtcccctagctctgtctcctagcatcgtctaccattgtgccctacatacctagctcactcctgccttagggtacttgtacttattgtttccccagctttgaaagtcttttccctcatgtttttggctagctcctatttgtcattaagatcttaccttaaatatcacctcctcagaaaggcctaacttgattatttaatctaaagttgccaccaggcattcatcactatatcactctgcttcattttctgcatagcatttattaccatatgatattttgtgtagttgtttattttctgtccaacagacagaaaatatatttgtatatttgtttatcttctgcccacctttcttagagtaggagccttgtctgtctggttgaccattttatcattaatgcctaggacagtgctgagctcctaacaggcactaagcaaagagttgaataaaaaatgaattattcaatgaaggaatgagtgaatgaataatagttcttcctagttaagattgggttggtcagtaataaaatatatgcaattttgctgcccaaatttgaattctgatagctctagcttgaagaacttcttaaatttatacctataattattggaattatttagtactgccaaaggttgtgagcaattctctatgcaacagataatgctagattgcctggaggtgctaattttctagggtagatgattagtgatgctgttttctgacctttcctgagctacaataatcagctattactgtttatgtaatttcacagtacttatactcctcatctcttcctagggtaaatcatatttcatgaaataaattcaaattaatttgtgatgaaaaactcatgacacattttgagattattggtgacattttatgatttcataaaaccagagccggaactccctgacttaatggttgaactggtatttgcaaatggtatgcttaatctattacacttgttctcatttgtggaggcaaaactcagagcctgaggatggtggcataaaggattaagggcaacaagaagggcccctttgctcacaaatatattcttgctttccagaaacctggtttcatttgaattcatcaatttttccttttgaaacacaaagaaacccactggtgtcagtcattcatatttgatttataactttatgtagactgtatgacttcagtttgaagcatggtagactaggtgagtctatgagggacacttacatgaaggaacatattaaaggaggccataggcatgagggaagcagaagagagaagcttctccagaagagaaaggagatcagacagaaagccaaacatgaaatcacacatcttcctaggacacctgtgacaacagctgcaggaggctctggtaataacttctgtctatctagcgctcactatttacaaaacacttcaacaatatcttctgtttcattgttaaaatcaagacctacgccacgcgattattgctacattttcaagtgaaaaaaacctgaggatttgataagttaagcaacttactcaaattcacacagcagataacagaaacaaaaattagtctaatggcttctggtcttgttcacttcccacttataactcctatctatgctattgtcactagtccttctgttgcagttgtctggcaaaaccccaaccctgactgaacccaaccctccaccttcttcactgccccttccagaagttagtggagaaaatcctcaaatgatggaagtcactatgatctccaaatgtaacaccacacttcgccctgctcagcttgctgtccctctttctaaaaagataaactccaatgttctcctttcctgcatcacttccagaaaatatgtttgctaataattccaagagaaaaacaaagccatgtgatgtgaagtctctcaaattattatgccagatttctatactttactgcatgcaaacccaccgtctcctttctattcctattacagtggagcaagtgttccctctgataccaaaagtccatcaattcatgtctttttaaagatctcaccagatcatttaatctctctatattctgcatcttcaaacccagcctctacttaagtcatctctgaatattcaaacatgttctagtatctcttagtttttaaaatgttgtcttgacctggcatctccccttggctactgtcctatctccttcctctttaccagtcaagcttatcagaagatctgtttatacacactctctctattttctacttcttccttcccaaactctctttatctcattctagtctgagtttcctcacaaagcccctaccaagaaaaagagaaatggtcctactaaattcaccagtaatcttgattttgccaaatctaatgagatctcgttagttctcattttggtccatctcacaacagtgggaagcccagtggctcattccttccttgaaacactcttctgcattctgtgcctctcctgcttttcttctgaccatgctggccattccttttgtacatctctattttaattcttcctcaacctattaatcttcatacttaaaaaacaaaaacaaggaaaacaaaaacaactatgtgctatttttgcatgttttaggctgacaattgttataaatttaaatagtagcaaaggatatcatttctgacctactgtgaattgtaaaattttatttttttcacaattacatcactatttcaaatgtatcccatgggatataagtacatactgatttgaagtccacgctcacaatttaaaatattaataaacaatatcttcttgagcagttaaaaaatcacacttttctttctccttgaacttatgtttccattctacttttaccatgggaagttttacttcaatatatcactatgttagaacattttctattgatcaccctagcatacttatataaaacaaaaacacatgtacaaatataaatctgatgatttttccctcaaattttctgtgaccataagattccaaacaataaaaataattttctagactgggttttatgattattagtgttatgcaatttatcaaaatcactaaaatatattatgaaattcaacatataaacctaaaacaataaagatgaaattgtattggggattcttttcttagtagattgagtagtgtttttcaaaatcagtccatgtttccatagattaatatgaattaaagttaagagtaagacaagattcagaattccttttttcatttctgtatatgtaagtgatcagaaatcttgttcatataaacaggtagatgggaatgggaagaaaactgaattccttccaagttatatgctctgaatcctgtgacctataattaaaattactttaataatctatcagttgactgttgcttttcaattttattaaaagcaaagaattggaaaccacatgatttaacaaaatgattagttacctaatcattagagtcaccgactttctcatgccaggcaacagtatttcagattgtttctttatatctaggacaatgaatcatagcagaatttaggacggttaagacatatactttatttttttaaatgtgaaaataccaattaaatggaaaagtgaaaaagaagaaccatcataaagctgcaggcttcttcttgggcaggtcaattgaagatctggatattaagtgacataaatccacctatgtactcctagaggtacaccttactcaatttagaaagctctgctctaacctacattaaaagtctgaaatatctcaggactaagtcctagcttctcttttctttttattccatactttttcaaggcaatctcttaattcacttggttttaaaggttcccaatgacattcccagtcagatctctcagagttccatatccacgttcaactgcctatttgatatctccatttgcttttgttgtaggcatcttaaattaacattgtccaaaatggaactattcaacatattttccaactttacctctccaccattcctttccaattgtcatcctcaaagtcattctttaataattctattagatggtgaactctttgaaaacaagggtattatatactcagcacctgatatggggcccaggacaaagaggacacagatgatttatttgaaggaataccacttccctttgcatcccattccaattaatcattaagatttataaagtttatccccagtatatttcaaaatatgtctatttctctcaatctttttgccaacaccttagttcaagttacaatctttcattagctgaattactataatagcttctatttttggtttgtttttttttttgtttttctttttgagatggagtcttgctctgtcacccaggctggagtgcagtggcacaatcttggctcactgcaacctctgcctcctgggttccagcaattctcatgcttcagcctcccaagtagctgggattataggcacctgctgccatgcccagctaatttttgtatttttagtagatgggggtttctccattttggctaggctggtcttgaacttctgacctcaggtgatccacccacctcagcctcccaaagtgttgggattacaggcatgagccaccgtgtccagccctacaacagcttcttagactgctataactgcaggcactcttatcagctaagccagacttccatggcagagtgatttttatagataacaatttagttttgtcatttcccacattgaaacattccaggtctcatgttctttcaaaaggataaagaataaattacttactatagcacccaaggctctctctccctgatttctcatggccacctctccaccttcaccttgtgccagtctgcactctcccaccacctccagtcaccttccctattcctcctcaggcctttgggcatgcattctctgcctgaagactcctccagctccattcacttgggtaacagttaccctttatgtctcagcttaaatattaactctctacaaggcttcccctgagtatcttaggctagattaggtcatgccattacagcctttcacagcactacgtcctttacattcatagaactccttttaactctcaacttaggttgattaccgtgttgggttgagaggtccatggtggcaaagatcctgattttcttgttcccttctctattcccagctccagatgtctgaagcacaacagaatactcaagaaatatttatagggccaataaataacaacagtttgggagtaaaataaaatattctgtgtcagtttaataaacacttgttttatcccttatgcttattatatcacttaatttcccaatgacagtgaatcagcttactcaagatctatctcaccacaatgaaaaccctgaaactaccttccctcactccccacatacaaaacagtgacatagctcatattcttttctaagtcaggtttgcaagtttgatgctgcactctgaatgctagagaagtgagaatgcagaggtgatgagtttatggcacataaagcatactctcacataaggcacaatcaatcattatgggatgcttttgaacaaaggtctaaaatacatgttacattattattatgatgatgtatattattatgtatacctggactaatgactatcaaatagattgtgttttaataattttattcaacatgcagataaacaggggaaacagctaataattcatttttcaattcattgttttctgaaagaaagcattgctttgggctgggcacagtggcttacacataaaatcccagacctttgggaagctgaggtgggtggatcacctgaggtctggagttccagaccagcctggccaacaaggtgaaaccccatctctactaaaaacacaaaaattagctgggcgtggtggcggacacctgtaatcccagcttctcaggaggctgaggcaggagactcacttgaacccacgaggcagaggttgcagtgagccgagatcgcaccattgcactccaacctgcacgacaagagcaaaactctgtctcaaaaaaaaaaaaaaaggcatttttgcttcttttttttcaaatggtctacattcctctgttaatttacaactaaatcagactataatatttaaaggagttaacaaacgataggagaagacagaaaattataccaacactttaattattagcagtatattgtggattatatcttgtggctctgatgtctgtgttgtaaataacaggcacatttgcataatcaaaaatgatttgggccaaattcaggtaacatgagtcttcacaggccaattctaggtcactgtgcgaaggatgatttatacattgtcttagctcaaaatgttagaataatactgatattgagtgttacaacctctccagaagctggttttaattaataaacactattattattaattcaatcagacaaatgttaaaaaatacttcaggtctataatttacaaagaaaaaagaaaaaaaaaagtaacaaggaatactggagccagttaatttcaaacccagaaatatgtaagtaacaacaaatccccacactgtgtccaagtgttctcattgttaaattccctcctatgagtgagaacatatggtgtttggttttgtgtccttgtgatagtttgctcagaaagatggtttcatccatgtccctacaaaggacatgaactcatccttttatgtagctgcatagtattccatggtgtgtatttgccacattttcttaatccagtctatcactgatggacatttgggttgcttccaagtctttgctattgtgaatagtgccgcaataaacatacgtgtgcatgtgtctttatagtagcatgatttataatcctttgggtatatacccagtaatgggatcgctgggtcaaatggtatttctagttctagttccctgaggaatcaccacattgtcttccacaatggttgaactagtttacactgccaccaacagtgtatgtaaaagctttcctatttctccatatgctctccagcacctgttgtttcctgactttttaatgatctcctttctaactggtgtgagatggtatctcactgtggttttgatttgcatttctctgatgaccagtgatgatgagcattttttcatgtgtctgttggctgcataaatgtcttgaactttcatcctgcctttttcatttaataccataacacagtcattttattttaaaatactttgtaaattctggcagaaactctacaagccaaaatttacaaaatatttttaaagtacaatgcctgtgttatggtattaaatgaaaaaggcaggataaaagttcaactgtttgaaaatatgcactgaatatgaaggagtataataaatagaggcttttagtgataaggttgtgaatgattctaatttactttgaaatgtccgtatttttcaaattttctatgaggtacatccattactttataatcagagaaatacattatcttcaaaaacaagattacttaatctttttcactatctttttagatgggtttgtgaagtgactaaaacaccaatccacactgatcagtcatttcctgaagagctaaaagaatatgggtgtcactttgatgtatttgtgcttttaatttttaatactatgacatgagatgttggcagggctttgtgttcatagattcttaaatatatgttcagttatttatctgcagataattgcaattgcagccatgtgctgtagtgagaagaatatggattttggagtcaaacagactgagtatgaattttgtctcagacacctgtaaataactgaacctctttacacctccataggcttctggaaaaaaatttaatgaatggtagctatcattagttctaagtgtctgctgtgggtgagagacatgctagatgttatagaaaatagaatagtaaatgaataacatgggatagaagacatatagaatggtggtatattaaggagacttagagattgccatgtttcttctcttcagatttagctatcaagaaaataactaagtcagttgctgggtatggtggctcacacctgtaatcccagcacttttggaggccaaggcgggtagatcacctgaggtcaggagttcaagaccagcctggctaacatggtaaaaccccatctctattgaaaatacaaaaattagctgggcatggtggcaggcacctgtaatcccagctactcgggaggctgaggcaggagaatcgcttgaacccaggaggtggagattccagtgagctgagatcatgccactgcactccagcctgggcaacagagcaagactccatcttggaaaataaaaaagaaagaaaataacagtcatctaatgtaaataaatgtggtatcattaagacaaaggaaagattgctctattaatctgggatgaaagccacaactaccaccacaaaacctaatatgagaaactaaaagccaagaactctaccagtcacagtcttattgtttgaatgtgtcccccaaaagttcatgtgttggaaatttaattcccaatgcaacagtgttgggaggtcaggcctaataacaggtgattgggtcattcgggcagagtcctcataaatggattaatattatcatgacagtggttagttatttagagagaaggtggttataaagcaagtctggcctatagtatctctctctgtattgtgtacttgatcctgcttctgccctgccctttcaccaagggatggcctttgtcagatgctggtaccatgctcttggacttgccagcctccagaaccatgagcctaagaaacttcttttctttataaattacccagtctgtagtatcctgttacagtaaccaaaaatgaatatctatttattttatttatttctgttatatagtaacagaaagagaatacctatttattttatttttactgtgccttaaaactaaataaatatagttagcatttaagtgatcacttcatggaaagtctacaagatcccagagaggctttactctcattcaccccaacagacataatcaggaattccttgaccagagggccgcagttcactccagtagatatgtgaacctttctccacagttcatacctctaagggttgacagtgccagctttatgaataaccctaggctcaaaagtgaccaaagggcaactatttgaagaaaaagtaggtggagtttaggtgtacaagttgtagtattgtaggcatgcactcagggctctcatgaggtaagaaggagctggggctagaaaacgaaatgcataaactgggggctggggactgctgtcgctgtgctggaatttcctggtgtagaaatttgagaattctaaaaagtttatattctaacttggttttccagcgttagcttcctctgagaaaccaaaatgtaatgtgttcctttggaatggaagtagggatagtggtgggggagagggaagggtattttgtgaataaaggttgcctggctcagaatgggtggtatgggagaaaccgctctcagaagatatgcaagattttgttctactgttgccacagtttctgaaaatgtctgggtgggcctggtgcttaccattttataagctcaatgaatattaagtagtgacaaagattctctccttgaccaaactttagtcaggctcctctaagctctcttctcaactgggctttgaccttgggtttcagtgtctgtccttctcaggcctgtacttctcagttttagtaggaattctgttaacttaccttttttgttaatttattctattgatacataatgattgtacattttctgggatatagtttaaagagaatccctcaccattgatatctgatcactctggcccactttcagtaagttcaattgatcaagaatgcccccttactcttgatgtttcctcctagtaattttctgtccactgatctccaccctgctccttggctgtaaatccccatttgttcatattgtatctgaaattgagcttatttttatagtgaggtctcttttcctctactgcaacagtccctgaataaaatctgtttctaccaatttaactactgcccagctttgattttctgtgacagtagctctaacatctttatgatttggtcatttaattgttaagctaatttgaagtggcttgatgcttgtgcaaagcttaccacattattagacctttctaaataatgacacaatttataaactgctcagaaaaaccaattcttgaaaatatttaagattaccattgaattcaatttcagcaaataatttaaatatatttttctacctccctcaaaccattttcttttgtctagagcccaaagagctatttgctaaaatcaatataaaatttggtttcagaatgttagaatgacaacatgtgtctggagagactattagaaataaataaaaacaaatgccttatcaccacttaaagctgcaatcagctctttggtatatgaatctaatgagcagtggatcttctcagagctctgagtttaactgaaacaaagcattgatttcctggccatgataatagcattctgaacttctcaggctgtcaacaaatgtcagataattagaatatgattttaaaatggaaaattccccaagatcctgtataggactcatagctagttagtggcagagattcctatgtctcctgccttcactagagcagtacatcttgttaacttttagtctgggctggaagtttagatataaacctacaaataattccagaaattgcaccctatacacaaagcagtggcgatgcttaaatcagaatatttagaatcccataaagccaatcttaagggatatgaatcatcacatctatgtctcagcaatcctgttgttcctctgtgaggaatcaatatatcattctttcttttcttgattatatttggaaaattggaccttataaaacacaacctgaattaatcccctaaattgtaaagcatatcaataatttggttttgacttttgaaaacagaaatgctatttatcagataatttttatacaatgttgatgttttagcagctggaatacagggtcaaatacctgtttagaaaatgtgagcaccttgtgatatttgcttgtttaaagattacttacaccatacagacatggagccccaaacaaatggtactctctacttggttagatttaagaacaaatcaaagatcttctttaacagattcaagaacttggtgaatgaattcaaaaactttaaataaattgtatctttaaatgaacaacaatatgaagaagttgtgagctttctgaaactaggaaaaaaatttcttagatttgtaaatggggatatttatgcccaaaaagaatgacagggcacttttaaagtaatatctttattgagatataattcacatactttaaaatttgcccttttaaagtgcataattcagtgtttttttagtacagtcacagagttgtccaattgccctatgtaattttaaacattttctttctttctgttttttctttttctttctttcttttttttttttttttgagacaaggtgttgctctgccaccctgactggagtgtagtagtgcaatcatggctcactgcagccttaacctcctgggctcaagcgatcctcccaccttagcctcccaagtagctgaggctacaggcatgcaccaccacacctggctaatttttgtattttttgcagagatgaggtttcaccatgttgtagaggctggcctccaactcctgtgctcaagcaatctgcccgccttagcctcccaaggtgctgggactgcagacataagtcatggtgcccagcctagaacattttcatcacccccaaaagaaatcttatatctattactagcccctggcaaccactaatctaccttctatttgcatggatttccctattctagaaatttcgtgtaaataaaattgtataatatgtggccttttttgtctggcttctttcacttagcatgttttcaagtttcattaatgttgtgccatctgtcagtactttattcctttttcagctaatagtatcccatttttgaatataacacaatttatccattcacccatcaatggacatttgggttgtttccagtttttggctgttatgcataatggtgctatgaaccttagtgtacaagtttttgtgtagacatatgttttcagttctcttgggtatatgctaggagtagaatgactggtcgtgtggcaattctatttttagctgttagatggactgccagactgttttctaaagtagctgcaccattttacaatcccaccaggcatgctgagggttctgattctctacatccttgccaacacttatactgtccatcttttttattatagccattcttgtgggtataaagtggtatctccctgtacttttgatttgctgttcaccaatgaataatgatgctggacatctttttatgtgctcattggccatttgcatatcttatttgaataaatatatattcaaatttgtggtaggctgaataatgcccctcacctcaagaaatttatgtcccaatgcctggaacctgtgaatatgttactttatatggcacaaaagacctttcagatgtaattcagttaaggatcttgagatgaggtgactttcttggattatcctggggtgtccaatataatcacaggagtccttataaagaagagttagtagagtcatagtcaatgaagagataggatgatggaagtaaaggttggatggagaaaagggttatgagccaagtgattcagatggccttttgaagttgggaaaaggaaaagaaacaaattatcccatatagtctctggggttcccctgtcaacattccaagtttatctcagtgagtctgattttggacttctgacgtccagaactataggataataaattcgcattattttaagtcactaagtttgtagtaatgtgttacagcagcaatagaaaataatacgaaatgattgatcatttttaaattgggttatcttcttattgttgagttgtaggagttttattacacattccggatacaagtcgtttatcaggtatattatttgcaagtattttctctcattatgtgggttatcttttaacttcttgatagtgtcctttgaaagcacaaagtttttaattgacgaactccaagttatctattttttctttgttgctcatgctttttgtgtcatataaagaaaccacttcctaaaccaagatcataaagatttactcctacattttcttctaagacttttatagttctagttcttacatgtaggtctatgatcccatttaattaatatttgtctacagtgtgagatgggagccaattacattcttatgcaggtatatatccagaagtcttgatagaatttgctagagaaaaaaaaaaaaacaaaaatccaacgagtcatgtttgccacaaagttattaatatttcggtcaactcataggtggatttcctttattggaatatatggcagttgacagaaataggaaaactccagctgcgaaagactacttgtgggtgcctgatgttctaccagatgtgcagctgaaattattcttcttgtatagaaattttcttgtgtaacataatactaaattgttggggacttgtcgattgccagtcaccacagaaccacttgctaggtgattttcttcttgtccaagtactctataaatacaattagggctgatattatggacagagaaaatcaaaagagagggttgttacccttcaatacttttcacttttgttgggagagatggaaaaaataatccttaagaatgagtccattgagatttgcatcatacatctttctaaagagagcgctggtatcatttatactaggtaataaagtctcccttctcatgaaggtcttcctgttcagagcaacagctgggcttgtatcctgctttgacccccaaaacaatgatgaaataaatgtttacttggatttggaagcactagaagtctctgcctttgaataaaacatttaccatgatcatagtcatttagtgcaacaatcagttggggtacagtggaaattgacaggttggatgttgtgacttgtggggtttttttatttgcaatcacccaaactcatgacagttcagtatggagaggtactctaagaatttagcaatctcttatgctatttccacttcctagaaatctttcattttcttaaacaattggtaagtgggtcttgggaataagtgtcagactgtgatgcctggaagttactccctttcctctgtttggtgcttctcatttgcacagaaaacaaaaaacaaacaaaaaaaccaagctgagctttatcttttccatttctaagccttcatctcgtgatgattaccaatcatttttcttccttcttttcctcccctctctgtgtttccttttcctcccctccccttctgtctttctcatcgtgttcttattttaaaatcatcactgagttagtggatatacattaatgaaaaagcaaaaaaatgaattgacaaaggacagccaaaggacaacgttgttgtttatacacaagaactgcattcttgaaacattcgtccttgacctctcaactttgtcagtacagtcaaacctcagtataatcattattcttgtttgaaataaacatgtatgttgtcttggtttttatgaggacaaagacaaccttacctgtaaacagacacagaagtaataaatgaagcaatggatttaaagaaaagaaaacttctttttttttatatcttgtctgggagtagaaatgattatgctgaaggctaagagattaaattgtgtcacttgtcaggaaattggcaagcagccatcttttctgcctgtttctacatggtgcttttgtgctgtggatgcctttaataaacgcactcttgtgtaaaatgtcattgctgcattgccaagtggaggctgtcatgtgatagctcttccccatgatgacatatcaatattggtccctggcaattctaggacttcaaactacacagagggcatttttataattcaaatacaagtgaagaaataaaaatcattcttcatatcatggatgtatatctattttgctctgaaagaaaacctaatgttcttttcaaatactgcttaaagataggtaacgctggccaggcgcggtggctcacgcctgtaatcctagcactttgggaggccgaggcaggtagattgcctgaggtcaggagttcaagaccagcctggccaacatggtgaaaccccgtctctactaaaaatgcaaaaattagctgggcgtggtagcaggcgcctgtaatcccagctactcacgaggctgaggcaggagaatcgcttgaacccaggaggcggaggttgcagtgagccaagatcgcaccattgcactccagcctgggtgacaagagtgagatttcatctcaaaaaaaaaaaaaaaaaaaaaagatagataatgctatcaaattttaatgactactctagaagacaaaacacaaatgacgagtaacattttttaaaagtttcatcttactcttaatcaagtaaatgcaaagcaaagcagggaaatataccattgtttgccttggacatacgtgtatgccaaaattacatatgtgaaaccacatgcaacactgacaacatattgcaaagtaggacctctccaacattgttggtaaaagtaaaatttggtagaatatttctggaaagaaatttggtaacatgcatcaaaaggttttaaaatgttcattctatcaggttcagaaattctatagtagaaatatatactaaggaaataatgaggtacaaggttaataatgttttccaaaagatgtccatatatttaaaatgctcataaactgaaaataaattccaaacaatgtgaatggctaaatatgctactttatagcaattaaattatttgcaaaggcttttttactgatacagggaaaggtctctgaactaaggttaagcgaagttaaacaaaaattaaatatcatatagagtatgatctaaactaagtttaaaaggcaaaaaatatcagaaagacatgtacaaaaatgttactagtgattagctttgtgtagtgcaaaaatgaaagtgctgtgttttgcttagtctttgtctactcttctttattttatatttattacacaaaggacaaatatcacggccataaacacacatacccgaaaagttctatttaaaaagaagttctatcagaaaatggtcactgttcagagaaattcatctaaaccgccatgtgctcttcttgccttgcctcttgacttagccctcatctcacattttccctgcagtttctggctgtctccctcactccagctcagattcacatctccagccagtagagggaaaacaggtctcagtctccatctctgctgtccctccacccgagggactagattcctcccttttactggcgtgggtccacctcttgcttttgattgattgtgctttggcctcttgcctttaggtattagaaagtcccaagtccaatcatgaggcctgatcagtgtttctgaagttttgggtgtgacagtattaccggagacctgcaacagcaagctactctgcagcccagtttaagggaattttagggtccagaatttatatgtctatattagtttcttgttgttacatgacaatttaccacaaattaatcagtttaagacaacatatacttattatctcagaatttcagcaggtcaggaatctagacgtgactcagaggagtcctctactttggtatcacgaggctgcatgcactgatgtgtcagctggactgtattcattttgggaacttggggttctcttataagctcatgtagcaatctgcagaaatcaattccttgtgactgtatgtctgatgtcttctatcttgctagctgtagcctggggacttacttagtacgtaaaggatgccttcaggtccttactacacagccccccataggttctttaacaacatggaagtttgcttcatccatgccagtaagagaatctctctgtttttaaaagtctcattacatgggtcagtctgaatcaggataatctccattttgattaaatcaaagtcaaatgattaggggacttaattacatctgtgaagtcccttttgccatataaagtagcataatcatggaattgaatctgatcatattcacaggtcctgtccacattcgaaggaaagggatgtaggttattagggggcatcttagaattttgcctaccacactgtccatccctggctgccacagacttgtggctgaggttcagcattctgctaaatagctggctctatagataacagagttgtattgcaggccttgccttttacataactcctttacaaacactatttcatgtaatcttactatatcttcttgagatatatgttcctatctccaatgtaccagtgaggaaactgaagaacatagagcttaaaaaggggcccaaagtcacatagctaggaagtagtacctgaaaccttggtctttgactccaaatattgtgttctttctcctatatctcttttatgagaagttgttctttcaggagaaagaacaactaagactggagcttgatttgaagtctggtctacttagggaggaagtcacttctcactttatctgtgcctttagtctgcactgtcactttatattggctatgatttcgcacacacaggaaggtttttcataatgattccagggttcctagaattgtttcctagaaaattaccacaaaccggctgggtacggtggctcacacctgtaatcccagcactttgggaggctgaggtgggcggatcacaaggtcaggagttcgagacaagcctggccaacatggtgaaaccctgattctactaaaaatacaaaaattagctgggtgtggtggcgggcacctgcagtcccagctactcaagaggctgaggcagaagaatcgcttgaacccagaaggcggaggtggcagtgagccgagattgcgccactgcactccagcctgggcgacagagtgagtctccgtcaaaaaaaaaaaaaaaaagaaagaaagaaagaaagaaaattaccacacacttacacacttaccaacttgaaactatttctatttattagctcactattggtgtatgtcataagtctagcacagcgaggccagaatctctgcttaagttctcacaaggctgtatcaagatgtcagctgagctgcattctcatctcaaggttcagggtcttcttccgagctcatgtggttgtgtcagaattcagttccttgagtttgtgggactgaggtccctgcttcattgttggctgtcagcctgggggcctctgtctgctcctagagaccattctcattctttctcacatggcctccttcattttcaatccagcaacaacgtgtcaagtacatcacacatctttaacttctgccaccagcctgagaaaagtctccacttttaagggctcatgtaattagaccaggttcacatgtatattctccctattttaaggtaaattataccatataaaaatcataggagtgacatctcatcatagtcacaggttctatggattatggtatagaatcttggggagtggcatttttatttttatttttatttattttgagatggggtctcgctctgttgcccaggctggagtgcagtggtacgatctcagcttactgcaacctctgcctccctggttcaagccattctcctgcctcagcctcctgagtagctgggattacaggcgcccaccacaacaccccgctaatttttgtatttttagtagagatggggttttaccatgttggccaggctggttttgaactcttgatctcaagttatccacctgcctcagcctcccaaagtgctgggattacaggcatgagccatcgcgcctattcgtgagtggcatttagaatgatgcttaccacagtgggtctttttttttttattttttattttttatttttattatactttaagttttagggtacatgtgcacattgtgcaggttagttacatatgtatacatgtgccatgctggtaacagtgggtcttttaagcgtcgttgttgtttttctgcattatagcttagaagataaaaacatggacactggagtcaaactgcttacattcaaattctggctccaatatttactagcagtacaaacttagggaagttgcttaacctaccagttcctcaattttcttatctgaaaaatggataataaataatagtgtgaattttattgagtcatttaacactttaaatgagctaatgtgccagaaaatgacttggcacattgtaagcactgtgttggtctttattattaggattattattattgatctgattattacataaccactaatttagagttcagatttactactctccttggagcaaacccatcaccttatttctgtggaccttagtttctctgtaaatgttagtgttatttaactgtcaaaaatataatttatgtcttagtctgttgggctattataaaataaaatatcataaactaaatggcctataaaccaaggcactggcagatttgatgtctagtgatggccctcttcctggttcatagataatgcctttagatatgtcctcacataaaggaaggggcaaggaagcttttatgagggcactaatataagccagggcttcttttacagagacatgcaggagtactccaccttcaaaacctaatcatctctcaaaggccccacctcctgatatcattacattggggattagctttcaacagatgaattttgggaggatacaaatattaaggccatagcaatttataatgtaaaggtacattttaaagaaatttaagtgtctctaactcaaaggaaacaccaaggatttgtttacataaaagaaaactgtgtttaatttataggggttttttttaagcaaaggaaacatagcagattcagtggcttacattataaacttgagaatagaagtacagaaccgttttttgcaccatacctattttttaaaaatggtctttaattccatgttatgaccaagagaaaaaaaagtatgtgaaaaatagggacaggaaacttagggaagaacacacagggtgaaaggagactgcagaaggaaatgtagaaggtataataggaaaggggatagagaagaaaaggaacagaggcaagaggagaggaaaaactgcttagagacagagagggaaggtaaggagaaaggggaaaacggtggtaaaatttattgagcaccaattatgtgcctgccatagctaaggagttcggttatctcacctcagaacatctcagtgaagtaggtattattgtcaccactttacaaatgagaaaatagctattaagtgagtttaacttgtgtccaaggtcaactgtgttacatacagaagttagaacccacatctttccagagctaattacaatgtccttctcccatgtccttaaggactaatggtgagataaaacatactcctcatggcttgttggtccaacctcagtgttcctgtcacactgagaaaagacttagtctgacttagttgaggcgatggtgttactgtctcttagcactacctaataatcttaattatttgagtcaggacatttggattttagttaaataggatccccaaatgatttatgcctcaggataagtcactcctctgagctgcagaatcccactctataaaatgtatgtcttggactagaccacctgccaaatactgaaaattattagctgtcttcacataggcaaaggctgtaatgtggattggggagaaggtgaattttgctgctctagttagaagcactgtacaaagttttgcaggttgtttattgtacaaccttagtaggcaatattcatatacacagtcataggccatggccctggctccaggaagccaaaataaagaccaatgggtagaggccaaaaaaagggaaattgtggctcaatagaaaaacagcaaactctgttatgttcagaattacctcttaacattgtgaaagctttacctttgggggtttttaggcagagaccacatgatgtagggattctaccaacacatgagattttagagaatacctaagcgacattcagaactggatttttaatgtggtcaaagctagctgggtgatcttaaaatcattaagccttaattttctgaatccttattattatggccacaataatagtacctacttatatggctactgaagtagaagattgtgtgtgtgtgtgtgtgtgtctacatctgacatctctgtatcttagcacaatgtcctgcacatgataaaatgtcaagaaatgttagctttcattatcaatattatcttttcaactacgaatgaatgaagtttctagcacagcagaactttgctttacctctgtaggcatggggctgccaccatgtttgcaggcaaagaatgctggcattctcagagatatcacttttcattcttaattgtagagcaaacatatataaacatataacataaaatctatttcaagcttagagccagaatttggttaaagggtggaggttctccccatcttgtagctaaacagagtggtgaaaaattatgattatggcccgccataatgataatttagagataatttctaaattatcctctaacaaatctatttctaaactttaaaaatagagcttctttagggtccagtgttagcaaacagaatccccacgatgactcatagaattacacagcatctttttcaaacctttcactctagtggggatatgtcctcattcagaaattaatttagttaattcagcttaaaaattctgttgtcaaaaagcttatttcatgtgggagtatcttttttgttgaaaaaagatgcacatttacctgaaaaaaaaaaaaatgtgattctcttcatcaagctgtaaacatgcagctgtcaaaagtaatcactacatcagaaaaactggataaggaataaaagtatctttggttgattcataagaaaaacagcaaagtagcttatatgcttaatgaaaaaacagactgaggaagtgctatgaagcttacatttcgctccttaagtcacagtcctcaatgtggctccatgcacgctaaagtcattcttacctacaggacttcacttgctttatttaataagactccgtccttgattaaatttgaatcaggcttctctgggtcctattctcaattaggctttgaccttaggctttttatttggcctcgttagcccagttttaccaagaatcctgctgagtcagtttatgaaaaatttctctcccttggtatccgatcaaattccttatcccatacccttgataatttatcagcttggcctgccttcaacaagaatcctgccaagtcccttcagccagaattccccttacccttgacgttttctctcagtaattttccatgcactaactgccaccccccactccacagctctttggctatacatcttcacttatgctttctgtattcagagttaagaccaataactctcctccactgcaaaatctccattgcagtgaaccctcttgaataaactcttccttacagtcattaacaagtgtcataaatattttgtatttcacatatccttcctatcttacctcccacaataattttcacttctccctcttctccactttatttatttacttactcaaaaattcatttcttcagcaagagtttattgagccagttatacatatgtaactgcttggcctgaggggatttacaacctagcaggggtgctaaaagtgacattagggcatgttattcttcctgaaaaatctctcctaatttttccaacctatagtgccttttagctaaggttttgatcccatagcattttatgttatttaccccatgagggtaactcttatttcccacaattaagttccttaaagaaagtagcccagctcaagcagctactactctctatcactgagaagtacctggctgcactccctccaccaacctaaactcaccatgtgcctttttttttttttttttcttttttgctttttgagacatggactcactctgtcacccaggcgggagtgcagtggcatgatctcagttcactgggatcaagttcaagccattctcctgcctcagcctccagagtagctgggattacaggtacccaccaccatgcccagctactttttgtatttttaatagagatggggtttggctatgctggccaggctggtctcaaactcctgacctcaagtgatccatctgccttggcctctcaaagtgctgggattataggcgtgagccactgagccaggccatcctgtgctcttcatccagatgaagctgctttccctttttttctgagggacaacttgttcttttctctgtgttcccacttagatttgtagggttagtggactcagaggaaaccttcccagggaatggtttttttagactctttttccctctctaaacgcctagagaaagccctataaatggttgccgaatatgagaatacatacaatatctacaacgttgctttacttgctaatgctacttatagtgtatccttttgataattatattatttgcccgttagttcatatttatgttctttccaactagactgaaggcctcatccaaacaaaagatttatcttcatcccctcctcacagtgcctggcccaatgttcaatgtggtacctaccaacgaacacaaatcaaacactactgaaattcaatcagtagcaaaagatctgcaaagtcatttcaggaagcttgccttaaaaatctctttcaagtacagaacttttgtagaattattattcttcaaaggtacaaatgtgtctcattgatgcagcagatttactttcaaaatcattctaatgtttcagatctttacctgagtctgccatcctctgctgcagcacctcctggtataatcttcgtaataaatatgccagggtcatctccaatgtggggattatctgtccccccagcaatactgaatcccaggccagaattcccctatagaaacaaaaagcagatattaaatgatgtgtctgtcacctaaaacctagttcctcttgcactctgcattatcatgttactactcaaatggaaatcaggtgacaacagtcttgtatgctaaatcataaagtgcacagttagcagacaaaggaaggtcaggaaaaacactgaggtttattcctgcactgtaagaatgcaagagcattatatttttcttttaaaaattgcttcctttatgcagcaattaaaatcacatttatgaagcaggaaataaaaacttacaaattgtgtaatatgaaaaaatataaagaatcattagagtgtcaactgtaaaaattatacatttatatgaaagaggaagaaaaaagttacatgaaagaatttgatttaatagaagagtgaacttgggtgtttcattttcttatttctggtattgttgttctaatatcacttatctgtcaaataatgtgtttctaagtaaagaaaacttccacttcagaagacaaggcccccttctagaatcataatacatgagagatacttttgaacaataaacaggctttaatttgcaatagcaatagaaaaggcatgcaatagtgcagcagcatggaaatctgagtagcttctattctaataaagcctttacacttactcctgtagattatagtaactgatatcctgtgggtgtgtatatatatatacatatatacatatatatacatacatcgctttctaaagatatatatataaggatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagcgatatatatatatctaaagagatatatatatctaaagagatatatatatatctaaagagatatatatatctaaagcgatatatatatatataaaggatatatatatctaaagagatatatatataaaggatatatatatctctctctctaaaggatatatatatctttctaaaatttgtatgtaaggcataattaaaagtccccccaaatccacaaaccatattgtttatttcttatttctatagtctcctttactccccatctcccatctccacagctacatatgttttcatggttgtgttgtaattttttccaaatcacattatattttatgccctttctgtatagctaggcagtctttataaatattcgtcttaaatggctagtcatgtttcatcaaggtcacatattacttatttaaccagtcccttgtcactggatattaaatttctctacatattcttacaaaaaatatagcttactaaatttatgatcatttgattaatttccactcttgggtaaaaagagatgaggactatgaattcagtagttatttcagaaaaagtaattagggtgcttgattagtcagaaaggttcaatgtcaagataagatcagctataacttgacacctataccactgcaaatgtcaaggtaatgtttagcaattcttattgactaaatttataaaactgatttccagagggttgtttttacaattgtatatttattacatatgttgaaagggtgaaatgaataattcagctatggcaactaaaatctcatgtgtttatacttctgatgttttctctaattctgtttgctctttgaaaaagtccagtgttcactgaacagagttattacttattagcactcatataatcatgaatttatttaatatttattaaacaccacctctgtacctggcactagactaagccctggagctacaggagtaagtatgtcagtttataaggcacatgaaggggaaatgcagagtgtaggagtgggtaggagaaccaaacacagtgacctggtgacatagagaagaacattttgacatagagggaagaacttgtgtaaaagcccttaggtgagaaagggtatgccacacccaaggaacagacaataaagttggaacaaagaaagcaagaagaattggatagatgtaccttaatcatgaaattgacaagagcagagtgtacgagaaaccattttggattttaaatacttactgacaccaaatgactgtgttagtattggttgagcatttcgtatgcaactgactctaaactaagactgcagaggttaaggccagatggtttctgccttcatggatattcaaagcatagcaaaaaaaagcaataatactctggcatctagtgatcagtatatttcacgtactgtataacctcaactgcattgtcaagtatgtagccatggagatagtgtttaggggacttaatgaggcagttctctaagatccagaggtttgggaagaaaaaatgggaggatgagtattttcaatgtaatttgggtcaagctctaagtacatcaactagagtatattggtctcactgtagttagcatctcagggataataatgtcttgattaatgagagtagggaaggaggcaagcagagattgggagatacccaaatgctttctcctgatactgtcaacatgtttggagagggtactcaaaactttgtcctgtgagaaagatattcgtgatctaactcttaaccttgtcaactttatttccagcttcacactttaccccccaggaacaatgaagtgaactgcaggctctttactgcacagacctcactataattcatctattggtgtttatttatgctgttttctctaccagaaacttcacatcgccttcttgactatttcaattcttcgcatttttgaagatgtggctcagacggtgtctgctcaaattaatactaaattatcacccaacccttctctagatagatcacatttctgtgtttttgcaggtttttatgcttacttacattatgcattgtgttattttgtagttgtctgtttctgagtctgtctttcctttaaactgggcttgtagaaggcaggaactgtgtagtattcatctttgtttttttggagccttgtctagcacatagtattgacaataaatacttgatgaatgaagtaacagaaaaacaagcctactgagaatgtttgtgccctaacaggaagactcaaaaaggccacaatagaaatccacaatgtgttaaggaatacaatatggaagtagaagccattttgctctgtgtcattacaagaataaaaaagtagaaagctcaggcattcaaactgtggtgcagctaaaggctgactaataagacacaactgttcagattggagatgcactactctgtaagggatagaggatccttcactcaggaggtatttggctagtcactgggcgtgaaggacccaggcatttattgaaaggttaaactggatgattttaaaggattcttttgggactctggctagatataggaagtctgctcttgccaacagagaaaaggggatgttttagggacatttagtgggggaagtagatcactgtcaaattcttggaacttagtctgtgaatcaatatgtctttgaaataatagctttgataacaacctagaaacatttaaccactgtttttcttttgaattgactacaatatggagaaaactgtggctctggcattttctaatatacattcccctgtccccagacccactctgaggaaaagaatgaatatatttaggaaatttacagtggaaactaggtaggtagagacagaatgtaacttgccctgtgtttctggtcccaaagcatccctgaaagcttttgtgtttcaattaaaactagtctaccagctgggtctggccagtcatcatggttctttacaagagattcatctgaattcagctaaggaaatgatttaaagagctttcacctccctttattgttctcttccagccttcccttttaagtctttgctaccagccagcagcatttagcagagagagggacagatgcaaaagtgtcattgaaattgctgcctgctgctctctatggctgaatcacttcaatcccctgacaattgtcccagagcctgccagctgcagggacagatctcagctcctctcttctctgagcagcaatctctccatgtgaacaggcagacccctggttgacactcttagatcctgaaaattgtgactaattaaccgagtgttgatccctgatgcagtcaatggaaacttcaaggtgccatgctggtaagggcagaccctgtaaaggattctgggtgggctgctgtgtccttgcagttgggaagattccatgacagatgaatgtcactgacatggaccattctttctcttaattgttcatatttgctgactcttccccacgagcacaaacccattttctagccaaatgacacttcttgtttcatgtactgcacaccatctcctctcagagagagaatccaccaaaaggaaagacatttcacaaatataaatataatgtctctgggaaagccccacttttattaaaagtttatttcccaaatgaaaatttctctcaaaatggggttatatataataaaaaagaggaaaataagtagtaatattataatcacattcatttatatataatgttgtaccgacaatgatttttttttgatttttagaatttttctactttaaaatactgtttgacctgatcattcgattctaggattttatcctaaagaaataatcagagaaacatgaaaagatttgtgttcaaggtttgttgcattatttttctagtgttaaaaaaacacaactgaaaactgacatccatatcatggagaaatggttaaaatattgtggtacatttatctgaatgtggggatagtttggagtcattaaaattgtagtgcttttcaataataaagacatggaattaacccaggtgaccatcaatggtggactgaaagaaaatgtggtacatatataccatggaatactacacagccataaaaaaagaataaaatcatatcctttgcagcaatatggatgcagctggaggccattaaactaagtaatgcagaaacagaaaaccaaacactgcatattctcacttataaatgggagctaaacatcgggtacacatgaacataaagatggggacaatagatactgggaaatataagagggaagaaggaaggaaagggaaaaaggttaaaaaactacctatctggtactatgctcacttgttaggtgataggttcaattgtattccaaacctcagcaccacatgatataactttttaataaatgtgcacatgaacccccagaatctaaaagttataaattaaaaataaaattttagtgctgttaataaaaacggaaaatgttgattatataaatatgagaaaaaagtgacattttaattacagtatgattgccactgaagacatttaaaatgacttaattttaacaagaaaattactaactttaattaataatagtaaaattgcttaaataatttaaactacataagaaggagattttaaaaaattataaagcccctagtaaaatactaaaagcattattaagggaactaacatttattgcatgcttattctatgctaaacactaatctatgtttcttacaatttcctatgtggtagattgtattattctctttttatatattagaatgaaaaacaaacaacaagcaaacaaacaaaaactgaggctgagaggagtgaagtaacttacttaaagacgtgaagcaagtaaatagtgaattcagatttaaaagtaattctcagacttcaattactattttctttccattatatcacattgtctcttctgaattcaaaaactaatgcaatggtagggaagtaatacaaattttagttataaggaaccgcttcattggatttttggaaaagatttaaacttctatcagtatcatgaaaatatttcaaaacatttctaataaagtgatacggtttagtggaaaaacatagatctgggtcgttttaacctgggtttgcacactggctctgccattgacatctgcatggtattggatacattttgaaactagactttgagtctagtttcatcatctgtcaaatggagataatgagatgaattcaaatgacacaggcaccagcaagtgctaagcacagcacatgggtgatgatcaagcaatgttagttcaattcctttggtttgatgcatagcactgtttaaagggtccttacgagtttgaggacagtaagggagaacagatgtcaaacaatgtattctttaattcatgccttatttattgatccaacaagtatggattaatgcattttaacctacactgataatatatgttacttttctttgttaaaacaaaacttagctagaagtactaaatttggggtaaagattaggttatagtattgaaaccttagataaaaaacagctagataaaaaaagactcaaataatgttcttttaacattttaatacccatgttctatttgataaatattgaaatggtatattcctctcactaaccccaagattcctatatgcttcccttaacccaggaacacctatctgttccttttgctacttgccaaccatcatcgatattcaagtttaccttctgtatatttgttccagcaaagccatttgtttattttaatttaatatagtttatactacaaaactatatgttgttttcaaatataacatacctcagcccctaatctgtaaatttctcatatgcaccctgatcgaaaattactaggctaccacttgaacattggccatgaagataataggacagcgaacaatataagtaggtagaataaagatatcaaaaaagattaaaacaggtaataagaagttaaaataaagaaccatttaggctacatgccagaagaagaaatgtcccttgatagaaaggtctgttggttggcaaataatcttccaaattgtcctggaagtcattttactttgaaaagtaaatctggagtggcacagggaataaaaaggtgtcttttcatacacattacttgttaaaattatttaaagtctttctcacatccactttctgtctcatgttacgatatctaaagatgaacagccccaggtctattactaggatgtgaaggtgagaaaataatgcagacatttctaactaccattgctaaatagagatttttttcctcaaattttttatttagtttttaaatgctatctaataatgtatgtgtcctggaacaaagtgcttagtccaggaataagaaatgcccttttcacaattatacaatctacaggaattgcatttaggatgccccatagtttgttctattaaattgtatttttctggaagctgctgggtagaaaagccatcaggagaatacttcatttggggattggtaaatgtttacataaaaatgctttaacaagatgggggatggtagagaggaagcagtttaataaataggccaagagagaatgccagattattgtagaccaaagaactcctgagaagcaaagaaaagtaaacacagtgaaagtagattattatctgtgtgtgtgtgtgtgtgtgtgtgtgtgtttgagtgagtgtgtgtgtgtatgtgtgagagagagagagagagagttttagctttagggggtgtgtgtgtgagagaagtgtgtgtgtgtgagtgtgtgtgtgagagagagaaagagagagagagttttagccttagggtgtgtgtgtgtgtgtgtgtgtgtgtgtgtgtgtgagagagttttagccttaggggagatatgtggcagtatcgaaagagaaggagaaaaagcagaggaaagattttggaggatggcagggaggggactcaagcatctctttagtctaaaggaaagaagcccctgggaaagggagattgaaggtacaggagagaagagagcacacaaaaaaacataatcttgaaggaggagtgagaatggggcccagagttcagactctttgagtcccaccataggtactacttaatttcatgtagtatagccacaatacaacagtattgtataagtttatgtgctgacatgaaaagatctttacaaaatagttgtagataaagtaggagacaatttaggatttaaactttgacctcactttacaatatgcatgcattataaaagtttgtaattatgctgattaatttattaatagtgctttgtagatctttttcttttgtcattttgagcactccatctttaattttccttataaatatatcttgcaatgagcgcatatgcatgtatacacatgcacatacacacacattatacttgtacaacatgtgtaacattagaaaaaataagttcgcttttgacacagcataactcagccatgggtagggggaggaatacttcgccctctgagataagagtaactgagttcctacggtaagttatagtattattttaaggtggaagaaattaaaggtcattttaaggtagaggagaaggaggctgaaggaagtcttaactgattagatgtctttactccatatatttagaagtcaggacatcagagggaaaggtctagaatgaagttgaaaacttaagtaaagctgtaagtgattggaactgcagctttgaggcaagagagagacacttagggatcagctggagcctgctaagcagcaccatggtgggatgccatcaacgtgttatgggattttctcccacagagcttagtaatcttgaacagtgaaagggatgatttggttgctttaggggtgaggcttggggaaaaagatatggtttactttgtaagtgatgagtaacatgttagaaaagataggaaaatatgagacgtaagggaagatactcagactggaagaacagaagagggtgaaaagatggagatacgataaggtgaaaacatagatttatggggagcaggggaaggaagagggagcaacaggctgtggatattggcagatttcagggttcaatattttggagataaagcagcactcagtgttagtcatgtgagtatagtaaaggtcaagttataagagtgtattgaggtgatgatcaagtcagggtactttgtagctgacactgaagtttcccagtaagacagaaggagatttaaaaaacaaaaagatggtaaagacagaaaaaatggctaacatttttcattgaaactgaagaaagacctagggtagaaggagagaacagtgaaaagatgagaagaggagtatgatgtgaggtagtgtggcagttaagtattcttggcagaggaacaagatgtgctaaggcctaaggaaaagagagagcttgacttgttcaagaaactaaattgagaccagaatagctatgcagtggtaagaaagggaaggaagagctgaggcaagagaaggtagcagggggtcagacactggggacagtaagtttttgggtcataaaaggcttaaaacaggggaattacattatctgatctagtttaagattatactttttattgtgtacaaacttattggagagtgctgaaggggagaacagagaggcaagttgctgtagtccaggtcagaaattgatggcatctgaactaggctgatagcaatggggatggcaatatttgaggcataatttgaaggtagaaatgactggacttactgatggctggaacgtgaaaggtggaaaagagaagaatcaaagatgacgtgacacatagctggacagggatgctgtgtatgagataagaagactgtggtgaggatgaggaaagcagtttgggagatgtaaatcaagacttaggcttgggcctttttcagtttgagaaatatgttggtgttaatggagagaaagaaaaaaaatacttacatcgtcaaaaaaaaaataataggtaacactcatttagtgcttgctatatatcagatactgtgttagaccttacaattgcctacttaaggaagtcaagatgctggccagaaaatagggtgggttattgcaggaatatcaggaaaaagttctaagcaaagttatctactttggtccccacaactgtaagggtatatgagaaagttttctgagtgacagacctaggattatgggctttcctggagaaactaggttatctgagtaaggagcgatatgacaaatgtgatgctttaccatgattaattcaagggcattgtgtgtttagaatgctgaatttagaataggctgggtggattgagtcagaaagcaaggagagcaatatgggatcaaatataatatttaagctgttaattcttaagatctgatttaagatgttgtcagtgatactccaactacaaaatttctaagtaacatcagtcttctgtcctgtaacagtatgtatccaaaatgctactggcagcaaatatgtacttctcattagctcccaacatagtttcttaatttgttgatcatttttccagtgtaagctggtaataatggagtgagttcctcttttgtagtcccatcaaatcttctactcctaatgacatctctgcttgtgttctgaaaaggattaaagcagagatgtctatttagactggtttgtgtattgaaaataaggaagaaacaagaatgctcaacaattcttattaccatagcaagaaatctgatagtcatccttgactcctgcctccccatcggtccctacattttattaaaactcaaatcttgttgattctacccctgaaatacccctcaaatccatccagctcctctcgacttctgccatcactctctagtttagaacatctttagttctcctcattggttttctggcttccacacctgactcacttctctccttccttctcatgcaaggatgtgctcaaaaacaacaaatctcaaactccaatgcctatgaaggcagaaaacacatataggagggtgaagtaatcccaggagaggtaaaacaacagagcaagaatgtgagttaatgacaactgatcttcgtattggaaacaaaacagaagtgcgggttgagaacgtatctcatctaaagcgataacctgccattcagcttttatgggttattgcctctctgaaatggggtcctcttactggatgattgtcttaccctccccacaccccagagaagccaggaatcaaatttccttaagtaaaatatcaatttttaaatgttagaaaattattgaatttatatctgtaaatatatattaggctgtactagtccaagtcctctgagaagcagatgtcaagacaggattaaatctaagaattttgttaggggaaatgcttgtgaaggaaaatggggaagcatccagaaaaggctagaagagctattagatcaccatgcaagtccgatcccaaagaggagaacagaaagaaggaagataggttggaagtatccttcattgcttttctctgagtccatcagagaaaaggccccacctgagtagccatgcagcactaggtcactggctcagaggagccattggggcaaactcaagaatagatttcagattttagagcttagcagctgggttccaggtgaattatgctccctgtagttggcagtctgtgaagcacatcctcatgactgccccacaggccaacaatgtgaagagcaaacacatctgcaagccagagatatagtctgagggtcgccattttgtaaactgctcaccattcagtgaactagcttgtactttcttctgtgtagatttatatatcccgaggaacacataaagaaaagtgcttgactcagagtaactcctcactttccccttcattttcctcctctatataattctctaagtgattcacaattcattactgcacacagcacattgttttgtacttgtttatatgtttattttccctattctattgtgagaatcaatgcaaaatatcgaaacttagttattcattttccatgccaggattgcatagtacctgtacatgaacagaactgaataaatccttgtataaactgaattgaactgaactatttcctattctgcaattcttcttttctttgctgttgaatttctattcaaatatcaaactccacctcaactgctctctcatgttttctccaactgcttcaggcagatgcgaaggcccttccttctgggcttccgtaaaacttcattcataacgtgagagagacactattcacactgtgtctctctttctctagatcctcagcatctggaaggcaggggccccactgtatttgcaattgtatttctctctctcaatctaatgcccattgacagcaaatgctcagtaaatgtttgatgagttaaactaaactgaagaataatccaaaatatttgcatgattgagctaataaggaagggtcaggtgaaggggtttacctgaaattttaatgtaggagggctaaactttgaatcacctaattaattctgcatttgtttctttgagaacctgctatctgttcaacattgtgtcaaattctgcaaaccaaataaaagacgtacagttcttgttctcaaggagcttacagtctagttggggagatgtgccatatacatggggaacagcatgagtacggcacaatatttcccattttccattggctcctctctccctgggtcctctcatccatcatttaccaagttttattgattctatcacttgagtaactcttgttttcatccttttatttctatttccactgcctctatttcctcattttctattgaccaggatatcataaattctaagcatctgagaatgactttttttttaaccacttttttttccctttttccctttttgagacagagtctcactctgttgcccagactggagtacagtggcgcgatcttggctcactgcaagctccgcctcccgggttcatgccattctcctgtctcagcctcccctcaggcgcctgccgccacacccagctaatttttgtatttttagtagaaacggggtttcgccgtgttagccaggatggtctcgatctccttaccccgtgatccacccgcctcggcctccccaagtactgggattacaggcatgagccaccgcatccggcctttttttttttctttttacttttcctttttttttttttttttttttttttaccacttttatgactaccacttttcattccagaagtataattttctcactttctctcaaatcagtttagatgttcctgctgttttttttctattccaaatctttaaaaacttctaaatgttgaataaaacaatatctttttactctttactctgtttttactctttactgaaccatgagaatttttttttttaggcagataactagagatttttttctggcggtgtgcacttattatttcttctagtatttcttggcaatactgtaggttctcatttgctacagccataaatttgtatttctttaaaataacttccctttaaaatggtaacatgcgattaaccaactgtacttctgacttaacaagactttaacaccctttcctttaccaaccttgactaggcaagagggatgggaatggacacttgctgtcatctattaggtgctactcccttggaacggataaagaaaataagctctgtaatcatttctgctgtgttcagattctagctttactatctcttgacttgtgaccctgaacaattctcttaagttttctgaactataacttcttcaccagaacaaacggaacaataataccttttggattggttataaactagtagtactcaaaatatcttcaagatcaaataataatatgttatttgtctttttcactgtgttcacctgtgtgctgatggtacaaaagcaatggagataactgttggtgtcttagtacaaatcaaggtagtggtgccgaagtatgctagtaagcatagagttcttcactcccatacactcacacaaaaaattaattttacttaagaatatctttgatgaggcattaaaaattattaattttcttaaatattgacctttgagtccataactttataatattctatgtgatgcagtgagatatatgcataaaacacttccattgtatagtgcacatggttttctatagaaaaataaaaatactgtgcaattatttcagttgcaagctaaactaaccacatatttactgaacatcagttttacttaaaagaatgactgacatacaaactggttattcagtttcgggtatttcacaaaaacattcctgaaaactaataaagtgagattgttgttttaaggaaaataattgccaatatttgtggtcaatagcaaaatttgaattttcaagcacacattagaatttggaaactttgtattcaccaccaatgagctgacaagctttctgacttaaacttttttttctgataggatgggtgataataatgacaaatactattttttgatattatatagggaagtatgtcaacatttggagaatctgcatagctcagtgaatcaataaatcagtaattttcaatcaaccaatacatattatacaaaaatacatgagtaaaaggttcatttaaagtgcaagatagatgaacgaattttaatgtaatggtaataaaagttcaatgatagagtctcagattccaccttgcagctaaactttaaagaatgaccatttgtcaagttttaatgtggtatcaaagaatatccacagttatctgaaaagcctatgaaaacattctgcctttctccattcacagaagagtaaaaaaaatgtcctataaagatatgagaatccaactatattaaattaagccagacattaaaaagatttcgaaaatgtaaaacaatgcccttctacttactactctttttggcttaaaaaaaataaaactagttttaatttttttaagttacattaatatttaatgggtttattattatttataaataaattattacttataaaaaatttcagttttaatttcgaatacggtaaatactgtagacagaatacacataaactataggagctcttcatgaattttaagtgtaaaaaggatcctgagaccaaaatgttttagaactgtttttgtaaatattttgttacataattctgacaaagcatttaacttgatacattggaagggctcagtaaatattagtaagcttatttacaccaagggctctaggtagtattagccagcattataatttcttgaaatcacccttgactatcatccatttttcttaatttgaaagcgaactcaaggagctgaggcagcagagtgcttgaggaggggaggatggagatggatctatcatagttgaatgcttatcaaattaataatactattcaccacctcagaacatgctataaggaatcaactcctaaagagaaaagatttttcaatatgatgtgtttttctgcggctgcacggagattttaaaagcatgcacccaggtttcctactgcctcacgcctagtatgacttcacattctttttctttttttctttttgtttctttgagacaggctggagtgcagtggcacgatctctgctcactacaacttctttcacgtcagcttcccaagtagctgggaatacaggcacaaaccatgaagcctggctatttttttttttttttcattttttatagagacagggttttgccatgttgcccagccttgtctcgaactcctgagctcaagccattcagccacctcagcttcctaaaatactggaattacaggagtgagccacctcacctgggctgacttcacattcttgtaccaagtagctattagttacaggcttcttaaagctatgcttagtctgtagttttatattctatttgttaaatgcaaggcccattggcagtggtaaggatttcaaagacctaactttctgttttacacaactttatttgtagagtctatttccttactaaaagatgtcatgtgtaaatgtcaacgctaggttaagattagaacttatttgacccaataatccaaactcccctcagcccaccattctcactgggctcaaaatctattcattggtattcaaacaattctaacttcagagtgctgcccataaaacctctacccaggaaaaagaaatattttctggaagcaagtgagttcaatgttccatcacaggtatatgttgggagacgggaggtggaggtaggcaaaggctggattgtgtgcactccattccccttaggagtatatttgctttctttgcaaccctgagcattttggttaatatctaaatcctttagttttgcaggggacaaaaaaaatttaagtcacggacacctgtctcctctttgacttcttgtatccttcttctcccttactagactgcaattatcatgtccccttttatggtcctccaacatttcaagtttatttctatcttggagactttgtatttgctcttatatctacctctagcatttttacgtccttattcttcagatcccagctcaagcgttaccacctcaaaggagcctgccctgatagcaacaaactactcttctcattaccacctttggtcacttcctatcttatcaccctattattttcttcatgtcctttatcaccatctacccttattttgttaactgcatatatattgtatgagtacctcactagagtataagctccaggaggcaggaacctttctgtcattttcaccactaactgtattctcgtttctagaacagcaccagacacataataaacattcaataaatatgtgtttaagaaatgagtgtctcaatcagtaagaagcggtaatagagtgaaaagtgtataagttttagagttcacagactggaatttcattcctgctatgagctcaatatgtccaccaaattcgtgtgttggaaacttaatccgcagtgcaagagcactggcaagtggggccttttgggaggtaagatgatcctggactttatttattaagtgtgtgaccttgggctagcttcttaacttctcttaaattcctcattttaaaacagtgattgttaaactcttgtgaagaatgatgttttcaaatgtaaaagcattcgatactgtttagcacataaaaggtactcaataaaaaggatatccctgtcctgctcaatcgaaatactttccatgttttgttagtccattctcaagtggctaataaagacatatctgagactgggtaatttatgaaggaaagagatttaatggactcacagttccctatggctggggaggtctcacgatcatggtggaaggtgaaggtcttacatggtggcaggcacgagagcctgtgcaggggaactgcccttttataaaaccatcagttcttgtgagacttattcactatcaggagaacgacatgggagaaacctgcccccatgattcaattacctcccactaggtccctcccatgacatgtggggattatggtatctacagttcaagatgagatttgggtgtggacacagccaaaccatatcacatgtgtatgacaagtaaagctaaagtcctaacaccacagaatttaccattttgtgaagaagcaggatatataaacataaaatgacattaaatgtcagtatattttaagtgtcaaatgaatgttagagggacaagtgaaacgtgcattggctccctactgcttagggaataaagtctaaatttattaggcataacatttatggcactttgttattatgttgcactttgctttccaacgcctatttctcactgtggttttccacttaagcgtcacctaatcaaaccccagtattcactttactttgtaaatatatggtcctgataagccttgcaactttgctctcagactttccctcacctcttattctattcttcctttagggcttgaattaattgtcatttgctccaagaagtctcacttgatctcacgcaccctaatccttacaaatgaaagcaactgctcccacttctaaggtcctagagcacattgggttatacctttcctaaagcaatttatctttggctttatgttcggagtatatgtgtatttgccttattttctagcctgctttagtttttagcctaaccctctggttgtctctgatctatcctagtcattccgaaaattctgcacatatcatatgtgctccctcattatagttagatgaataaatcaactaatttaaaatgaatgaaaaggaactaagtgggagacttggttttctacttgggtctttcagcttaagtctgggcttttctcatctcccttcattcctcctcccaactcctacttatagattcctaaagacactcattccatttccatttctaagccttctttcctcatgtatctaaacgtggtttaagcatcatctgctctgtgaggcttgtgtgactcaccagttgggttcagataaccagttgggttcagttacacccagagtacattgaacttacttctgctgccacatgtatcagttatattataagaattgtattcattgagaaaaaaactatgttaatgtaatttatgggcacctctaaccatggctggcatataataaatatgcaataagtatttgttgaataaataaattaatgcaaactttatttttattgatattattatcgtaagcattttataggctttatttatttatttatttatttttgagacagagtctcgctcttgttgcccaggctggagtgcaacggtgcgatctcggctcactgtggcctctgtctcccaggttcaagcgattctcctgcctcagcttccggagtagctgagactacaggcacgtgccaccaccctcagctaattttttgtatttttagtagagacggggtttcaccatgttggccaggctggtcttgaactcctgaccgcaggtgatccacctgcgtcggcctcccaaagtgctgggattacaagcatgagccaccaccacccagctggctttatcttagtaattcctctaattagtatatttaaatccatgtttatttatgtttactcatgcttctatcaactacaaaagatcaagcagttcaccatttgaagaagaaaaaatttgttcagcctcctgctgcatcaaatgtgtactagagtaacagtttgcccgatggaagcctgagaaactaatttgcctccatggtttctccttaattccctaatcacaggcaaaatccgatcagactttaagagaaaataaactttgaaatctaattcatatttctcttagagtcttctcccatctactagagtgaagtatagcctaaatcatttttctctaacgagttcatatttgacaaaagatttaagaacacaatataaaacttttcaattctcaacatcaattctaatgtatttctacacctgaaggtaaagtaaataaactgaattaaagtgcagcacagaggtatatatttcttttagaaggtacttaacccgagtataaacaatttcttttgttctttactcatcctttcagcagcagaagcaggaagatggggtacttactttcttctaatttgcggtagaaataaaattcatttttatgattctgccaccaaaaagatattttccagtcacttctttgattccctaaagtatcttcctacactgaagtccaagggtaagcagaactcacaaaaaatgttgttctatcttgtactttaggcaggttaataattctcactgaggcataaatatgacttgccacattctgccactttcaatcctttgtgaatacacttcaaaagcaaaacgtgtttataagccctctaatatctgccacattacaataaatgatagaccaacctccagagtattggcttcgacctcaagcaaattatacaataatgtttccctcaaagtttttgtgcatgcagctccttctctcccagaagaaacatctaccatatggcaaaagtgacaacctcagaaaaaaaaaaaattaaagctgagttgaaaacgacagcttcttcagaaggtcagggcacaaatctctggtagcaaagcacaacacagcattttagagataaaaccttattacccaaataccgctatttcacagcacttaatattggatggtagtaaatctgcctgaggacatattgctctcatcctaggatgagtccaaaagattttaaccaccacggcaaagtaggggtggatgagaccatatgcagatgagcgttttagttcattacaactggattcatatatatatgaatttcatatatgttatatatataaatatatatcatatattcatacaggtaatatattcatacacacacatacgaatcacatttaaaaagactgaacttgtacagtaaataagggttgtgtttgcttaatagtcatggtgagaattaaagcaggaaatcttaaagaagttatacagaaaaaagcatctttattttttgatgtgccccatttttacctactttttacctcgctcaaacaagcacatgtatcaagcttcacagaacagaacaaacctctaagaatttcacttcttaaatagatatttagaaagagtatacgaatctttttatatttggcttaaaacatcttattagttacctataataaggcccaacttagaagctaagaaaccctttcttgaaaagcatgagtgtgtttctaaacaaatacaaatgcaatgaaatgaaagaaaaattcctctgatatgaaatgcctcctactgactttgtactggaacatttattttctttgtgtggaagatgtaggcagcatactttgcattaactgattatttggaggtatggctggaaggaggggactaggaagagaattggcttgatgcctgaactaatttcaacttcatttcatccaaaggcaaagggaagaattggccagtctttcagtgaggtggatattctttttcactcctcaaaaaagtagataattctcaagtgtgcctaatgtctgtaaggctcatttgacattccatcccccatttatcaactataaaaccttgtcccttgtctcggtatttcaccatgttaaaaggtatttacataccagtatgcaacctgaaaatagataaactaagtagacccaaatggaaaaaagggtaggcattgaatcactcaagaaagctgctatcttgtctaccccatttatttcttttagccccagggcaaaaatttttaaaagacagtggttgaattatattaaaggggatacaccggtagtaatttagcattcattcttttaaagttgttcttcacaatgactctgagaaaggttgtagcagtatcactgcatcaaaaataaagcggggaaaaagcccagataaattaaatagtggtctagacagactcacatgacagttctgccacagagtgggtaaagagactggatgacagacactgagcctgaaatcatttgggttataaagataaaataggtttccttcattaaaaattaatcaaataatctagactgggtggcttagagtaacttagtagtttgcaccactcagcaaatttgtattatggcaaccaacaaaatagaactacaggcatgtaagaaagaggctaacatagtcatgctacacaggtgacaatgtttaatttttgagctgagtttaaaagcacagtgtgtaaacttatattatgtatgtattctttcgaataactatatccttacattcagtcactaattatgtggttttagtggtcagttggagaatatgtatataaacatgcacataaaatcagtggattgtaagctacaacactactctaatttcttttgtctttactcttgctcattcattcaattcattaatttattcattcatttattcactcatttatgtatttaaaaatatttattgaacaccttctctttacctggcaataggtgacatgctggatatatacggtgaacaaaacaggcacagtcctcactttactgggttctcattaaccaaagaagttttatagatggaaaggattcacagctataatgttatataagttatttaaccgctttgagtctcagttgtctcttctataaaatggggttagtaatattttccttccagaattattatgttcccatcttgttcataatacgtatccctggttatctggtatatagcaggtactctatgtttattacagaactaatgaatgcatcaaaaatgaatatataggtcacttaagcaatgggtccacattatacagtagccagtattatggaaaatattttctcctcctttttaaaagtcactgtcacagataacaacaataaatgtgacaactcatatatgtttactctcacttatattccttgctaattttttttttttttttttttttttttttttttttttttgagacggagtctcgctctgtggcccaggctggagtgcagtggcacgatctcggctcactgcaagttccgcctcccgggttcacgccattctcctgcctcagcctcctgagtagctgggactacaggtgcccaccaccacgcctggctaattttttgtatttttagtagagacggggtttcaccgtattagccaggatggtctctatctcctgaccttgtgatctgcccgcctcagcctcccaaagtgctgggattacaggcttgagccaccgcgcccagcctttccttgctaacttttaaagataatatgtataatttttcaaattttatatttgaataatgctgagagatagagatagagtaggacttatcagccccattttccaagttaagctatagaaactcagtggtcacttggctttctcaaattaaaacaatcagtggtgaaaaataattctgggctgggtgcggtggctcatgcctgtaattccagcactttgggaggctaaggcaggcagatcacctgaggttgggagtttgagaccagcctggccaacatagtgaaaccccatctctactgaaaatacaaatttagttgggtgtgatggtgcacacctgtaatcccagctactcaggaggctggggcaggaaaatttcttgaatccaggaggcagaggttacaatgagccaagatcgcgtcactgcactccagcctgggtgacagagctagacttcatctcaaaataaaataaaataataattcctgaacccagattttctcattaagctctcagtgctttcagagaacacctggggagaggacatgtcaatgtcccattaagttggagactgattagtcaactgatgaccagtgatgcctgtcttcaccaagatttttgctcctaaattttgcatgaggtcaagcagcctatgagttcacaactctcaatctactgcacaccagacacttacttttgaacttccatgctcctagggcaaacaaacaaaaaaaaaagttgtcgggctgtgtttcgggagatgttgactcattttcagcacatattagaggcttaaaaagtgtttataagctgaataaactaatgttcttttcactaaagcagtgcttgaatgtattgcttaaaatgaggcagaaaattacattcaatttgaggtagcaaattaaattgcccttgaaggttttttataatctcgtggtattcatggaagagacagaccaaacatataacacacacacatagacacacacacgcaccccacacattagtgaagaggagaaaacaatttattctacctaagaagaggggaaggattatgattctaaagttctaaagtctatgctcttttataaaaggcaatttgttacaaaaaagagaagagtggaaggagagcaaagaagaaagaaggaaaatattggaaaaaaaacccctaatatttgcagagagacatgactatgggtcatggactatgctaggtactttctttatgaaaaaaagtgagtttaaaagtcagtcctcaatagtagcatcctctgctacttattatatgtttcattggtaagatactattttctgagtctgtttcaacatttgcaaaagggcataataatacttcatagagttgttgtgaggcttaaaattggttaaaatgtataaagcatctgtaatgcactttgcaataggcatgcaataaactactcctctttcatattgataatttcatactgccttgggttatcagatcttggtataaggtcacatattctctttataatgcaaaagccaagtcaaagccaagtctatgctgtgcttggagtcataagacaatattacttttaatcctccattaaccctggatcctctacagctgaaccctagaatcaaggtataaggcctcattggcagatgaagacactttaaatgtagtcctttcactgagttttgtatctaagctcctctgctccgggtactgtatgaatcctgcttacattcaatccaactctgtagtaaattgttattcagagtctccagtgtgatgctggcctcctacttcagaagaagtgctccaaaaagttaagcctcaaagatatattatttaaccaatcccttaaccatttcttttgcatgaaatagcggcccaaaaggcaactaagtacatagagatgattttttatatcttaatatatttttcctggcaaccactgtaaatgctccataagcaggtctacttaccacatcagaaatataggagaaattttctgaagttgaggcatgtgctttcattagtataaaaatgtgtttcacaaaattatttttagaatgtattctactcacaaagaactaagcaagaaattgtcaacattctattttgtgattcatgcatgtaaaaataaagtcggttgagagctattttgcaatattgaatctagcaaactgtcattcaaaagagctctcctttcaagaaaacaaaaacaaaaaacttcagtgaaggatactttactatgaacctcaggtgatagatggtattgttggggccacaaagcctattcaggtggcgtgttcaggtattcacctttgaaatgtactgaccactaccagcacatgtttttttcctatgttataggtttaaccagaaaagctacatcatccaagaaagctctggagaggtgacataaaatgtgatctccgtgtcctctgataaaacaaacctctccatgagttgttatttctacctgacaatggaaaagagcagactccccttacctcacaggttgtaagatccagaaattccactgtgattctaaagaacctcattctcacgcttctatcatatcagttgctacataaagaaacacaatatttgttgaatatttacctcactaatctctctagcagggtggaaaataatttgtattcatctctggatctttattgtggaataaaggtttctgtcatgatagacgcttaacaaatgtttagtgaaggatctctctccttcccattttctctctttctttaccataaacttgacaatagcagtcccacacggtacatgtcaaagaggtcctagacttccataatcagggacctctttgattatttgatctctcatggatatcttattttgaaatattgaatctgccaaacaaactagatttattgtctttagacatggcacttaaatagtgccaacatttttttgcgtaaatgtgataagaaatcatatttgttgagaaataacttgttttcacttttttttttttttttttttgagagggtgtttcgctcttgttgcccaggctggagtgcaatggcgtgatcttggcttaccgcaacatttgcctccagggttcaagcgattctcctgcctcagccacctgagtagctgagattacaggcatgtgccaccatgcccggctaattttgtattttcagtagagacggagtttctctatgttagtcaggctgatcttgaactcacgacctcaggtgatatgcccgtctcggcctcccaaagtgctgggattacaggtgtgagccaccgtgcctggcctgttttcactttttattagtcaaatacatatattactgccagacaaggctcacgtgctaaattccagtatagtacagttagaggtggttgtatgcaaaccaagggggattaaagctgagacagcacttataatactacaaatccaacctcacacacacaagtttttggttacccatagcttttatgtagcatggaccataacagaagttgccatgtacttccgatggtgcttcaaaggcaagcaggtgagaatcagtgggccttctgtgagattattatgctgaataaagtgaccctccaaacagaggcttctagataaacaacctaagccactataatttagaagatgtagttatgatgctgaggatctttagggtcagcaaattttgagatgggggcaagtcagctgtaggggggtactaggatctcacaaggctgaaagcctagatcacaagttctaccactgtaggcttcaggcacagctgtcaataagaaacccagtggtcaggaaagacaaagaaatagccatgcaggcagcaaggactcagaggacaacacaagctacaggttcctatcaccatagaggacacataagatttcttatccttccaagttgtttggtcaaggcaatgtgaagatttgttgacatttaaaaatagccctgataagaaatttgaacagtgaaattaattgtttttctagtgtgattgttaaatagtaaaccagtgtgattatggagtaatataatgaatttatctgaaaaagactgctttaaattggaagaaatcaagatacctttgattctaaaatcaagttttttcctccctttctttttttaataaagaggataaaatcagctattgaaagtttttaaaaattgcatttttactttgccatctctgaatatgtcaaatcccgtttgattaaacaacatggaggtcattggaaaccttagtaagaactggagtgtaactcatggggcacagtaaccattgcagggtggtttgtggagtgagacgatgatgaagaaatggaggcagcaagagaaatgcagccacgaagggtcaggagaattagtatagttacctggagggatggaaaaaaggactcttttatgttagcgaagaactgaataaacttaaataaatattgatggcagaggtcaagaaacaaaaagaaaatttatgaagactgtagatggaaaatacagtagaaaaaaatgcagagacatgtctaacttatctcaaggagaggctggccttttaaagcataataccaaagaaagaaaactctaaaggaaatactaacagagttaactacttgtatgcattggaaatcatctgatacaaaatataaaagacaaaatattgatgggttgtatataaagattttaaaactcaataagaaaaaatgtaaacatgccaactaaaaaacagaggtgtatatatatcgatttcagaaaagaaaaaatatttcaatccaatttgtaaacgtatgaaactatattcaacctcattagtaataaaatgcaaatttaaacaataaaaaacaattttgcctatcaaactggcaaagataaaaattagactatgttttttcctttgtagtacttaatttacaattattttataaactgatctgctcagttattttagtctcttacccactaaactacacatttttggggtaatagaatgtctgtctagttaacttttgtatttacaattccttgtacaatgttgggcacatgatgggacttccataaacatatattaatgaataagtgaatgtcagtgagggaacaaggtatttgcatactctgtgggagcagcaagtggtacaaaccaatctagagagcagcttgaaaatatctagccagtgccaatgccatattcgtcaagctagccattatagttttaggaatttatccaaagtaaacaatttttgtataatctaggacaaggatgtttatcaaagggctatctatattgtgattataagttatacattgtgatacacgttagaaggtaagtctgcatgacttcagagagtgcgccaaaccactacactgatggctttcagaggaaacccaaatggtgaaatttgttgtttaggactaggattgaactctcagcatacccagttctgacatacattccaatactccccagtgatcaaaaggttttcctttacatttagctccgaattaacctttctaatccttcttctgctaaagctctatgtaatcttttagtgctctaaataataattttactgtctcacagtactggaggctagaagtctgaaatcaaggtagtggcaaggttgattccttgtgagggctatgagaaatgatctgttccatgtctatctcctaacttctggtgatttgtcggtaatctttggtattccttggcttggcagatgcatcactctgatcttggtatttatcttttccttttttctgtacagacaaggtctcactatgcggcccaggctgcctccaactcctgggctcaaactatcttcctgcctccaccttcaaaagccctgggattacaggtgtgagctactatgctcagccttctgtctttgccttcacatggtgttcttcttatgtgcgtatctgtctctgtgtctaaatttcccttttctgtaagaaacagtccttattggattagggcccaccctaatgacctcatcttaacttcatcatctacaaagaccctcttttcaaataagatcatgtttacaagtactggagattaagacttcaacatcttttgggagggacataattcaaacaataccaacgcttaacatcttctaacatattctaaaagctttatttgcttatttatattatagatgttcccccttttcaatgtttgctcaaaggaggcaggaacattttacttattcattgttatatcccagggcataaaatcgtagcagccaacaatagatgtttaataaataagtgtggaatgaatggactataagccatttaataggggtagagagttggataagtaggaagaaggtgtgagatgttagaccagtagctgggactcagattaaaggccttttgtaaccaatacacttagaaatttgtctagctagttgtatccaatatctgcttatatgaaaacatactgatttactgtgctaaatactgtcaatgtatactttgttggagtattttgttaatttgctgcattttagtgatttaaaagtgataaggtatttttatattattgatctctcatacaatcctatattttattcactctctacatatttagtattacctacagatttaccaaaacagctctttaccacttaggagcctacttgtcccaaaaacaattcttccttctagaaatgtgaataatatatgtatgactgggtaaatctaactgttctaatttgctttttctctatcaggtttcttttaaattttttcggtctgcattgggattgactttaatatattcaagattcccccaaccccccttagttacatcatggtataaaaagttttagtcttcagctaattggatcaatcaggcatttagggggcaatatacacttcattgatataatcaagcgaggctgtgcagctgggtaaaccaaaaaatcacaagggggaaaaaaaacacaagcagtagccatttaagttgaaaaaacgtgtatggttttaaaagtacttcctccaacttcagagttcaacatacaatttataaaatagatcaccttttttggcatgttctgctagaaacttctaagttgtcaactcgttttcttaaaagcagtctttttatttcagcctaatgatgctgagcccagagaaagtcattcaatctgctggcagatgaaaatgaagtgaaacagtacactaaatgggtcagaggaaaagttgtttcagggacctaaacaggctttcttttacagtttttttcaggatgactgaagagatagtattatagttagatgtaatacaacagaacgtccttcaggcccaaaagaaaactttgaaatctaggaaggactaagaagtcatctactgaaccatgacacatttacagactagatggcatatgtccaaagggtgaagtccctgcagtccttctgggggagctttaagaggatggcagcaggaagaagtttgggtattcaggaaggcatctgtgagagaccttagcctgttacttgaattttccagggtgatctcaaggtcaattatacagtctcattatctatataaactgtccaaatgtcccccaaatttcaatgcccaggctacatgtctcagtactactcaaacctgaatgttgtacataatttcattttcaaatgatatattccaaagacagggtacatgatgtgagatggcctgtcatcttgcctcaaaacagccacgtcaggcagaagagtgtatggtaagaaaagaagtatatagttgctttttttgagaacgtaaattatgcaccactaaattcatttaccctgaaaatatttatagtatttttacattgtattagagacaaactgaagagataatagtaaccttaacctaaggtttacagggaataagatctacattttgccgattatggggtcttaaatatgagtacactttccctgcactcctccttgcccccaaaagcacttatgaaagtgagtgaactatgaattatatctcaataaaggactaaatttctagaaacctggtctttctacaatctcgaacttagaattttcataagacaattaccatatagtaatatataaatcctatattaaatagttaatattttcaagtactaaagaaagtacaaacacaatatttagtactataccaagtatttagaaatttctcaaaagttcttgctcataaagctattccctaactttatcaattaaaaaggtattcttgagatagcacatagtgaatttatgccaggacacacaaacaacaggcccagataggcctaccataattacaatctcaagaagggggagtatgagtctgaaactatgttctacacacaagtttccaaaaattaataaaatgtttcaaagtaagtcaacctatgacgttcttaaaaaaatcattgcaacatttttattctacatagaaacacaagttaaacatttgcttatccccttggaaacaagagaagaaatcacaccttcaccaacacctacagtaggcaaagatttattttaggcattgtcaaggatacaaagaaatacagagcacagtggctacacagggtgatctgtcagctctgcaactgtaagaaattatcaaacatcaaacatgtacaagtggaaaagtatatatatatatacacacacacacacacacatatatgtgtgtgtgtatatatatataaagtatatataagtatacgcacacatagacacacacacacacacacacatataaaaatctgtatatgatcgttcttaagcagctactaaggtaaaataatcatgtattactgcttctttagtactctatttgtgtccaacttgtgacctaaatggtcgtaacagcagaaataaaccactgctctccaaaacagacaaaaccaaactacagggtaaagatgcatgaaatttacacttgtaaacttagaagcaaatggccccagttgcttctcttcttcagtttgcttttagagaagtatctcattgaaagtggaactacctgttctgagaaacaaactcatacagagaaaaaaaaaaagtaagaagaggtcattattaaaaaggcaaacatattacaaaacatagggttaagatgatgcaattaagatatttaaatcagaaaaaccaacacatacatgtacttcataaatagaccagtatatgtgtagcacaccaacacacattcccaatagtgatagccagggtgtgtggtgtcttctttgacaacatctagaaagggattagagaaaacataagtggtaaagctggttttaaaagaagaaaaagatgaagttcacatacaggcagaaggaggcagcttaggaaacatgagcatgttgaagaatggagaaacagctgtccagagaaacagggaagacaggtcagtgaagtggcaaatgagtcagcttagattattgacgcctaagataaagttccaatgttctaatggtaaatatgccatagcatcttctaaagtaggtctgagccctttgagtggatttgtatgttgcgtacttgtatgaatgtttatatatacatacatatacatgtatacacacacatacataaataaatggtatctattttttcgtgttcctaccatgagcaggaagttttggtgtttctttcaccctatagaatttcattcattcattcattcatatttgtctagtgtttactctcagtcaagtattagggcactaggatcataatgatgaaccacatctgagtgtattgcagcaggtatgaggtgggggtcatgggagatgcagatggaaaggtgactcagttgtaatcacaatgggccttatatgcaaaggtaggggaaaatatttgggttgaagagcaagaaatcaggaaacaaaaggaccaacaaaaaacccaaacagtgatgttttttctaaacttaaagtcaccagtcactattgattttcctgtacagaatggttttcttttgtgatttttcaaaattacttatttatcttttaaattgacatataaaactggatgcattatcatgtatgacattatgtttctggccatatatgtatgtgaatatgacccttcttctacttattgttttttttttgtcataaactacaaaacgtttgaacacgtacacacacaaataaacaaaagcacaagagaaagatatttattctgatttgtgtatcaggattacctctttattttaattttgatgtctcacatgaagctttccaaccctttctacattctagatgcttacatatatcaaaagcagggcatgacctgttttttgttctggctttagctttagtccaaacggttaaacagctggaggtaattatcaaagaatttagtatatgcccagcctattctaagtgattaaaaaaatgttcagtttcacattggattaccactggggcaaagcagattcatcagggtgttggcaagatacctgatatctataagctttaagcttgtagttggagaattccaccatgcgttggggtggtaatgtgcagatgcttagaaacatacaagaagcatgataaaataatttgactccctattatagtctcctcaccttctcagttggcaatgattcctgaacacacacatcacttaaagaaatgagcacaaagataacgatacataagaaaaactgaaaaaactctgtcactgaatactaacaatttttcttttaatatagcccttaatttattgagaacctactatgtgcaaaacactgtgctagtaaacagtatattcactggtaaacaaaacaaggatgattacctgatttcagagtttagtatctaatgacagaagcagatattaaaacaagaaataagcaaataggaataaaatagccagtactaagtgagagaacaataacaggggatagctaatttgaattggaaggtctaacacagtttctttgagggagtaatggttaaactaagacctgaaggatcactaaaaatgaagtggatgaaacagcacttcaacagaattagcattattttaaatcttggatttttacggcatgaaaatatccatgtgtcttaaacaggaaatggagaaaagtaatcagattattagaagtaagcaaacaaccagaatatctttaaagaaaagctatatttacagaagtaggtctgaacatcattgcctttgaccaaaagtcattgtaaatgtattgaatagttgtaaaaaataaatgaaagtttaaacagttaagtcgaggttggcatgctgtagcataggcaaccagacaggaactttgaaggaatacttttccctcaaatgtttttcttctgagatagcaataatatgaggccacaagaatcagaatatatttaaaatgtaaaaagcaaatccaaagtctaatatcttcaacaaaacaaaattccagtgaatcccagggcaaccagaggaggaaatatattctattcttattattgatgtttttagttttagaggtgtaactgaggtcacatgacttcttaggatagtgacaaacaaagaaactggtagaagtatcatctcaaaatggccagtgtgggctataggaggtttgtacctgctaaatatttataggattattttatttaaagcattctgttttaggttagagttggttccaaaccacatacaaaaaattgtgtaaaaagttggtagctaaactggaagcagttcatttccatttaaaactacttcactataaaattaatcatttttgttttggatctcttgagagagaataattttttccttcttcttcttcttctacttcttcttcttctaaatagagacagtgttttgctatgttgcccaggctagtcttgaactcctgggctcaagcaaccctctcacctcagcctgtttaatagctgggactatagatgtacacccctatgcccaggtaaaagaagacatattttgttcaaatatttcatatatttcataaccagacaaggaacaatataggatatctggcttttaaactaatgaggtagctgtgttgagcctgggtaagtccttgtaactctgtgacattccatttcttcatttgccaaaatccgtaaaaatgatagtgttgaattagctgtcaaccttatctagctctaatattttctgattcatgatatggatttcttactttggtagatacccattttcctttcttccttcaggtatttcttactatgtgcctgtactcggttagatgctgggaattcagctacaaaagatactaccctcaaggagctctagttgagcacagggaaggaatggggtgactgcctaggaaacaggctatcatgacatagcgtgaaatgaccttgggtgctacagtaacatctagggagagcttctgatccaatcagaaacttaggtagaaacagtcttcctgaggaggaaggaataaacagattcattttgcaattatcatgtcacagcaacaatacagtttacttccttggactattttcttaggctcacacaaaagaatacaggtaatttcaatttgggttaagaagtgctatttattaaagcctaggtatctactggaactcagtggatgggtatagtcagcatgttatttcagggcttgacaatgctcaaaagcacattcatatttaaagcttagcttcttatcttctgaacacccaactaggcacacacacagtgtcttctaacctggttaattccaagtcacccagtcagcagggaactaggtacagttcccaccaccaaagatttgaaggtctctccttcccagataaaaatagaattacatcacatgtagtcttgtctcaagagacctcttttgttatctgtgtgtgtgtgtgtgtgtgtgtgtctgtgtctatgtgtgtacctcaactaatttgaaatggagactgtttttatgtttgtacaactgatatatttgtggagtgtcctgatacttctacaacggaaacacctgctaattccaccctctcccttttctgatggtgcctgaagtccagccaatatagggtagtcattacagcacccacccagactagccaaggggtgaagggcaatgatcattttgaatggcaattgccatcttaggaggaaacataaagtggctttcttctgtttgggtgactaaagtcaaaataaatctgctctattccatttcatttattactatctaatatattacttatctattaggttagtttacttaatgtttaccccactaaaatataagctttctgagagtaagaatttttgtttactgctatatgtactaagcctagaacagaacagaacagaacacatgataggtgatcagtaaatacttattgactgacagactgagtgaataaatgttgctcaaccagcagagactcaacatttaattccctgactaggtagaatctagatggaaaattttcacccataaatggctacaaaattgtggcagggaagataactaggatgctattttcttttctatttaatcaaatatacgttttttaaaggacaagaaaaatggggctgttattattttgagcagttaccaaaggaaatcaacaagtactggacaggggtcagtaaatcttgacgaagacttttaaataacaacagaggggaaagaagtccaagagttaaggattatgtcagggaaggatcctagaaggacataatatcaagttcacatatgaagtttgagcaggcagtagtcaggcaaagagagtagggcatggagaagggcatttgcagaaaagaagagtgagaaatgcaggagcccatgagtttgaaaaattccacgtcatgccgtgtggttggagtacacatgcaagaagggagtggtaagaaatgagctggaagcttcagtgagaggtcgaacatgtaaggcttggttgccttattccaagaaggtcggaatttatctaaaagtcagtgggagcataatgagtattatggtttatttgaacaaagatcacactgggcgcagtgtgagtaatacattgtggggacttaagcctgggacataaagactagttaggtggctgctctaattctgatgagacataatggtggcttgaagtgggtagttgtgtctgggaaaatacaggtggaatttaagagtaatttgagaggtggaatttataggacctagtggctgactagacgcaaacagtgagggttgttttctggctaatcagatggcgatcccaaggtgagaatataaaaggagaaagaatgttctagatatccacagttgcatgatttttctctatccctggctttttcatacaaaccctaaatattgagtaacttacttaacttactaagccttagtttcttcatctgtataatggtttaaataacatctaccacataggttcacagcaagaaaaatgactttcatagaagttatcaaaatagtagggatgaattctgaccctaccatttaataaaaatgtgattataaatttgagttactttactaaaatcttttgttttcctattttgaaaatgaagataacaaaaggtaaatgcttgttttttgtggaatttaaataacataatggaggcttcagtagtacatctcactatttaggagctgttattacatcatcatcacatctgtgctataagaaaatgagatatgagaatctattctatctagtgaataatctaacgaagtgaaggatatggtttcatagactcgagaaggacaatatgtaacatgttaatagtaagtacatgagacaaaaagatgaacaggacgtgactggctagaactgagatttttaaacaaaatatgaccgtaaacagtgggtcagaaactttgcagttggctaaaagttaattgtgcttatggtcaaggcaaagtctctggagagctctacgtggcatgggaagtagataatagtactttgttaaaacatagtgtactctcattcatgctcaataaaacaggagattcatttgctgggagctgaaagatctattgcacttactctactcatacaaagtaggaggtaaaaatgtctcactgcatttttcttttggaatttctaccagggattctggcctattcaagggaacctcatgccaaatgcagaactgaagggaggaggcacagcagaaaaaaaacactacaaactattccacaggctcattctaaccagattgtggtcccagggcaggaaagggggagcttttgatgagaatcacagattttctggtatgcagtatgtctttggctacaactgtgtaggttgtggcaacttaccagacagccagaaaattctgtggtggcttggggcctggcaattcagtggtggcttctaaatctttagaaggctcaactttctcttgaggttttgaaactatgcagctttgacatgcctcatatgaaactgtctaagcatggttatttaatctccttttctggactttttaaaactcacaaccatactctatcattaaagagaaaaaaatagccccatgtattcacaaagaagctgagttttctgtgaatgaggtttcggcaatgctggagggcataattttcaggtgacatgaccaaattttatgtgtgtgtgtgtgtatgtgtgtgcgtgcatgtttcaaatgctgtctgcacatcttgtgttcgttattacaggagatatttcatagctcaaacaaatttaggaagcaccaatttgttctcaaggttattatcaacagatgttttattattttgatcacacaagacaagtctctgaaaagacctgctctatatggggcactcaacataaactaatctgaaagtatgaaagaatgcttccaccatatggttcagtctgcatgtggctataaattgtgcattctagatgtgaactgggttaatattcaatttcctttctcaggattctaagaatgatacacagccttctaagactaattcattaattcaataaccttgagatttaaaagatagctgatttcacagtcagtgctgccttcatttaatgccattactctttcttccctactgatcacaaatgcagattctatgttcaaagtgagaaacatccccttagaaaccagaggcaagaatccccttgttagctgttcaaatgccaagctttccaaagtgaaaattataatactatgtgaaacaatacagtcagccctgataatcagtagaaatagaaacactgaaaccatagagcaagtggttctttgtgaaattttggatttgaacaagtctcagttcaaatctcagctctcccacatcctggctatgtatgcaatcttatactagttacttaatcactcaacaccacagtatgcaaaatagatatgacaataattacttcagagttgctgcaaggaggattaggtaaggtaatacaatggatggatttaacaacaaagatcagatttccagaacatttggggaaaaaattcccttcttattcagaacagccaagtctgagtgatgcataggttgtccaggcagagcagtatgctgcatttcaactgcatctgaaagtgttgccaaaggatttgatcagttcacctaggagcatcctcgaggttccaccaaacatgataggtcaaacgtgtgttgtaatgtcgatcaaaccaaacaggctgaagacagcccgtccctaaagtaatatgcttgaagagaaggggattaactaacactgacacaagtttaattttgaagcagtaataaatagttctcacaaaatattttgtcacctggatattttatcattgaattcaggaatagagaaacatactacaactaggaaacattcactttaggccaggcacggtggttcacgcccataatcccagaacttcgggagtctggggcgggcagatcactttatgtcaggagttcgagatgagcctggccaacatggtgaaactccatctctactaaaaatacaaaaattagcctagcgtggtggcacatgcctgtaatcccagttactggggaggctgaggcaggagaattgcttgaacccaagagggggaagttgcaatgagccgagatcatgccactgcatcccaaactgcatggcagagtaagactccatctcaaaaaaaaaaaaaaaaaaaaaattcactttaacaactggccaatggaaaaggctgggttttcattttaccacagcaaagtgaataagaaagattattttttccttttatcaggtttgtatcatggaatagttacatagaacaagaagagtcaagtctagttgacattttatgatagcttgccctgatcatcccattcacatgtctgtctccccttctacctttaatctctctgagggcagagactgtctcattcatttcctattcacagcatcttacacacccgccacagaggtgatcaatttacacttgttgaataaacaacccatgaattccaggcaccacagtaggcattcaatgcatatttataaaatatgataacattttaggagggagaataataatcaggagcattgccagagggaggaaaccatataggaaatagttaaagaaatgtggaggtagatgaatcttcagaagagaagacgaaagggaagagattgacgctggtttctcaaggcctataacatgaatagcaattggactagtagtaataataataattactattaacaaattattatataatacttattagggctaggcactattctaagcagtctattttctatttttggacttacttagtcgtcacaggaatccttggaggtaggtattattatcatccctgctgtacagatgagaatactgagccacagtggggctcacattcacaaagcaggtaagtgttaaagctacagtttgatttcaggctaaatgactacaaaggccacactcgaaacactttgctgtatttgtaaaaatacacagaatttagtagaagaaaattcaaaccagtttaagaaaacgctttcaaacagtaattgttccaaatttagagggctaaagagttctcactggaagtacaagataaaaacttggtatgtagaaatgtctttcatagtacttaatatttataattgttgcttttagaaaagtaaatttaaatactttggggtgatttaaaatccaattttttataagagaactatttcttttgatttcagcttagtttggatgagaaatcaatgaccatattttgacattttcagttagtttcacctgagtaggatgattaactgaaattgtatgatattaaaataaaacaaaaaaaccacagtcacaagagataatgggaaaggaatcaagctgtaagttaaagatgtgaatttcagactgccctttgctatgtattgagtgacccttgggaacccatgtaaacacctcctgagcgtttgttttcttatttgcaaaatgaggagcatcatgtttccttttcctatttcacagggcactttggagaataaaatgaatatctaagaaataatttgaaaatagtgacgtaatatgaaatatgagatgtatcataatatatacattatgtcaaacaagtaaaacaataatgctgcatgcatacaactaagcatctcattgattttaagtttcagaaaatatagatacgtttttatgagaaaaatgtctacaacacaattggaacactgatttaactgtattcctattcacgagttccaaaaatgctaaacatgcaggatgtgatgtcacttttgttattgtttttccctggagttagggcaatgttacggagctttgaataagttaggcagatgagcagggagaagtatggcttatttcccaaacattaaggaataatcacaaacaaaaataaatgtatctctatctacctactgttttcatctttctctctcagctgctttcaggctttcaatatttacctttgttatctggcttagttttccttttgataggtgggcttaagtcttgaaggcaatctgactatatcatgactagtgagagaatgaatatattactccaaaaagtcttccatattttccatgtttgctggtcacatcttagtgatttaagacagattaaccagctctgccatatacttgttatgtgacccgggacaaatgtgttaacttctttgaaccacagtttgcttatctataaaacagaggctcaaaacttatgtaacatgcttattgttaagatataaaagagccattgtagagtgattagaatataaggtccaaacttcaataaacaatagagagttatacttactgttacactgccactgctaccagcactagaaacagatgcactgagcattggtcccaacctccaaagaatattcttttttcttatttattttcctatctatctatctacctacctacctatccatccatttactatctagtgacatgcataactgcatacaattacatgaaagaaatatatgcatatatataatatagaatatagaatgtatataaatatatatgaaacaacatacttattaaaaagtatgtaaatgaaaatgtatagacatatgcatacatatatttgtacatatatgtttatacttgtatatacatatttgtatatctgttacatatatgcataaacaaacacacactctcaggaggaaaaactagtttttatcctttgtcttttgctggaaagctaaattgattattctagtgataaaatgccaaatgaaaaaaaataaactaaggaaaaatttagccctttagggccttaaacttttggactccagattttcctttggttcagctaaaatcaaagtgaacaggagccaagttagttaacattctattagtggctgcaggtgtctcctcaaaaaaattatttaactactagaggctcatcattgagtagtgataaatctgcttagttacattggttttattgagccatattttagttcataggtttgtatattaaaatatctacaggttttttttaatcaatagaatgtgaaataataatctctggaaactttagttttctaatcataattcagtgattctaagaaaagaacagtactgattccattgttttcaacctggaatttgtatatttaacttttttgttggttatttttgctgtaccccaaatatatctgactttccatctttctagctccaggtagaaaggagatttgctggccgggcatgatggctcacccctgtaatcccagcactttgggaggccgaggcaggtggatcatgaggtcaagagatcgagaccatcctggccaacacggtgaaaccacatctctactaaaaatacaaaaattagctgcacatggtggcacatgcctgtggtcccagctacttgggaggctgaggcaggagaatcgtttgaacacaggagaatcatttgaacccaggaggcggaggttgcagtgagccgagatcgctccactgcactctagcctggagacagagtgagaatccatctcaaaaaaaaaaaaaaaaaaagaaaaggtgactggctttcaggccagtaaaatgtgaataaagcattgtgtgtcattgccagagataaatttaaaatccaggttgtgattacaaaggtgaacacatcacgatgaagtcttggtcagtgtgatgattaattttatgtgtcaccttgactggcttaagggatacccaaatagctgataataacattgcctctggtgtgtctgtgacggcagctctggaatagattagcatttgaatcagtaggctgagtaaagaagttctccctcaccaatgcgggtgagagtcatccaatctgttgaggtcccagatagaacaaaaaggcagaggaaggacaaatttgctctcttctggaggtgggacatccattatctcttcctaccttggaacatcagagctccaggttttcagacctttggtctctagattttatatggatcctgccccttgttttcccctcttctcagatgtttggcatcagactgaattaattgtaccactgactttcttagttctctggattgcagatggcagattgtgtgacttcttgtcttccataattacataagccaattctcatactaaatcccctcatatatatatatatgtcctactgattctttttctctggagactctaatacagtgagtctctgtccttggaagactaaaataggagtaagatataaacttgcaatctggtaggtcattgagatttttcggtaacctatcctgactgatacagtgtctttgtagaatttcagtttcaacgttgagcatctaccttgtgccaggtgctgggaatataaggcgaataaaatatgatgctcattttttagtcagtatataaaaggtaggcacatgtgaacacatgatgagaagaaagccttgaagtaatgaagagaagggacaagctaactctggggatatttgacaaggcttttcaggggagataacatattagctgggttttgaatgataagaagaagttgatcagttaaaaatggtaatagagtgaagaataattttagaatcaataaatctgattggtaatattgagttaaatccaaggtgacatttttctaaatgactacatgtgcatttttaatttaagctaagtctatatagaccaaacatcttaaactttaaaaccacgtaattcaccaaacaggttttaatgcctattttcataatacatacattcttttccttcaaacaatagataatttgagagtttaaaatgcatcaggctcatcaacatcaaggtaaatggataaaatataagcttgtaaactctgaattctaacaattgctcaaatgcttgaaataatttcagtttttcctaatgtacatctctgtgtaactaggctctatttcgagctactagtgtttttattacttctctgtgcgtttttccttttcctttcttcccactgaagcaggtattcattgtaggaggaagcagggagaagcagggttgaactcagaagcagcctgtaaagatttccctgcttttgttttcaaaacctaataaacacgttagaaaattaaagggtttggggataaggtacaatggagaacaggaattctctacaaaagcacaaagtcttgatgaagaagagaacaagagtgaggtttccaaaattgggggtgggtagggtgaggaatgattatgttgactaagaaaggggagaaaatatctgtcagagatggacattttaaagcatgtctaagaagttggggccctatgcagtttcctaaaaatttcatgacctgctatgtaatagggttttgttgtttactttcatatgacaaaagcaccaatgcaaactggctaataaactgtattcatagctttctgtaataaaaattcagaaggaaagtttcaaagatggtttgatttacggtctgtagatgtcaccaagcctgttttcttaccttcatttatctattctgccatctaaaatgctggtttcattctaaagatggaaacccctacagtcacaaaacagcttcaagctactcttccagatacagggttccttacttcgtgctcatagagaagggtgggcttctgcctcaaagttctaagtaagaatcatggaatttgctctgattttactggattaggttgcatatccaccactaatggaggccagggtatcaattggcctaaatcagtaaaaacccacccttgcaattcagagtcatgtcagcttctagcaaagcacagggattatctgaaccaaaatctagggacaattaggaaggggtaggaagaataacatgaggagataaccaacaaaggtccactattgaaagaaacaactcagagaggggtaatgactatcacagcagttatttgtgaggataaaccaaacaatgtgtgggttgtcttgtcactgtgtaaggacatagaactgctggacaattctgcagatgactgaagtagttgggaaagcactaggaatgactgaagttatattttttgccagcctgagagttaagctacagaaatatagagccaaagctgttatgatttgttcagttgcaaatagcaaaatttccagctttaccatttctcaagacctgtaatctagtgacccaggtattattcagatgttagacctctttgtgtattccctggatctttgttatttccaatattctcagaatctggtaactccatcagatcctaaactcgtacccctgagttagatattttcttgccaaatctccttagccacccacaccttgtttttacaaattatggaaataaatctactttgattagaacattcaacttggggatacagctttgtcatttctatgcaagtctttccattgcagattttgtctaaaagctgttagttttaaaagtacccttatacagtcatgtgttgcttaatgacagggatatgttctgagaaatagattgttaggcaatttcatcattatgtgaacaccacagaatgtacttaagcaaacatagatggtatagcctaggctacatggtatagaccattgctcttaggatacaaaccagtacaatcaatatgttaatactgaatattatagacaattgcaacacaatagtgaatatttgtgtatccaaacatagaaaagttacaatacaaatagggtattataatcttatgggaccactgttgtataggcagtttgtcattgatcaaaatgttgttatgtggtacatgactgtcctagcattagatgtgctggtaaaaatcagggccatgtcaaagatggggtaatattgtaacaagtgattcgcagaagaaaatatattggtcagtttagatgatgtgagggcagtaagacttggactaatgaactggaagacagcacttgttaataatcaggtggcagagggtttgtgaggcgagagaaaggagataactcagctgagcacttacagagaaaaatggagaaggctggagtcagcagctgaatttcagctaaatgcattttgtgccgattcatctaactcagccctttgaggtatgtttactaggcacttctcattcctgacactttgatgcttacatctaaagaaaagttagattaatgcccctccgaatgtctgtaaactatatttctaacacacacatttttttccctgacatctgactcagatagttaacactgcaaaagcactttgcacacacaaaagccagctggtttccaaatcagaaaggtttctaggcagtggagacctaaatttgcagacctgtccctagtcattctttttacttgccactttaagaaaaattgctctttcattcttggaagttaggacacagtaatgagttaaaggagactatatgtataagctttggggtattaaggtttatggcaacctgccaatgttgttctactggagagctttgctttatcatcttactccatggtgaaagacatgattagaatttagaaaaggtctaaataataatttaattgtacattttaaaataacaaaaaagtataattggattgtttgtaacacaaaggataaatgcttgagggatggatactacattttacatgatatgtgatattacacactgcatgcctgtatcaaaacatctcatgtaccccataaatatatacacctactatgtaccaacagaaattaaaagtaaaaattagaaaagaatttagaaagaatttagaaaaagaaattagaaaaataattagaaaaataatttagaaatgttgcattgcatgaagaatctatgcaatgcaacatttattttgagaacaggctgtggcaatatgaccctaggacatgacctacctgacaacttcagaatagtgatagctaaagtacaacttcaagatacatttgtataaagccccacttgttggcaagttatacattcctgatttggggtacctagatataagaggaatttaagggaaggctcatgtagacataggaaagagggtggtggtttctgattgggtccttgggacagttataacatgggaattggaagttgccagttttctctttctccttctttccctctctctcatctccagtctctagctttctctgcaggaaggctcattatttcagatgacattacttcatatggcaaaaagaccacatagtggccacttttctgtattgtatgtcacactttactacacagtgggaatgctgccccctctctgctcccatactccactgtagaaaatcctgagaaacaatctgcttggcttgatttcgctcaggtgccagcttctaaactgcacatgtgaccaccaagatagttctaaaactaaagattttccatgctccagccccagaggttcggatccattgggtttagttgagattcatctggtctaattatcagtattatttcttactagctaacctggttattccaatgagcagctctagacaaatcaactgtgtgaccaggggtactatgactgcattctttcccagaatcacggggttggaaagaggagaagggcagttccctaaaaggaggaggatgctttttaaaaagaagaggtgcttttaatgcacgacaaaacactagctgtttagcattttatatgcagagattagaaatggggagtcattaaaataaaatattttaaaaaggtatcagagcaaaatatcatagtctcaaactattgaaaataaaacactgtaatttcttatctagcctggaactaagttctcatgagttaataaagaaaagaaaagagttgcagagtgctatgttattctagaaaaaattatggttgtaaatcaaggacagattccacttatatacttaacatacttaaatatatattaataattgggcatacacacatttcagagatcacttaaaaagcatactattaaccacaaatatagtcacatatgtgcacacatatacacacgcacacaaagtagaagcatatatttgccttttgatatagtcaaataatcatagcctaaagttatacaaacaatgtcatctttaaaaaggtgggggtagataaatgtttgtgtataaacattataatagctaataatactgataatctagtatctagttctaggaactcttttaggcattcatatgttatttttatttttattttttttaccacaatgctatgaagtagatagtagtaccccattcattacagagaaaactgaggctttaacgggttaagtaatgaacggtcattcaggaagtggctgattctagactctaacaaggtctgagttcaaagactgtgcttctttccaccatttttatttttatttactttttgttttataataaaaaaaatcttctaaatttgatatttctgatttttccttggaattttacaaattataattttttccagctattactgtagattccaggggacatgtgcaggtttgttataaaggcatattgtgtgacgctgaggtttggagtacaatcaaacctgtaacccaggaagtgagcatggtcctaagtaggatgtgtttcaggccttgcaaccttccctccttccctctcccctctgatgttccccagttatctattgttcccatgtttatgtccatgtgtatccaatgtttaattctcacttataagtgagaacacacagtatttggctttctgtttctgcgttagtttgctcaggatgatggcctccacctgcatccatgttgccacaaaggatatggtttttttatggctgtgtagtattccatgtaaatgtatgtatattttctttacccaatccaccactaatgggcacctgggttgattccatgtctttgctattgtgaatagtgctgtgataaatatataggagcatgtgtctttttggtaggatgatttattattctttgggtagatacctagtaatgggattgctgggtgaaaaggtagttcaactcttagctctttgagaaatctccaaactgctcttcacggtggctgaagtaatttacattcccatccacaatgtaaaagcattcccttttctccacgtccctaccaacatctattattttttgacctattatcaaaagccattctaactggtatgaggtggtatctcactgtggttttgatttgcatttctctgatgattagtgatgatgagaaatctttcatatgtttttcggctacttgtatgacttctcttgagaagtatctgttcatatactttgcccacattttagtggagttatttgtcttttggcctgtttatttgtttaaattccttgtagattctgaatattagacctttgtagatgtatagtttgcagatttttctcccattctgtaagttggttgtttattcccttgatagtttctctggtgtgcagaagctccttactttaattaggtcccgtttgtcaatttttgtttttgttgcgattccttttgaggattttgccataaattctttgccaatgccaatgttgagaagggtatttcttgggctttcttttaggatttttatagtttgaggtcttatatttaagtcttaatccatcttgagttaaattttgtatatgataaaaggtaagggtccagtttcattcttctacatatgaatagccagttatcccagcaccattaattgaatagggaaccctttccctactgcttatttttgtagactttgtcaatgatcagatggctttaggtgtgtggctttacttctgggttctctatgctgtttcattggtctatgtgtctgtttttgtgccagtaccatgctatttggtttctgtagccttgtaatgtagttgaaatcaggtaatgtgatgcctccagttgtgttcttttgcttaggattccttaggctactcagcctcttttttggttacataagaattttatttatttatttatttattcattcatttatttatttaagatggagtctcactctgtcacccaatgcaatgacattgcatctcgtgatgcaatgacatgatctcggctcactgcagcctccacctcccgggttcaagtgattcttctgcttcaccctcctgagtagctgggattacaggcacacgccacaatgcctggctaatttttgtatgtttagtagagatggggtttcactatattggtcaggctggtctcaaactcctaacctcgtgatccacccaccttagcctcccaaactgctggggttacaggtgtgagccactgcacccagccacatatggattttagattagtattttcttattctgtgaaaaacaatgttggtaatgtgataataatggtattgaatttgtaaaccactctggtcagtatggccatttcaacggtattgattcttccaatccatgaggatggaatggttttccatttgtttgtgtcatctctgatttctttcagcagtgtttcagttctcctggtagagatctttctcctttttggttagatggattcctaggtttttaaatctttttgtggctactactgtatcctgctgtaaataggattgcattgttatttggctctcagcttgaacattattgttgtatataagtgctactgacttttgtatgctgattttatatactgaaactttactgaagtgcttcatcagttctaggagctttttggtggagtatttagggttttgctagatagagaaacatagtattttatactctcatagaatatacagtatacatagttttctattctctcagtaaagagagacagtttgacttcttgtcctatttggatgccttttattcctttctcttgcttgattcttttggctaggacttcaagtaccatgttgtaagagtggtgagagtgggcatccttgtcttattccagttctcaatgggaatgcttccagctttgtccatgtcatatgttgactacaggaatttcatagatggctcttattattttgaggtatgtttctttgatgtctagttggttgagattttttatgatgaaggatgttgaattttatccaaagctttttctaaatctattgagatcatcatatgaattttgtttttagttctgtttatgcaattaattacatttattgatttgcatatatggagccaacctcacatcccagaaataaagcctacttccttgtagtgaattaccttttggatgtgctgctggattcagtttgctagtattttgttgagaatttttgtatctatgttcacatcagggatattggcttgaagttgtcttttttgctgtgtatctgccaaatttgggtatcaggatgacgttggctttgtagaatgggttagggaggggtccctaaccctagatttttttggaacagtttcagtgaaactggtttcagtaagattggcttttttttttttctgattcagtttcagaacttattattgggctacctagggtttcaaattcttcttggttcaatcttaggaggttgtatgtttccagaaatttctccattttctctagattttctagcttgtgtgtatagaggtgatcacaacagtctctgaggatcttttgtatttctgtgggatcagttgtgatgttatctttgtcattcctgattgtgcttatttgagtcttctctttatttctcttattctggctagtggtctataaatcttgtttatctttttaaagaaacaactactggttttgctgatcttttgtatatatttttgcatcttgattttattcacttctgctctgatttcagttcttttcttctgctagctttgaggttagtttgttcttgtttttctagatcctctaggcgtaatgttagattgttaatgtgagatctttctaacttcttgatgtaggcatttaatgctataaacttttctgttaacactgctttcactgaatcctagagattttagtatgtcacagctctgttttcattaatttcaaagaattttttatttctgccttaatgttattattcacccaaaagtcattcaggaataagttgtttaattcctatgtaattgtgtggttttgagagatcttcttggttttgatttctatttttattgcactgtagtttgagagtatgtttggtatgatttttatttctttgcatttattgagtcttgctttaccagtaaagcatgtagtagatcttggagtgtgttccatatacagacaagaagaatgtactttctatcaatgttggatagaatattatgtagatgtttattaggtccaattggtcaagtgtctagtttaagttcatgattcctttcttagtttgctgcattgatgatctatctaatactgtcagtagaatgttgaagtctcccactattattatgtggctaagtattttcatagatctagaagtacctgttttacaaactgggtgctccaatgtttggtatgtatatatttaggatagttaagtcctctttgaattgaactcttcattatcatataatgcccttctttgtcacttttgacttgttattttaaaatctgtttgtttgtttgttttttctgaaataagaatactgtcctctgctcttttttgttttctctttttttttttttcagacggagtcttgcactgttgcccaggctggagtgcagtggcgcaatctcggctcactgcaagctccacctcctgggttcacgccattctcctgcctcagcctcccgagtagctgggactacaggcgcccaccaccatgcccggctaattttttgtatttttagtagagatggggtttctccatgttagccaggatggtctcgatctcctgacctcgtgatctgcctgtctcggccccccaaagtgctgggattacaggcgtaagccaccgcgcccggcctcttttttgttttctatttgcatgataggtctttctccattcttttactttgagactgtggttgtcattatatgtaagacaggtctcttgaagacacttgggtcttgtttttttatctagcttgccactttgtgcattttaagtggggcatttaggccatttatattcaaggttactatagatatatgaagttttgatactgtcatcctgttgttagctgttttgtagacttgattatatagttgccctatagggtctgtgctatgcacttaagtgtgttgctgtggtaacaggtatcattctttgatttctgtttagaactccctcaaggacctcttgtatggctgatctggtggtaacaaattcccttacgcttgtctggaaaggattttatttctcctttgtgtatgaaacttagtttggctggatatgaaattcttggttggaatgtcttttctttgaggatactgaaaacagaccctcaatctcttctggcttgtaaggtttctgctgagaagtctgctgttagcttgatgaaatttcctttgtaagtgacctgaccctttttcctaggtgcctgtaagattttttctttcatgttaatcttggagaatctgatgactttgtttcttggggttggtcatcttgtatagtatcttgcagcggttttctgtatttcttgaatttgcctgtcaacctctctagtgaaactggggacatgttcatgaattatatcctcaaatacattttccaagttgtttactctttctccttctctcttgggaataccagcatgggttgtagtttagttctccttacataatcccatatttcttggaggttttgctcattaaaaaaaaatattttttctttatttttgtctgactgtgttgattcaaaagaccagtctttcagcttgagattctttcctcagcttggtctattacattgctaatgcttgcaactatactatgaaattcctgtagtgaatttttcagttccagaactttagtttggttctctcttaaaatggctctgtcatctttcaactcatggatagttttactggcttccttggatttctcctgaatcttgttgtgtttccttgtcatccaggctttgaattctgtgtctgtcatttcagccattacaatctcattaggaactattgttgggaagctgttgcaattatttggaggtaaggagacactctgaatttttgaattgccagagtttatgcactgattctttctcacctgagacggctgcattcctttatcttacattgctatcacttggacaggcttttgaagtttatttttatttttttgagacagagtcttgctctgtcacccaggctggagtgcagtggtgtgatgtcagctcactgcagcctctgcctcctgggtttaagcgattctcatgtctccgcctcccaagtagctgggactacaggcacacgccaacatgcccagctaatttttgtatttttaatacagatggggtttcaccatgttggccaggctggtctcaaaatactgacctcaagtgatccacccacctcagcctcccaaagtgctgggattacaggcgtgagccactgcacccagccattaatatttttaaatacaaaagtaatacatgcttattctaacaattgaaatcatataaagatacataaagtgaaagcaaatcatctcctttagcctcatcttcaaccccatccccttgagctgccaatactcacacctgctgtagactttccacattttccccttgttctttcaaacagatgcaaatgcacatttacatacagatagatacttttaatactttaagttctagggtacatgtgcataatgtgcaggtttgttacatatgtatacatgtgctgtgttggtgtgctgcaaccagtaactcgtcatttacattaggtatatctcctaatgctatccctccccccttcccccaccccacgacaggccctggtgtgtgatgttccccttcctgtgtccatgttttctcattgttcaattcccacctatgactgagaacatgcagtgtttggttttttgtccctgcgatagtttactgagaatgatggtttccagcttcacccatgcccctacaaaggacatgaactcatcctttttgatggctgcatagtattccatggtgtatatgtgccacattttcttaatccagtctaaaagccaaaattgacaaatggtatctaattaaactaaagagcttctgcacagcaaaagaaactaccatcagagtgcacaggcaacctacagaatgggagaaaatttttgcaacctactcatctgacaaagggctaatatccagaatctacaaagaactcatacaaatttacaagaaaaaaacaaacaaccccatcaaaaagtggacctatttttatattctttatttcttttagagttgaattgtggtatatattgagtatagttgattggcttcatttctggatgcttttagagggttgaggctcttcatttgtgactagatttctgcactgggtttcaccagcaatgtatgcccttctttaggtcctatttagggccaggaactggccctggagcttgtcaactctgtgcagggttcccagtttcccccctcttctactttggtttctatgtcacctctctataaactttcaacgttttatttcaaaagatctattcgaagtgtgatgatttactcgatattttggtttccttcagtgcaagaggtgctcccagctatatctagtcagccgtctagtcccctatgttacttcaggctgaccctaccagtgctggctgcaaattccaaagcctggtgatctaaagggtctgcccctggaaatacacacccaatgccaggtgcagattagtgggcagatgtcttgggtatggggccactggtagtcaagtaccagcccccactgtttttataagcttatttttcttctcaaattattccaacacctttaaccaaaaccaataaaccactgattaaaattcacacatattatataaatgtatttctgtaactgcaagtagttcagaatgactgcacttcaagatatgaactagggctccaagggagaaatgaggctggcaagatgaagaggacatccatggatgccttaaataatataccaaggagtttaaaccttatcctaaagacaataaagagcctctggagaaattttaggataaaaatgacataatcatttttatgttttaaatacatcactttggctgcaatattgcacatacatagtatttgggaaaggatgaaggtatgccatttaagacaaataattaatggctaaattctgccaagttgatggaggaggaaataattcaaaaatatactaggaacgatagaagaatatatgtggtgttttgcaggacaggaaaatacaaaagagaagggaaaattcaaagatgcctagagtataattccacaaattccttttactatcacaatctgagccgctcagccatagacaactttgatatctcaagctttcctgactccctggattcttatgacattagcaaatgcagctaagtcaagtccatgtctttgcgtactctgagtaatttatacattttccatgtatgaaattaatagcttatataaccccaacatgatttgtatcaagagtagttagttgaccgagcatggataatagatttatgatgcttttataaccctgaccagcacgcatgattacagttttgcaaagatgctaaaatgactatcagctaccttatttgactctcatattcctcccatcctcactgaagaaaaaaacatttggagtgctctcccaacagctgcagaatgtatggccatgtgatactatttgaacgttttgtctgacaagttagggattctttttgcaactaataaaataatttaaaaatctgaaccatttcctgaaatgtaaattactgacttttgttagtcattatttcacctctgccaaaacaaaatgacttatagagaaaagaaaaatgactgatttattgcatcatgcaaattcctacagaagaaacaagtttaggatataaggtatgtaacatgggaattttaaaaacagtattagtgaattgccaggtaagaagagacccattaaagttgtctaatagtggcctccccagctctccagatatcaaaataactagaaaatcattagatatctgatttatttagaccaaattcttttatctcacattgttgatctttttgaaaattcctaatttctaatagaattaaggatctgttacttcaaataatataaagcttttgaatttctaaattcctcattttttctaggtctctttagctatttttaataatagtgacaggaataaaaaaacaggcacggtttgagtagatatttgatagaatttcagtttttatatagtcaactgtattaaaatcttatagtttaattaaataattttggtaatagatacatttcttaactgaactccaaagtttatgtatgtgcaatcatcactgtatattttgcatatttgaaatatatgcaaatgtaaatattaaatacaaaggtaccacccaagcatgtgtgtatttatacataaatgaatatatttgtataatacttgtgaatttttatttagcatgttacttttccatgggcccattaacatttgcacctgctactccctatctgagaggccgtcatccactactttttaaaaaaattttattttttaaagatggggtctcattctattgcccagactggaatgcagtggcacaatcatagttctctgcagcttcagactactgggttcaaatgatcctgctgcctcagcctcctgagtagctgggacctcaagcatgagctgctatgtctggctttcactctcttttacatggcttgttccctctcacctctcataagccagctcagttatgatgcctcaggaaattacttcatgcggaccacatattgagagcaatctacttatcgtcatagtttttgtgcatttacttctgtgtcctccacaaggctgcaaaattctttgaaacaaggtctgtgccctgtacctatgtttaacaagtgcttgacaattaaatgtacaaaagatattcatgaagttcactctgtgtggcaagtggttaatgctttaaacaatgctactgtagaggaggagtcgtcaacttgtttacaaattgcccaagggctttttcttttcttttaatgtcaccatgataacataaagaacattatgagaaaattcctttcatcatagaattcataggccagtggaagaaatagattttatttatcatctagtgtgataaattctctatttgtgttttgtttttttggttttttttttgagatggagtctcactctgttgcccaggctggagtgcagtggcaccatcttggctcactgcaagctctgcctcccaggttcatgccattctcctgcctcagcctcctgagtagctgggactacaggtgcctgccacgacgtccagctaaatttttgtatttttagtagagatggggtttcaccgtgttagccaggatggtctcgatctcctgacctcgtgatccgcccagcttggcctcccaaagggctgggattacaggcatgagccaccgcccctggcctattgttgttgttttcaaagaggcatattgcccaagagtgaaagtcaagaaaatctgtttggaggaaatgatatttaagcttaattttgacagcagtctaattcagtggtaataagctcagattctaatatctgttggacatagggctgaatcctaactctatctcttataaagctatgatttttggcaagtgatttaatctttgagcctcagtatcctaatatgtaaaatggagttagcaacatctacctcataggagtgttactaaatgtgattattacttaaattaaacgttacagaggttaaacatagcaaaagtataagctgtaaatgcacgtggcaaataccataacttatttgtcattgggtatttgacatctaataaagaaaagaaaagcagaaacaaaagaagttcttgttagattaagttgtttgttgagagtggaatgctatgtctttaataacttcctcaattatatttataaataattcttgtgagaactaccatgttaaccaaagaaaatattaagaataattatatatgctgctctaaacctttacgttaactcatgtattcatcacaacggccttatggggtaattataaacagtttagcctcattttcagatgtggcaactgaggtacagagaggttaagtatgtagttcaaggtcacttgaccagaaagtgctagagccagaattcaaacctggattcaaaccaggccatgtgcgtctatgttactgtccttccagtaatacaaccaggccaacttcatttagatgccaaccactccctgagtatacactaaatttcagatgttgttctagaaaaattgtatataaatcactttatatttatatactgcatatatttacaggaaggaatagatgttaacaaaataaactataaataaataatatacatttcagatactggtgagtgcaattaagtaataataaaatgggaaaaaagaatgatggaaatgctactaatttaattacagtgaacagggaagatttttctaaggtgatgatatttgagcagatatttaaataataaaaagaataaaccatgtaaagatataacggacaatttttccaggcagctagaataacatacatatagggcttgagttaggaaaagcttggcttgtttgagaaacgtcaaggtcaccgtggctagagtgaaatttatgaagagttggtggtgagcacataatgttggagagaggagcaggtgtcacattacagaaggccttgtatgtaatgataatgaagttaattatcacctttggaaggtcttaagaatataagtggtatgatctggcttatattaacattttgaaaaaagataacgggttacttggaggagaacagcagggtaaaagtggaagctattatggttgttgaggcatgggatgaaattggtttggattaggattcagcagagcaggtggtaagatctgactgattttgtaatatattttcatggtagcacaagcaggacttactcatgaatgctgaggataaagaataattgagcaagacttttagattttagattatttttctggcataaataatatgggaaatgatagaaccaattagtcaatatgaagaatattagggcagcagttactttggccctgagaagagggactgcagggaaggggctttcttaataatcaagcagcagagatgccaactgcacagttagacatatacatttgaagttctcattcagggagatgtcatggcttcagaattgggagtcatcagttgacagttggtatctaagggcatgagtctggatgaggccatctagggaatgaagaaaagatggagaagaggtctgtacactgggtatctggagtgctgaaacctttagaggaggagccagcaaggaggctgagaaagggcagccattgaggtggtaaaagaacaggagagtgttttgtcctggaagttaaaatgttgacatctttgaggaaggaggaagcatcaaatcctgctaagaagtcagttaggtctgagaactgatgcttcaatttagcaagatggaaccagtaatgactttgatataaatggatttatgactattgtggggatgagaacatgaaacaggttaaaatttaaaaaatgaggtaataagggggagctaatgaaaatagacaattttcttagatttttggtaaagcaaaatagaataatgaggtaatagtggaaggaaaacatagggtcaggggacggttacttattttttctaagatgaaagatatactgtgcctgagttaaagttattcagtaaaaagcaagatagggcttgatattgcagaagagagaggagataactgcagaaggaaaatcattcaatggataactggtaatggagtctaggtaacaagtaaaaagttggtcttagaatggaataggaactttccttcattgccatgggagaatatactagtagacctggtagtaggaaaatgtggttttcatttgattgcttggattttctcaaaaacatattaaggcaggtcaacagctgaaagagaagatgagagaagagagtgcttgagatttgaggagatatgataaggtatgaaattgttgtcccagagtatgagaaagtgattttttctaaagaagtgtataagaattgctagaaagtcttgagagttcacttaaaatcaatggttaaatatttaaagtgagatgagtgagtgtttctctagccatatccagttgctgaggcagtggcatggagtgaagaggaaagtgttggcttaaccagcgtaagctaacttggactggggttttgctggatgagcacaaaaagctagagaagagaaaaaaaagtgcatgagagggagaattagagtgagggaccaggtaatacatgctaggtggggagggaagagagggcataaagaaaggtgaaagctgggtagaaatggtgaaatcaatgatctgaggttccaatggggctaaagaagtttcaatgagaaggtactagaataaatgatatgaacagaagggaggaagtgttcacaaagatattgcttgacatagaggctttggagagggggcagttaatggcagtaacaaagttcagagtatggtcatgaaccccaaggcaggaagttagcaaggtaaactgacatgctgaagatcaggaaacaagtaagatcagaatccagactagaacccacagttgtctgactcctattgagtgttctctctcataccaatgttagcttttattttttgacctccaataccagggcaactaaatagtgttctattcaagatggtgatgtacattggataaggaaaaaggagaaggctcagcttcacgggcatgagacctgttcagttgcattgagtcctgtgtttagaaaggccccacgttttcatgttgtactgcactccataaatcatatagcttgtcttggagagaaacttaatgattcaggagaaatgtgtttttttgtctcatttgagctcattttccataagcctcacttttctccagttagcataccattaaaattttatcaagtccataatggaagttttaaagaacccatctgtcaaacacttaagtttcaacgtatattttggtttaaaagcactcacacttgataaaaatcagcctgaagatgagaaatgctctgactcaggaaagtgaataattagtaaactaaaaacgagatataaattaaagtgcaggtctacaatcttcatttatacttgaatgatagcttagtgaaaatatttacatttttatttcttatactaaatgtggtatgcgtttatcatagaaggtttatgaaataaatataagcaagaaggataaactaaacattaccccaaaatccttaacaggagttagccaccaacatgtgtaacatttggtgtacatctttccaggctttatgagtgtatttatgtatatatattatattatatagctttgtgtctactgaattatattttaaataccattttaaaacttaatttttaatttaataatataatctaggtagaccttctatccttgcaattacatatttttctaaagtattatttcagtatattttaatataatttatattacatgaatacataataaacacattatccttttttgtttattattaaacacctatgtttttcaatcttcactattataaaccatatcaatacacacattcatcgtgtatttgtccgctactgtaagtacaatttctgggtcaaagagtgtattcattttaaaggcttttaatctatgtttccaaattgctcttgtagggttgtactaattttcagaacctctcactggcattgaatattcacattccttttaagtttctgtcaattggacaggcaaaacttgtttgctctcattgtcttcctttgttcttaatgaggttgaacaggttttcatttgtttattggctttttcttttttaatgaatgtcctgttaatgctttttggtcacttttttctacacggtctttggcctttctcttattgttctgtaaaatatctacatatattagggttgtgttgcacagtttccttaatttgtcaaagcactttgccaggaccctaccagcatatttgcagagctctatggggttgctgtgttttttcctatgggagtagttttaaaatgcaccacttgttttttaaactaagtaagaaacacatggtaactataattatgatgatagtatcgatatcacacaaatgaaaacatcttgtaacatatctaaataatgtatagccaaaacactaataataaaaccattaagaacaaagtgctgtacaagctcatcaaacatttctcttttccattcatttctccaaatcctggcaatgaaatttacatactaaacattcagttatttggtctgctgtctcaatgctttctactgtgagcatttcattaatattctcattgtgagtcctgtgggaaacttccaggttataaaacacaattgtataatttcacaagacaactcattaagattagaatagaatgtgaaatgcaagattggggctttggatttttcaaaattttttcttaccctctccagtgtaatttcttcaaattcatattcaatttctgtcccattgacctgtaaatagggaaaaaataagaagagaactattaaatacatgttgaggaggagacagctgcattttaaataatgcttgggggtgaaattttcattctagctataaataaccacattttcttgatatttctgattgtgcattttcattcaagtgaaacataatctatgctattctaaaatatatgactgagatgctacaaaaaatactcaaagattattgcttcccttagtaattctgtgatttttttgtagtgaggtataataacacaaaatacatattgtgagcttacaaagaacaaatcatctaggggcaatgatacaattatgaggaaaataattttcttgttttttaaaaaatgttatgtttgaacactaaaatatgaccttaaaaatcagtgataatggcagaacaacattgttccatttttgaatagaaaaatagcatgaaaatgactgcatcatctgagaaataccttttctttagtggctcaagctcaggtaaatcatccccatcatccttttattatctttattggaaagccctggaccatataaccatacctatgtacctcagtagcagtaagaaatgagcaaagtaagacacattttgaaatgcttagtgacgaattgtttcaaccatccaaccaatccttgtattgatttgaatttacagagagaaatacattttaaatacagccaggcaccttagatttccacaaatgtgcacagaggccatatgaaaagttggtttaaaataatctaacaaatattcctttctcattttcatctatctcagaattcttctcaaccaggcaaaacctctaagcaagaaaattctcaaatcggttgtttcttatttctgatacgtgtcttggcaacatcattggaatttaggaatcagccagaaggactacattttaactataaagccatactttttataggattctaacttacatttacttttctatcttagaagaatttatacccagtaccagggattgagagttctatgcaggcaaggcccagacagccagccctgttgcctaacacagagcctggcaagaaaataatgagggaaaagatagtgaatgaatgagtgactgaactaagtaattaatttacttgtgtaatttataaacatagatatttgtggattctcttttgtaacaaaaaattgaatgtagtatcatcacctaaaggtgtaattatagttataatcagtgaacatatagaatgacaatgacaatggactttacttaggtgtgtccaccacccactcacagcatgtttttgattttctaattacgtgagctaattggtgaatcacaatttactgttttactacattatcaaacagccctaaactaaatttgattttctaggcttcagcaacttaatgactcacagaaaaggacttgatgatgtcagaaagctttagcagctttctagagggttttgttttgtatatgcaaaagtaaaacacacagacacacacacacacaaacacacttcaaactccttgtatgtttccatatgaatgatttttaaaataattttctttgatggataggaagaggacaataggggaaggctgaattaacgagatacattttcattccctcagtatggctccatgaggcttttctttgcttcagtgcttctccaaactgaatcacttcacattattaaagtgctgcaaactggggagaaaaaaacaacttccaagagagaaaaacacgcctctaataataaatgtctaaaggctcaaagaaattcttttaggaagtgcttaaaagacaagaatattttagtggcatacactgcatagttgtggcctatcaaaacctacgcttaacatttctaggatcctaaatgctgactcttagatttttagaagtattatatatgcatatcctaattggtattccaaagttccttagtcagctacataaactattgcaggcttatatttacctcatgggtctttcattttcaactcaagaaaataatatcatttgtctaattcaacagtatccaggttcttttcatcaggagagatgatgccatcaaggttgcaatgtaactttgcttttaaaacaaagcatcccggctgggtggttcacacctgtaatctcagcactttgggaggctgatgcaggcagatcacaaaatcaggagttcgagaccagcctggccaatatggtgaaaccccgtctctactaaaaatacaaaaattagctgggcatagtgacaggtgcctgtagtcccagctacttcagaggctgaggcagaagaattgcttgaacaggggagatggaggttacagtgagccgagatcgcaccactacactccagcctgggtgaaagagtgagatcccgtctcaaaaacaaaactaaacaaacaacaacaacaacaacaaagcatcccatgtctacaacaagctttcgtgaactcgtagaagcatgaaggatttttagcataggtgaggcatcatttcaaccttttacatgaggagcatttagagcacggaatcacaggagccagtgagagagttcagaaaagacattggaaaggccctaatctctattctctcattacagggagagtgtggtctatgttctgccaaaggactcctaagacaagaaatggcaaatatcttgagggaaagaatgagacagaacaaaagaactaagaatacccccccagggctgggcgcagtggctcatgcctgtaattccagtactttgggaggcaggagcaggcggatcaagaggtcaggagatcgataacatcctggccaacatggtgaaaccctgtctctactaaaatacaaaaaattatctgggcagggtggcgtgcacctgtagtcccagctactcaggaggctgaggcaggggaatggcctgaacctgggaggcagaggttgcagtgagcctagatagtgccactgtgctccagcctggtgacagagtaagactctgcttcaaaaaaaaaaaaaaaaaaaagaaaagaaagaaagaaagaaagaaaaaaacaatacctcgatcttaatttgtgaaaatttggtgccttttcaaacgaatataccagtacagtattaaataaggatttaaatacttatttcgactttatttctaaataaactctctacagtggttgcttactgagtgatgaaacactgagaggtatctacagtaattcacccctaaccataatcttgtgtatcctcactcagcaaaaccaaaactgttataaatggctcccatcatcttttgggtggtttgcaaacaatccattgttgtttgaacttgccttggtgtctcatataatattcccaatcaggttatcgacatatgattttcaattccttttcctcaaaagagttcggccgaatacattttttttcttgtacagtaacacttacggtaatatttaagtaccttggtcatattttatgctactgatagtttggggcccggagagcttcacagttggggtttctgttattccagttctggccctaactgtcacagcctcctctctactttgagaactagaaaaatcagaggattgacattttcatagacttggagagtcagtcaaatagattaaacttttcagtgtttgaaaaatgtgtgtgcatgtttaagatacttgatttttctgaactttatggttctgtggtgacagctggtagatttctctggtggccagaaaatcaaactgatgtcacacattgtcctgtgctgttctgagcatgtagccttcctagaatcatatggcagttaagcaaagagagtgacccacagccaactcaaatttaaacttggtatttaatttaaagctctaatttaatgaatgttgaatgcattaaatatttgtttttctccaacagcttttagttaattttatggccttttttctacttcaatgatatagtaatcacctgcctggatgatgatataatttgattttgagatatatttttatctcctgaaaagaggttctccatacataacaaatgtgaactatccatattttaatgttgtttcattggaatcttaaataataatttctctgaaatgttttgcttgttctttgccacctttgtagcttcattaaggctaaggatatactaaactccaaaatgaataattttttttttttcgagacggagtttcagtcttgtcaaccaggctggggtacagtggtgcgatcttggctcactgcaacctctgcataccaggtttaagtgattcttctgcctcagcctcccaagtagctgagattacaggcatgcaccaccatgccaagctaattttgtatatttagtaaggactaggtttcaccatgttgacaaggctggtctcaaactcctgacctcaggagatccacccaccttggcctcccaaagtgctgggattacaggcgtgagccaccacgcctggcccaagatgaataaatttttatatatctctgtgtcacatattataaaagtgctgaaacaaggatatcaaagcattcacttttttagactaaacacaattctacccaaagagcaattattaagcatgcataaagtgtcaagaacagtgacagatactgagaaaatattttaagatacagccatattctagagaaacacacaacctttaaagaggcaccgaaacacaaatatattaaggcctcatacaagagtgatatctaatatttaaaatatagaggtagactaaagctgcagcgccactattgccacatgcaaggtatgtgcagatctatttactctttgtcgtttacatagattaagtcagtagtagagaatatgacagacgatgttctaatccttctccttattataagtaattatgatatagttaacaaggtatacctctgattattattgttttagcatctagcactacaattggactttgggaggaatgtgatcatcatgcaaattgggacctccagttcttgtggtctcttgtcacttccagagtaaggtggggcaatgccactttgcttcatccacagatgcagcatatattacagtggctagcaatgatgactatgtgagtgagtaagtagataaatcagtgaatcaacaaatgaagtttttggatgggttaaacctgatgcactcaaagaagaccttggttgctaatggggatgccatgcctactgggcccatgccttttgccattccttgtttatttatcctcatctctgagcttggctcctctcagaagccctgaattacagggtcacaccaccatcaaatgccacagcaaatcaacacacacacacacatacacacacacacacacacacacacaaacacacacactcatttgcattcctcttttttagtaccttgccaatattcatccttcccttcttttggagtatctcttatagtaaatatgtcatgatgcattactgctctttacacttgaccttacatacagtgtgatactcggtaggcaaaaacatggcttccagagtaagaaaagacagatttgaatcttctttccaacatttttgatgagtgcgagtttgggtaagttccttaatctcttaaaacctcaatttctttatgtgaagaatagtactaaaaatagttcttcctcgtatggttattgcaatgattacattaggtaatttatatgaattatcacacatcttaagtgattaaagaaattttagctaaaatcccaaacagttttcttctcagtttctacttcataaaattcttggtaggaataaataatattacacatgttaactgtctggcacaaagcagatcttcaataatgatagctattattattagttctggatacaaatctataagggtcacaaaatttgtctgatcaaatactgaatgtttgctaatttctccagtaatacataacttaagcaaacaaacttgtctttttctatatatccactaaaaggctttcctaactcaaacatctttttcttgaaccaatctaagatgcactgccttgtgtataggaattaccttagcttttgttctcaaacaagtgtggccttcactcaaaatattattttggccatgcgtggtggctcacccctataatctcagcactttgggaggctgaggcaggtggatcactcgaagtcaggagttcatgatcagtatagccaacatgataaaaccccatctctactaaaaatacaaaaactagctgggcatcatggctcacgcctgtagtcccagctactctggaggctgaggcatgagaatcgcttgaagcagggaggcagaggttacagtgagccgagttcacatcgctgcacttcagcctgggcaacagagtgagacttggtctcaaaaaaaaaaaaaaaatctcaactaaactttctcccaatcttgtgtatactcacttttcatttaaaaaaaatattcccttgcccagtattgatcattatgttgctctgctattggcactcactttcttaaggctattctcaaggcatttcctatatcctcatgttcatgagagcacaggttgtatattaaccttttttttacccttgtaccttctgacaccatgccttgatcaaagcaggtctccagaaaaatctttagacccaagtcacctatgaactccaaaaattgagttgtgtttaaactgtatctttgcctaagtatgggcagcccctaacaacagctgccctttcctgtgaaatatggcttgaatttatcctcccatctcaggaaatttttgcaaattttaaaaataatttccaacttaaatactgaataaattaaaacatcaattaaatacattaatacttagtacctatcatgtacttggtataatgataagcactggagatacaaagttgggtgaaatatggttcctgccctcaaataactcagtctaacagatagagacaagtgaatggaaacatgtaacaaagcgataggagtgctatggtagatgtctatagactgcagcagctgcagaggtgacataaaggaggcaataggaataggtgattccaccggcagtgagtcagaaaacttttcatagaggagatgggatgagctgagtgtgttcatggcaggtgttcatgagaatgtgtaggcctatcaaaacagagacagcaatattaaccacatcttcagaatgttctactggagacagcactgaccttaagagtctgatgcttgcattgtactcctgagtctgtgatttaacatgctaggtaaccttgggcttgtcatgatgctttaattttctcatgcagatagataacctctgaggtccctcccagctctgacctagcaacagggcttttcttcccatctagtgcacctgaccaattgttactgtgatttttctattactctttattctaaagatcctaactggcaacccataattttgccaggtgatatctctctgacctctgaatatctctgtcttatctcttctctttaacctataaaaggcctcaacagggaggaaactaaatagtggtatcactttccgtcttggctccactcgaggacattaccataagcattttttccatttctactcctcaaagatctcaggtttctggagggaaagagtaagtagctgtttctctctaaaaaggaaaaaacgtaagaaagttttgctctacttcaaaccaaaagaaaaaacttgaggaggctgatgttctttactcccatctttttatcatatttcgctatatttttaaaatttgtatgaatttaaggggtacaggtgcagttttgttacatggatatattgcttagtggtgaagtctgggcttttagtgtaaggatcacctaaggtacactgtatctattgggtaatttcttatccctcattccattcccaccttctcatccttccaaagtctccaatgtttattattccatacattacatagctcctacttataagtgagaatatgtggtattttgactctgtttctgagttattttacttaagataatggcctccagttttatccttactgctgcaaaagacttcattcttttttatggctgaatagtattccattgtatacatataccaaattttctttatccaatcacccactgatggacactgaggttaattccacatctttgctattgtgaatagagctgcaataaatatatgagtgcaggtatctttttgatacgatgatttattttcctttgggtagatgtccagtattgggattgctgggtcaaattttctctgctgaatatatgaaaatcagttgagtgctgaaaaagtgagtcattccaccagaatgtaagctctaaataggacaaaacacattacaaaagcctgaggcttgcattaatacaactagattgtccatcaccacctttaactaatgtcccttctcctagactatcttcactaaagatagtgaccaaaaacaggcccttttttcaagttacagcgcattatcacacagaaattaaaagtttagattgtggaatctaaaagacctggattccataacagttctgtacttacaagctgttagaattcatctttgttatgcattacacacatttgtgtaagtgtcaaaattacttatttaaacacttagtagtaagcaaaagattttctgcttaagctttgtttagaacctgttttaatgtaaggtatacatctggttattttatgaatactatgaagttataataagactggtttaaaatatgcagttttattaaaaactcatcatagttcattattcctttctttaaataaacgctcacaagctataaaaacaatcactgatattcttagttaagattctgagtttggtaagatcactattcctattattcacctgaatttgttctaccagtaaactctaatttcaagttaaaatttctaatcttaattacaaaaacttccgagctcagcgaatgctaaatcatagcttctaccacataaagaaaaaatcagtatactataattttttccattcttatttatttatttatttatttatttatttatttatttatttgaggtggagtcttgctctgttgcccaggctggagtgcagtggtgcaatctcggctcactgcaacctccacctcccgagttcaaccaattctcctgcctcagcctcccaagtagctgtgattacaggcacccgccaccatgcgcagctaatttttgtatttttagtagagatgaggttttgccatgttggccaggctggtcttgaactcctacctcaggtgatccaaccgccttggcctcccaaagtgctgggattacaggtgtgagccactgtgcaaggcccttaaataactttttttttaaaaaattatctgcctttgttatgaagtatttataacacacgcaactttgggtctagaaaaataatcacagacttaataactactatgtttttaaaattttaattagaaagcacacgtttttttgtaattagcggctttttagctataaaattataataatttttatcagtatttccatcagaagaaattaagaaaaatagcttagggttcttatatgcataaaataatcattttctatatacaaaattgtcttgattaaaggcttttgtaacaaaggaacaaatatagttacttagtatgttcaaaactggatttgcctgatttggaaggagtccattttctctcagctttgctcccttgttttgcaccatgtgcaggatggagaataacaggtggttttaatgcattcacttggctccagcctgatgcaggctgttttgttctttgggtttaaatatttcatgagtttgtacatgctctttgagaacagtaaatggtgttaagaacacaattgatcaatggttgtaaggcatcatgatacacaaggtttttgtcccaacaaatctcctccctcacctcaccacccatctatgcaaatcatgtggtcatttgcaagcaagtgtccaaaagtatcaagaactcaaagcacatagccaaaatatttagggaaataaaaactgggtgctaagccaaaagatgagactttacgaatatgatgatctaaccagatagtcaagaatattttcttttacttgagtataatatgactgtagcatgagggaaaatatcaatgttctctacttcatcccctctctctcctcaatcctctgcagcttttgtttgtgttccactattatacaaaagttgaacccaaaataatcaacaaaagctttttcacatttaaatacaatgatctttcccagtcttcatttgccctggctttcatacagtatttggcactagagtgaccacccaccactcgcaacttccctttccttccatcacagggtctatccttgctagtctcctccctactgctctgtccacggcagtgatgaccatttattttactcctgccagatatgaacatttgccaagctctgtcctttgttgcttttataatctacctgagttttgacttcaccccccggccttttttttttttttttttttttctgagtaaacacttaagtactgccctggtctcaatacatctaaaacagaacagatgctcttgcctaattgtaaccataatttcctgcagtctaccactctatatctctgttaaggagattttttttttgtcatatacatcctttacatttgttatcaattcccgccatcctatttcatgttcaaattatcactttcttaagaacattggtataacttcctaaaaatacttcttcccctattgattttcaacatcaatctattcttcatatcctttgaggtttattttcctaaaatgtttcatcaaggaattttactgctcaagtagcttcaataattttttaatccccagagaacatttcataccatccaccagctgtccccaacctacctttctagctaaataccctgtttctcatcttcaaaaacgttttctagccaagtaattgagctgaacacctcctccttttggtatctttactaatgccacatacgctgccttaaatgccttaatgcaatttatgtttattaaaattctaattaatgtagaaaaatattttgaatgcctaaaatttcccatgtattaggttaggtcctagggctatagtggtaaacaaaaaaaggcctctgcctttatggagctgcattctattggtggtgtgggaatctcccatttttaccaactaaagactgtcttgtccatcgaatcaaaaatatttttcttatcgataccctggaaatcataaccctgttatctccagaaaaaatgctaataacaataaaaatgattactactactgcagctactattgctactactggattttgttaaatatgtagtacatgccagacactatcttaagttcatctaataattgtaacaattttgagagcttagcattttaatgttgattttactatcaaagaagctagtttctaagttaaacaattttttcaaggttatgctttcataagcaatgtgaaaccaggagaatcttgttcatcctcatccttacttactgatggaaagtatgtgctcaatataaatttgttgaacaaaattagcaaatgagtgcctatagggatggagaaagaaatggaaatatctagtgtttgaatccagtatctgacattaaaacaataatttttctttctggtcatacatagcagagcacctctcttactatacttgtggtcttcctcttgccagctcctcacattgtgatttctcttccctgacatactgtcctcttgctcggatggggaactatcttttaaatttgtgtttcttttatggcacctattataactgaacttatgtttgcccctagtagccgcattataaattgttattaaagaaataaatggattgactcttatgctaaaggctttttatttgctgtatatctttaaaatcccttttattcaaaaatcttaccactgtcagtttccaaaggcgtgaactgccttaatttctctctaatcattttacttcaaatcttgctaacaatgagctgcatcccttttcatctaaatataggtcaccctttcagcagttttcaagatcaattcatcaatcaacaaatatttattgagtgactacccccaccttcttcgctatctcatataatctcttttcatcccatttaaaaagcacatcactatcttcacaaccttgggaaaagagctatagagccacatcaccctgctccttcatctgaagttctgtgattttggaaaaatgcttcgggctgcttgttacaataaaggtcataccagtatttccagatcagatactaagggaaagcattctgctgctttattttatttcacctttttcaaagtactttaggaccatgacaaggactgcttattaataggttttgtcccctaccgaatgtctggcccaggtgataacatagaaattgtaaggtttaaagttgtttatatctaacatttttagattatggtaacaacagtattattaattttcatactattttcacatacattattgcattggattcttataacaatcgtatatatagtgatgttttaaaaaatttcctgcaagcaataaccatcagtttcctgatggttacctgatggttcacttaccatccccctccccctagcagacatgtacatacatgccacactggtctcttttaagaaaggtgaagaggtagaaattaaataagccaatagcagacctggaaaaaaccttttaaataattgtagttaatattgctgaagatttactatatgctaagcagtaaagcttatatatatatatatatatttgcatatatataattacatataattatatataagcatatttcatatataacatataagctttactgcttggtgtatatatatgtatatatacatatattcacatacgtatatgcacggggcagttgtgttcaatattcatacagaagacctgacttaccctgttttttctctgttagattcaattaacttagaagtctaaagtgacaaaaaagtataagcaatatatttttcaaagaaaaatgtagaagtttctacatatctattagtgtttctcagacttgatccaggagtttgaaaggggtcatgcatactcaagttgtgatagctagtcggattaaggcgttctggactctgaattttatgcaccaattctatctctagaagtctcagagacagaatttctctctctctggacacttttctttgttgacctttaagtattctgtcacagggtcaactgggacgctgataggataagtttctaacagttcatgctcaagcatagctcactgctgcttgcttgcttgctctctctcttttcttttcttttctttcctttcctttccattcccttcctttccttttcttttcttttcttttattttctttcttttcatatcttcttggaataggaagactcaaaagggtaccagaaaaattttcacttgcattctattaattaaactacagatactcctttaatatagtaaacaaatgttaatcagacaacaaacttacagcaaaaagcaccaaggattgaaagcagttggtagggcagggagaagagatggaagaaaattcaaatcatgttttcattatactctttgttttcttaatcatcctctgcttaggatggtcttgcttgccaagttttccctgtataactcctacttagcctttaaaaacatcttccatgattctcctctccttccatctaatatcatcacaaaccctgcctttctttctctagccctcctacgcactctaatacacacatatgcatgcacatatatacacaggccaggctctgctaatgctgtttctctgtgtttacagactacttctgtagattctttttgctctgattatattatcaggctgtgttaagtatcagctcaggctttggattcagtcagacatgtaggctaatcctaaattggcctcttaataatttttgtgactttagaaaagttaaatagcctgagttcctcctcaataaattacgatactacttatacttacttcaataaggttgttagggattataaatgaagtaggaagtaaagtacagttctcaactgctcataatctagagacatttcctaagtttgactctgccagttaatagctgtcagatatctgcctcagttttctgatctgtaagtggggtcaaaatgaatatcataggattgtgaaggataaatgaactagtaaattagtgtaaattaatttaaataaattagtaaaatacttggaacagtagtctggcacatgataaatgttattattatactgttcattattattacagactggtggaatagggagctcagcaaatcctgtccccaaagaacaactttaaaactgggcagaaattgccaacaatagccatttctggactttgaaaactgactaaagacatatagcaagttaaaaatgattgattaaaaaaaaaaactgctgaatgttagttaacaactgtgagagcctgtgttattccagtctggggctgcacattgccccatctcttcccaccccacaaaattctgtgggtacagtagttctaccagcagaaaatgctatgaaaaccagcagctttactgccagagggggccaacttcatttggagcagaatgtgggaaaatcccatgcatagtttttgaaaacaatagtgatttcagtggcaaacttcagggaaagcaaaaatggaagtagtctaaggttgcaatactggctggtgcagtcaacatgctgtctacagtagccagaaatttaacagaacaatttgggtacttagagagttatgtcaggctttgagagctcctatatttccatggaagactggaagtttgagtgcatatgaaaggtcgtgagtatcctcaagagactacagaaggtcctagcaatcaacatatccctgcctgaatgtgagaccttgcacacatgcacaggagataggaaaaggaaggcctattcgaaaataaaatctcaggccaagttgtaggctgcttgaatgtaaacacattccctggcccactcacaaatccattggtgaaggatggaaggcttactggctcaaggtgtttcagcataacctctcaccaatcactggctcaccatctggctacgttgatctaaaggcactgctatgatgccaggcttcaaaaacaacaacaacaaaaaagaaaaaaaaaacaagacagactcatcagagacatcagtagctatatactgcaggggaaacagactacagatctagcatgtgactaaatgttagtttttaaaccaacatttaaaaaccctcaaaatctggagctggtaagagagaagagggcaaatcagaatctctaattgcttttatcttatatgtagagttttcaaaaaaatataggagacacgcaaaaaaggaaagtatgatgatccatacataagaaagtaagcaataaatagaagctatttctcaggcattccagatgttggaattagctaacaaaaacatcaaagcagccataaatatgtgcaaagaactaaaagagccatttaaaaaaattaaagtatgacaacaatgacacatcaaattgaaaatattaacagagaaatagaaattataaatcaaaatctcatgaaaattttggagtcaaaaactgaaataataaatttgctagagtttggggctgatggcctactacataaatagcttagaagttgccattctgttctaacaacaaataaaaagctaaacaaactgaaaaatcaacaactattgttagatccatcagagaagttaagttacaaggcaaatcactgtccccaaaatcagtcagataggtagacacaaagaatcaccaattatcagagcaaaaaccaatgggcagatacctctttgggaaccagtgccagggtagaaaaacctgaactataactgatgaattgttagatgctcaatgtgaaaaactctgacagtcatgaactccagagggaacagtcacagggccgccacgcttttgtgagttttactgcctaaagctctacgaggccttcgtattgaatattagaagaaaatctactagtgctctggcagggaagaggaaaaggaatcattctgaagtaggttagagcattcagtgcttcttaataagggcttctctcaggagaaattattttaccagagcctaacctgtcggggttttaccagggcctaacataactggggaaagggaaatacccaagtccagaccctctagccatcctgtctcacctaaaattggggataagggggacaacagagaagcactggtgaaatttagaatccagatagacaaactcaccaaaatactgaaacctaatcacaggaataaagcatgctttcctccccaataccttgccactacattaccaaagatctattcaaaacagctccttttattcagttcattatgtcattttaaataaaaaatgaccaggcatactaaaaattaaaagaatacagtatgaggagactcaacaagcatcagaaccagagtcaaatacggcagaaatgtttgaattatgattagtatactaaaggctttaatgaaaaaactagacaactaggcaaggacagacgaataatgtaagtagagagatacattctaggaaggaataaaaatggaatgctggaggtaatatagtaaagaaatgaagaatacttttgattcttacgtggctgagaaaagaatcccttagtttgaggatacaataatagaaacttccaaattgaaaaacagagaaaaaaagacaagacacagaacaaaataaccaatagagaacatttaagaaatgtgagacatctacaaaggtgtaacataagcataacagaaattccagaaggagacaaaacagagaaagaaacagaagcaatatttgaggcaataatgactgaaaatttcacccaaattaatgtcagacaacaaatcacagatccaggaacctcagagaacaccaagcagaataaatgacaaagcaaacaaacacacaagcaaacaaaaaatcctcctactcccaataactggcatctaggcataccatattcaaacttcagaaaatcaaggatttttttaaagtcttgaaagaagctagtgggggcaggtgggagccatatctacggaggagcaaagataaaaattatatctgaacccccccagaaaccatgcaaactggaagagagtgaagtgaaatattgaaagtgtggggagaaaaagaccaaagtaaaaatttataaaattatccttcaagaatgaaaaagaaaagacttcctcagacaaacaaaaattaaggaaatgtttctgtcagtagacctatcttgagagaaatattgcagtaagtacttcggagagaagaaaaatcataaaggtcagaaacattgatctacataaagaaagaaagagctctggagaaagaatatatgaaaataaaacaaaataaaagttttatttttcttaatctaacagataacagtttgttcaaaataataataggaataatgcatatgattatatatgtgcttatatatacacacatatgtatgatcacttatatataatcatatatatgcatgtcacttataatcatgtatgattatatataagtgaaatgaataatacaagaaactatggcagaatggggaatattttgttataagacacttgtactatttgtgaagtggtggagtgttatttgaaagtgaacttggattggttgtaaatgtgtagtgcaaattctatggcaaccattgaaaaagtaaaagaagaagtataattgatatattaataaagaaaataaataatataaaatgccatttaaaacgaaaaaaggcagaaaaagtgtggaagacaaaaataggatgaaagaacaagaacagtaattagaacagtaattagaaaatggtaacagatatggcagatattaatccaagtagtaaatacatcaataatcactttaaatatcaatggtataaatacatcaattcaagagccaagattttcaaagtacattagattaaaaagcaagacatgactgtatgttgtctacaagaaaaacaccttaaatgtaaggagaactatacataaaaagtaaatgaatggagaaaaatatatcataataacactaatcaaaagaaagtgggagtagctatattaattccaggtggagcagatatcaacgcaagataaattatcagagataaatagaggcattacataataataaagtagtcaatactgggagaagatgtaacaacccttaatatgtatgggctgaacaacagagtgccaaaatacatgggggtaaaaacccatagaatagcaagaaataaatgaatccactattatagttggagacttgaacgcccctctatcaaaaatggatgggcctagcaggcacaaaatcagtaaggatatatttgaactccatggaaccatcacacaactgatatcaagcacatccatagactacttcattcaatgacagcagattacacattcttctcaaacttacatgaaacagtcatcaggatagaccaaattctaagccataaaacaaatcttaacaagttcaaaagaatagatacaatgtctgttcttaacaccacaatataattagactagaaatcaataatggaaagacagctggaaaattatgaagtacctggagattaaacacatgggtaaaagaagaaatctgaagagaaattggaaagtattttgaactaaatgaaattgaatacatgatgttttatccagcctgggcaacatagggagaccccaactcctaaaaaaaaaaaaaattaggcagtcatggtggcttgtgcctgtggtcccagctacttgaaaggctgacgcaggaggatcacgtgcccaggaggttgaggctacagtgagccctgatcatgctactgcactcaagcctgggcaacaaagtgagaccctgtctcaaaaaagaaaaaaaaagaaaaagaaaaagaatagcaaatagaatgtattaaaattaataagcttcagtaaaagcagtgtttagagggaaattcatagcatcgaatgaatgtatataaatgaagaaacatctaaaatcaataatctaagcttctactttagaaaactagaaaaggaagggcaaattaaatccaaagtaagcagaagaaaagaagtaaaagttagagaagatcaagaaaattgaaaacagaaaatcagtatagaaaatcaacaaaatattggctattttttgaaaagatcagtaaaattgataagcctctagctaggctaattaagaaaaaaaatgacaaaattgctaatattagaaaagaaacacaaaacatcaccacagattccatggtcattaaaaggataataagagaatatactgaataactttatgctggcaaattttataaccaaggtgaaatgaactgttttcttgaaagacaccatgtaccacaactcaaagaagataaaacagaccatgtgaataggcttatatctattgaagaaattgaatcaataattaataaccttcccaaacagaaagaaccaggcccagatgggttcaaaggtgaatcctaacaatcatttcatgaataaattacaccaattatctacaatcacttccagaaaagagaagcacaaaaaatactttctaactcataaatactttctaactcataaaatgttcaagaacaaaagtgaactatactgttaactatggactttgagtgataatgatgtgtcactgtaagttcatcagttgtaacaaatttaccactcagttgtggatgtcaatgcccgtgtgagcaaggcctgtgtgtgtgttaggtggggaggaggtgtatgggaaccctttgtactttccatttagttatgctatgaacctaaaactgctcttaaaaaagttattaattaaaaaaattcactagagcagctcaacagtagatttgagttgacaagaaaaaacataagtaaacttggaaatatatcaatagaaatgtttcttttttttaaattatactttaagttttagggtacatgtgcacaatgtgcaggttagttacatatgtatacatgtgccatgttggtgtgctgcacccagtaactcctcatttacatcaggtatatctcctaatgctatccctccccactcccctcaccccacaacaggccccggtgtgtgatgttccccttcctgtgtccatgtgttctcattgttcaattcccacctatgaatgagaacatgtggtgcttggttttttgtccttgtgatagtttgctgagaatgacggtttccagcttcatccatgtccctacacaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcacgtgtctttatagcagcatgttttataatcctttgggtatatacccagtaatgggatggctgggtcaaatggtatttttagttctagatccctgaggaatcgccacactgacttccacaagggttgaactagtttacagtcccaccaacagtgtaaaagtgctcctatttctccacgtcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatgagtttttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattctggcttttgttgccattgcttttggtgttttagacaggaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatggttgtagatatgcgacattatttctgagggctctgttctgttccattcgtctatatctctgttttggtaccagtaccatgctgttttggttactgtagccttgtagtgtagtttgaaatcaggtagcgtgatgcctctggctttgttcttttggtttaggattgacttggcaatgcaggctcttttttggttccatatgaactttaaagcagttttttccaattctgtgaagaaagtcattggtagcttgatggggatggcattgaatctataaattaccctgggcagtatggccattttcatgatattgattcctcctatccacgagcatggaatgtccttctatttgtttgtatcctcttttatttcattgagcagtgatatgtagttctccttgaagaggtccttcatgtcccttgtaagttggattcctaggtattttattctctttgaagcaattgtgaatgggagttcactcatgatttggctctctgtttgtctgttatttgtgtataagaatgcttgtgatttttgtacattgattttgtatcctgagactttgctgaagttgcttatcagcttaaggagattttgggctgagacgacggggttttctagatatacaatcgtgtcatctgcaaacagggacgatttgacttcctcttttcctaattgaataccctttatttccttctcctgcctgattgccctggccagaacttccaacactatgttgaataggagtggtgagagagggcatccctgtcttgtgccagttttcgaagggaatgcttccagtttttgcccattcagtatgatattggctgtgggtttgtcatagatatctcttattattttgaggtatgtcccatcaatacctaatttattgagagtttttagcatgaagggttgttgaattttgtcaaaggcctttcctgcatctatttagattatcaatggaaatgtttctaaggcaagactgctaaaaacaaattcagtcttttgtttatttgggattgtctttgtttcccttttaattttaaaggattgtttttctggatccaaaactcttcgttatcagttcttttcttttagcattttagatatgttattccaattgcctgtggccatgattgtttctaattagaagtcagatgttaaacttatgtagttaccttctatatgacaagttgacttcctcttgctatttctaagattttatctttgcctttcgcttttcagcatttgaatactacatttgtagctgtgggtcactttgtgtttatcctgcttaaaatttgttgagcttttcaaatgtgtaaatgaatgtttttcatcaggttttggaaatttgggtcctttatattttcaaataatttttctacccatttcctttgttatttctctgtacttccactatacatatattagtatgcataatgttgtcccacaggtttctgaaaatctattcatttttctttaaaaatgaatgcaaatataaacctaagagagctggagcggctatactgatattagacaacttagaatttaggacaaaaagagtcttcccaaagacaaagtacatttataataccaattcaacagagagagaaaataattattattaatagtaatactatataataggtattctataaatatttgttagattgaagtttgtcagacctagatctttcaggctgggcaaaatcctaggggcattatgaaccacctctaataccccacagagttctacgaatattagataagttagtatatgatccgtctctgaacactcctcctatctagattgccagttcgagttacaggctgcaaatataatcagaatgaatgagaatggattttttgaacagtatatttatataatcaatttgccaaaattatcagcttcaataaactactagtagtatgttaaacattgtattaaggctggaaaattatttttgaaccagaaataaataagcttaggtaagtgaatggtagctaaaaattacctgctggtagcaaagctgtaaatataattactaaaaatgtccttctgaaaatatgtatgcacccctcagttgtccatctcaactggcttttaatctcacaaccagaaagaagtatggtaagtgttaagggcgttaataaagtacacttcacactgatgtttaatgagtttgccaaaattcccaggcataatttttaagtataaaataaattaaatattatatctttatataaatatataagtaaagtattatatataaatagaaattaaaattgagatgtagacatttccagctgaaataaagtgagaaggtgatagcattatttcttactaaaaattggtaataacagagctggtatatctttattatattcattaatgtcatgatacttttccagatatctagacttacaaaagaaggtaaataaaatgtggtttctacttcaagagtatatatttagttgtaaaggctcttgaaggtggtttgtcaattttctttgaaatcaaagggcttataaagattcagaggtagtgtacttgtgtggattttctcccttgtcatcacaaagaataaaagaagcatcccccttttctgagttagaaatcaaaccttaccaaggactgtttcacccaattgctgttttgaaatttggtcatcttaaaaccaagagagaaaattcattttacacacaagaacccatttcttcttatgtctacctccaagaaaaattttatctcaatgttgctaagtattcctggtattgtcatcagcaaaatctgctcatatgaacaggattttaggataaaaaaaataaagactgctttacacctcttgtctgttaaaggtaatgatgggtatctggatgagagttagtggtaaagaccttcaggctatgtaaaaccattaatcaatagaacaggaatattccctggctaatttatctgactgctttaaacataggactaaaaaataggaagtgctcagcataagggaaattaccttggcaacgtggcatatattcttttggagagagctgtagaaagactctaaaatgtaaccactactgcctgaaatctttgcagaatgcccacagccttcagcttttcccaaaatcaaataggatacaattattgctgctggtttccagtcaacattcaaatccatttaaaagcagattcctataaagttgcctctatccaaatatgcaaagtggtcttatgaaaaataacatttatgacccaagatccagttactagttttagcaaccttgagggagccacttagacttcaaaatatagttatacgctttaggtgtatatgtttatatagggatatatgcaaagaaaagcatttgaatactcaatatgcttgtccatctaaaaatctgaattttaggaaactaacaatttggaatttatttttaacctctcaattacagtcacatttttaagtaataaccattagttttcatgattgcatctccagatgctctcacatatattatcttactatgaagtaagaatgattttatctccactttaaatatgaagaaactgaggcttagagaggttaagcacattgaccaagttcagctaataaatgtatggagttgagcaagcattcttgttttttaactcctggttccagactctttcagaatctttgggaacttcagtgaattttcccaagattgcaagaaaatttcttcccactgagctaatattggagtgaaaaataaagacttattccttacaaaaactggcttcaaaattgcaaacccaaagccacagctctccctaaatattctcttttgctcctcccacttcttcaacgggaatgctttggcaaagacatgcttattcttttgccagattatccttaaagaagcagccactaagcaaaaagcctggactcagtgattatttatttaaaaaaaaagggaggacagtctgtagcaaggcttgcctgagtataccctcaataatcacccagagccttctttttgaaagccctttgaagtgtcactgatttctctatttcactagcagaaaagtttcaccaaagagtagtaagctatgcaatgaagcccattaactaataaaatttccttatttgtttatttattcatctattcaaatatgttttggtctaccaggttctggaaatattgaatactgcaggtgcaaagatggtcagttctaattttaggacaatggatggatggttgatgctaacgtcttactgcttaagcagctttcaagaatcttgggtaaataacgaaattaagtcagaagtcaacaagacatacatgcagccaacaaacatatgaataaaaagctcaacatcactgatcattagagaaatccaagtcaaaaccacaatgaaataccatctcacacctgtcagaatgactattattaaaaagtgaaaacacaacagatgctggcaatgttgtggagaaaaaggtacgcttttacactattggtgggagtgtaaattagtttaatcactgtgaatgtgtgatgagccctcaaagacctagaggcagaaataccatttggtccagcaatccaattactgggtatatacccaaggaatataaatcattctattataaagatacatgcaagtgtgtgttcactacaacactatttacaatagcaaagacaaggaaccagcctaaattcccaccagtgatagactggataaagaaaatgtggcacatatacaccatggaatactatggagccataaaaaggaaagagatcatgttctttgcaggaacatggatgaagttggaagtcattattctcaacaaactaatgcaggaacagaaaaccaaatactacatgttctcatttgtaagtgggagctgaatgataagaacacatggatacatcatggtgaaacaacacacactgggtcttatcagagaggcctatggggggaaggagggcatcaggaaggatagctaatggacactgggcttaatacctaggtgatgggatgatctgtgcaacaaaccaccatggcacacgtttccctatgtaacaactctgcacatcccgcacatgtaacccagaacttaaaaattaaaggagaaaaaaaaaaaagcttggagactagtgtgaaggacaaaccgcacagtaaggtaagtgtcaagatagaaagatggtagtatgggagtccatagaagacacatatagccctgtttgacttaaaggaagtagccagataaaggtcttgcacaagtgataatgcttagtctagaaagttaagtagtcaaaaaaaaaaaagtgaattggagagagagtaagtatactctagaagtttatttagaattccagataagtggctcagcatacataaagacagaaagaaaaagatataagcatcaaatgcactccttgtactacaaggactttactatgactagaaaaggttacaaagtttaaattttgtattttccaaattgcatccgatttaatgaacctcaaggttacaaagttggatttggaaccagaaagcaagtgaaaacacgcattactgggtctttttccccctctagaattgttagtgatgatgccatgtgttgaaaagtcaaatcaaagaagaataattcttggaacttattatgtaagtcatgttgcatacataagtttgctgaagttattcagagttgtacaattttcagacattttaatgttttgagaacatgaaaattcctttttcagaaaattggctaatatatacattcaatggaaatagcaactgcctgggctgcttctggaggcccacaggcatttcctattaggagatgcacaatctgcaatgttctggagctaaaaggaaagggtagttaagtgaccttttggccaacatttccttccaatcaaaattacttccttcctcttccctcactcccttgtcaattggtaagtttctctcaagatttcagaaaaataggaacagctatcgtaataatctagttggatatactagtttattgataaagagaaaaaatgaatgctggtcaattagtattgcacacatcaaaataaacacgttcattaagtatgtactgaccaaactttgatattactttaagggaagaataaagaacatcagttcaaaaaaatgggtaagaagttaaaactttgttcatttaaattgcagtttggtttgtggtgtaggaatctgaagacctggatcctagccctgactctactgcctaccaaatgtgcaatctggagaaagtcagatttttttatgtggatttcagtttctcaatttctatattcaggtaactgagttttgatctccacttttttttaatgtataaaacatttatatcagaaattttaattttaagaccaaaggaaaattattgttcatgtgactttgcaagatatgactacacatagaattattcaaatggacttagtctttccttcctgagtctactgtatatgactttaactggcaatcagaaagaaaaataatttgtatatagctgccttttaaaaggaaagaatgccagatttgtggacaagatgacttttattactctttcaaaaactacattagaaactgcagtagaacattatttcatttgttaaacaaacctcgcccaaacttcctcaaagttaaaagaacacatatgtgggaactagaaaagcctggtttgcaaatgaactaatacaaatatccaaagttagaactttctgaaataccttatcaaaccgtttatgacactttcttaaagaaaagtcttagctggaaaaagcagcttacattaaataattgtttcagggatcctgaaatagatggcaattaacagttaataaataatcattgacaactgcatacagtctgttacgcaaagccacaaagtgggtagagaaagtggagtggtagggagaactgtggacatttagttaagcttaacattctgtcaaacaactgaagaacaaactgtaatttgtgtatagaatcttctgttaaatctgctgctgaaacttaaaaaaaaaaaatgctgagcacggagtaacattttggaatttcccctggctattcttatcaactagccccatttgttataaaagtgggtcattctaatagcactatacagatttgctagaacataaatgaaaattttaaaggacacattaatccaaagaattccattaagatactactgctgcacatgggacaagtaagaaaactaatgtgatacagaagataaggaaaagaggacaaatattctccaccccaaggtaaaaaataaggtagattataaggagaaaatacttttagtaaacagggggtgggtgagtatatgacagtttccttctagataacttttgacagttggcctccacataatggtaagataatttggggtttgctaagtaacagcgacatctaaaacatgttctgagtaaagttaacagcatctaatatctgttcttttagaaaactacatgcacgtaaagaatatatgggcctttttataatgagatattttattttatgatcagaagagattggcaaagaaaggctgggcacggtggctcacgcctctaatcccaacattttgggaggctgaggcaggtggatcatgaggtcaagagatcgagataatcctggctaacatggtgaaatcctgtctctaataaaaatacaaaaaattagctgggcgtggtggcaggcgcctgtagtcccagctactcgggaggctgaggcagaagaatctcttgaacccaggaggtggaggttgcagtgagccaagatcgcaccactgcactccagcctgggcgacagggcgagactccatctcaaaaaataaaaaaataaaaaaataaaagaaattgggaagtaaggaaatttaaatcaaatgtttcttatgaattaaactatattgacatctcagaggactgcaaatgtaaacactcctaatcatgatgaatacaatacatattcctctttaggtaatgtcaactctttagaaattggggagagaaagaactattcccacatgaaatcataataaactctatattagaaactactctattgaaatgcctgctttaaaattaaaaaaaattagtgaattttatattcatggaatagtgatttttatatctgctgaagtggctaacaatgcatgtagttgataggtcagttaatcaattagaatttattgagcacctaaggtcttggacagtggtactgggatatctatttgacattattaatggaatcctagacagtcattgttgaataataataaatgaggactacatccctggccccgaactctggcaggagcttaggaagggaacattcactacaatcatggatctagatagtgattcagggaggccaattttaagggaaaacaacccagccacatcacctggtgttagactggacctgagattcgaagatattaaactaacacataagcaggacagagagaagatgcctggatgggaagtgtatggtgataattaaaacaggaactctggacccgacagtaagggttaaatgagtcaagatgtgaaaacagtgcttagaagaatggctggcatataataaataatggagaagtgttcattgttattatacagtgaatcatccaccctaagagcaaagctaatgcaactaattctgtcttctatggaatacttcaaaattattttccacttttgattaaacctcatatttgattttattagaattttacctaagaaacatcacagtttgttctgggtcctatgctgtacagggaatagcctacagtctggtacaggtcaaattaaactatcctaaccagttcagctgaaattatggtcaaaacaacaataatgtagatgtttcataagaaatatcatcctttgttacactgtgtccctactgaagcttgtacaacttttggattttttatgaaggcactgatccaattactctacctttgggcaaggggtgttgttgtttcacttcctcaaaataagaatcctacattaccacagaatcatcaacacatagaggactgctggcgtatggaacatgctcaggaaatatttgctgagtggattaatggccaaaggaccacagactcaaagatggaagaaccagagacaatataattcttcatcctatttcacctgcaaggaaacgaaaaactaatacagggttgaagccaacttaatctggatggggaatcaatctttcgatgatcataattagggtaatgcttctcttcctcctatactctatcctttctcttttcccttctctcactctctatgtccttttgtgtccagaattggtgggttcttggtctcgctgactttcaagaatgaagccgtggacccttgcggtcagtgttacagttcctaaagatggtgcctctggagtttgttccttcaggtgttcagatgtgcccggagtttctttcttctggtgggttcatggttttgctggcctcaggagtgaggctgcagaccttcatggtgagtgttacagatcataaaggtggcacagacccaaagagtgagcagcaggaagacttattgcaaacagtgaaagaacaaagacccgagtggcttgcgctgttggcttgggcagtctgcttttattcccttatctggcccacccacatcctgctgattggtccattttacagagagctgattggtccattttgacagggtactgattggtgcatttacaatccctgagctagacacagagtgctgattggtgtatttacaaacctttagctagacataaaagttctccaagtctcaacctgactcaggaccccagctggctttgcctagtgtatctggtgcctactgggacccacgctggggccgcaggcagagctgcctgccagtcccacaccctgcgcccacactcctcagcccttgggcagttgatggcactaggcctctcactgcctggggccggcggcgctggccagctgctccaagcgcggggcctattgagcctgcgcccacccggaactcgtcctggccgcgtgcagcctcggttctcactcgcacctctccctccacacctccctgcaagcagggggagatggctcctgcctcggccagcccagagaggggctcccacagtgcagtggcgggctgaagggctcctcaagcgtggccagaatggatgctgtggcctgaggtgcccagagcaagcgagggctgctagcacactgtcacctctcactttccctctactcttcatttttttatttatttatatttttttgagatggagtcccactctgttgccgggctggagtgcagtggtgcggtctcagctcactgcaattgccgcctcccaggttcaagcaattcccctgcctcggcctcctgagtagctgggactacaggcacacgccaccacgtccaggtaatttttttttattctagtagagacggggtttcacccatgttggccaggatggtctcaatctcttgacctcgtgatccacctgcctcagcctcccaaagtggtgggattacaggcataagctaccgtgcccagccttgcctctactcttctccgcctacccaatatttctctgcctctcctttggaattgagtctttctgaaagggaggtactgtgcacaaagaggtcccatagttacacaatgctaggctcaaactctaaccttgccacttatattagttcctcaacaattctaaacctcagtgccctcatctagaaaattgggataaaaatccatactgtgtaattacgacaattcttgataaatacatgtttgcgcatatgtcacttccacacgaaacttctgcagcaacctccccagtgtaagccaggttcttctgttatatgctcttatgatgccctccacttttccttgcagcttttaacataattataataaattatgtgtgtgtttgtttatttaatgttggtttcttccattagattattaagctctgtaagtgcaaggatcatgcctgctatatttgcatttataattctaggacatagaactcctgacacaactggaccaacaatgtatacatgttggatgaggaaataaagaaaacaagtgcttaacataaaaccaacaccaaaataaaattatttgtatgtagatcattattaaatcaatgaaatcagggaaaagttatagaagccatcaaatatttatttccagtaatttttaaaaaatttaaccccaatttcaagaaagacttcattcttttgagtgctttttataatttttaacccagcattaaataagtgtcgagttacttttatatctcatctggaagataactgtcataaaacatggtcccctttgctatctgactcaagagacaagaaacaacttacaatcaatgtcacaggaactcaacagacagaaaagattgaactggactaccacagatgggtataggggtaagagaaaaagaaatcaggacattctaggcaaggagaactgtgtgagaaagtgttgagcggccaaaacaactctcaaagagaatgaaagacaattaaaaagccagtttgtactgtaaaaagaagaaatactactgaggaataatggagtatactccagggaatgagatgcagggtattatttcctagtcagttttcagaaataaaattttctcctgctgctaacaggaaacttgaagaattttaaataatttaactaactggtattttaggaagattgactttcagtatatgtgccagtataatttaccttaaattaaaagaaagtagttatttctataatttacatttatttatgtttatagagtgtttcctaaagaaacaaggttagaaattaaaataatgatggccgagtgcagtggctcacacctgcaatcccagcactttgggaggccgagacgggtggatcatttgaagtcaggagtttagatcagcctagtcaacaaggcgaaacaactctactaaaaatacaaaaattagcagggcatggtggcccacgcctgtaatcccagctacaagggaggctgaggcaagagaagcgcttgaacccaggaggcagaggttgcagtgagctgagatcaccccactgcacttcagcctgggcaacagagtgcgactctttctcaaaaaaaaaaaaaaaaaaaagaaagaaaagaaaaaaaaaacgaaagaaagaaattgaaataatgatcattccaatatcttttttaaatagaaggctttgaaccatatgttgagtatttttatactaagctatgacccaaggtatattaaatatacaggagaagtgaaggttgatttccaaattatctctaggtccacatacctaatatattcatttcctttgaatgggtccctaatgactcttacattatgccatttttgaaaaggaaggctctatgatgtgtgaggtgatctatatatataatcaaaatataaaacacaaatcattcatgcacaaaatgatgatagcatagttaaaactcaatgaatttgtatagccatttttaaaatttgttctccagaagttaaggatcttctgttattcaatccaggaccaggacaatggaaagaatgacatcatgattcccatgccacccagggaaacaaatcaaatacaaatcactaaaaaagcctccaaagagtcaagacacaattaaaatttttacaaaggaaggtgcctaagcagaaggtatttgaatgctattggacttaaaaatgatgtttgggaattttaataaaatgtttcatatgaaagggaaaacaatctaaatgttgacaacaaagcgtggcacattactgactaaaaaaaattctaaagctaaattatgtcccaggtattcactcaattaagtaactagataaacagctaatcctaacacatactgtgagccaaataattctggtcacgttttataggtcagcctagagtttctcagatattttcactaaaatacttctcaggggctacagaataattacatatggggatataggatttagagggatggcttcagcggccccacaccaaatttattatcatttcatacttcatctttaaaaagtatttttttaaatatgtaatattaagatacttttccctcaaaactccacataatgatctaggaaagtcagccatactttttctgggtttgtgtaccttcttggacaacttctgtataaatacaggtatagatattttgccttgaaaactaatttaagcttcacagccactctatgaagtaaataccattacccccattttatagatgagaatatgaccagcccaaggtcacaaagctattaatactaagaggtagagagtgtatattaatccctgtttttcggaaaccaaagcccttgatgctttttctataataccataatactttcaccacaaaatataggagtaacaaagttagagcttatacttattggaattttgtttcttatagtaattctcaaaagaagcaatagctttagggaaatatattttataaaaggaaaatcaatttttcttaattttattttaaaaaattgaagcatactaaatggcctctagctaaaagtttatttttgttgtggggaagcacaaggaaataaatactattacaatgttatatttaccaggtaatgtaatgtcaaaataccaaaataaaatttatactttgtaagtaaattgcatgtattcttaagaaaaaatataaaaccatgacaattatctacaattagtcaaataaatggtatacctgaatatgagtaaaataaaaattataaagtggagtgctaaccctttatcactattggggagacaaggacttagagagggaagtcaaatagaaaaattctgcctgtgatttagaatgtaaagaaacatagatagttgactttgcactcatggtaacaccaagaaaatctagagagtataaaagacatacattttgtaggactactgatatgtggtgagttacagcagctttcaggggcaaatggtgcaggtgcagggaacagaaaaggagatctgccaatgatcaagaaacttaccttgttaaaaaatggtcaacagagctatggataacggtaggatcagccaggaaagatggatttgaaaaattctcaagtgcagtattatttgcacgtcataaaaagtcttcctaccttattctttcccaagtttactgagaaaagggaagtgaagataggcttgaaaagcaacaaagaatgtatgtattcttaagagagtatgtatttctaagagtgctagaaagctttgaatctaggctcacaaactagtcaaaaagacaatttcctaggcagctactacagtgagattgaagttgacataaacaaaattgaacataatctgcttaaagttgaggctcaatcacacactcacccgatattaataatttctgaattattactgcctcccttttgttaccaaatgtagggcagagctctcactctctgggaaaaacgttttcctataaaacatgtctagtataataaaatacaatacatgcaaaaaagcaagaaaataggatccaaaagaaatcaatccatagatcaccaaaatagtggaacaagtagacaaagatttttgaagtaactaatacaaatatgttcaaaatttacataataataaagaaaaaatggaagaacaaataggaatcttggcagtaaactgaaaataattttaaaaagaacaaaatcaaaattgtagatatgaaaaatacattaaattatcaatacactgaaagggttcaaaagaagaatgaatgaatcaccaaagaagggtttactcagtgggaatataggtcaatagaaattattcaggataaaatctgagagaaaaaatactgcaaaataaacctacagtgtcagttatctgtttgacaatatcaagtggtctaacattcatgcagctggagtctcagaaaagaaaaagtgggaaagacaaaaatatgtgagaaattatttttctaaaactttccaagtttgatgaaaaaaaccacagttctaagaagtccaatgaattacaaagaggataaatatatggaaaagtatgccaagaaatattctagtcaaaatattataaattttaaaaaagaaagaaaatcccaagactactaaggaataaaaagatatgtcacatacaaaggtactattataaaagtgactgaaaacttcttagaaaaaataatgcacaagacaaaccagtgatgtctttggagtactcgaagggaaggaaaaattagtcaaattagtattcaatatgagtaagaatattattaaaaaatgtagtcaataagtaattttacaatagatcatatcagagagcattaattgccagcatgtctgcaccaaataaaacactgaagaaacatttcaggggaaagaaaaataatagcagttggaatttcagatttacagaaaaattttaaaagtcacataaaaattagtcacccgactaatttttgtatttttagtagagactaggtttcactatgtaaatatccaagactttttagcagagactaagtttcactatgtaaatatccaagacttttgataatgcttcccaatttcattgaaagatgtttaattttataaattgctttgggcagtatggccattttcacgatattgattcttcctatccatgagcatggaatgttttttccatttgtttgtgtactctctgatttctttgagcagtggtttgtagttctccttgaagaggtccttcacttcccttgctagctgtattcctaggtattttattctttttgtagcaattctgaatgggagttcattcatgatttggctttctgcttgcctgttgtcggtttaaaggaatgctagtgaattttgcacattgattcggtatcctgagactttgctgaagttgcttatcagcttaagaagctttaagactgagacaatagggttttctaaatataggttcactttttttgcaaacaagatggtttgacttcctctctttctacttgaataccttttatttctttctcttgcctgatttccctggcagaacttctaataccatgttgaatagaagtgctgagagagggcatccttgtcttgtgcctgttttcaataggaatgcttccagcttttgctcattcagtatgatattggttgtgggtttgtcacatatggctcttattattttgaggtatgttccttcaatacccagtttattgagagtttttaacatgtagggatgttgaattttatcaaacacttttccacctctattgagataatcatgtggtttttgtcttttgttctgtttatgtgatgaatcacatttattggtttgtgtatgttgaaccaatcttttaccccagggatgaagcctatttgactgtaatggataagcttttggatgtgctgctggatttggtttgctagtactttattgaggtttttgcatcaatgttcatcaagcatcgtgccctgatattttcttttttgttgttgtatctctgccacattttggtatcaggatgatgctggcctcatagaatgagttagggaggagtccctccttttcagttttttggaacagtttcagtagaaatcgtatcagctcttccttggacctctggtagaatttagctgtttatatgtctggttctgggctttttttttttttttattggtaggctatttattactgcctcaattacagaacacattactggtctattcagggatacaatttcttcctggttcggtcttgaaagggtgtatgtgtccaagaatgtatcaattttttctagattttctagtttatgtgcatagatatttaatgctattcccattaagctaccattgacattcttcacagagttagaagaaactattttctttttttttttttttttttttttttttttgagatggagtctcactctgtcatccaggcatagtgttatggtggggtttcggctcactgcaacctccacctcccgggttcaagcgattctcctgcctcagcctcctgagtagctgggactacaggtgcatgccaccacacctgactaatttttgtatttttagtagagactaggtttcactatgttggccaggctggtctcgaactcctgacttcatgatcctcctgccttggcctcccaaagtgctgtgattacaggcaggagccaccatgcccagcctattttaaaatttatatggaaccaaaaagagcccaaatagccaagacaatccaagcagaaagaacaaaactggagacatcacactatccaacttcaaactctcctacaagcctgcagtaaccaaaagaggatgggactggtacaaggacagacacatagaccaatggaacagcatagagaatccagagatgagatttcacacctacaaccatctgatctttgacaaacctgatgaaaataagcaatgaggaaaggattctctatttaatacatggttctgggagaactggctagccatatgcagaaaactgaaactggaccccttccttaaaccttatacaaaaattaactcaagatggattaaagacttaaatgtaaaacccaaaactataaaaaccctagaagaaaatccaggcaatatcattcaggacataggcacaggcaaagatttcctaacgaagacaccaaaagcaattgaaacaaaagcaaaaattgacaaataggatataattaaactaaagaccttctgcacagcaaaagaaactatcatcaaagtgaacagacaacatataaaatgggagaatatttttgcaatctattcatatgacaaaagtgtaacatccagcatctacaaggaactcaaacattacacacacacacacacacaaattaaaaagtgggcaaagtacaagaacagacacttctcaaaagaagacatcacgtggccaacaaacatatgaaaagaaagctcaacatcgccaattattagagaagtgcaaatcaaaaccacaatgagataccatctcacgccagtcagaatggctattatttaaaagtcaaacaacaacagtttctcacaaggttatggagaaaaaggaaagcttttacactgttggtgggagtgtaaattagttcaactgttgtggaagacactgtggtgaatcctcaaagacctagaggcaaaaataccatttgaccgaacaatcccattactaggtatataccaaaagaaatataaaaaattctatgataaaatcacatgcacatgtatgttcagtgcagcactgttcacaatagcaaaggcatggaaccaacctaaatgcccatcaatgatagactggataaagaaaatatggtacatatacaccatggaatactatgcagccataaaaaggaatgcgatccgccaggtgtggtggctcacgcctgtaatctcagcactttgggaggctgaggtgggcagatcacgaggttaggagatggagaccatcctggctaacacagtgaaaccccgtctctactaaaaatacaaaaaattagctgggcgtggtggcgggtgcctgtagttccagctacttgggaggctggggcaggagaatggcgtgaacccgggaggcggagcttgcagtgagccgagattgagccactgcactccagcccgggcaacagagcgagactccgtctcaaaaaaaaaaaaaaaaaaggaatgagatcatatcctttgcagcagggacatggatggagctagaagccattaacctcagcagtctaacacagaaacagaaaaccaagcactacatattctcacttataagtgggaactgaatgatgagaacacatgaacacatggaagggaaaaacacaaaatggggcttgtcagagggtgtgggtgacaggagggaatgcctcaggaagaacagctaatagaggctggtcttaatacctaggtgatgggatgacctgtgcagcaaaccaccatggcacacatctacctatgtaacaagtctgcacatcctgcacatgtgtccctgaacttaaaataaaagtcggggaaaaatattttttattttttatttttgagacggagttttgctcttgttgcccagcctggtgtggaatggtatgatctcagatcaccacaacctctgcctcccaggttcaagtgattctcctgcctcagcctcccgaatagctgggattacaggtgcccaccaccatgcccggctaattttgtacttttagtagagacggggtttctccatgtttgtcaggctggtctcgaactcccgacctcaggtgatccgcccacctcggcctcccaaagtgctgggattacaggcgtaagccaccgtgcctgccaagatatttgatttttaaagcaaacaacgttttgtggggatgtacagcataggtaagagtaacacaaaaaatagaaatagagaaatacagtacaataaatttcttatatgtggcagggcacggtattgattcatctaaactgtaataggttaaagatggatagtataatcttcagtgcaactactaaaaattaatacaagaaaaattttcaatacaggaagataaaatactacaaaatatgtgattattccaaaagaaggctggaaaggaagatcaaagaaacaaaaaaacagaagaaacagataaattactaatggtggacttaaatgaaacattataattattatttatattaaatgcaaatgaaagacatttcaattaaaaggcagatatcagaatagacattaataaaaacactctacaatgcttgccattgatatactttttaatttattttattttatttgttattattcttttgagatagagtctcattctgtctccaggactggagtggttcactgcaccctctgcctcctgaattcaagccattctcctgcctcagcctcctaagtagctgggattataggctcccgccaccacacttggctattttttttgtatgattaggagagatgggattttgccatactggccaggctggtcttgaactcctgacctcaggtgatacacccgcctcagcctcccaaagtgctgggattacaggcgtgagtcaccgcacccagcagccactgatgtactttaaattaaaaaacatagatagaaattaagaggatggtaaataaagctaacacaaatcataataatagtgaactgcgttattaaaggagatgatgtagactgtaaaacaaggagcaaaacggaaaaagagggatatttcataaggactaaaagacagattcagcagaaagacaaagcaatcttaactgtattcatacctaaccataaagcttcagaatagaaggagcaaaaacttacaaaactaaagggaagtatagacaaatctacaaatatatttggagactttaatattcctctttgagtaattgagtgaacaagtaaataaaaagtaagaatataaaagattcaaataatactattgaccaaattggcactatatatattatagaacactcagtatatgcataatacagattctttttaagcacacataaaacactcatcaagtaagactacactgggccataaaacaaatctcaataaatttcaaaggactgaaaacatagactaaattctctgagaataacagaattaaattaaaaaaaaaaacaaaaataaagtaacatatttcttaattatttgtgagtcaaataaaagatcataaagaaaataaaaaatattttgatttgcagcataataaaagcataatagataacaaatttttttggactcagctaaagtggtgctaaggaaattcattgccttaaatgcttgtaatggaaatcaaaaaagatcaaaaaccaatgatctaagcttctatcttaaaaagctacaaaaatgaagatggtatattcaaagtaactaaaagaaaataatgaaggacagaagtcagtgaaatagaaagcaagcaaacaatagaagatgtcaccaaatacaaggtagtactctgataaaaatcaatgaagttgataaacacctaataaaactgatttttttaaagacagatggcatcaattccaatatcaggaataaagggagaacatcattacgagtcttaaatatattaaacagaaatgaaggcaatattatcaacatttctatgctagtaaactctgcagcttagatgaaatactgtaatatttcatctaagttgcagtttctttggcatagaaactcttttcaatggacacaaactaccaaagcttattcaagaaggaatagaaaactgtttagtcctgtatagtcttgtatagtcctgaatcgtcctgcatctgttgaaaacattgaatgtgaagtttaaaaactccacaaagtaattccatgtccacatggccttgcttgtaaattctaccaaatatgtaaagaagaaataacaccattcttatacaaactcttccacaaaatagagaacaaaggaaaacatcccaagtcattttttgaggccagggttagtctgataatataacctgacaagaacacaatgagaaaagcaaaagatcaatatcctccaagaacaaagatgcaaaattcctaaacaaaatagtagcacaccaaatctaataatatataaataggataatacatcaggaccaaggggaatttttcacaagaatacaaggtgggcttaacatttaaaaatcaatcagtgtaactcaacatactaataatatacaagagaaaattcatatagtcatctcaataggtacagaaaaataatcggacagtatctttatacctatttgtgataatgcttccattactttgattcaacattatattggagaccttagcatggacattataatggacaaagaaaataaatagaaggcataaaatttggggaataatgcataaaaatgactttgtttgcagatgacacaactttatatgtagaaacctcccccaaatctaaaacaaacaaataccaaaaaattcatataaaattaggttaataagggaattcagtaacgtcttaggataaaagttcaatgtaaaaagttatttgcatgtatgtatattaccaaccaactgttggaaaattaaatttaaaaaatcaatgccaattcatcagcaacaaaaaatacaagatatataagaataaatctctctctctctctctctctctatatatatatatgtatgtatatatgactactcctacactgaaaattacaaaatactgctgagatagcttacataaatggaaaaatataccacgcttatgggctggaagactcaatattgtagagaggtaaattatttttaagtttacttgaaaagtcaatgaaatgccaatgaatatcatagcaggctttctgcagaatttggtaagttgaccccaaagtgtataaagaaatataaagggtcaagatagccaatacaatcttgaaagaaaaaaaaaatcagataatttgcactacttgactttaatatttattataaagctatacttactaagacagtatggtattggcatatgctagacatataaatcactggaacaaaatactgagtccagatatagtaccataaatatatagtaaaataatttttgacaaaggcgccaatggcattcagaggggaaagaaacatctttttgaccaatggtgctggattacctggatatctattggaaaaattgaaccttgacatcttcctcacatcatacacaacaagtattttgtgatggattaaaaaccattatgtaatagttaaaactataaagttcataaaagaaaacatttttaaaattctttgtgatctagagatatgcaaaggtattttagaatccaactcactaaccataaaagaaaattttataaacaacatgataaaaatgtaaatgtctcatcaaaagtcactcttgagaaagtgaaaatgtaagccacggtctgggacagaactgcaaaacatgtttatgaaaaagatttgcatcttgaatatacaaaacaattttcataaataaataataaaaaagtaaatagctcatttctttacatggggaaaaaaggctcacctgagtaactttagaaaacagtgttctgtatccctgaacctgaaataaaagtttttttaaaaaaggatctatgaatccacctctaacctataagcttctgcttcaacatatctcacctttgcagtccaaaccaatgtatacgtttcatgtatacattagtatttgtattttacttttactatatatttatggcactatatcttgacttacaattttgttccattgatttatgtctttgcctgcaactcctgtctccctgaaatgtgtaaaaccaaactgtaacacaaccgactttggtgcactctctcaggacctctagagactgtgtttctgtgggccatggtcactcatattggctcagaataaactttttttttttttttttttggtgagatggactcgctctgtcatgcaggctggagttcagtggtgcaatctcagcctacggcaacctctgcctcatgggatgaagtgattctcctgcctcagcctcctgagtagctgggactacaggtgcgcgccaccacacatggctaatttttgtatttttactagagacagagtttcaccatgttagccaggctggtctcgaactactgaactcaggcaatctgcccacttgggcatcccaaagtgctgggattacaggcatgagccaccactcctggccagaataaactttttaaaataaaaaataatgaaagaaaaataaagaaaatggtgttttggctgaaaactatgtatttaaagataaaaggaagtgtacactgtacataaacactgtactttaattgataaatttgtttatcatagggattaaggttaaaagttttgaaaccagtttacatgtatactggtattaagtaaatagtggatggtagaaagtgggagtctagcttctcacttttggagagggaagtaaccgataagcagaaaaggaaggttagaatagaactggagtatagtcagagacatcaatatgaactcatgtttaaatatagactcatatatgcacccaaattaatagatttaaaaattatagatatatgtgtatacataggataatatacatacatatattacctagatttgtcccttgagagaatctggaaacactagtttaaccacgtgataaaggttaacgtcaccagaaacgtcaagtagatattacacatcacctcatgtgatgtattgagaaggacagttgacctctgtgatattctttttaaacactcataaaactagtctgatcattaaagtaaaaacattagataaatctagattaggcacatttcacaggatacttggccagtattctaaagataatcaaggtcgcaagaaataagaaaagcctgaaaaattgtcacaggctggaggacttagagtaacatgacaaatgaatgcaatgcggaatctcggactgaattccagaagagaaagtatacgttaataggaacactggtggaatccaaataaagtttggagtttagttaatagtaatatatcaaagttggtttcttaatgctgacaaatattctatggtaatataatatgttatcaatgtgaaaaactggttcacgggcataaagaaattctctttcctatttttttaacgttcctgtaaatctaagattgttccaaaataaaaaaaaaaatttgttcgtgaagaaatggacaaacacttggaccaacacttagcaagatgggatatatgaataaacaataaacacatgaaaaagatgctcaaaatctttagtcttagtggaaacacatgccaaaagcgcaatgagatgccactcactggaatagctaaaattaaaaagatgaacaacatttaatgttgaagaggatacagaggaactggctcccttatacactgctggtgcaaatgtagactagaacaaccactgtaccaaaatgttgggcaggttctgattaaagattagtatcttcttataacagttaaacataacacctatctaaggatccagaaattctacttctagttatctactccaaataaattagactgggtatggtggctcatgcatgtaatcccagcactttgggaggcagaggcgggaagaacatctgaggtcaggagttcaagaccagcctgggaaacatggtgaaaccctatctctactaaaaatacaaaaattatatggtcatggtggtacatgcctgtaatcccagctactcaggaggctgaggcaggagaattgcttgaacctgggaggtggaggttacagtaagccaagatagagccactgcactctagcctgggtgacagagtgatactctgtctccaaaaaattaaattaattaattaattaaaacatatgtccacaaagtgtcctgtaaagatcacatggacacaggaaggggaatatcacactctggggactgtggtggggtggggggagcggggagggatagcactgggagatatacctaaggctagatgacgagttagtgggtgcagcgcaccagcatggcacatgtatacatatgtaactaacctgcacaatgtgcacatgtaccctaaaacttaaattaaaaaaaaaaaaaaagaatcttcattgcagctttattcagaaaagcaaaaaactgcaaacaactgaaatgtctattattgggaacatggataaacaaattattgtatgtttaaacaatagactactacttagaaataaaggaacaagttcttgatacaaataacaatatgaatgaatcttaaaaaacatgttgagtgatagaagacacagcaagtatatactgaattatttcatttttatgagtttaaggaacggcaaaactaagtaatgaagaaagaaatcaggatactggttgattctgggagggcacagactgaaaaaaagaaaagagaactttctagggtgatgtcagtactctatatctcagtttaaagtgttacacaagcgtattcgtttatcaaaactcagcaatctgtacactttaagatctgtgcattttgctgtatataattgtacttcacttaaacatttaggtaaggaaaagaaaagctctgacttgaactcttgaatcaagtttctaaagtatatcgttggatgaaaagaaacaaaacaactgtagaaacagatataacagaaatatatgacatctgttagttctcactggagcataaactactgtaaaaagtgattatagtcatctcagactctcctgattgcaattaagccctctcatattggtgatacaaaagtactttctgtattgctgtattcctctcttatggcattcctattattgcagagatgaatgcaaatgataacccacttcagcctaggtaattgagtattatcctattatacttgtagttcacctccttccctgctcagattgagaccagtgccatattctctataagagaagctttcaaaattagtttgaataattatttatttaagagagagattgggtcttactatgttgcccagactggtctcaaactcctgggctccagtgatctgcccaccttagcctcccaaagtgctgggattacaggtgtgaaccaccaaacccagccaatttaatttgtaacaggttttaaaaagggaaagcttatgggtaaatataataaatgcatgcccacttcccaaattttccctattgctttaggtaaaaacaatactaaaaaatggaagacaaaattttaattcaagataaaatagactttccttagtattataactatgtttaaaactattttatttagttttatcacctataggaaactcagtctataggatcagatttaactcagcagaaaaatcccttttgttaaagggaaaataatggctgattatattcagactttttttgctgtgaagataagatatatttatcaaaattagagtagatggctccaacatttccaaacttagaatatatgctatacttctattctatataagaggataaatagatgtgtatataacctccctcaagtgtgagctggaaaggctcagtgcattgcatataaacagttatgccaagacgctggtttcattatgaaacatttacactaagcactgtttgcagcatgcatgccgttctgtgtttttctattactttcaaatgaagtaatctatctgtagaaaatgagcaaatggaatattcatgagttaagagataatttttatcatccctggagaccgtctttctttgggttattacctgcagagctcaactgtatgaaaattgattaaacataatttaccaattatagtgataccagagcatattccttaaagcaaacactaaaagcataatgattctcacaatagaaggtatgtttgcagggctggatccaggttctgtggggcttgaatcttatataatttggggacctcttatttaagaaaaatgacataaaattacaaaaacacaattgctgcaatcccccttggggcactggaaagagccatgcaaatgaatggcctctaagtttcatttgcttaaaggaaaatctgcctttgttaattttattttaagaagtagtggcagtagatcaaagaatttgtccatttaaacctatttaaaaactaacaaataagcctttgagttttcgtaattgacttgaaaaccagtggctaatgatgcttttctaaggggtcatttgactgaattcaagtacggtacttactttcactttttttgagacaagagtctcgctctgttactcaggctggagtgcggtggtgcaatctcggctcactgcaacctccgcctcccggttcaagcgaatctactgcctcagcctcccgagtagctgggactataggtgcatgccaccacgcctggctaacttttcgtatttttagtagagatggggtttcaccttgttagccaggatggtcttgatcacctgacttcgtgatccgcccacctcagctccctaaagtactgggattacaggcgtgagccgcggcgcccggccttactttcacttttatgagacggggtaggtagatagttcccgtctgaaaatccatgctgccacattgtgtgagccacactgttattattctttactttcaggaggagctgcttacacagtttaccaactccctaggccttgttccagcaaacataaatcttcaaaatgaaaagaactcctagtccttaagagttaggtcagaggaaatcttccattgccaccccaactcccttgctacaccacaagaaggattaatcacccccatctaaccttccataccctttgtagtcatctcattatatcacttttctcattttcattagttatctgtgtatgagcctgactttgctaggatgtgagctccttaagagcaggaaatgctctatgaacttaaaaggcctagttcacactgggggctcaacaaatgtctattgaataaattaatgaatgactgctttagaggtaagctactcaaggtatgatccaaagtatgaactagtagcattggcattacccaagagtttattaaaaatgtaaaatttccagacttaagacctactaaattagaatgtatgtaagaggccaggcgcggtggctcatgcctgtaatcccagcactttgggaggccgaggcgggtggatcacgaggtcaggagatcaagaccatcctggctaacatggtcaaaccctgtctctactaaaaatagaaaaaattagactggcgtggtggcgggcacctgtagtcccagctactcgggaggctgaggcaggagaatggcgtgaacccgagaggcggagcttgcagtgagccgagaccacgccactgcactccagcctgggtgacagagcgagactccgtctcaaaaaaaaaaaaaaaaaagaaaaaaaaaaaggatgtaagatccctaggtaattcctatacacaataaagtctgagaaacactgtggtttttgttattgcactagcttgaatggaggactctaccaagaaccatatcattttatacatcacaattgttcattattggttattaatatgtttggctctgctgatcacacccacagagggcaaataacccaatggactattatcctgcttactctttcttttccttaacaaattaaaacagtaatttaaaaagcccaagcttagtagaattagtgaaaaatgatgatgaatatttcaaatactaacctgaaagttcagctatcaattcagagccaaaactagggtcttcatatatatatacatatatatatgaatacatatatacatatatatgaatatatatatacatatatatgaatatatatacacatatatgaatatatatatgagagaatatatatttctatacatgtttatatatgtttttatgtgtacatacatatgtatatgtttatatacaaacatacatataaatatgttttatatatgtgtaaacatgcttatatatacatgtatattctatacatgtttatatatgtataaacatatatgtctgagtatatctatatgtatgtttttataaacaaatcctcaagagttcaacctcagtttttgtagaccaatgcttctatatctcagaaacttgagatgaagaaataatcttggaaaattacgtaaaattaaatttagccagattgcactctcagtacagcttctaaaaagtatgtgtcaaatgaaatctcaggttgtaaattacaactcacctagttttaatttcatgagagaaacataactagcatattcagtttacagtccacttccacaccctcttgttaagcagattaaccaactgtctggaatttttcaagcaaaaagagataaaatgatcttggctcaattttaagagtagttatcttttcaggcacttaggtaatctattgaaagagcaatcatatatcagaaatgtgattaagtaggaaaaggtataaatatatccatttgatgaagatacatttcaatgcaagtcttgaagaatagaaagagaaattaaagattgcaaagaactgtcacctatggcagaagctattagtcatgtcatggtgaagaaataatgactgtcttagagttgctcagttcttcaaggtgaacttcaaaagaataaagtaacttcaaagaaaaacacagaaagaagaatatgaatcacagtagacgtgttgctggtggagttaagcatgtacctgttttagttgatacataggtccgaaacacgtcaaagcttattttttccttttcaaaaatcatactctgaattttctctgcaacatgagctgaattagaaaacttccacctgatcatagtaggcatagtatcttggtctgaatgctacataatgaaggataatccagaaatctagtaaaatattgtcactgggaagagcgtgtatctgtttctggattaatcaggataggctaggttacactgttgagcaaaattaacacctaaatttcagtgtcttaacactatcaattatttttttttccttacaaaaatcttctacaagttgagcagtttccaggctgttaacaaagagctggaggtcaagaaggggctttttgctggttcagcttaaagtccattgcctagaacaaaacataagatcctgcctaacttcaaaggagctaggaaatgtagtgtcccatctacatgctcatgaaagagaggaaaaccagatattgaggtgcagtaatgatgttactagtgagcatatgttagatgatacctatagagggtccagcatcagcatcagaaacaaacctctctgaggaaagtaggtagataaggacatactctgagatgaaaagataaaaaaataacatcactggtcatgaacaggtcatttttagtgtagaaatagtccagaaaaatgatgtattggacaatgtcttagaatcagcttataaattgaatgcattccaattgctcactgcttaatgaattccagaagtagtggttttggaaagggaagaactgacttgttcggtaagttttggttttctattgattcataacaccttactgcaatttagtggcttaaaaaatagccattaattatctcacatttctgtaggtcagaagtttgatatgacataatgggattctcaactgagtctcactaggttacatcaaagtgtcacccatggctgtgttcctaatataaggctctgggtctaagctcactggttgaagtaatttccttctcatgctttctttgtgggcccctatctattcaagcaagcatcagcaggccagtccttctcatgctgtgaatatttctgagtttctcttcttattttaaggctcatgtaattacagtgaatccccccagaaaatccaggataatctccctattttaagtttagttgattagcaaccataattatgtctgcaaattccctttgactgcattatgtaatataaccaaaggaataacgccaagcaggagagatcacggggggcaaaaatctgcctactacactataataggaatctttaagcctaatatttgttttacatgtaacgattttgtttatctaacaggatattgtaaaatggacacatactttcaatggatttgggttgggatgagtgatgaataagaaagagaaagttataaagaataagcttgtccaacctagagatgagggaaaacgaaaaagagtaggaaatagggctaagagtaaggagaataaaaggagcagcggatgtgcaatggaaagcatgaaggagacatcaaacttaatactagcaattggtggagagaccatatagtgggctataatataaatcattagcaacaaagaaatgttatattgctcatagtaattcaggtactaagaagcttaaatatggtaggaatttcctgatttccctactacctaaatagattataataaataaagtgtatttgtttttctgaatttaccagctggcattatggaatcatgaaaatatagtaaaaattcaaggggacagtatgtatacaaagtggcaagctcacatttagctcctaaaaaataaatgaatggaaggaaaaaagtttgattatttaaaaaccactaattgtcattagtttatatcaaatcaatagataagacttagcagaatgtttcctaaaactaactggtcaatgaatatgttcaaactctccatcaatatgaacttctttccttatttctgtccattctctggtacaggttctaacacctccgaaagaagccagaaataaggtgtcagaaatatcatgaccatttatatgggttggctgtgtccccacccaaatctcatcttgaattatagcttccacaattctcatgtgttgttggagtgacttggcgggaagtaattgaatcatgggggcaggtctttcctgtgctattctcgtgatagtgaataagtcttattagatctgatggctttataaaggggagtttccctacataaagtctcttctcttgtctgccgccaagtgagatgtgcccttcatcttccaccatgattgtgaggcctccccagccacatggaacttgtgagtccattaaacctctttcttttgtaaattgcccagtctcacatatgtttgtatcagcatcatgaaaatggactaatacaaccatcaatagcacactaatattatctcaaaaacaaaaatcaacaacaaaatgggggagaagggattatgtggtcaaataaatttcaggcgtgttaacttcaagaaaacttaacagacacattccatgctggattgctcagaaactttaaagtgctaatgttcattgtgagtttttaagagagatatttaatctgaagagtttccaaaaatatttggctaggaaacatgttttcagtcagactatggcagaggttgctagctgttcaacaaattttgtgctctcttttccatagtagaaagtagaacctgtggcctggtgcagtggctcacacctgtaatcccagcactttaggaggccaaggtgggcagatcacttgaggtcaggagttagagaccagcctagccaacatggtgaaatcccatttctaataaaaatacaaaaattagccaggtgtggtggcatgtgcctgtaatcccagccatttgggaggctgaggcaggagaatcatttgaacccaggaggtggaaattgcggtgagctgagattgtgccactgcactccagcctgggtgacagtgcaggctctgctgaagaaagagagaaagaaaaagaaacaaagaaggaaaggaaggaaggaaggaaagaaaggaaggaaggaaggaaaggaaggaaggaaggaaggagggagggagggaaaaagggagagagagaaagagagaaagagaaagaaagagagagagagaaagaaagagaaggaaagaagggaaggaaggaaagagagagcgagagaaagggagaaagggagggagggagggagggagggaggaaggaaggaaggattgacagaaggatggacctgggaagcaagcttccaaataagagcgtatttcctggctcctcttgtatctacatattactgggtgataggttcatgacattggaatttgagcaaaagacatatgagtgcctgaagcaaggcttttaagaaaacggtatcccttgtctgtgatctctttctcctttctctgctagtagaaagaagtttggcagacccttaaaatgaaaggatcctgggtcactgtgtggaagaaagttctcagtgatcaggaatacatatattagaccagcgattttctacttggtgtgattttgtccctcaggaaacatttggcaatgtctgtaaatatttttagttatcactactgaggagttggcattactgacatttagtgagtagaggccagggaagctgctaaacattctacagtgcatagaacagctcttcatgacaacaaattatccaatgtatcaatagggccaaagctgataaacaatttagactgttaagtgagagaaaaatatttttctattgtattaaggcactgaaattatggggtttattatggcagctattggtaccttaacttgtatctcctagagttgatgttccaaggaccatacttcagggaaaacacattacataatcaatcctgtaaataccatgatttactggttgtcaagatgcgctgactctaccttcagagaatttctgaatgtaattccaacctctgtgttttagctggcacaatcctactaagatatgcatttcctctttcctgaggtattacaataatttcctaaatgaactttttgtccctagttgacttggttatttttacaacattaagcagtgacagaactagaacttgaagtcaagtttctacatctaaatcctttgtactcattcaccaatgtgtgagaggtactctattgttacggggagattttgaacttgagaattgaagagacctatctttaaatagtcttgattcttaataaaatcataattttagaaaaaccacaaagtacgtgtctgagtttggcctcaactgtaaaataaaaattttaaatttagattattttttagaattaatatacttcttgggatatggtaaattcgcatgaaattgtaacaaattattagggaaaaagaaatgtgcattgcctcaggcttactgacctatattttttcactgaactatttgcggatccatctaggtagatgttttctttccctagaaggagtgttttcagcgagtgggaaatctctaagttgttcaagcactgtcttcctccccaaagcttacatatgtgcgcctgcacagaatactcagacttatggccatcttcttgtctttgtgccccttaagacctgcagccagcttacggttgggcttcatttgtaatcattcactcattttattgtattggttttaaagttgctcctctgtgttatatacatgtactgtaacttggttcttatttttggctgttgatgttaaatcaatttgctttaaaaaacaattatggggaaacaaagaagcagcacaggcaaaatctcacattgttccacctgtcaggaatacttacatatctaaattttaccactctaccaaatgtctcacttttaccctgaaaatgtccctgacatagctgctaaaaataatcgttccctctatggactttccactctccttagtgtctctctttatttgtatattaatgtgttcgtatattcattccacaaatattcattaagtatcaggctctgtactgagactcatcacttcataacttgaactctggttatgaacttctcttatatctcctagacaaaattccttatggtactagaccacagattaccgatttatgtactcctctcacagaacctggagctgcacatagtaagtgcttagtaagtatctataatactcactgcttcacacagaagctagagatttactatttaccataggttttctaattaccttaatgactctaaacacagaatcacaaatcacacacatacaccaaaacttacttatgttggtttctatgtttcactcctggtgctagcaaactcaattaaaaattaaaagagggatacataaaacaaaactataatttgggcaatgctattctataattttatgtgctgagggaataacatcaatcttctaacatggataacaattacacacttaagaaggtttcctaatgaaagagaaataaaagctcaattatgtataaaaattacagctaccaaatgagtttaggggattaagaataccaaccatttatatgactaagaatttataagagcttaaaaagtgtcacgtgctttttttttctttttcttttctttttttttttttttttttttgacagggtctagctctgttacccaggctgaaattcagtagtatgatcacagctcagcgcagttttcacctccaggctcaagcgattctcccaccttagtctcctaagtagctgggactacaggtgcatggtgcatgccaccatgcccagctgatgtttttttttttttttacttttttttttggtagagacagagtctcactgtgttacccaagctgctcttgaactcctgggctgaagtgatccacctgcctcaacctctcaaagtgttgggattacaggcatgaggcactgcacctggtcacatgcatgaacttaagcatcctgattgggtgaaacaaacaaatcaaaacgcctgtatctgtgtaaccattaaaatttaatgttaggctgggcgcagtgggcctgtaatcccagcactttgggaggccaaggtgggtggatcatgaggtcaggagttcaagaccagcctggccaacatagtgaaaccccatctatactaaaaatacaaaaattagccaggcatggtggcacgcgcctgtagtcccagctactcaggaggctgaggcaggagaatcgcttgaacctaggaggtggaggctgtggtgagctgagatcgcaccactgcactccagtctgggcaacagagtgagattccatctcaaataataataataataatattaagaagcagctattctcaattaatgctatctatgtaaagtgctaagtagcaaagtttctttgtttcctccaggccattttctatcaaaagtttccttctagctggctgcccagtttaagtcacctgtacagcattttaagaaaattttcttatcatgtcagatcctattatcaagaagaatgttcaacttttaaagaaaatatcagctaatattttcttttacgtgaattgggagttggggttagcattacaatttgaaggcaaggactctctttgcttatccacagtgactactgccacgtttgtctcatgtaaagaacttagcaagtgcttactaagtgaaggaatgatagataaatttggccctcagataacattaaaattgaaatatatacacaattatatttaatattttttataacttctaagcatttatagatattatgttattagataaattactaaaaactaatagtaacaatattagcataataatactatattaaaattaacatagcaatgtattacaggtaaaatttaagttctattttttttatttttttttaaacagactttcactcttgttgcccaggctggagtgcaatggtgcgatctcggctcactgcaacctccacctcctgggttcaagcgattctcctgcctcagcctcccaagtagctggtattacaggcatgtgccaccacacctggctaattttttgtatttagtagagatggggtttcaccatgttggccagtctgatctcgaactcctgtcctcaggtgatccacctgccttggcctcccaaagtgctgggattacaggtgtatgccaccatgcccggccaagttctggtatttatataaatattactttctgatgacatttaattgagacactgtactataatatcttttttacctttttacatctatgactacaattcagaattcaaatacgattcataaataaggcatatgacaaggaagacataagaaagggctataaaatgtcgattttctcttccttagatacttaacaacaattatagtactatctaaaatcttttctgagcaggaaattttacaaaatattttgcacatgtatcacctaaccttatgtcaccacagcttggaagatgagtagcagtattctgctcttatagcctgagaacctgaggctcacctggagagatcagtggatgtgtacaaagtcacacaatgtagcttccacttaccccactctcatcaatttataaaaattcactctagagcttaatgatggatgcagaaagataggtttaaaactaatttactgactattaaaaatcctattaattggaaagatactaagagcagatcaccaatttggtaaaactgcaaatgaacaaaaaaagtgataaaatccttggctaatgtgtggcataatgaagatgttaatgagtttaatacttgggtatattttgtgaaactcatcatgtttgcataagagcaacttatagctcgtcctttggttgttaaaccttcctccagtgtggtgagtacaactgggtcaggttcctggacaggccaaaatgtagtaggatctattattgttcagctcccaaataatattaagataagcactaactgggacttataaggaatgattcaatactgagatgggatgtcaacaggatttgtcatgcttccttgtgtagggctctctaaaaacaggacttactgtccagtagtgaggtaggagttgagagtagtcagaccaagtagcatcatggaatcgagtaaaatgcttttgcccttgataagacattgattgagagagaataatgtgtttttctgcgcatgggattctaaacaatatattttctaaaaaaaattaactgctggtaagatatttctctgtgttttctagccactaagatccacttttattaccctacgtacaatgaccagagtgtcatgttacttggtggtgggtcacagccagcccatcacaacctcctgtttctgcctgtgctcagaggcacacatgtctttctcataagatcattaattgggaaaatttatgtgacttttttttttttttttttgaggcagagtctcactctgtcatccaggctggattgcagtggcacaatattggctcactgcaacctccgcctcctgggttcaacagattctcctgcctcagcctcccaagtagctgggactacaggcgcatgtcaccatgcccagctaatttctgtatttttagtagcgatggggtttcggcatgttggccaggctggcctcaaactcctgacctcaggtgatctggcccctcagcctcccaaagttctgggattacaggcaggagccagtgcatctggcaaaaattatgcaccttttaatcatgcacaaatataaagaccccatcctctcttccactccttccctggcacacatgcttatattagcccattaaggaacccagcctactttaatggaggcctgcctttccactcaagggtgagggtttaggcctccaggtttatggcagaaagacgtagagggtggaggacagagtgcttccccacccatgcaacttcctgccttcccctaactcctcccacattgtctgtccccactgttccccagacataactggctataaggttatgaagactttgaggaaggatgcagcagagagttctgacctatgctagaagaagttgagagcggttatttccagattcctgagaggtccaggcattgactgaagttgcatcagtgagaagcttagccagctaacagtcagatgccccagttgagtccagtcaatcctaggctgcttttgttacactgaaccagcctgacaaacctcctaaggtcttaagaggctgtttgtttgatctttcaatttctacttcacatttttcttaggaattattgaataaaatagtaagttagaatgtcagaataaaagataaatggtcttgcagctgtgtacatcatttcctaggaattggctggggaaaatcatgataatgacagctaagacatacactttgtactatgtgccaggcacttttctcaatattttatacatattaactgatgtcattcttaatcctatgtgatagatattattattacccccaactcacagaaaaagaaactaagtccctgctcaaggtcacacaggttgcagaacctaaattcaaatccctgcagtttggcttgagtcaatgctcttaactattataccatgcgctctactgctgcaggaacagccacctgttctgcatcctctcactgtttctaatcttacggatcttattcctgaaacaccaaactgaaaacagtttactgaattacctatcctttttcatgtatctgatctttctttgtatatgactgtcttatccccatggattgttcttcccccaagtcccctctcctttgaagacaatttcttgccctttaaatttagtttacaaagatgatttgcctttcctgaactcctaaacaatactaattactcccttgtttgcattccagtgtacttcttactccctcttcacagttaccatactaagttttgttggtctgtttacatatctttatcatctacaaatctaaggccttcttgaagccatagtctctatctcattcctctttgttgcatcagtacctcagctaaggtctggcacacagtaaagtccctcagtgaatatttctgtaatacattaatggattattaataacatatttgaatagcatttgagagcttctaatatgttttctatgcattcccttatttatctaagtagacaaacatgcatatcacacacacatactgtacaacagagattattcagcttcatttgacaactgagaaagctaggttcagggaagttggtcacagtttctccaacttaaaatcctgctctgtatatctggagacagttgttcccaaaaccaggaagatctcgtgtcacgatttttaattgtcctgaatgacctgctcgatggtgctcacaatattctagtattgattattccactagaatatcattcaagggcagtcgtttcctttagtggactctcttgctatcagtgatgccactgtgatagaataagaacagtgacaggacatttaaactctcattcctccctatcgtgtccttttccccaatgtatgttctttagaggacaaaaattctctatatttttcatctttatgcattccataccattaatcacactctatatagagaaggtactccaaaatatatttcttaaataaatatataacatgaaacattttcttttgtctttttttttttttcccctgggatggagtcttgctttgctcactttgttgcccaggccgaagtgcagtggcacaatctcagctcactgtaacctcctcttccagagttcaagcaattctgctgcctcagcctaacaagtagctgggattacaggcacaggccaccacgcctggctaatttttgtatttttagtagagacggagtttccccatgttggccaggctggtgtcaaactcctgacctcaagtgatccgcctgccttggcctcccaaagcgttgggattacaggcgtgagctgctgcacccagcctaaacattttctttggatagtttattgtttatcttttatttaaaatttggttagacttctaactaatttttaaccagggttcgcacattttttaagtccctaacataaatattttttgtgctatgatgttactagggatgatatttatttaattttacttcttggttttcatttgtttgtaacagcagattacagattctctgttaattcagctcttcagagtggtctgccagcatgtctaaccactcagctaccttaaacaggtactccctaaaagtagcatgaagttttaagaaagttaattgttcacacaggactcgactcacacatcctaattcagggatcaaaatgtcacataaatccctaacaatgtgaaggtaggtcaaacaaacaggactttaaattgcaaataggtcagtggaggatcaaataaaaatactatttctaataacatatgcattgtacagttcataaactgactactcatactatgtgcccagaaagtaattaggttcaagaatgattttaaatcaatttgtttaatccttttaactatcaaaaaaacaaaaataaaaacaatttactacaagtctgtttaatcctggggcagataaggaaacagtgtttgcctcagggagttacagatatataaacaaatatgatgtgatgtgtgcaagtttaatgtgccttggaatgactgggcacagtggctcacatctgtaatcctagcactttgggaggccaaggcaggcggcacatgaggtcaggagatcgagaccatcctggccaacatggtgaaaccccgtctctactgaaaatacaaaaattagctgggtgtggtggtgggcgcctgtaatcccaatcactccggaggctggggcaggagaatggcttgaacccaggagtcggagattgcagtgagccgagatcgtgccactacactccagcttggcaacagagccaggctccatcttaaaaattaattaattaattaattaattaaaattttaaaaaagtacctcagaacaaggaagagggtgtacatggtaggaggaggggtgaggcttcatggaggaggtggcatttcaggagatcccactccaaaaataaaccacattttgacaggtgaaatgaaagaaaaagacatattagacgtagacaaaaattagtgcaaaagcatacaggtagaaaagatcagagaattgcaaaaggaaattctgtgtgatcagagggaataaggcctaggaagagagacacacaatggatatgaaggaaaccaggccttagaggaggtcatgagtgtatatcatggaaaactgcaaagaggattgaacccccttatgtttgtgcccccactgagccatttattttctttaatcacagcatctgtaagaatatagttatttgttcacaataatcttatattaaactataatcatcttgagggcagaaactacctcacttatctcagtatttcaacagctagccctgtgccaggcagagttggtgctttaaaaaatatgtatattggctgggtgtggtggctcacacctgtaatcccagcactttgggaggccaatgtaggcggatcacaaggtcaggagaccaccctggccgacataatgaaaccttgtctctactaaaaatacaaaaattagctagctgtggtggtacacgcctgtacacccagctgctcaggaggctgaggcaggagaatcacttgaactcgggaggcggaggttgcaatgaactaagatcacaccactgcactatagcctgggcgacagagtgagactccatctcaaaaaaaaaaaaaaaaaaatgtatgttgactgagtaaattatattttttcacaccacaaaatctggactcaaagtcttggatctatggtggaatgttgtattatctgattatctggtgttagatatatttaaatcagtatcacaaactatttcatgattggtttcctctaaaactctgactcatctggttgcatcactgacatgatggactctcttatttccctaatgcccttaactatccatctcttccgtactctatctccagcctccactgaacttgcttatttggaaacattttatggaattcccctattgctttttttggttagagtcaatcatggctgttttaactgcattggtcatggacttactatgattaaaagggatttagggactaattgttctcagtacattagtccttgacacattcatcttggatctcattggcacttattcaattggtgctgtttggcagctgctcaattgttagttattatctatcgggaacaagactttaatcagaattttactcccaactatgtattgccaatttatatgtagctcatgccaattcagggaaaaataattccaagtggttcttggagtttggtgaagtgatcctaagaaatgaagcccacatatttctaaataaagttggcacattcggatgtgatatgatacatgaaagaaaagtgggttgtttgaacattaaaatgctggaaacatttatcattttaacaaagcataattttgagagaccaaaatcaaaattcataaacacaggtaagataataactgtcttttagaatccagaaaaaaaatttaaaggactaccctactactgcttatgctaatttcagcccaatgcttgtaatgaaatcatggcaggccagtgtagtacattggtaaagctggtgggctctgtattgatgtcgcctggcttcaactttagcttcagtgtgcctaaactgggagccttgggtatagttttaaacattctgggcctcagctttctcattccttgaatgaggtccacaatcatatctccattaaaaagctgtggtgaggatcaaataaattatctaaggaaaaaaaccacttggcacagttcctgctatatcatatgtactctatagatgctgggaattataattatatcctggtaagcactcaaataactgagagacaaaatgacaaagtcctgtaagaaaggtccagataaaattctttggccatattgtctttcaaattattttttaatggaaaagttataaaccagaaaaagaagaaaatgatgctggcaggtatccctgtaataaaaaagagcgaacacagagaaagaaaatcaatggaggatttaaaatgttcttcttgctttggcatctaacctcctgcttccaaattttttccagtatcatggtttaactactttaatgaagcgatgataccatatttctcttgatccacgtaacccaagtggtttacagaaacagaggtcaacagggtcaatatttctgactaatattttaattaaatctcaataagtgggcagattcccagaattgatgtagcgttgtgatatagaataagagaaatggaaagcagactctctgagtgagcacttatgtggtatcttgttaaaatgcagggatcttgttaaaatgcagattcagaaggtctgggttgggcctcagatcctacatttttacaagctcccaagtgatgctaatgccactggtttgaagacccctctctcaagtagtaagggtttagagcacagtcactgcttgggtttgagtactggctccttctcttaccaactacttgaccttggccacattagttaactttttcttgtatcattttttaaatcatcaaatgaggataagatcaatatctaactataatggtggttgtgaggatcaaattaattaacacatgtaaagcatgtaaaacagtacccagtactgagtaagcactcaataaatataaatgatttttatgattaagtgaagttttctcattataaacatttaagctagtcaagagagatgaatatcccagaattttaatcatgtttaattcagcacaataatttattttaaggcattaatgtcaagaatcacataaatctccacatgtgaagctttgcaagttataatttttcaagccaatgaacttaaagaaggtaatttacaatttttttggtggtagccatacacaaaggcatgagcctgtcatgatagaacagtaaacttcttcatctacctttttcattaagaaagaagaactaaatatgtttacaaaataactaagatacaacctactaggagccccacagcatcattagtagtttgttttcttcctgctctgttattattctctctcacaactataattatctgttgtttattatctctatccctcaacatgaatttaaactccatgagggaggggcaatgttgatcttgtttgctgctatatctcagcatctagcttgccgcatgatatttgttatgccagtaataaataaatgtttgtaaaagtataaaataaatgaatatgtaccttagttgtacattttattaatttattcaagaatgcattgagtagctgtgattttttttcctggttctaagtgctgggaatttttaaatacataagacacagtatgttcaaggagcttatggtctacttaggggaaagatatgtgagcacaaaactgaatacatgatcaactccatatggaaagcggatgaataaggaaagagctcataaagtagaggtgggagtgaaataagagctttccagttaaagaaaaaaaattatgcaatttcacaaaagtgtgaaacagtgagacgaacaggaaaccttagataggatatgcactggaaattaacagtggagacaaggcaaggtccaaatcataaagacaacatgagtatcttctatagcagtattggttatagtggaaatacaagaacttgaagaataaaaagaataaacttcttcatgaaggatactaataatactgttcagagaatgtagcaaagacaattaactacctcagaatatacattgtcttcttctcattagaaattgttaccctgctaaaaaattaaacacactagcgtctctcagctaggtatagacacgggattgtcttcaaccaatggatgaattgattcttctgggtaacttctggaagtgtccttaaaggtgaagagcacaaccttcttattgtcccttcttacttcctgaaatgtaatataatggttggcgctacagcagctatttgaaccattaggtaacctagcaaaagggagcctcaagctatgatgttagaagagttaaatagaatgatgctggatcttaactatggagcaccttacaagccatgggttgtctagcttacaacttcatttacatgaggggaaaaaaatcattttttctcactgattttgtcactcttactttgggagttgtatgccactgatcctaattctcagtgatacaactacagaaatggggaagtgcttcaagaatgactggcttttgaagtagatactgaaggacgggtaggagattatcaggtacaaaataagagattgggcattaaagaagggctattgtgttcatggaaatcatcaagaatacagtgtattcaggaaactgggagaactgtgtagtggaatcatagggaatattgtgtgaaaggaatggaggaagataaggcaccagtaaaaactctgaaatatcatactagtgagtttatattttatgagtcaatgcaagaccactgaaaactttcaggtagttaaaagatgggaccataggtagttttctggaataagaactcagagagctatgtggacaggaggaaggaaaatcaaaatcagagagacaagttcagaggcaaatgagggagtccaggagagtagtagaccaagggtcttgacaatgaagaagaagatagcacagagacaggacacatttagcaaacatactatgtaaggattactgatcacatacacaccaggacagaaagactcccagaaatgtaatgtgagttgagttgatagtgaggtaatttaccaccaagatggggaaggaagagaaacaaacaacatagaaactaaagccagactatgtgaaataaggaaaaaaatatatataaaagaaaaactgcaacacaaggatctgtgcgcagtaggatttctcttgtattcaggttacaattctcgtatcaccttctccaagagatctttgccatactatctttctaaagaagccactgcacttccctcccctcaaagcactttgcttcatttttttcagagcgcttactattttatagcttcctttttgtttgttacctactttgacaagaatgaaagctcataatttccacaagagtggaaattatgtcttgcttacagtaaacctaggtaacagtacctggcacaagtaggcattcaagaacttttattacatgagttaatcaaattaccttggagttgtttgaaattcagagatttctacggactgaatcaccctaaaattttacccccctaaaattcatatactgaaatcctaattcccaacagaattttcagatggggacaatgggagaccattaggttatgaggtggagccctcattatgggattagagttcttagaagaagatgaaggaaagagcttgcttcccactctctgctcttctctatgtgaggacacagcagaaggatggttatctgcaaaccagcaagacaggcctcaccagaaccaaaccatgctggcaccctgatctcagacttcccagtcagcatgataagaaataaatttatgttatttaagccacccagtcttcagtattctgctatactagtctgaactaaaagagagtttataaataagaataaaatattgaagagatcaaggccatgatataggagagctcccccatctgatgaatgacaaggaagcttagttccagcaatgcccataaagacctgcccaacagaaaataaccatttaggtgggaggaatcagagggcctgagcacaagtccaatttgccattacaaaatgatatgaacttggaaacttcacaacctcaaagcacctttcagtttccttagctaaaaaacgatagcttcctccacaattttgagaactaattaaagtaacatggatgaaagtgttatagtaggtagctagtcagacatgagcagggcaggagagacctcctccctagccacaacccctactactagaaatgtcaggtaaccatcaggtgatggtcaggtagttaaccgctactctaaaataataattggtcacagtcagtgatacaggaggtagaaagaaattgtttaggcagatagtgagggcaaagagtccttggcagagcgtcccttctagcaaaacgcagcccaagaaattatttttctcctaataaagagcagcctgaaaaatcaagctgaaaacataaataagcaagctggaagcttgcacaggggaatgctggcagctgtgccaatagaaaagggctagctgggggccaggcatgtccaacatggatgctccatcttccctttctttgctaccacatgtacaggaacaaagaaatgggtaacatggcatagctcaggcagagaacctgcctgcaggataaaagattagggtggggcctacaaaaaattcatcccctgtgcaaatggcacacctggtctaaccagttttttgcaccctatgtaaatcagacactgcctcctcaccagctcatctgtgaaccccaatgcatttcaccacagatccagcaacccacttttctggaacccctttctgcaggaaagagctattctctttctttcgcctattaaacttccactctcaatctcactttttgtgcgtctgcatccttgtcatctgtgagacagtaaatctcagttgttactccagacaacaaggccgtttcaccagtgtcagggaaaggcagcttcccaataaatagcaaaaacctgacactggtgatcagcagcttcctgacaagatcttaggagctggcagagtgggctcaaagatacacattaagaggcaaagtggcattttaactggcataggaccttctagggacattgggctggtaagggaagaatgcctcacatgcagcacctgctcccctcccaactgctgacaggccactgcacatgtggacagcccaccccgagggaagaatcatgggggaagagatgcaagaccctgaaaggatgccaacaacatataaaaccccaagtcaaaagatcaagccgtgcacatgatctctcaaattgcccacttggccagcctccaagtgtatttcctttcattcccactctaaagctttttaataaactttcactcctgctgtaaaacttgccttggtccctccttctgccttctgcccatcagttgaattctttcttctgagaaggcaagaattgaggttgctgcagaaccccgtatggattcaccactgctaacgaaagtgcgttggttcaggactttcaccccatgtgtcccagatcactctcaacttctaattattatgtattagacaaagtgacatcactaatgtaaaccaaaaataaaattctaagccccccaaccaaccaaatggacccctcctccaagccaagtgcattctaaagtaaacccaaaacactagttcaggccatgatgggaatgggtggttggacatgcttcattaatccctcctcctcctcccgttggaattcaggcacagctgaccagcattaacgttacaatagaagactgacaaagctgactatttagagtaataaaataccaacatgacagagagcaggccctgaaagaaattaaagcatcttaccccaaaatatatttatttgacataatttgaaatggccacacaaagttttctcttatggggaaaatctacattctgtagaaaatcccctcccctttccaggactttttcatgatccaagagagaattaactaagagtctggcaccttttaaagcctgataagaaacatttacaatctattattcgctgtgaagcctgcggcctggaagcttcacctgcctaataagaaccttggtctccacaacctcttaccttaacccaggcactcccttctattcattccaggtctttagataaactctttcaaccaatgccaatcagaaaatctttgaatccacctaccaactgaaagcccaccccctactctcttcaagttgttccacttttttggactgaaccaatggactgaacaaacaaatgtattgattgatatcttatgtctccataaaatgtataaaaccaaactgtagcctgaccatcttgggcacatgttctcagggtctcctggagctgtatcgagggccgtaggtttcatatttgattcagaataaatctcttcaaatactttacagagtttgaccctttttgatgacactaactgcattttaaagatctcttctcagcactttgagagcctaaggcagaaggatcacttgagcccaggagcttgaggttgcagtgagacatgatagcaccactgtactctagtctaggtgacagagggagaacctgtcttaaaaaaaaaaatctcttcccaggttgactttaaactttcacaacatgtatactcgcaaatttcctgtcaaccacaatctcgaacaatgtgtttctctttgtagcacttcaaccttttattaatgaagtgttcaacaacactgtgctggaccttagttgcttttaagtgtctccttcagtctgttaaataatttagcaaattaacttttattacaactaccgagaggcagggtagtataatgctattcttattacaagccccttactatctgctgtgtgaccttggataagttattaatctctttgcctacaacttcttacctatagaagtaacaataatatactttgtatggttactgtgaagattgaataaattaacatatgtacaaaattttaatagtgcctagagtatggttcagtaatagctatttttattcctacaatgacattgttcagatcattttcatatctgtactgtgagatatttccacctttctccattttattaaaaaaaaaaaaaaacaactaaggctcagagagcttaagtaatttcctcaagttcacaaaagagagagttagttctcttagatgccaagtctgtgcccttggccataccaaaataacattccattttaaagaatccagataatttcactatcaaagcataaatttattaaatcaaactgccatcgaataaacctgagttaaataaacttttggccattgtccttcttaaagtatgtgcaatagacattcaaagacagggaaatatcagtgaggttggttgtcagagaaagcttctggtggacttgggcagggttttgatatttgatttttttcttacattgagcctcaggttctacaataacctacctcaaggtcaaccccagtctagttttcagctgtagtttggcttgcaaatttcttctctcagtatttttgggggcccttaggccaaactgctaaagcacaggccatgactccttttttaataaacccaattacaactcataaatggtgacatgtgtcagcagaacaacccttggaggggtgtttcattaacttgatcaagtctgagcctgagggcatgtgccttgcatagctagctagctttcttagcagtagctgtgtctgttaccaagttaacaggtggcagctcagtttattgcctatataataagcacactaacccaaccacccatttctgttggaaggccttcccagaatcatagtaggttagcaggttagaagaactagatgctttaacttagttatttagttatttatcacttggagagattttttaacatcccaattcttatacccagactcagacccattaaacaggaatctttattcctggggttgaagcatcagtatgtttttttttttgtttttttttttgagatggagtctcactctgtcactcaggctagtgtgcagtggcatcatctcggctcactgcaacctccgcctcccgggttccagcgattcccctgcctcagcctcctgagtagctgagactacaggcgcgtgccaccacccccggctaattttttgtatttttagtagagacggggtttcactgtgttgtccacgatggtctccatctcctgacctcgtgattcgcctgcctcggcctcccaaagtcctgggattacaggtgtgagccactgtgcccagcccagcatcagtatttttgaagcgggaagcaattacaatgtgggggcaaggttgagagccactgctttgagacatcagcaaaagtattagcaatttgctttaaaaacaagaaaaccacgaaaatttcctgagattgtctttaaagagatactgattataatgcgctattgtttattcgttcctctcagcatgccatttgacctatctgaatttgttatttcattactacttttccttcatgtgacagctcattagattggtaatgtttcagttttatgctactgagtttccaaaataaaatacttgggggcaaaacatcatttagggcacttggtagaaattaggataatcaaaatgcatttccattaatgctgttcatgaagaggaaactatactttgtcaccaaaagtaaagttcatcaaagttcatccagctcttcgtgtatttaaacaaacttggaacttccaagtgacaactgaggggaagtaatttagggctgagatatgatacacttagaaaaggaaagacacagccgggcatggtggcttatgcctataatcccagcactttgggaggctgaagcaggtggatcatgaggtcaagcgttcaagaccagcctggccaacacagtgaaaccctgtctttactaaaaagaaagagaaaaaattagccgggtgtggtggtggggcacctgtaatcccagctactcaggaggctgaggcaagagaatcgcttgaacccgggaggcagaggttgcagtgagccgagagatcacaccactgcactccagcccgggcgacagggcaagactctgcctaaaaaaaaaaaaaaaaaaaaaagaaagaaaagaaaagaaaaagaaagacactagagggaagtcagtcactgaaacaaggtagctgcaaggtagctgtctgatttcacagagaaaaatacctatagttatccctcaggaactggcccctaaaaaatatcagtgtcaaaaagtcaatttaaaagcccagcaaggccaggcatggaggcttacacctgtcattccaatactttgagaggccgaggtgtgcggattgcttgagcctgggaattcaagaccagcctgggcaacatggcaaaactctatgtctatgaaaaatacaaaaattacctggatgtggtggcacacgcctgtagtcccagctacttgtgaggctgaactgagatgaaaggattgtttgagcccaggaggtccaggctacagtgagccctgatggcaccactgcactctggcctaggcaacagagtgagaccctgtctcaaaaaagaaaaagaaaaaaaaaaaagccaagcaagatttaacaagggagagatgaagttataaattaccccaagcatcacataaagttcctggggccccagaaatatgttttagtatttgcttttttttttttggaaatagagtttttagctcaatccaaatattacactgttaaaattgaggaaagtaacataaaaatgttaagccatttctctttattactccagtctcatttcctctccttgatttttactcaactgtcactcttcctctttcttttcactcaactagccactgtcttccctgtcatcatctatgactgcctacattttctttcaaatatatatttgagaaagaaaaaagcatttgtaaacgaccacactttgaaaagagtgcttatctatgagcaagttaaactataaagagccaataaattgggcagcccacttttaggtggtcacatgcacattgatccacatgatcatgtagattaaattaaaacacacatatttacctgatgaattacttttcaaataaaaattcactctattaaaacagtcaaattcaaataaacaattgagtgtaacattgaaaaaaacttttattgaaatcccactacatgcatggactatggctatttatggaatttatttattttatcatttttattattattattatttgagaccaagtctctgtcaaccaggctgcagtgtaggggtgtgatctcggctcactgcaacctcaaccttctgggttcaagtgattctcatgcatcagcctccggagtagctgagattaaaagcaggcatcactacagctagctaatttttgtatttttaccagagacagggtttcaccattttggccaggctgctcttgaactccctgacctcaggtgatcctcccacctcggcctcccaaagtgctgggattacaggcatgagtcaccatgcccagcctggaatttaaagataagtaaagcacaattgtatctggtgaatatcaagtactaagaattattaataaatagagaggaatatggtaaatactaatttaggactgcaacaatggccaatggccatcatttgttgaacatctattatgagccaagcaatgtctaaatattatctccaatgcttacaaccagtggtttctgaaaattttttagtgttcctaccagtaaaatgtttgcaagcgtgctccccgatatgtgctagtctgtatagatatagtatactgatacaattgcaacaatacagtgttttatatataaaatgttgaaattagaaatgatgaaaaactataaaggctagcacttgatggatctgcttcagcatcccctgggcagaagcttccgacattgaagaatactactaacatgttgtgtggtagaaaccgctgcttctccccaatattcattacccttttctcccataataacgggatccctcacttttatctgagcccagggcatctcagaataaaggttatatggctcagtctccctttgcatctaggaatggctttgtgcctaatctttgaggtatgagggaaaaatcatgcttacaacttttcagacattgctttaaacggacgaacaatgtccatctctgtacttcttttaacctgctatttagcacgtcagcatggtggtaggcctcttggactacatgtgcaagggcaacccccaagggtggtaaaaaagaaaataaaaggtacttgggtccttttaagaccttgtggagcagcatagacattctagctctggacagctaacctagggactgtcatatatgaaagaaatacattcctatcttgcaaacacatcattattttggtctctgttatatgtaactgaacctgtctcctaaagaatacaatatgcaaggtagtttttattgtctctccttacagctgagggaaaagggtcagagaagttaatttttttagttatccagctggtatatggttgaatcaaaagagcccagactccattctctttctactaaaataacaatctcccatgattgaaatactatggaatcaaggaggaaggagacattaatatgacctggagggattgatggaggcttcctgatggtggtggcagtttattgagatctaaaagatgggaatggaggaaaaggcattgtggactaattgaacagggtgaacaaaggtaaggatataggaaaatgtagaaaaggctcaagaggagcttgtgtcagttgttcttaggtgatcactattaagtctttggctttattcaaaatatgtttcagggcacctacaatatagcagataaaaattaagacctagaaatagagtgataaaatcagatgtcataatatcctaaatatatgagaagataatgctaccagcaatgcctacatgttaaagtccaaagccgataccaagcaaaaaaggccttcacaatcagactcaacccaacctcatattatgctattgctctgtgctccatatggatgaaactcaggacatgtgagttgcctgaactctgacctttgtacttgcacttccctcttcttggaatgccttttacctactttgcctagaaatgtctttttattctttaagagctagacaaaattctccctttctctgattccttgaaataggatggcttattattgtagtttcttcccttcctgcctgtctgcctgccttccaccagtcagtaaaaatgtgcagggtttctgaggtataactgtgggaaagataaagcaatattttctttgtgcttcatgaagtttacattctagagagaaagatcaactattaatgaaatagctgcaattcagtgtgataactaccttgataggaagaagagccttcggggaagctcctaagaggaactctaccctgaatctcactttcctagaagaagcataatttaagctgaaccctttaggatatgtaagaataagccaggcagagataagcaaggcgtgtttaacaacatgtgcttttcaccatgcattatccattttcattaacatgtctattcattagactaggaaacaatgtgtttaaaggtcccaagtgattcaaaaagaagaaaaaaaaaacccaccaggattaaacactcattcagattcatgctaaatgtctgatcattgtgccttagatatgtttattttgtccttcctgtatgcagtatttcctactttcacctccacttcagtttagcaactagagctgcttaaggtctcccactagcttttaaaaatctcttgtaaattgtagagcagcatctctcaaacttcagcaatcctaagaatcacctgaggtacttttaagaacaaattttttggttccactctcagagattctgattctatagctttggggaggagctggagatcccacgattctaacaacctgacctgtgagacctgacgctgccagttcacagactgcaccttgagcagctttatgcttgagaagctacacaaatatttttcaggattatttcccccttgttcttaaaagtgctctgctaggttacacttcttggaataagagtggtttctctgtccaggtaggtaaggcttttaggggaacccctctaagaaagacgggccaatattgctactttcacataacagtcacattcttcacttggacaaccgttttattttcccgttggctctaaatccaaaatgacaagcctaagtaagggcttcccagtaaatgagaagctatgagtacagtagtcaacaaactgccctctgcaagggtaatgcaaggcaaaaaaagtgaattagtttgtgaatggtaagtaggtcaggtcttctgttggtttttttttgtttttgtttttgttttgacttggcttttaaaaaatcatcccaatctaaatagaactttttttttttttgaaatggagtcttgctctgtcacccaggctggagtgcaatggcatgatcccggctcactgcaactgctgcctcccaggttcaactgattctcctgcctcagcctcccaagtagctgggattacaggtgtctgccactgtgcccggctaatttttgtatttttattagagacacggtttcaccatgttggccaggctggtctcgaacttctaacctcaggtaatttgcccacctcggcctcccataatgctgggattacaggcgtgagccaccgcacctggccaaaataggaattttataattttacaataagaaaatgatgaatcactgaacttttaagaaagctttcagtaattgctgacatttgcctccatgtgtatcatgtttaagagtcttcaaagttaagcttttaagagccatgagaacagggatcatgtctccatgtgagcatatcccacaattcctggagagtgctgactatttagaagatttgaaaatagtcaacttaaaaaaggaggaaattaaaccaacacacaaaaattggaaggatagttttgatgattaattaggttctctctctctctctctctctctctatatatatatatatatatatacactctcacatataaagaacctagagtataatcatttcttgataacaaattagctcccttatctcttctatttctttcttattatgtattgcctacaacagctctgtctgatagaactttctggaataatggacaattccatatctgcattgtttaatacaatacccattagccctactggctactaagcacttgaaatgtggctagtgcaactgaggaatgaatttgtaattttgtattattttattttaattaaatttaaataaccatatgtgacttataactacttttttggaaagcaaaggtctagaaagtaggacaacatagtagttgttcatagtgtgttcaatttgttgaataaatagagctctttccttatagatgtgtatatgtttaaagtaaaagagttagaaaatggtagctatctcaactgcaggccaaaacatgtagtgaaggaacaaaacatcaggatccaaaccaaaaaataagtttcttattgagcagtgtttctcaaacttaaatatgcatacaaatcactgaagtttttattttaaaacatagtttctgatttagtaggtctttggtggaactttagattctattgctcacaaactcccaggtaatatcactgctgttagtccatgggtcacactctgagcagcaaaggtctagatgtaggtaagccatggacctatgtaactgctactggcccaactcctgaactagcagtggcttctcattttgactcaccagttcaagattcagtcagagaaatgttttattttatcatagatacacccaccttacccccagtctcacgatgaatattcattaagccccttctgcatactaggatgagtattcataacaacccctgcaaggcaggtagtattattcctattttatatataatgaaacagaggcttagagaggtgatgtgacttaaccaaaactcaagaaaagaactaactggcagaggtgggtttacaacccagtcgtgcataaagccaaaggctagtttctctctttatactcttttgttactcaaagtatgatgtacaactaagcagcatcaacctcacctggcaacttattagaaatgcagactgacgcatcccagacctagtgaatcagaaacttcattttcttttttttttccctgaggtggagtctcactctctcacccagggtgggagtgcagtggcacaatctcagctcattgcaacctccgcctcccgggttcaagtgattctcttgtctcagcctcccaagcagctgggattacaggtgcccaccaccacacctgggtaatttttttctatttttagtagagacagggtttcagcatgtcggccaggctagtctcaaactcctgacctcagttgatccacccgcctcggcctcccaaagtgctgggattacaggcgtgagcccacctcttgcttataaagcaaagcaacaagcagttaagagtagggattctgctgattgtggcagttgagaaatgaatttagattggctaggtttgacaccagagcaaatattgacagctttgcctctattgctaaattcctattgcttcataggagtagttgagacaaaataaagctgtttcctggtaagtaaggattttaaaatttggaactgcattcccaatagatgaaaacattaacaatatagttttaacaatgtccatgggaaaaaccacaaaaagaagaaagcatgtttgttgaaagataaatgtactaaaatcagcaaattcttccaaaatatcataccattattaatcactgccaggatggttcaaaggaacacacatatttctcctttctttcccatcagaggcaattatggaaaatggtccaatcaaaagtgaatcatagcctaaatcataagaatatgttatttacactcaaataaattaatgtctaaatgtacagacctacaacaagtgcttggtcacctcacttctgtaatatggcaacttccttctcagagagctcttgtcctcagcttcctgatgctggtatcaatcagcagtgccatttaaatgttacttaaaacatctcttagacacaaacccattctctggctcctgagtgaagctcattgctaattcaattgtgtctctatgtcactgaacccatagtatcctttttcttgtcactgacactcatgtgttcagccttttttttggttcatctttttccctttagttcactctcttgtccttggccccagaatcatagttttgtttgcatccaatggccttttcacattgaaagcactctgtaaaaatgttgctgatattatatgatattataattgtccacaaataacttttacataaataactttcttggcagccaaatccaatgggggatatactactaaggacccactcatattcttcataacctaactcttatttgtgttctctttttcttctacttttctctctcccttactttcctaggagggttttccaagcaagagacctgaaacttctcccttgtctccactattatttctacctctagaaacaaaatttcagcaacaaagtgtcttataggaaagtaaaggcattgtactgccagtacttgctagatgtttcttttacttctcagtgtttgcccttagacaacatacaataatctacacattcactctccctatcagttgaaccaggtccctctgacactttgtttagtgccattgacctacaatataaagtacaagattttttcttttatatctgctttgtttttattttttattctcataaagggacatacacagattctcagccctttatttaaggccctgatgtactagtttattgtttagcaaatactcactcttcccctaattcgagcttggcaacatgacttattctggccaattgggtgttggtggatgtaaggtgagcagaagctttaactgtgtttgtgtcacgggcttgatttcttgtcctttgactatcacaatatgaaaacataccctggatagctactgtcccacctcctggtccccagaatgaaacttctgaagcagagatgccccagccaacctggtacaatggcaccccactcacccacttattcgtggtttcacattctgcagtttcagttatctactgtcaaccattgtctgaaaatattaaatggagaattccagaaataaacaattcataagttgcaaattgctttctattctgagtagtatgatgaaatctctcactgtcccactccatctcttccaggatgtgagttatttctttgtttagggtatctgtgctgcagatgttacctgccctttattcacttattagctgtctgggtgatcaaattgactatcctggtatagtagtttctgtgttcaagtaactcttattttacttaataatggccccaaagcacaagaatagtgatgctgacaattcagaaatgcttaagagaagccctaaagtgtttcctttaagggaaaacttgaaaattcctgacttaagaaaaaagaaaagagacagcattgtatgatgaagctgctaagatctatagtaaaaatgaatctttcatccatgatattgtgaagaaggaaaaatataatcatgttagttttgctgtggcaccccaaactgcaaaagttatggccacagtgcctgatagttaagatggaaaattcatgtatataggatttggcattatctgcagcttcaggcatccaccaggagatttggaatgtgtcatccatggataaggtgagactactgtattctgcagcctgaagcagctgtcctagctaactgatagagaagaaaaaaatgcttattgccgctgatttttttttggttgtggttacacaccaaaaattggcaattacatgaggtaacagtaaatggtagatcaagcactaccatttactagttgagatagaaaatccatatctttaaaatgaaaggtttgtgttcattgaactccaagatatttaacaagatggaaaactcatgattctcaagtatacctctctcaacagtgcatttctatcaaagaggtcagaatattaccaaaatataaaaagaatattagagaaggttagagcaaaataaaaaagcattctagaatctctctaattttattttctaaagcataaagaatactatttgttagggtgctgttcaatattgaactctaaagtgtctgctgaaaggagaggagagcgcaatgtcagttggttgcagagtaccagagagtaaagcattattatttggctgagtcaaccttcagggaactggattcacaagcaggctctaatcactctgagctccctaagaacaaagtactttcagtacctggcatgaaacactattcaacatgtaatggggaagaataaaaatattgagcaaaaaatagaaactagagagtattgaagtggaaaaatatctttccttgtttctgcttgggtgattttaattttcatatagggattcctgctttgcatgagaagctagactatgtcacatttaaggtcatacccaaccctaatatatcatgacctcatataagacagagcttacttaaggcattttcatgtaagaacctcagtgaccccttcattaatgcaagctctaatgtctcttaacttaccttccttaataaaaagaagtctctttaaatatattttgtacttttgtttgacacttacataaaaattccctttggccctagaaatttcctgtagctattcaattgtcatttgcatttgtgccaaggaaccattttcacaagaaccatttctatcaaaaatcaaatttgctaattagcaaaattaatacatttacttgcaatgaaattattttttagaaagactttaatatatgttaaagcttggcattctgataatatttttaagaaggaaatgttcttacgcaacatgactaaaatgccctagggaactctgaaatcgttttttcattaaatagagctgaaattatgtgaacaactagaacatgaggaagaaaagaggaaaacaaagtatagaacactggggaatgagaaaatagactgtgaaaggaacagtaatttgttcaaggttaccccgtgagtcaggaacaaaggggagagttgggactctgccaagaaccaaagcttatccacattaatgagtatgcactaaatctgccattttcaatacataatgtattcatgttttttctacatcggggaaggtattcatatttaccattctcctagaatttagcatgttttacctcataagtgtttattttttttttcaaaaaaatgataaatactttagctgctatcaaccagaagctaagaaaatctctgaggcaggtattataagtcctctcttataggttaatttaggtgcatagagattaaataaattacttaagaacatactaccatgataattgggccattttcatcatatcaagctcctcacaaaccactataaagatccttacccttaaggaagcacaaagtgggttacattaagtatgaaaaagttgattaggccaggaatagtggcttacactcgtaatcccagcactttgggaggccgaggtgggcagatcactgagatcagaagttcaagatcagcctggccaacatggcaaaaactcgtctctactaaaaaatacaaaaaacaaaaaaaaattagccaggcatggtggtgcactcctgtagtcccagctactcgggaggctgaggcaagagagtcacttgaacctgggaggcagaggttgcagtgagccaagatcaggctccagccatttgtactccagcctgggtgatagagcaagactctgtctcaacagcaacaacaaaaaagatgattaaaaataatttttgaaggactcaaagtcagatacaaacctggtatttggaagaatgggaagaattttgatgaatttgttatttgcgactcattttactagctaatcatttgggataccaattgaacatgtctacaaaagacccttagatcttactgataaattatttctacatgaggatatctggcagttacgccaccagaaccctaataggaggctttgaaataatttagatccaccacaagaaagtggtcttacttacaaaatcagctctctgtgctccaggcctacttcttgagagcactgcttacatgctttgacaatggctatagtgaagagattttttgggacataggattccttcatatataaatggatccctgtcctgaatatattgaagcttctgtgacaagttatctctcatccaaatctgcatgtatcaggggagtaagtaaggaaactatgttcccaagctgacaggcagaaaacaagggagggaagaaagaaacacaggtaacagcatgttagaaattaaataagacttctaactctacagccaagctatctggattgactcttgactctgcctcttactgtgagtccttgaaccagttacttgacctctttatgactcattttttcccaagtgtaaaaatagagaaattaatagtacctacctcataggattgttatgaggattaaatgagttaaaatttgttaagtgcctacagcagtgttaggcatacactgttacagaagtttggtaagtaaagaaaggtaggaagagtaagagaatagtggatgtaggtacctttaagacattgctttgtttgcttctacagagccctttactttccagtgttggggtctcttggctccttccagtaagcctaaccttgtttccggtctggtcccaaactattcttgttcagaaagatttaagaagccctagttcagtagttcaggtgattcagcattaagtcaagcttgctgttattcttgtcctgaccctgtgtcccagttttagttcctcattcttataatcaagtcccaaccttgtactccagttctgacattctgctcccctgtggctgagtcccggattgcagaacctgctcaggaccgccagaacctgctcaggaccgccagttcttttgaggtatttgaggtaacatctctcaaaaggcagcctatggactagacacactttgtttggcagacacagtgtttgcacttttgaaaattagttgcctgtatttagaaattgcaaacatgtacaaatttccatcttattttgtaaaatgatctggcaccagtggattccaagtggcagttgctctctttaaatggccatgtgctttctattccccacaggccccactctgactgctccatttgtttctgtgatttgcttggtcattgaagggatttgaggctgtgggctaaaactgagaagagccagtacttaccaagcacttactttgtgctaggtactgttctaagtgctttctgtgttttactcatttaatcaaaggccaggaatctgtttgttgttgtccattacccttgtagcccttcttctcagcttcataccccctgtctagcatgcatctgtggctatcccatcttgtttgatcactatcctccactcatcagctagcgcccactcacaaagccttgttggacctccataatgtcaaccactcacccacattgtggcctatagctggtctccaatcttccctgcccagccagactctatcttcaagaacttttgccatcatagtggttgtgttacaggtacagaatcctaggcttcattggtttgcttgatcctattatctcatgctcatgctttcataaaaccataactttcattatatatagataggctctaccctcacgaaacttttggccacttcttattagaagcccaataaaatccataaaaatatttattgattacttactttaggttccagactatcacagaaattgacttgaatattccttttataagaaacccaaagaagtttgctagtgtctatgagcaattcagtctcttttcagtgagccacttagcaaactaacactatttaaacagcgttgtttatttttgtttcataatgggcccttgtgttttacaaaacatgaatgaaagagggaaatatttgatgactaagacaagatttagaaattattaaaagaaaatttacaaaactacatgtcattccataagattatttagtttgggtgaaactaaatgtgaattgaatttaaattcagccaattaagttctaccacagttttaaaagaaggtagtaatgaaaaagttacttacataaggaattgtgtccaaagtatctgtgttgacaattataggagcaggactggcctgaaaaaagaaatagaaaaaaaattaaataatgaatagtgtattctgagacagattatttctgttaacttatttaacaaagagctcaacaggcatttcttgaggacctctacaggcaccgtgtcaagtgttagtagggtaaataaaatgactaagagtttctgtaccttcccccaactcaaatatttgttacatttaccacataaagaaattaagtaagcattcatataatttacattcattttctcttacattctacaaaacaatgcaggaggtgaggatttctgctatgtgtaaggcaaggatttctaataaattgggtaagagttaaaacttgtatcttttctttcttttttttttttttttgtgagacaagaatctcgctctgtcacccaggctggagtgcagtggtgcaatctcggctcactcagcctccgcctcctggttcaggcaattctcctgcctcagcctcccaagtagctacgactacaggcacacaccgccacacccagctaactgctgtatttttagtagagacggggtttcccacattggccaggatggtcttgatctcctgaccttgtgatctacccacctcggactcccaaagtgctgggattataggcatgagctaccgcactcgacctgtatcatttctttatgaaatgactttgctaaaggaatttgatttctctctcaaggaagcaaaattaaacctaaaccaatattcatagttattctcttcaaactgccttttgagagtatgctatattcaatacaaaaaggcttcacttatcaacatctacgtttacacattatgcgtgctgtatcctgtattttctttctttctttttttttttttttttttttttttttgagatgaagtgttcctctgtcgcccatgctggagtgtgcagtggtgcaaactcgggtcactgcaacctctgcctccccagttcaacgattcttctgtctcatcctcccgagtagctggaactacaggcatgtgccaccatgcccagctaatttttgtatttttagtacagacggggtttcaccatattgaccaggctgctctcaactcctgacctcgtgattcgcccgcctcagcctcccaatacaggcgtgaacaagcatgccctgccatattttattatttatgcacctctaatcataaacctctaaatccctagatagaacattgacagtcaaatatgacagaaaatcatattggatatgttcaactttcttttttttaaaaaaattgtacgatttgcagtaattctctttaaagtttagcgggaatctgtgtaaaactgatacaggagtgctacaaggcaaatcactagaaaataagagattgcaatctctatttgcatcaccagtctaacttcatgaatattgagtagagctatctttactttttagtttctagaattttcacaacaacttttgctttatcctccaaaggatctttcatctttgtctcaaattacagatttcatttagataaaggacatactttcatcttgattaatagagaactcttctatacgacatggtggttttggaaagtgctcaaattttggggtatttcattagctgtgccctctggagttaacagagttaacagctttttaatgtcaatctattctgtggaatcctaatcaaatgataaaacaaatagcaatccagcaggttttacaaaacaaaatttcatgtctttaccaaaaacactgggcatggaaaacataaccttggcatacatatgtatataatggatcaactagttagtcataatattttcatgattctcaatgggacgtatcttgtgggtaaataaagactctggagaaagacagtttttactggatctcattaaaaaaaaataataagaggcatgtagagaagagaaaaaggtatgaggtctgcagtcagaagacatgggctcaaggttggtttagcaactttctgattgtatgatttgggggctcagtgacttcctagtggtgtgatcttagggcaagtccactaaccctctctgattaattttccttccgtgtagaatgggaatagtagtaacaactttccaaaaaggttgaagatcaaatgaggtgatatagttgagtgtgcttggtaaacagtacatttcagaattaatgttaaatattattagtagtaagtgtctcttaagatagactactgtaaagatatattattggatggcttgtaaactgtttacactgcagagatctcaatgctatgttggtggctacaactgcactaataagaggcctgtttagattgtggttctaaaacagctcatgtcaaaggcaataataacaataattactgcttattaagtatgtattaccatttattaaatatatacataagcatatatatcctcatttaatctccacaaaaccttactgatgaggcattattatcactatttctatgttatatatgaggaaaatgaggctcagtgaaaatgagatttgacatttgaatattgttttttctgacctcaaaattcatttttccccactaagctgcttcataatcccagtatctaggtggttctatcacaagagtcttgcagtgatatgtcagccctatactagagtaccatacaagaactagacaaagcaaagaccaccctgaaggcaaaagatgcctaaggatattgcaggttagacgttgaacacagtctggtgaagccttagtatgtatttttaaaaaggtttttagttttgatgacatctctcctatgctttctgtttggtttccatgactcacaaaagtgtgcctcatatccaagaatagactgaaaactctctgaatatcacatgtaattcttgtatttccccatattttctagtatagctttgattaataaataggtattaattttatttggggctttcatcccatctttgctttttttcttacagattataataatgtgttatgggaataaattttatacatacgcctatttcctatgtaatgccatttaaaacttttgtatgtttatgttgctatttttcattttttaatgtaaatttagtctttccaagaagactgtatgtctaaaaattggcaagtattgtatacttttctagaattctccacagcacttgggtatacagaaggagctcaaagaatactgagaaatacttagaatttattgactaaaggtagtgataaagtatagaagtaggtataaaggaaagtaatatatctttacgagctttgtaaagcacttctaaagaactggaaccccaaaatctcatgataccaagactgtgactacttttccaatatccaatatcactttctttctttgtttagttactattacttaactaaattcagcttttataaaataataattaataatttcataactctaggatgtagagtctgtgaatggactccacttgaagtagaggacaagaatttgaaggataagatctatgttatgtggaatctatgttatatggaaagtttattattccttcttggtgccaaagggatccagaagccactgctaacacctacctctctaaaagtcattaaaaatgcatgaacaaacaagattgtgtaaaaataaacatatatcacatacacctgacattggtaacgccctggtgtgactgccaaagagatgccacggtaggctcttctgaatgacacactaccccactgtgctgctacaccaggctctctgaagactctcccactgccctgctccaggaccttcacagcccaccccagactacacagagcatagatgaattctgagcatggcctatgagtgtgctcttctcaccagttggtaattccaaatcttcctttagctcatctggctcctgattctttgttcacttttacagtcaagagaggctatgactagtttgatctagtttgtttctgagtcctaaaaaccaactatccacttgctttgatagttcccaccaagtattttctccacatttcacactgccctgccatatacaccctctttattttattattatttttgagatggggtctcgctctatcacccaggctggagtacagtggtgcaatctcggctcactgcaaacttcaccttccaggttcaagtgattcttctgcctcagcctcccaagtagctgggattacaggcacctgccaccacgcctggctaatttttgtatttttagtagagatgcagttttgccaggttgcccaggctggtctcaaactcctgacctcatgtgatccacacgcctcggcccccaaagcgctgggagtacaggtgtgagccaccacgtccggccatacactctctttcttccttttggatatcctctttaattggatgcctaaatcaaactggtgactcagcagattctagtgtccttctttaatatgcttttttccattaactggaaggagatttatgaaaaatctagaacaaaatctttctttaatcagaaaattcaagatttatctttatatacatctaggcaagatttttgaaactataagggatgaagaaaaaaaaattctttcttaagtaaaccaaactatgaagcctttttttgtgttgtttgccttttacatgacattctctttcatgcacagaaagccagttttcagcataagggactagtacagctaattacagagaagcaagaagcaagcagaaggaatactgatataatttaaatgatagatcaagttattaatgaatgtcagccaccttcctatccttgggcttcatgtgacatacaaatgttctcagattacatgaacaattttgtttatactagtaatagatacacttttttttttgcttgcttccaagagactctaaataaaaaataatctgacaaaatgaatgcaactttacaaaggagttcattgattctgactaatgtggttaccttttgatatgtgttaagtgtcagatatgggaaatgcctctgacatatgtggacaggtggtcatgaagccaactatggtgaagaagcctcctcaagcaaggtattggcaggaaatgtagagtagctagtcagccaagaaacactctcatgtagcttagctccgagaagtgtaggctaatcagtgggaaggtcaaaagacttaatctagtacctagacttttaagaagcaaggtagaaaaggagagaactagatcagcaagaaattaacagtaacactcatggtactaggaactatgcagggatttcagctgacccgggacatgcaaatggaaggcaggtgattgtcattacgccaatttaaataggtggtaaaatagtgcaagaataacatatgagctgtttttggatacctttggcttatcttatcagccttacaggacaggattactgagtgggcaagatttcttgtctatttagagggacacaggccctataaatgacttttatatatggtatggcatgacattttgaaacaaaatggaagccactgaaagtttgaaaatgagtcctgtatgtgggtgtatgtgtgtgcatgtgtatgtgtgtgatttcattatgagaggtggagatcccagaacctcaaggtaaatattagctgttttagactggcagctacaagatagcatgctagcaaactttttgcttcacaattcacacagaagatttccatcgggatgagccccagtcagaccatatgctaatcctggctagggaagtagaatattggggttactatgcacataccccatcaactttgaagtaagacatctaacattaagtaccggattagatatgctgagtgttgaacacaggataactgtattgtgtattagattttcccccataaccctctattatgttggcttactctggaaaaaaaaaatgtggcatggttgggggagtgacttccgccttcatttcctgaattacattttagttctccattggaacgaaactctgtctttcctctccttcttttccacaatcttttaggctggagttccacatctctaggtgctagtaggaccctactcctatttggaggatttacttggaacctacaattatcactacctgaaggtttgtagtattatgaccctgccacacctaaatcccctgatatattaatactgggacagataataataagtgtatgtacttatatagcaaatactttatgtgaattaacttatttaatcctcacacaattctatgagacaaacactgttattctcaaagtagagctgaggaaacagaggttaaataactttctcaaagtcacacagctggtaaatagctggtaaatcttcaaacccaagcaatctggctccagagccatgttctactgccccttagaatgaaaacagatttcaccagttatctctggatttttttttttttttttttttttttgagataggatcttaccttgtcatgcaggctggagtgcagtagtcccatcttggcttaccacaacctctgcctcccaagctcaagccatcctcccatctcagactcccaagtagctgggactgcaggcatgtaccaccatgcctggctaatttttgtattttttatagagacggggttttgctatactgcccaggctggtctcgaactcctagactcaagtgatccacctgcctcagcctccccagatgctgggattacaggtgtgggccaccgcacccagccagatcctaatttttgctgttgatcaacaagttacaagccagttcaaatctaaatttatttaatgtgccttgatcttggctggcccaagaaccttcccctccttcctctggtgtagttgctgaggcccagtgtgtcataagaagaggcctgtaggaggcatgcctaggaaaaggctgatggccccagcatacccaggctgactgattcaggcattctttgagcaagccccaaataaatgggtaattgactgattaaagacacatcgatggttgtgtaagagaggaagaacaaaataggaagaacaaatatattctagaatcatagaacttttaaagctgagatcttaaggaacctttaattacactcttacattctataaatatgaaaatgaatacaaagaatatgacataacccagatctcacaattacatagtatcaaaactgaggttaacaagaataacaataataaagtattaagcatatataaggtgcttattatgtttcagtaatgctataagtactttaagatatatgaatgcatttaatttttacaatgttctaaggaaaacattattgttcccattaaaaagaaggaaggaatgaaagaaagaaaggagagaagaaaggaagaaaagaagatcccaactgagcaagtcacttgcctaaggtcacaaatctaagaggtgccacaagcagtttttaaacccatgtctttctaaccccagagtccataatggtaactccaacatttgattttttttgcctgagtttttctaggcgaccagactgaaaatgcaattattttctgcctggaaacttgttagtttctcttttacagtctgaagagaaatttatcaccgttctgacttagattcaattccccagttatcagaggtttctgggtcccttaatgtcttgcaaacccccacttaaaaatgggacagtgctattttccagttaacctatttctcaagaatttagctgaataaagaatgcatgtgtaggccaggaacagtggatcatgactgtaatcccagtgcttcgggatgccaagccaggcagatcacttgaagtcaggagtttgagaccagcctggccaacagggtgaaaccctgtctctactaaagatacaaaaattagccgggcatgggggtgggtgcctgtaacccagctacttgggaggctgaggcaggagaatggctggaacccctggaggtggaggtggcagtaagctgagactgtgccactgtactccagcctggggagactgtgtctcgaaaaaaaaaaaaaaaaaggttcttaggttattatacttattactggagattagtttttactttttgctttcctagattttcttctccttttaagttccttctctacaagacaactaggtgggtgcagttcaatccagcccagctctaagtcatcactactaatatcatccagtggctttggcttgtcacctgctttgcccctgctctacggagacataagaccgctggacttactgagacacgaacagtgctgaataaactatgtgagtgcctgagggcgtggctagttcatcctgcagactgtgtcaggatgtctaaaggaagcaactttggaggaagctaagattgtggtccctttccctagcatttaataaaatgcctggatggttacctacctagcttaacaccagcctagctcagaaaacaaggtagcaggatggaagattcatgttttggcttgaaatcaatttgactctgcttgcctgaactcttaataataaaaataatattaccctcactttcagataacaaaactaataacagtaagtaactcgcccaaggtcattcagctggtaatagcaggaccaagagtcagacaacggtagcctggctccaaagtggataaatcctaaccactgcaatacatttgcttctgcaccctattaagatttgataagtaaagtctgttctagtcaacacaatttgtcttacttatccttgaacactcaccattagtattttttatccccttggactggagagttaccatctctgtttgatcctcctttaaaatacaaagtagtaaaatattttgcagaaaataaatgaatatcctatgaatatcctaaagacctcagataggctgagttggtcttcccttttttttctagtgcagaaatgatggagcagcctggagaatgaagcacagaaagtagagaccagtagatcccacaaaaaaattgagtcattagctcaaatctcaaatgtggtttagtcaatgtgccccatgccaaacagaattttcttcactttataagttttttctagaatcaatcctatttggatgaagaaatggggattgcttgaactgttagtatgaagattcttcagatctccatcctgcatgctcgccatatacgtacttacacttagtataaaaggctaaaataaattactcactaaaactacatctacagatcaacactgaaacacaaattggcaattatatcaaccaccaatgtcatgctatataaagtatatcacacacattcaatcatttaatttccatagtgagaggaaagggaactaacattgattaaccaactacctactgtgtgccaagcaaatatggtaagctttttacttgtgttttattgtttactccttacagaaccccagaaggattgacggaactttctcttgtctatagagaagtaaacagaggcacagaatgattctgtgaatttctcaaaatgtcagatggctagaaggaagcaaaactgagattcaaacccaggtgttctgactctaagccctttgcttttcaccattaggccataatgcctcaaaccccactgactcacaccgagcttttacaaatctgctttatttatgcaaatgatttctgaagatcccacaaaaaatggagtcaatagctcaaatctcaaatgtggtttagtcaatgtgccccatgccataataaccatacctacttaattcactgattcactctatgtggtgctattcctggaaagatccatgtggataccatctgttcctcgttgctaagctactaaagagctataatcttagcagtacagttgtattatccagatttaggtgccagaattcagagcaagctgccaataacctggttctttaggttaaggtagggcttatttcttctgtagtacatggataatggttttatacacaatgtgggatcactaaattattgctatttagtttccatccttcttctctcttttcctcccaccaggcaaggatccttactactccaagcacataccttgctcatgcctaccgcaatgtctttgttttcatttcttccttttcctacatcctaaatcagttgcagtcctcaatcttatctctctaaccaaattctttccatcctgcaaggacaatctaaagttccagatgcttcatgatactttccccatcatcactccaggactcaatctatacatcctattccccacattttaaagcactcattatttgtattacttcagatcacactgaattttaaatattaaaggaaataagttatgtgaaagcactaaaccctgacattctgaatgaatatttctttatatttttatacatgttgatagctaattggttcatgtgtgatattcatgtctccgtgcagaaattgtaatcattttgaagtcagggtcctcctctctatttcttcatcagccactccacctacactcctaacagtgctgggcatacaacacacactcaaacactcaaacagtaattgttaattgatttttagacctattggactagagccacagcaataggagttacaattcatgagaaactcttggggcaacagaattagatacaatgggtagaaaggggtaactgcatgctgccctctggtgatgagctcttataccacactgcttgatggtgtccatgtgtgagcatctggagcctgtcatgcactccagaccatgctattcactgcagagcatgaaaattaaggaaaattataaacagaaagactcctctatgctaattatacactggtactttgtgcttattcttccctattcctcattgcaaccctatgaagtacatattccaattatgattatcttatagataaggaaagtgaggcatggacctgtaacacaacttacccaagatcaccagactaataaccagatggagccaaggctcactcctcttgactccaaatccatattcttgtcttaccattaccctgcatggaacaaggatggtagctgctggcagtgttacttgttctaacttattattccactgtacatttcaggagaagttaggtgggaggaagtatgggatttggagaaaaaactaagaactcaaaaatcacgacaaagcaaaatgacatctacagcatttctcaaactttccagataaaatgtgagaatatatccccaaagacttacccaaaactagacatttattcaaagcctcatgtcttatattaaaaatgaatgcaattttcatcctttactccataatcatcttttttttcataagttattggggtacaggtggtatttggttacacaagtaagttctttagtggtgatttgtgagattttcgtgcacgcatcactcgagcagtatacactgcaccatatttgtagtcttctatcccctgaccccctttcactcttcccctcaaatccccaaagtccactgcaacattcttaggcctttgcatcctcagagcttagctcccacatatcagtgagaacatacaatgtttggttttccgtttctgagtagcttcacatagaataatagtctactgtctcatccaggtcactgcaaatgctgttaattcattcctttttatggctgcatagtgttcctatttttaatagaaacataaagttttgagtcattgataatggaatcaacctgacaacccaggtggttcctgcatggctataaaaaatcaggcactctgtctccctggaaataaccacactccagtcaaggaattatgttcctaatataaagatggcagaactagggagtcaggagatcttagtttcagacccagtaagttaagtaattcagcagtttactgagtctccccagttagttttattttttaaggaataaagagggaaatggcttctgaaagtccacttctcatcaaggatctaattttactcttgcaaagttcatcctgctaggaaatactgtaaagaaagcaaggatgctgtataacttttcattctgggaaatgatctctgtttttaccactcagacatagaaagttaggagacaggacattaagaaaagcatgcagaaataaaagacaaaagttaaatttgataaggaacaattatagaaattggtttctaatgacttggctgaagcataatgtcctgtatgccttagacaaggcacctcaaaaatctatatatggtcctgttgttctatgttcatagttcatattttgtttttcttgtaaacaggttaattttctggcctaagaactatgtaatcagcagcaaggagttctcttctatataaagagtaaaaaagatttgaagtgaagctgagaattattaccaagctctttcttccattattgcctctatccattttctataaggtataactccagaaaaaaaatccctctgccttcatttttcccctactcaccataatttgacactagatcatacactaagatttgaaacataacaggtgaggctatacagaaagtcttaaaatattttatatctagaatgattcttttgtgtgagaagaaattttagggagagaggcaaagatgaagtatgagttttagtttgctgttatccatcagtaatctgtaatgtgcttatgtttatggtgggcctggaggatgttccaagacttgtttctaaacaatggcacttgggcgctcattacaagacgaacagggtacaggatattttagtttcattttcccttattttaaattctcataacatctgtaagtctaagaatctcccctcaacccatttttcttcaaaattaatgttcaatttggaaacatttccaatgaggaaaaacatggagaaaaataacagataaaaaggagacgtgaatggggactagaaacatagaggttcactaaatactgctggcatttgctgatgccaaagaatatactctgcagatgtgtttctatattgtcatcaactaggcaatgaagtctttgttctccaagccaagagcctacaaatctctggatccaaaatgccaaccagttcctagccccacagctgttctagcttcccacagtggcagtgtctatgttactcttgctttctcagttttctggtggctttcttactttaaattattctataaagcaaggatactgcttgttcagtttacctcctagtaggcctggcataatgctacaactgtgtgtttaacataaagaaggaggaatattatctgttgctgtgggctagaggagagatggggaaataacaagaaaaaagaatgaaagagaaggagcacagggagtaggttgttttctggtatgtggggactctgtcacaagttggagagtgaaatgatgattcccaggctgggactctctcttctgtgctctcagactcctttttccattggaattgtaatctcaggtactctggaaccttcatttgttttataaaggtttttcctaaccaactagaaaggagatgataacttccttatgaatatatttgcaatcatctcgtgactgctcctcacccaccgttactggataagaacatttgtatcttatgcttttatgtcataggatgagcatcttctagtcctgcacttggatttagcagacgaggcttctaggactggctgtggccctgtagaacttagtcaagtcacttaactctctgaattatttctaaggttatatacaactataatgagaatcgtatgattcctgattttaatactagtctaattttgaatatcataaaagtagtaataaaagagtttagaacttggattatctgtctgggatttaagatctttctcctcacttctgcaatggtcttagctaattaatttaatctctctgaaaatttctattcatgtatagatgttaaaagttattatttcatcaatatcatgtggttcttcaagaagcaaatgtagccatatatgaggacattatgcaatttgtaaatgtatatatttgggaaaatatttaaaaatttgcagcaacagtaataacaacctttaccaggcacacttttgggtcaggcactgtgttaagagttcaattcacatgattttgttagacttcgaacaatgctaaaaagttatatataacatctaattttacattggatgaaacttaggctcagagaatttgagtaatttacccaagatagcaaatggtggaagaaggatccttcaagtagctgaaattctgaatcagaataaaaactgaactcggattttagtcctactacattatgtcttactgtttaaccatttctgatcctggccatttcaactttctaagctttaattttcatataactactatgaagatgataaaactcgtcttgcctaattgtgaaagttgtaacgagaagtaatctagtttatactactttgaaaattgtaacaagataaataaatataaggaagataggtagtagtagtagtagtagaggtagtcttagcagcagcagcagcaagagtaaaaacattggtgtaattttttcaactctacatgatgaaaatgagaattcccattgctcctaagcatcttctcgctaaataaaaatatctaaatgaagcttcaaaaactatggcatatctagtattagctcattaaagcttttcagattttaatgtgtatatatttttaaattttggtttgctacatggaagaggactgccattattaactctgaacagctgtctatttttctgttctgtaacaaataagcttggcgttctatttttgcaatttctgggatgggtatggaaagtggaagtggcagaatgtaagctttactctattgtacaataactatatcagtgctaatactccattttaatgagtcatcaaaacattttataatgagcaatactggaatacaaagaaggcaccctgcacctggtgttagtttttcgtggcctccagatgtgtatgcacaggcatcacaagaccggtagtcaaagaaaatgcaaacttcacaagtgaggaagatataaagatagcaggctcttgcttttttgttaaaaacctaaagtgacaatttcattccactttaccagcaatctgcaaatgttcttgcagtcccaagctattgtaattatccaggtcgcttctggtgtagttcccctctctgccttaaattgaacatctccatagattaagtgtcatctttattcctatactaatagaaattccattaatagccttgttcatattcttcagaaggaaatggactaaaaattggggtattactaaacagaaatgcaaagcaaggttaagaggaaggaaacagggaaatgaatccaacatgattgaggatgatgagttaagtactatttagaatccagaaaggacaaaacgcacttggaacaccatgaactgggactgaaagtcatcactgaacaaatcctatttagagctgacctcaacatatgatggttcaaactatacatccagggaccacagaggcagagttggtggatgtgatgctggagctcaggagacatagtttaagaatttatctgaggcaagaaggatcatttcctcattatcgtttcattgttgcctaaattctcccttcttaagtattcaccattccatctatgcagatttacttaggaaacataatatttaagaaaccatacttggcactgcagaaagtaggaagaggagaagtgcatagtcttgccctgcaaggaattcataatgtcatgtggagataaaagaaacctcccaaatgcttataatccaaagcagaaaaaaatgcacgagagaaatagggacaaagtcccatgacaggcatgaagaaaggcaggtgggattacggttggaagacctaggttctttcctggtcttactggccacaagattttaaacaaggtacttaaccccactaatcctctgaaatgtagataataacaatgatccatttcatgttggtattgtgatgattgcgtacaaaagtatagattaaagtagttggtaagaaatttccctactcttatttttcctcagggggatgttaatcagggttgaagtaaggagggaaaaggcatgtcttctggttactaggcataaggaaaggcttgtggaaggggataggagttaagtcctgaaggatacaaccttactttgaagaccactgtcctcagctgatctgtttatcttctcttcaactccgtccttcatcttctttagcactgtatcctattcctgtaccactagtcactaactggcccctatcttaaagttctgtggctgtgggtatagaaactcacttgcactggcttaagcaaaatttggaatttgttgtcaggctaaaaggacaagaagcacagcagggcaggccgtctgataaactggaactaagaactgggagttttgggggacccagaaagtcacagtccagcctctcttagttcttttcagcctcatttctctgtgtctttctttgagaccacatagtttctcacctccttttctttttctacatttgtttcattcttttacatttctgcacaaacgttctctgcttctccatggatatactcaattctaggcaccattgtcaacctgtaggtcaggccacacatagcagggacaattaagccaggtttctgaaaataatctctttcttgaggttctcttctgaggctccagtgcctttgtctgtgggcttgaattatttagtgttgtttttatgatttacctgtataattcctgaccttaaatatgacccaactctcatcctggttgttctgaccttgcttctgtaatgctcaaagtgttagatcacaagttggagaaagttagtaacatactctcatttcatactgctctttcttgccttagtgactttgttccagttgtttttaacctctcacctccctcatcttgtaaacccctgttttaaaactgtctcaagacttttctcctttttctagccttcgctggttatctttcctttccatctcacgcagatggatcactcttcccttgctgcatttaccatggtttgtacatcttttaattgctgctcctaatcacactgcaatatagttttcttggttttagtgttttcttcttactctaatgaggtggttaagaataacgctctctgaggttggaacactgagttcaaggaccagtcattccatttattaactatgtgactgtgggaaaggtacttcacctctttttttttttttttttttgagacagagtctcgctctgtcacccaggctgcagtgcagtggcgcgatctcggctcactgcaagctccacctcccaggttcacgccattctcctgtctcagcctcccgagtagctgggactacaggcgcatgccaccacgcccggctaattttttgtatttttagtagagatggggtttcactgagttagccacgatggtcttgatctcctgacctcgtgatccgcccgcctcagcctcccaaagtgctgggataacagacgtgagccaccgcgcccggcccatctcttttttacagtttgtaaaatggagatgatagtacctacatcagaagttgctgacagaattgagataatacatgtaaaatgcttggaacagtgcatggcataaaattggtactcagtaaatattaactatcactttttgaactgccagtacctagcccagggtgtggcaagcaggatgtgttgtttgctggataaatgaattatattttaaaactaaagcatatttgggaggatgttttatttcttttgttttgtttgtagtgactgagaaagtatctactattgctacactttctgataattgatgtttatctgtgtatgtatacatgtaatattgaattgcaattgtgagaaacactgtaaacaacttgcataggatagtattcaagtgtgtaatagagatacatgtgtaactgtttatttaatgtctgtccccaccactagaaggtaaatacccccagggcaaggtttgactgtgccctatttattattagatgttccaggcatatcgtaatttctgacacataaaaggtatttaataagcattcattgaatagacgaacacatggaaaaatagactgtgtttacacaatttacaagtgccttttctgtttcctccacttggaatgtcctcttcttccatcattactgagcgtcaaaattctgtttaaccttcaaacctagctgagacagccttccatgaagcttgccccttctctgaattcttgtggtaattcatagactcttaggatactctacattttgcatatggtattacagtgatttgcaaatcaatttgaaaattcttgggggcagaattccaattaggggttctcctgatttatacacgtttatatctctcccaatgcttaataagccgcataaccttcacattagggtcagaataagtttttctgagatgaatgaacgaatgaattaatagtattgcgacttctttttgactgacagaagccccaagtctagcagcaagatgagcataagaactgtacttaggacccactgatccctgtgtgaatgtttttatgaaatccagatatgattgttagcagtataaggaaaaccaaatttgtacattgcagcaagagatattagggcaccatttggtaatactatctctcttacaaagtgatgatgtcacaaagaagttttaagtttacttttgggcacttgtcctgtctagaatagtgtctgacacatagtaggggctctagaaaatgtgagtgagctgattgaactaacaaacgaataaaaacacaggccagtctctatgaaaagaactactaattatgagactgtttttataagcatatctactcatttgaataaaattgcaaagcctctgatttgcctaatatccaaaaatactgactgcctagaagaatgtccttatgcctccaatgatggaaccaatttaaaatacttcatgagaactttttattattcatgcatttaataaatatttaggagcttacattcgccagacacttaggctaaaagataagaaaagttctgtgttgctgttttgcacttgtggctcttggatcagcagatgaacttgcttgagactccagattttatttacatcttgttaactctaggggaggatctaatatgtgaaatcaaatcctgaaactttgaaggacttcatagtttggtttccttcttctctgaagactgttttgagcagcactatccaggtatcagccactttaaggttcctttcaccaatatgaattttatatgggaggttccctgggggcagattatatcatgacttgagattttatgtcaggtttattgttagttcacagaactacattgactgaaaaaccagttgtgattcatagcttatggtgtgtgagtgagatgatccggaccatctaggtggctccgcattctaacgatgcgttaggaatccacactcacagtagatgcacagaagagcatttacttgcttacgaccttttcaggtcaattctcctaagattaacgacatcaatatgtgactatactttatagacattgttcattttcaagtatttgatttaaaagagaacaaggtttattttaaaggaggcaattatttgagccgtatatttgtcactgatttaacataatagactcagcatgataggatatgtatacttcaggatttattacgatactgtaaacaatgaagtgtatcattagtacaaattccatacaagtgaaaatacatgtgtgtacatgaaatacatatcattgggttaaaaagtgcataaagcagggaatacatagagtaccttttctgctgacaaaaaaataaattgagggtcagtttataaagagttattcttaactgataatattttaataatggctataatttctaaaagaagctctcatgaaattgtgatgatataatcatatgtttaataaagacttggaagatgcttgagatatattggcaaattcccaatatgttctgaaaagatttagagcagtcaaaactaaagcaaacctgaatgataatttgggcatgattttatatatgtgtgaattaagcaaaactggaaacacactggaatcaaagacagagtagcccacgaattatgagaattgaatccaaggttaactggacacataggggtctattccatgtattaacacatccctgcccctaccactacaccaccacaatgctatagtcaaggttctgagttttctccagatggactttaatagaaataattttatgagatcagtaaagacaaagctaataatgaaaactgtcaagcattaattggaaattggagacgcttgttggttgatttagtcattcctcacttgctcaccaagcactctttatgtgccaggcactgtgctagacactgggaatagatgcacttctgtatttaaggagctcaagacaagacaacaacaacacaaacaaataaatgttagttcctttctccaacttactttcctattcacatttaccccaaaagtaacaatataattagagagactgagaggaaacacttaagaataaaatgttaggtgataaatcagagatgcacacaagaaatcaagaagggggaagataaccctgcctggcaagggatggctccgtgaacgaggaaatacttgaggtccacaaggaatatcacactttgataataacaaaaaaaaaaaaaaaaaaaaaaaggaagagaagtctcataaacataggagaagcaaactatactttctagattctagttcaaagcaggatccttatagcaaaatgatttagagagtttcccaccattagttttttagacttcttacaaaaattatataagctttatggctttagtagtcaagatcaacttaccgtgatccaactaaaatatagtggttcaattagaagagcttcaaatatagcccagagtttgtgacatttaagtgatttcgaagttacagggaaaaatatgatggcatctaacttgagtcacttgaaaataacatgaacttcaaggaagatttattccaactgttgaaagaagcatatctcttgagtttctatgtcagaaataatgtttttcttgagaaggtaccaaataaattttagcagagattattttttaagactcttctctcatagctaattggtgatctcaattcttcaaagtagatctaatgaaaataatcaaacattttaatattcttcttggtagtcctatttaccttatctcggcctatcaaatgttgccagcctgattcctctggttaaataaattataaacacaaacattatttctccaaaataaaacacaatgacactgattcactaattcactttacatagctatacacaacttctgtcagaaatttttacaaaatctaaatattgcatcactactttactaaagaagcaattatacttttcaagataacttttttggtgggttttacttggagtaaagaatagcaattttggtttcttgatctatatatcaaacctaactgcaaaagatattcaagtagctctgggggaaccaatggggaaataaacattgcagtttatttcaaacattaatatatggaatatcaatattgtttcctttctttagtacatgccactattagaaactactgtcttcagtgggatgagtttgattggaccactgtttattctttctcaccgattaatgcttggacatattaagaattaggaattcatacagagaaaaaccatatatttagcctgaatgagaactacagagaaaataactatgatcatcaaatgcacagaatttatacatttctctatagatacaacaggagaaaaaggaagaataaataaaagaatccctaggaaaataaaagaaaattttccttaccggaataaatgcatgttgcatagcttgttcacattgttttaaggaagcaatagtatcccacaaaagctgataattctcagcccgagaaacacttggccgttgcatagcgaaagctggtaacactcaaactgagctcacagaacccagttgaagaggaaaaaaaaaaaaaaaaaaaaaaaccctgcagatctgttacataaacttcttaattagatctgctacacaaactgctatcttaagacttaaaaaaaaagttaatcagaacatttcttttgggggataactgggcatgacttgaacagagacagatgttttcatcgggaagaattttcattcctacacttgtgaaaagcaatcccatcagtgctctcctgtcttcacacgggtctggtgaaatggcacataccataagcgtgtagggggaaagaagtaggaagaagagagatgtgaaaaaatattcctaccagaagatttgggtggcaggtcatggtggtggaatttaagtagcttgtgaaaagtagtaacattgaagggagtcggttatatacacacatatatgtacatatacagatgtcagcacttgtttgctgtgtcagaaatacaactatatacatgcatactcacagtgtcatttaatatgtccagctctcctctcagtttagttaagagctagatgtgacatattcttcacctacagagtattactgtcttaatggcactatgagttgtttatctgggattatctctaaagacaagccagaaggcatcataaaatgtaagagtaactagaagaactttatgttgcctatatattgaagaaaagtcacttttattccttattctagataaaatttacatagataatacaaggagaatcgtgtctttaaatgttctcgggaaatgagagtaggctggaatgtgttaattccaaagaaatatgcatgtgcacttcgacaacaaaaaagactcgtataagcatgaaataaaatatgaacagaatttagggacatattctcaattcccttcaccaaggacagtacccacacagggaggtgaggctccaccagtccctaatgtctctgtaggattgctgagctagaaggtgctaggaggtaaggcatcttggaaggtgatgctcagagcacttggaagttccaaaggaatccgtactctaagggctggttgcacagtcaacaatggtgatatttactcaagcatgtcaagaggtaagaggcaaaaggagagaaactcacagcataataaattatgcatttaattgacctagaaaatccaaggaagaccaaacaaggtacaaattgtaggaaacagtttgataacatacacgaaatattttccctgtattatttttggaagagcagcatgatttgggttacctagttttcctccatttgtaccctgatgatggtagactggttcatactaatgcccttgtagtgttaaagtctcaaaggctgacaccagggaagttttcctcttaccttcatttcttttcaattttgaactgaaggaatgaaaagtagaactgatctttcaaaatctttacctaatttgtaaattttacctaatttgtagggaaattgtttttccttagtacttcacgagcacacaccataaggctattgccattagacagtttgtttttcaatatcaattcaaccaaccttctctttttctcattcatggtgttctgttcagctcacacccacagtccctcctctgccttcattcctgcccttatagtctcccatctgccccagccacatgcttcttctccatgcattgtcgaccagccagcccacaactttcagaaaatattccttcactagtaaatgttctgaatttctcaggaaacaacaggaaaataaaaagctgtcttttaagttaccttccaaaatcccagtcattcctctctgaaattcttaagcaaatgcttatcattattccagaccccacttgctgggtcttgtgaggcttttccaacctcctgtttatcaggttcctttattctttcctttaaagagcatgtcctaaaaatcctcttctctttagtttttggggaaaaaaaggtaaagaattcatagtctttgtgtgtggaaacagttttaaaaactgccctttgaatcttgcattcattcatttattcattgatccaacaaacatatcaagcatctcccatgtgctataatttttttttttttcttgagacggagtctcgctctgtcgcccaggctggagtgcagtggcacaatctcagcttactgcaagctccacctttcaggttcacaccattttcctgccttagcctcctgagtagctgggactacaggcacccgccaccatgcccagctaattgttttgtatttttagtagagatggtgtttcgccatgttagccaggatggtcttgatctcctgacctcgtgatccacctgcctcagcctcccaaagtgctgggattacaggcatgagccacacacccagccgtgctataatttttggtagtactttggacaaatgaatacatcagatgttgcctctacctttaaggagaatctaacagaagggatggtaaatcagcacaaataacaaaaaggcaaatttaaaaacgtgtaagtaccataaaagaggtagcataaactatttagaaagcaatgaaaaagaagagattatatccatggtggacattagggcaggctcatggaagatttagcactttgctagagtctgttgttagggtagtatttagttatacagatatagggggaattctgagaaaggaaaggtacagcaaaggcacagggtgggaaaggcttcattgattattgttttggaagaaatgtgacaccaagaaaaaaattgtaaatcaatgattacccagcttaaaattaagatttagaccaaatttgagcttattcttgattgaaaactaatagcttcctattcttgatgctaaccaatattacctttaaccaactcacagataattcatgttcataaattcagtgaaaatcttcttaaacctcttgaggtgataagttctatgtgtttattcctcactgtttgaaataggcacattgatatacgtttggaggccctaggtggctcaatcatttaggttatattacttattatttttcattaagcaaatattacgtgttttgtattcctgcccactttcataagttctaaacttcctactttctaagttcaagtggggtccactataaatccaatatttaccttatcaaatatttaacttagttcaatttgactcagtttaacaaacatttattgagctctactatgtgccaagaactgtgctagaaatagagaacacaaagataaatgtaatattatgtcaatcctctgtttcttttctactatcactcagtgtgcaactgtctctgcccacaagtggagcatatgtattttcttcctgttagcacgatgcttgataagtaattgctaccattttttttccattaaacacgcagtcactaggctacatgtctatcacatctaaatatgtcacgatgctctaacttagactgcagacctcagaatacctaacggtacctttgtatggtgggactaccatacgttgagtgctttctgctggtgaatggtttaaatttaacttcatgacaattgcacttccagtaaaaatagagtaacagggcctggatttgcattcccacctaaaataaccaaacaaaaggacacaatgtaggaaagaatgggtttcaagaatgcacatgagacaaaaaacaatgaacacagagagaaaagaaacaaacaaggtgggccctgtgatttctaattcttatagcctttaacttccaggccatattccagaaaggaggaatccagttgtggccaatggacttgttgcgttgagaagacagaattggtttgctgggaagatcaaggcagcaagtagaaatagataaatccacaattataattgaagatatcaacacctttaaataattaatagaacaaatagaaaatctgtaaagatagagaagacttgtataaaactaggcaccaatttgagctaataaacctttatagaatattttactccacaacagcaaaatgtacacatttttaagtgctcaaatagtatttaccaagatagaacatatttttaacttgaaatcaaattttcataaatttaaaaagattcacgtcacaggaaatataatctctggctataataggactaagttgaaaatcaataacagaacaatctctggaaactctcaaaatattaagaaaataaatgacacaattccaaatagctcactggttaaagaaaaaaattaaaaatgagaatatattttgaactgaatgaacataaactacaatatattgaatttgctggattcccttaaagcagtaattaaggaaacatacatatcactacacgcttatatttgaaaagaaggtagtgtcaaattactgacttcagcttccatctttcacgagaaaaaaaatatagcaaattaaacccaaagtaggcaaatgaaaggaaataaaaaataacagcacagaagatagaggaaaaccaatgaaaatgaaagctggttctttgagaatatcaataaaattgatgacactctagcaagactgattaggagaaacaaattatcaaaatcaagatggaggaagatgacatccctgccaatcctacaatcctacaaacatgaggagctaataaggaaatctttatgtatgtaggtatatatttatttatttattcttatagacagtctaatgttatgatcatggctcactgaagacttgaaatcctggcttcaggcagtcctctggcctcagcctcctgagtagctgggaccacacgcctggctaagttttttttttttttttttttttttgagacagggtctcactttgttgcccaggctggtcctgaactcctggcttcaagcaatcctccagcctcagtttctcaaagtgctaggattataaaacatgagccactgtacctggctgagaaaatcttataaacaactttttccccccaaaaattaataccttagatgaaatggacaaattccttgaaagatgcaaactaatcaagaagaaataagtactttacatagtcacatcataagctattaaagatatttgtaattaaaatcatcccactaagagaactccaggcccagatggcttcactgataaattccctctaaatattttaaagaaagaaataataacgattctacacaaaatttttcagagaactcaagaggaacaaatactttccagatcattttttttttttgaggccagcattaccctaatcccaaaccagatgaagatattacaagaaaagctaatatcaataaaccctcatgaatatacaagcaaaaattcttaaaaaattttttagcaaatttaatcgaacaatatataaaaaggataatgcatcatgaccaagtaggctttatcctgggaatacgaaattggtttaacatttacaaatgaaccaatgaaatttattaagttttcttttcctgaaaattaaataatgaatttattcatatgttgaacacctcgttaactattttcacaaattgtaattatgaaatagtaaacattattttatttatttatttatttattttattatactttaagttctggggtacatgtgcagaacatgtaggtttgttacacagatatacatgtgccatggtggattgctgaacccatcaacccgtcacaaaaacaccaaaagtaatggcaacaaaagccaaaatagacaaatgggatctaactaaagagcttctgcacagcctatgaaactagcatcagagtaaacaggtaacctacagaatggtagaaaatttttgcaatctatccatctgacaaagggctaatatccagaatctacaaagaacttaaacaaatttacaagaaaaaaacaaacaaccccatcaaaaagtgggtgaagggtatgaacatacacttctcaaaagaaaacatttatgtagccaaaaaacatatgaaaaaagctcatcatcactggtcattagagaaatgcaaatcaaaaccacaatgagataccatctcaagacagaatggtcatcattaaaaaggaaacaacagatgctggagagaatgtggagaaataggaacaattttacactgttggtgggagtgtaaattaattcaaccattgtggaagatagtgtggcgattcctcaaggacctagaactagaaataccatttgacccagcaatcccattactcggtatatacccaaaggattataagtcattctactataaggacaaatgcacatgtatgtttattgtggcactgttcacaatagcaaagacttagaactaatccaaatgcccatcagtgatagactggataaagaaaatgtggcacatatacaccatggaatactatgcagccatataaaaggatgagttctcatcttttgcagggacatggatgaagatggaaaccatcattctcagcaaactaacacaagaagaaaaaaccaaacaccacatgttctcactcataagtaggagttgaacaatgagaacaaatggacacggggaggggaacatcacacactggggcctgttgtggcatgggggtgctaagggagggatagaattaggagcatttattaacttttttttaaagaaacaaaactaattaacaacttaacgattatcttagtaggcacagaaacaacattttacaaaatccaatatctatttctggttttaacaaaaaactcttaggacaagataagtacgtcccttctcaccacttatattcaacattgtcggagaggttccaaacagtgtaacaaggcaagtaaaataaatacagattggaaacaaagaaataaagatgcttttattacacatgacataattatctgtggaaaatctcatgaattctaaagaaatgctagtagaatctttagcaaatttaacaaggttgtagaacacaagattaatatccaaagatcaattgtgtctctatatactagcaataaattcatagaaattaaaataaaaaataatgcaatttacgacaaatttttgaaatattaacaacttagggataaacctgattttttttttttgagacggagtcacgctctatcacccaagcaacccctgtatcccgggttcaagcaattctcatgcctcagcctcccaaatagctgggactataggcgcacaccaccatgcccagctaatttttgtattttttgtagtgacagtgttttgccatgttggctaggctggtctcaaactcctgacctcaggtgatctgcctgcctctgactcccaaagtgctgggattatataaaactgatttttaaagtgtgcaaggcatgtacactgaaaactacaaaaaaagaaaaaagaggatataatattaagatttcatgctctgaaaactgaatcccagatagtgactacaggggttgaaccatacatctataaataactgtttttttgttttttgttttttttgagacggagtctcactctgtcgcccaggctggagtgcagtggcacgatctcagctcactgcaagctccgcctccctggttcacgccattctcctgcctcagcctcccgagtagtagctggaactagaggcgcctgccaccatgcccagccaatttttttttttttttttttttttttttgtatttttagtagagacggggttttactgtgttagccaggatggtctcgatttcctgacctcgtgatccgcccgcctcggcctcccaaagtgctgggattacaggcgtgagccaccgtgcccggcctagataactgatttttaatgaaggtacaaaggcaacttaataaaggaaagataatattttcaataaatgatgcagggacaattggttatccatatgcaaaacaacaaactttgattcacacctcttgttacatgttaactcaacgtggattatatacttagatgtaaaacctaaataaagcatctaaagaaaaacatgagagaagatctttatgaccttgggttaggtagaatacaaaaagcaaaatccataaaagaacaaactgataaatcagacatcattaaaattaaaaatttctgttctttaaaaaatattgttaagaaaatagagaagccacagaatgaaaagagatacttacaaatcatacatctcataaaggacttgtttctaaaaaacaaataactctttttttttgtctttttttaaaattattattatactttaagttttagggtacatgtgcacaatgtgcaggttagttacatatgtatacatgtgccatgctggtgtgctgcacccattaactcatcatttagcattaggtagatctcctaatgctatccctcccccctccccccagcccacaacagtccccagagtgtgatgttccccttcctgtgtccatgtgataaaacaaataactcttaaaattcaatcagaaaaaaaaacccaaaaatgagccaaagatttaaacagacacttcaccagtgaagatataggtatcaaataagcatctgaaaagataatcaacatcatgacttgttagagaaatgaaaattaaaaccccagtaagatactactacatacctattagaatggttaatatttaaaaagactgaccatatcaagtgttggtgatgatgtggaagattggaagtctcatacactgctggtgagaatataaaaaattgtacaacccctttggaaacaggtcagtatttttttcttaagttaaatatgtacctaccctgggatttaatgattctgctcctaggcatttactgaggataaataaaagcacatgtctattcaaagacttttatacaaatattcatagtagctttatctgtaatagccaaaagcttgaaataacatcaaaagatgaatagattaaacaattgtggtatttgcatgcaacagaatagtgttcagcaataaaaaagaatgaaatattgacacatgcaaaaacatggactaatctttaaataatcatgttgagtgaaagaggacaaacaaaaagtacatactatatgatctcacttatataaaattatagaaaatgcaagttaatgtataaagacagaaaggagagtaatagttgactgggaatggggaggtagagcaggtaggataaggtagttggagggagggattacaaaagtctggagagattacaaaaaggcatgaagaaatttgcagaggggtgatggatatgcttagtatcttgaattgatggtttcatatgtgaaaactcatcaaactgtacctcagtgaagctatttaaatttttttaagtttctagagaaaccatcaggaagtcttatactcctggggcttatcataagtgataagcactcatcatttaatgctgtaatcttgcagttcaatctgtctccttgaagaggggttgggggagaaaaaaaagcttagaaagcaatgaccttccagcaggaagggaggcagaggatatggataagtttaatcagagaaaaagaccaagactttaccatccaggaccttacttctagttatggttcttgctctaatttagctgtaagatcttggttcagtcattttgctttgacatgcttcaatgactcaattttaaaatgaaaggattagatgcaaccaactctcaagttctttcagagccataactcaatgatctataggtatattttaaacatcaacaatcccattttcctcacaactcagcacttataggtatggccctaaatttagcagaaccacttcatgtaattttgaagtatgtactatgtcatatatgctggtaatctctctcctgtgatagagtaaactctctggagggtgaggtcctctatcctaaaatttctagtttccccatagtatttaaagttcagagcctacatcattgtaatattgactttacaactgacactaaaattataacaatgcatatctatcattttactgcttaaaaagctactttcccacatggcatccccatgaaggtcttattcgtaatatacagatagagaaataggttcacagaggctaaagtaactgacatcaccactaactagccttgtgaccatggccaagttccatagtttctgtaaatagagcctgtgagataatagtacttatctcataggattgttgaggattaaatgagttaatattgataaaactttagagcagaacctggcacatagtaagcactattattagtgtttatgaaattaatttaactttactgatttatttaacaagtaagaattaagtaatagatctaagattaaattcacatcttttggttattagtccaacatacatttgaccagtgatcagtaattatataaggtaattgtagattcacctttcctaaccaccattacaccctagtctaaaggatgtaacctcctagttttcttcctccctgaatcctatttgcttccttttcctccatagtatttactttttaattttcttcctcctccactaaactgtaagctcagagagcagaagccaatgtacagccagctccagcacagtacctagaatataagactctttaaaggtttgcttgatattattactattaatggggcctaaatagataaaagctaattacaatttcaaaaatatatgttagtatatttaccaggattttctgtattaaaaagatctatggtgaattcagccatgactcttaaaaacaaaaaaacaaaaaatggtccaggcacggtggctcatgcctgtaatctcagcactttgggaggtagaggcaggtgtatcacctgaggtccaaaaccagcctgaccaacatgaagaaacctggtctctactaaaaataacaaaattagccaggcgtggtggtgcatgcttgtaatcccagctactctggaggttgaggcaggagaatcactggaacccaggaggcagaggttgcggtgagccgagatcgcaccattgcaatccagcctgggcaacaagagtgaaactctgtctcaaaaaaaatcaaacctggcatctgacccattttttcctatttgagagagtgataccttgatgggcaagactcacatgactgtgccatggcaaaatggcaaatgccatattttataaggggaattatatgacctgtggtgtattgaagtccatataatataaaattgtgctacatattcaatcattcagtcatgtctcaaacctgcttaagagacgcgagtcatcgtattacagtgatatcctacacacactgcagagtctctggaatcatatgcccagtactataagggaaagaaaacaagagacctgagagaagttgactgaagtaggtgggaccccaggtcttgtttgcacatagttctgcagaatgctagatcacagcatgttaaacttcagaccagagtcaagccaggactaacctagatagaaccgtgaggcagatgaagtgtgtcttcaccatcttcttccccatctagagccctcagccattctctactggactttcttgacagaaggaaagctacctgaactcaactgtagggcagtattaagaatttaatatgcctctccccctacttgctttcttgacacttttcaaggccaggtgttaatcatatttatcagcttgttctcagcctttagtgcattgcctggcatataacaaaggacaccaaaggtttcttaaataaataggtggacgtagaaaatgttttacttgatgttgatgttaggaattctttatatttgcagagcatgtttcgattgacaaaacacttttataactaggacttctctgttacttttcacattctccctatttacacatttaaacattattatgtaagtggctcccttgtttatttttttggctcagatttctctcctaaattgaatatcctgttgcttgctggtcatctctgctcagatatctcacagacctctcagatataacagctccaaaagctgagctttcatcctccttcttccctcctcaaatctgcttctctttcaacttcctcatccagtaaatcccagctccgcccactccatttctcaagttaaatctcaggagccttcacaaccacttcatcaagaccctctgatggaataatttggacctgtctgtcaccagggtcagcttggcccatctcccccttctctgtgacctagccccacaggccctcttccattatttaggatataatacatcccattctcattttggttcctatgcaaatgccagttcttctgcctcaaatcttctcccacctgttctccagaatgctctcccacttatcatttaaatcttagcttcactgtgcatcgtaggaggcttaccagatccctgtcctctatttgctagatgccagtaatccttccttcttccagatgtgaaaattaaataggtctccagacatgacctaatgccccctagggaaacaaaagtaggcccagctgagcaccactgccctataccttactcacgacatcctgttatagcttttcatggaaactagtttgtaaacctcttttgtgactattgtgtgatgtttacattacatacctgaattacttcattatggataaaaactagttcttttgcttacaatgtatcatctatatatagatagtgtccagcatgagtaggtactcaataaatatttgttggataaatgaatgaatttcattctcatacaaactctatggaatatgcacagccagaattagcaaccctatttctaaattgaggtagaagacacactgagtggttcaatgagaggcccctgaatcacatcatcaataaacggtagacctaggaatccattaacctaggttttatcactctcaattcctcttaccagcatgtatccttttactgccattaccatgtttttaaccttctcagattacttcatctcctttctcttccaagttctttatcacgtgttgtccttgtagtccatgcacagaaatatacacctagctctatatcaagggctgaaaagctcagactttacagtggcttccagtgatgctccactctgctgcttttaaaaactcacagcatattaaatataagagaggtggttagggcttctcatgtaataggagtgcaagggggtaaaaaaaagtcaatagctctcctgagtaaatttgctttcatcatacacttagctagtcttgtggtctactctagtaaacagttaagatactctaatcttaaggaagccattgcaatattgttaactagaacatggaataacttttaaagatggctggctaaaattatcttttactttcatgctgcttaagtatggccaagcagaaaaatctcatttgaaaatgagaattctcttaaatggtacttttagcatgctaatgcacttccatgttccaaggttttgaatagcaagatctatatggcacactcaattttttccctcaaataaactatttttcaatagcctaagggccataatggtcaacaagtgtctgagtgaggacagggaatgctgttgagaggtaaatttgactcagagatgcccctgagccatggaaaggagctgtgctggtgggctttgtaatgttagaatccctttactgttaccaaaggctggggttgacgcctaagctttcccatctctctgcagaagcagagaggatagttaagcgtacatgatctggaggtcaactttccagattagaatcctaacttcaacgctttttaaatgtctgatcttgaccagattactctacactttgggcctcagtttcctcatatgtaaagtgggtttgataatgatgtttatgtcatataattgttgtgggagattaaatgagttgattcatgcatccagcataaaataagtaccaaataataattgttacctattatctgtcttctttacatgtacatatttctatttctgtgtaaataaaagtatttggtgttttagtaagctctgcccatatcccagattttatcatctcactaattcacaagcacctttagggcctaacctccattacattttcatcatcataaaagtatcacatttgattcttacaacaatcctaggaggtcgggatggttatatccattttacagatatgaaactgagatctagactagttggactgtgcctgtgattatgcaattagatagtgttggggggccagggctaaagctttggacttcttaggaatactcttcttttcttttcaaaccatagaattttcacagactcaagtaagacttgtcttaacacttttaggatattaaaatgacttcagagcaaagctccctgggaatctgttctccctactccctgctctaatcaatgtatcttcactgggtagcagctgcatgttttagtcagtgttgcgtaagtctctgtttctatctctctctccttctttacctcttcctccctccatctctcctttcttctctcttccttacttctacctctctccttctctccctccatatttttctctctcttagacacacacacacacacacacacacacacacacacacacaaatactttattcgtctatttcatatagaaggagaaggtgtcattaataatgactttgaggtttccaacatctgtaatgagacaactgtgatcaggtgagagccaataggtgaacttggattactagtgcatggaaaggtcatgcattaaatgaaaaagcaaagaaatggagtttggattaaaaaaatagtatggaaacgggagagagcagtccttgattctagtaaagcttgtaggcagtggaacaataataattaattaaaaatatttctgagggaaggtagatgagtctgggtagctattcacttcactaaattgatatcatatgatattaaataattaacaatccattaattatttacaatgtacatttggaaaatttagttaatatcaccaagctttagttttctctctcataaattgtgaataataattaataataatattaatctcctaggattattgtcaggattaaatgaatacttacacttaaatatttcttagagtataagaaagtactaaagattaataaataaatgttagctattgtcaacagtattattattttattaatgctatcaggaagggacaagtatagaaggcctccaagatgagggtgataatagatttctatttgatactttaggcaataagaagctatgaagatagaatacctatgactgaaaagatattttgcagttatttgttaaaataagtatttagattcagggagttcagttagaatttatttgaaagaaccaagtacttctaagatagaataagatgtgtaactaaatctcagagtcattaaaagcattgatctccagggctcatgagatctaggtctattcacccccaaatgaaattgcatagagaatgctaatgtatcaacagaaaaacccctaaatgaaacgaaataaaacatttgaaattatactatgaagtcaagacagtgatatgtaaactcttccaaagcaccatagtcacagacaatggattccaccaaaataggccttgcaaactttgcttcattgaactatgttgacataattaaaagtcagttaatgtagggatcacaaacatttatagtggggagaagcttttgtgatatttacttttataatgaactgagacttaaatattgctcatgcacagaaatatgttttgtgaacttcgcaagaattcttttttcatcagtaatctcttcattaaaaagtcgaaaagcaaggcccttaatcatgtcatattcttttggagtcctttactcagcaataatttcatttaaaaacatttcagtgaacactaattgaacagaaactgtcaacttcctttcataatgaaaggaaaactgccatgatgaagagtttctaatcattatatctaattaaaaagttaatccttaagtttttcatgtttaagttctttcaaatgtaacaaaagaatttctctttcaaaaatgggaaacaaagcacagtcattaacgaacaatgcttctgtgataaagctacaaacttggaattaaaaaatattggcccaagcttttatgaggaaattaggaaaattacaagaatcagccaaaccttggccttcattgacctatttttttaatacagaaaaatttcattgtagcactgacagtgagggatcaaaaaataattggaatttaagccttttgaaatacagagagaaaaatggcctctgcatctcagctcatgggggaaatgagacatgactcactctctcagtatgagtaaaggtaattcttttaggtctagagatagagttagaagcaagttcttctaaataagtgaggctttaccccaagattctgactcacaggaaaacctttaaagctacagtctaacctcctgaagcctagtagagaaagagaggattcctaggcaaacatgggagatgatccacccaggcatgactgtctcactctgttcgtaaacaaggcagaagtgggagaaatagttctgaaagactaaatgcaaactgcaagatgatgagcagattgctttgactatctctacttccagcctatgcgtgcaaagtattttaggatactgtgtgatgatcagagaaagaaaacttgtttgaaagtaccgttttctggatggtcaggcccctcaaagtagtaaccagatccagaatatagtaatgcattacataaggggcttgcagatttcattaacaaagaccaacaagatcactcccaataactaagtttgctcattctggtattacccaatgtagcctctagcctattataaagcagtcctcggtaaaggctgagtatctatagcgctgaaataatatgattagatgtcaactcagatcatggtcttcactgagcaaaggcaaaaatatttctaatgcaatataaccttatttcattctatattattgcctctcagggacaggagggacagaagattgagcaaaagtttttgtaaaataattttttcacataggcgccttttagatttcattgacatcctctgctttctgccttcactttacatgtttttccaggaggcatacatgctataatgaaaacaagtgagaaatgtgaagtctttgctctgttgcttatgaggtgtgtatgaccaaaagaaagcctcttggtttttctgagcctttatttgctctaatgagaaacagggataataatccctgttatcgcagggttcttctgagactcaaatacaaaacgtgaaaacatttttggaaacacagaaatgagtttttgtgtgtgagggaaaatgatttaacattgattgaatatccaccaagtaccaggtacagcactaaattcttcatgtactaggtcttttcataaagtaaccctgtgatataggcattgtacccatctaagaggtgagaaaaggaagtgggagagatattgagtaacataactagggtcttaaagcttgctatttgtagagatagaattaaattcaattttgtctgtctccaaagacagtgatcagctcccagaaagtagaaattgttcttttggtagtacattgtttaaaaaagcaaggttttaatgtgagtcatccaaggtttgaattctaatgctaaaatcactcagtgttgctatgagtaagttgcttaaactctctctgaagttttattgtctcatctaaaaatggggaagaaaagtaactaacccctatatttttgtgaagatgtctagaaaaaaaatgcacatctagcaattaaaagtgttatttggcatacattatacattcaatacatgttagctactattgtttaaaaattactactttttaaatttgttagtaaccaattcagtaaattatctaggaatctcataactttttataatttactctgtgtattctaaagatgaggcagtttttattacatatgactgaccattgaccaaaaacaattaaaggctagctaagttagcttagatatataaaagaaataaatccaatcaggtacaaggtgagaagttatggttaaaataaaacagaattaataaggttaggtagacaaaaaagaatattgccaagttagactaaatgggcaatgcgcaaatcctaactatctcaactgacagtacgctaccttttgagttatcattaatgagtagtataatttacattatgtattataaacaatatggagtatatatcccctcattgaaaacatgaaaaagtcagtattaaagtcctaatctctaaatttatattctcccttaactgttttatataagcttattaaataaagcaaaaacacattagagcatgagtttttctcctcatgcaatgacctttatctccgtttgatttatatgcagaaaaacaaaagtaattccagctgacagatgacacaaagatcagagaggcacaagggttcatgtaaaaacaagtcaatttgttattaaatattggtagcacaaataattagctaattaggcaaagtttttctataaacctatttcttcatctgtaaaatggaactaatatcttcagtctcacacagttgttgtgtaggttagataagttaatacgaataaatttccagcctagctcctgtcatttagtagggaatcatcaaagtaggttatcttcaatagtttcttttaagtattttggaaaacaccccctctatttatcaaatgcttacaggttctaaactttgtcttaggtattggtgacacataatactgccctgcctttaaggatttcacagactacagtagctaatcatttcactaaattgacatcatgacggaatgactatagagtgtgatgaaaaataacatggccatattggttggaagtctaggcgaggttgggaaaaagtagaccaaggaaagctacagacaaaaagaaatgtcactgaagctggatttgcagaggcggcaggaatttggcagaaagacaagagaggaaatgattttccaggctcagagtaacgacatatgtggtaagttattctcacctcatgcctatagttaccagtggagagacttctccaggctaattctctggacctctttccccatccccagaagatgggagttttatgctaggtaagtttgaaaaatgggactaggaaagctcagctcacccctgcctcctgggagtcagcctgcctgctagagcctagcattcccttttcactgtaagatgaggttagctaggagaagctatgcttctgcaagagaaattgataatttgaagggtaaattgagttcaggggtatgttagcaagccctttggctgcctaccatagccaattcttccaagctagctttttatcagtagtagttctgatttttataagctatcagaatctggcacctatatcttatctgggtttgaccttaacataaaaaagactctattaagccttgtcaaacttgatagagaatgaaagtttagatgcgagaaattacatactatatccaaaaggtggtacttcttattttttcagaagaataaagtacttcagaagtgggaagggagataaattagatgtaaaggcaggggggtccaatccttggcttccctgggccacattggaagaagaagaattatcttgggccacacataaaatacaataaaactaacaatagctaatgagctaaaaaacaaaaaaaaattgcaaaaaatctcataatattttaagaaagtttacaaatatgtattgggcagacaggctgtaggttggacaagcttgatttaaggtttaaagttggtcagtgagtaagttataggggtttctctgtcacactaaggaatttggtctgtatctgaaagcagtgtggagccaatgaaggatcttaagcagaatgacaaggcagtgtgtgtgtgtgtcgggtgtgggggtgtggggcgggtggtgtgtgttggaagtattctggcagctttaggtggatagattttgtggtgcactggaggcaaaaagccagttaaaaggcagttctaatagtccaggcaagatctctgcaagtagatttagtcattgattcattttttatctcaacttttttttttagattccatgaaatataagacaaaaggtcatcacaccctacttttcaatcacaatttaaagatatcataggctgggcacggtggctcacgcctgtaatcccagcactttgggaggccaaggtggatggatcacctgagctcaggagttcaagaccagcctagccaacatggtgaaaccccatctctactaaaaatacaaaaattagccgtgcatagtggcaggcacctgtaatatcagctacttgggaggctgaggtaggagaattgctggaacctgggatgcggaggttgcagtgagccaagatcacaggccattgcactccagccttggtgaaaacagtgagactccgtctcaaaaaataaataaataaaaataaagatatcataaaggctcagatgggtaaaaacttcatataatgagagttccaataagaatgattctcttaaactaagccgttgctgaagtgaagagatgattatatggacaatctagaactcatcacaaatactcatacctaatttaaaaaacattgtctaaaaggcaagctaaatttccccaattatgcaataactagatattctacagaaaaaaacaaaatggggaggacatgaacctcctgtctaacgccatctttccttccctccctggaccacgcattgccaccaccagaaaaagagtctgcatgtaatagcagccatataacagactagggtataaaggttcatgaaagataatacagtacaccattcaccttgtaacactgtaacacaataggaggtaagttctagaagatacagagcaagactggaaattgcagctgttggcctaactctccatattctaacctaggtccttcttgctaaacaaccactctgtttttaatttattgagttgtatgagtttattatcttaaagttattaagtaatatcttaaagttattatgcataagtaaaaattaggaaattgagctagctttttaaagaacacctcttggccaggtgcagtggctcacacctgtaatcccagcactttgggaggccaaggcggtggatcatctgaggtcaggagtttgagaccagcctgaccaacatggtgaaaccccatctctactaaaaatacaaaaataagaagggtgtgttggcgcatgcctgtaatcccagctatcccagaggctgaggcagaagaatcgcttgaacctgggaggtgaaggttgcagtgagccgagatcgcggcactgcattccagcctgggtgacagtctgagactctgtctcaaaaaaaataaataaatgaaaatgaagaacatctcttgctctctataagagacaaaatttaggaatataacgccatattttttattcagcaataatttattaaggacttaatgaacgttatcttctgtgttaggtaggtcaccaatctgtcctttggatagaactgcggtagccacactgggctctgagcttggggtaagggtggagtatgcctaaattatatctagttgtcttccaaatttcaaaggaggtcaaaaatattttatttatttcagaatttgacacatttaccccaataaaatatgatgaagtctcaaaaggtaaaagaaacgttaaatagaactttcagaggtgtaagtgaattattttgaaaactatattgtttttacttcatcattaaacatattaaatttccagaaaacccatcagcaataattaatttctgagctgtataattacctaaataagtatagttctctgatcattttcatcaacgaatgcaggcttgcataaaattagtatgaaagcagtgactctttggactcagaacctgagctctgattacaaatcagttccttggtcatggtataaattaaggtaagttactttgcttctaaaagtctacttgtgcatctataaaatgaggataagatgacctatctccctatgttattttgggggttatgttaaaataatattaatagtatatgagaaatgcttaatagttggtagttgttagtataattataatagtaacataaagccatcacataaagcacatggcattatcaaatgccagggctataaaagaaactatgcatccaggctgccacttttttctttcttatgcatggctatactaattttcactgtattctcttctgggggtgccttgatgaagtctcatcattcttctgagcaccataatccagacaatcactaggaatcaatcggagctgacacagtgaaacatgaatcattttttaaatctacttgaacttcctcattttatagttgagatgtagacactaagattctgcgagttcactagggtgattcagggtccagagtagtacagatactagagtcctggtttctacttctgtgcctttcatttcaacacactcactcattttcttctgaattgtgaaattcaaacatgaattcacattgggggggtcagatcacttgatataatctgccactataatatttctgctgatctttgaattaaaccacgacccttgaaatacacagcttacagaactgaaacaagaatctgttcagaagactatgcactctgtcaaggcaactataatggtattctatcatacagtaattttagtgatgtgataatggatattatgccaagctactgccactctggataaagacatctcatgatgacaggacattttcagataatgacaaaatgtggtttatcaatttctacatcagtttagtcaattggtctggaaggtgcagagggaatatctgttcccagtggctgaaacgtattcccgaaaacacaacttgtttattactatcttaaaatcgaactgaaatttaaaggaggaaaaaattttagagcaatgtttggctttttttttcaaaattcctcttagaatttaattaaaataatcaatatcgactcttgaaataaaatacttagaatgaacaacagacacaggcctgtgatatgattttgttacttgaaacttaattgtgagaaacagacaggattccactgtaaatgttctcaatctcttaccctgtttctccttcacgtttggaggagttgttaatgaacccaatggatgtgttccagagatgtacttatgatttttttctctctttgagttggggtcttgcctgtaacctaagctggggtgcagtggtggtgcaatcacggctcactgcagcctcaaactcctgggctcaagggatgtgcctgcctcagcctctggagtagctggaactacaggtgtataccaccatgcctggctatgttattttactttttgtagagatggggtcccactatgttgctcaggctggtctccaactactggcctcaagcaagcctctcaccttaccctcctgagtcactgggattaccatgcccagctgtacttatgatttcatatttcaacttgagagagagagagaggaaataatatgctcaaaaaagctaaaatattttttcagtagggtgaattgatgatttccttctcagcattccccccaaattctttttagcaactttccaaaggaatctgggatatacatcatccactgtatttaaataagatattccaaatatctttcatgaaagtattagagaaagggtcaagacctaaagaggggggaaagggtcaatagcagatattgggtggggatgatctacagcctgtggtcagtatctgggggctttattaagatactctcccaatttccaacttaaaatgtggtaaattataattgacttcataagatcaatactcacccatgtgaggtaacctcaaagaatttgaaaaaaaaaaaacacctagacgagcatgattgattaatatattagcctgtctgaagaaaaattgaatcaatcagaagtttgggaggaggttaagggttaagaataaaagaaaagaacaagggtagtgagtgagagaggcaagtattgtctagaaatctaggaacttactagatgagaaggagtgtgaacattggagttcaaacattgctgcaattaaaattttctgaagatgttttgactccaggaagagatatataatacctgcaagttatttttggcttcctttatttttcttatcttctcactgtcatattctgcctcaggaatccacactatttaatccatcctttttgctctacatacaaaatatatcctcagtctctacaatagatccccatccccattgctgctacctgagtccagccatcattatctctcggttacaagtactgcaaaatatcattctaactagtctccctccttccattcttgcccctcccctcaaactcattctcactgtatacaatacatcatctcatgtctttgtttaaaggagtccaatggctttttgttgaactttgagtaaaatgccgacttccttccatgcccccagtctacctgacccagccttacctaaccctccaaactctattctcagccttcttcttgacactttctcttgtccacactagccttcttctattataataacttgtcaaactttttccaaccctgaggtccttgcgtatgctagtcttttatctgtaacaccacccaagaattgtcataaggttgcccccttttcacctttcatctctcaagtaggaactcaattgcctcctcattaatactttccttactttaatgtctatctaaagaagcacctctccaacctatcctccatatcacattaccataatttaatttgtaatagcacacccctgtctgaagtaatcttatttgtctacttgttaactttcatatttctctactacaatgcctgttgtatttattgctatgttttcaagttcctagaacagggattcttggttatactatctattatcaatatatgtttgcaaatgaataaacaaatgaattttatgaacatgggcgtttccattcatgtgaaaattatatgtttcatgcaaatcaatgacttttgcataccttgatataaggtatattttaactagtctgagtcagtttcttggcctcaaatctccctggacacttagaatgattgtctgggctttcaaaaggacagaatgtgaagttcagagacccaatcacagtgttacctaaagaagccccttgcgaccccgccttgccaaatataacactgttccacctctaccaatttttaaagataccaccctttcaatcactcataaacattttcaggtcctatcctggcaataaagttacagaaataaataaggtatactttgttttctcacaaagcttctaatacgatagttgaaacagacctgtaagtaactacaatgctaagtgtaaagtgggcatattttccacattttgtgggagcacagagaaatgaagccctcaaataagataacattagaaatgatccttgaatgatgagaaagattttatccaacacagaaatagagtcattacagagagagagagagaaaagcatgagcaaagatttggctggagactgcatggtggcttcagggaatcagagaacagtgaatagttgggtgtgaccagaacacaacagtagtggttggagatggagcgggaaatacagattggggccaaattgaagacaaccttgaatgctttgctagggaatccagttttattttgtaaactagtggttggcaatctgttttctatgagatgttcataaataaacgttcacgaaaaagggatttcattatcacacacatttaagaaacgttccacatattttaccagtctcttggagatataagcccccaagagctttgaaaaatcctaggataaaaaatagagaactgcttaaaacatgtttaatccaacatagaccactcattaacatttccaaagatacgtaagtgtaagtcagattacacttaaagtgaagccttctttaaatgatttgaagttgttaaatcatttaaatcagtaagtgatacaaatagaactgagtgttaagataaatttggcagcaatattcataatggattgaagagatctaggaggctacaggttattgcaaacagtttatgggaatgataacacaccaaaactcaagcacggagagcagaaatgtaaaaagggaaaatatttgaaacactctggatataattctatatcaattagtgattgattaattcatgagggccctaggaatagaaatgtaatggatctggtgatgacttcctgatttctgacttggcacactaagtgaattgtaaaacaggtttgagtgcaatgaagagcaagaaagaagaagaatgatgaaaatagactgaaggctctgagtgaactgcaaagagtggtagggatcttaaagtcaattgttatacttgcgtttgatttagttattggaaaaacgagtccatagggaactcccaattatgttgggttgttttgtaaactcaaaagaatctctttcctcaacgtacttacagtcttcaacctatttaactgttatcattccattcagtccttcgaaaataatgtttcttctactagaaaccagactgctgtcatgctgcaggtatgttgttttcacttttccttggaacaaccagaaggtgcccagctttgatgagaagagtcaagagagttgttgcatctgtaagttttattctaaatattagaatcagcagtataagaacaacgtgtttgtaacagataaaatgttatacaatcaaaaccatataatggttttgattttgggtggaggctgcctacattttaagacatgtagactcaaacttatctttaaatgtctatattcaaatttcataaaattcctatccctatgtaaacatactaaaataggaaatttccaggatatttccctttcccatctgatcagtcacattgtttttcctcttcaagctctcttactgtcaatttaatgtccatattgcactcttctgcaaactgtctacagatagaggcagatagcctgtctacttctgtctgttgcatgaactattttttcatatgtcactcaatttaatcttgctcacttatatcagggtgaaaaaaaaagaacattcagctcttttccttccagagaacagacacaaggaaaggggtttcagtgacaagaaagacaggtgcatagatcactcatgacgatggttaagaagaccctgctatatttaggataggtggaaatttatcttactaggaattttaaatgggaactactttcctatttgtatttatttccttaattccttcctactttccttccttccttccttcattccttccttccagtcaaaaaattaagcatgttttaaattgccaactgggcatagtaatctattgtggcaggtattatagaagacatcataagagcttcgtaatagaatacagtcataggaaaggtactcattttaattaccaaataaaagcaaattactatagcaatgttcttcaatttttaacctatcaaattaataaaggattttacaaagataaaaacatcaagagtacaggcagaaagacatgttcatacactcttcaaatgggggaatcataaattggtaaagcaaatagttttagaagcaatttggcaattaactctaagctccatgggccaataatcagtctctcttattttccagtatatccccatttattaacctagtgttttgtcttgtgttaactgtttaataatgaattgctgaatgagtattgactgaatgactatgtaaatattatgaaccttaaaaaattcacaccctttgactcaacaattggtctttttctaaaaatatatcctcacgagaagtgtagtcaaaagttctagtacaccaaggtttacttcactattgtttatattaacttaaagaaaggtaacctacatgcccaacattatgggttttggtagaaaaagaatatttggcagtcattaaaaaagatgtcaacaagcagccaacaaacatgaaaaaagctcatcatcactggtcattagagaagtgcaaatcaaaaccacaatgagataccatctcatgccagatagaatggcgatcattaaagtcaggaaacaggccagtgcggtggctcacgcctgtaatcccagcactttgggaggccgaggtgggtggatcacgaagtcaggagatcgagaccatcctggctaacatggtgaagccccatctctactaaaaatacaaaaaaaaattagccaggcctggtggcggcgcctatagtcccagctactcgggaggctgaggcaggagaagggtgtgaacccgggaggtggagcttgcagtaagccgagatcatgccactgcactccagcctgggtgacaggcgagactcaaaaaaaaaaaaaaaaaaaaaaaaagtcaagaaacgacagatgctggagaggatgtggagaaataggaacacttttacactgttttacactgttggtgggaatgaaaattagtacaaccattttggaagacagcatggcaattcctcaaggatctagaaccagaaataccatttgacccagcaatcccattactgggtatatacccaaaggattatagatcattctactataaagatacatgtacacatatgtttattgcaacactattcacagtagcaaagacttggaaccaacccaaatgcccgtcaataatagactggataaagaaaatgtgacacgcatacaccagggaatactatgcagccataaaaaaggatgagttcacatcctttgcagggacatggatgaagctggaaaccatcactctcagcaaactaacacaggaacagaaaaccaaacgccacatgttctcactcataagtgggagctgaacaatgagaacacatggacacagggaggggaacatcgcacactgaggcctgctggggttgaggggctaggggagggatagcattaagagaaatacctaatgtagatgatgggttgatgggtgcagcaaaccaccatggcacgcgtatacctatgtaacaaacctgcatgttctgcacatgtatcccagaagtataattttaaaaaatgatgtcaacaagaaaaatatttttctaacttagaaaaatgttcacaatatgatgttaatttttaaaaaacattgcaacatgatgctaatttttaaaaagaagttatattcttaacttctcacttaacagacatatataaatgagactcaagtttagctagatctgtgagcacgtgtcaataaaatttgtatctttcactgaagatacatatacagagacagataaaaggactaaaaagttgttactacattaactgtagttaactctaggtggaattacaggtgacttttaattttttaaaaataattaattcatactattttttaccataagcttgtattatatttaaactaaataatacaaattgttttttaagtagctaaaatattcagttttaaactaaaaggatttatgattaactactagtttttattttattaaaaaataaaacgtgggccaggcatggtggctcatgcttgaaatctcagcactttgggagaccgaggaaggtggatcacttgaggtcaggagttctaaaccagcttggccaacgtggtcaaaacgtgtctctacaccaaaaacaaaaaaaaatacacacacagacagacacacacacacacactagcctgccatggtggcgtgtgcctgtagttccaggtactcacaaggctgaggcaggagaaatgcttgaacctgggagggcagagctgagattgcaccactgcacttcagcctgggtgacagagtgagactctgtctcaaaaaataaaataaaataaaacaaaacttgaagttggaaacatatttttaaaaattgtaattaagtatgataacaggtattatagagattgagtaaaatagattagagaaatgaaaaatcagtgtgtaaacataatcaactttagagctagtatataaactgagctttggacaatgaatgtcatggataactaactataataaccataactgtaacagtcaatgttgactgctaactgaatagtgcagcctgtcagaataaaatgcaaatgtgttcaatcatagattttttatgcaatggtggtaactactgtactccaagcacttatatttaatgatgaaaatgatgaagaaaaaggtcatgtagtctacaacagagtatacagaaactaattataaaatgtatttcgtgacattatttcaaccttacagagaacaactgactcctaagttaaactatgatactgtgtaagatcaaaatttttgtccgatttcctctcaaactatagtactctacctttcatcactgaaatagtatgacccacttgaatatggaatctaatttctaaccaatgattccaatatttcaatagcaccacagaattgaataagaatctgagttaaactaaaaacaaaacaaataaacaaaggaaacaaaacagtaaatctgtgtaaacttaaaataatatgcttgttattaagttgagctactgtgggaatagaaggtgtcattcttgatcttaagacacctgcataatcagtaataataataaattcaaactgattgagtgcctttatatacaaggccctgtattaatatacattcagaaatcaagaacactttattaacttactgttacgtgctaagcactagggaaacaggtaaataagacaggtcatgctctaaggaaattcaggttaatggcgcagaaacatattgaaaagtatcaatacttatccatactatggtaaaaagtgataaattgtgcaggttatcctgcaagacatacaggtattgaacacatagttcctcttctctacagtcataaatgcagataagtcttggccccaaatcataatttaataatgatgctacatgaattgtcacaaagaggccacaagattgaacagctatgctactgtgagttaggctacattctgggaatacgaggaatctcacactctctaatcagggagactgagaaggaaactaaccgcgatgtaaggcaatactctaattttgcaggatcgcatgttaaatagcaactttgagagctcaaatgaaaggattaaagaggaagatgtgcttaatccagactttttaaaaaatggataggctttgttgggcagaaagggacattccatcaggtgggaaatggaaagccgataacctagcacagaggtcagcaaacttgtttctttaacgggttggataataaatatttttctgactttctagccttacagtttctatcacaactattcaactctgccattgcagcacaaaaacagctacagacaatatgtaaacaaataagcatggctgtgttctaataaaatttatttatagatagcataattggaattactcatgattttcatgtctgaaatattattcttttgattttcttcaatattaaaaataattcttagctctggagctacacaaaacgaagtatcaggctggatttggcctgtggctgtagtttggtgactcctggactagttggaaggcaagctaaacacacagatataatggtatacaaaacaatattgaatatctcaacaaatggttccattctatcagattcaacctttccatttgataatgttttgtaatgtcctccttttttcatctgaaataaaattcatagatgatacaactgactacacatattttttaaaatgtagtgcctttaccaaagtaaaagaagaaataaaaaaaaagtagtttatattaaaatagtgtgttgaaaacatagtgcaggttatcctgcaagacatataggcattgaacacatagttcctgttctccacagccataatgcagataagtcttggcacaaaaacataatttaataatgatgctacaaaaatgaaaatatggcagtctgtgagtcctactatgccagacaatgtaatgagatagtgaaatgcctgcatatatttataaagaataaatttggatttaaatggaataaaaagaccagataccatattttacaaagggtacaggaaaataaaacagcagatatacaataaattctaggttaaaaattagtgttagaaaaagtaatagcagaccatttgtatttgataaaacgtcagaggaaataactttagtagctgaaatacagataatttaacaaggaaaattgcagatggtaggagtaagttaaaaatgtgtcattcttgcagataaactgggtcttactgatatgtttaatgtcaaaatagggcatgccagtaagagagtcatctagctagttatctgtctatctatctatttatctacctacctacctacctattcctgtttggaattccttctcatgagaaggcatatatttgatttctagcactctaaaattctatcctttgataggtaatgaggaatgatagatataaactctgaaacctaagggcttatggggaagtggagttttgatacaagttgagtttgagatttgacacaatatcagaataatattgaaaaaacagaaaactctaaaacagagttttattatctgacttgatgatgtcaagtaatttgcacaaatagatttcttattatgctttaaagtgctttaaagattaatgtatggtatggcaatcaaataaaatattttaaaaacaactttattaatgaaatttggtgagatccctgtattttatgtttctatcaagttaaaatatttgattctagatcttgtgaccaacatcactccttttctgttcactagggactaaggttaatgataatgttttgtatattttaaagtagttaaaataatagatttcacacgtttttttcacatgaccacaaagaaataatagatgttggagatgactgacatgttaattactctgatttaattatttcacaatgtatacatgcattgaaacatcacatagggccccataaatatataaattattatttgtcaattaaaaataaaataaaacttgaaccaaaaaattaaaatatttggttccaaatctattaacaggagtctcaaatctctttacttgcatatttgcagatgaaatctatacacatagattgatgcaggagaggtgtgtcaatactaaaatcagcattatgttttaaggatatggtcttccaaaatggggaacaactgacaaaattgctaacagaacaaagtgtaatggtcccttgattttcgcggagttatagtcccagaaaatgtaataatcattgaatccttgcaaaaatacttgtttgtaaaattgagtttgattttaggcttagataataataaacttttttcgttaatattcatgactgtctagtggaacgctaaaaattgtgcagtacatggggcaattatttgtggggcaagaccactctgcacagggtgtctagcatccctgaccctcttcccctaaatcccagtatcacttccaatctttaacaacacttaagtacctctctgctcttctgaagtgctttctcaccagtcagaatggctattgaaaagtcaaaaaataacagatgttggcgagcttgttgagaaaaaggaatgtttatacacttcagtgagagtgcaaattagttcagccactttggaaaacagattggaaatttctcaaagaacttaaaaaagaactaccattcaacccaacaaacccattactgagtatatacccgaaggaatataaattataaattattctactataaacacacatgcacgtgtatgttctttgcagcacttttcacaatagcaaagacatggaatcaacctaggtgtccaccaacggtagaatggataaagaaaatgtgtacattgataacatggaacactatgcagccataaaacagaatgaaattatgtcctttgcagcaacatagatgcagctggaggtcattatcctaagcaaattaacacaggaacagaaaatgaaatatcgcacgtcgtcacttataaatgggagctaaatattgagtactcatgaacacaaaggggaacaatagacaccaggacttacttgagggtggatggtgagaagaaggtgaggactgaaaaaccacctattgaatattatattactgtgtccagaactggtgtgttcttggtctcactgacttcaagaatgaagccgcaggccaaggcgggtggatcacgaagtcaggagatccagaccatcctggctaacacggtgaaaccctgtctctactaaaactacaaaaaattagccgggcgcagtgaagggcgcctgtagtcccagctactcagggccctgaggcaggagaatggcgtgaacccgggaagcagaccttgcagtgagccgagatcgcgccactgcagtccggcctgggtgaaagagcgagacgcagtctcaaaaaaaaaaaaaaaaaaaaagaagccgcggaccctcgcggtgagtgttacagttcttaaaggcggcgtgtctggagtttgttccttctgatgttcggaggtgtctggagtttcttccttctggtggggttcgtggtctcgctgactcaggagtgaagctgcggaccttcgcggtgagtgttacagctcttaaggcggcgcgtctggagttgttcgttcctcccggtggattcgtagtcttcctggcttcaggagtgaagttgcagacttctgcggtgagtgttacagctcacaaaggcagtgtggacccaaagagtgagcagcagcaagatttattgcaaagagcgaaagaacaaagcccccacaacgcagaagtagaccccagcaggttgccactgctggctctgggagcagcctgcttttattctcttatctggccccacccacatcctgctgattggttcattttacagagagccgagtggtctgttttgacagggggctgattggtgcgtttacaatccctgagctagacacaaaggttctccaggtccccactagattagctagatacagagtgtggacacaaaggttctccaagtccccaccagagtagctagatacagagtgtcgattggtgcattcacaatccctgagctagacacagggtgctgactggtgtttacaaagcttgagctagatacatagtgcccattggtgtatttacaatcccttagctagacataaaggttctccaagtccccaccagagtcaggagcccagctggcttcacccagtggatcccgcacgggggccacaggtggagctgcctgccagtcccccgccgtgcgcccgcactcctcagcccttgggcggtcaatgggactgggtgccgtggagcagggggcggcgctggtaggggaggctccggccgcacaggagctcacggagtgggggaggctcaggcatggtcccgagccctgccccgcggggaggcagctaaggcccgtgagaaatcgagcgcagcgccggtgggccggcactgctgggggacccagtacaccctccgcagccactggcccgggtgctaagcccgtcattgcccgggccggcagggccagctggccactccgagtgctgggcctgcagagcccacgctcacccggaactcacgctggcccacaagcatggcgcgcagccccagttcccgcccgcgcctctccctccacacctctctgcaagctgagggagccggctccggccttggccagcccagaaagcggctcccacagtgcagcggcgggctgaagggctcctcaagtgccgccaaagtgggtgcccaggcagaggaggcaccgagagcaagcaagggctgcgaggactgccagcacgctgtcacctctcattactaccaggttaatgaagtaatttgtacaccaaaccccaggaacatacaatttactcatgtaacaaacctgcacatgcaccccccgagcctaaaatcaaagttggaagaaaaacattaaaaaataatttctaggggctctcctctctccgtctgtccttgggaatcactggtctaaattctgagtaaaaaaacaggtttatgtaactttttgtataatgtccaacagttaattatcaataaattgcatgcctcataattatctgacaataatgactctacatatgagcacagaagggctaggagagggagggcaacttataacaataaaaggaaaacttaattccgagtttaaggacatggaccaattctgccacaaactgaaatgaccctgagcaattctcttaacttttctagggtacagtttctcctttggaacatgtactaggtgactactaagattccatacagttctgatataattacaaaacatctagattcctttagaaaaccaaaagaatggaacaaagtagagaatgaatgagaataaaaccaggtgaggctacacttgtaagagatcaaataatatcagaaaaagaggatagaccatgaagaaggtggtatcaaacagagatttgattcttggcatgatggatacatagggagatagaacgtttgtatgagattcacactcagcaatgtgagatgatgctcttgtactaaagacagtgtctctctgcacttttattttgtatttatattaaatttacaataggtggttcccaaataccacaaatgttgcaaacttgaattcaatttacaagttacacagcaagtatcttattctggtgttaagtgctgtgggaatcaactccagctgcttcagatctacatagttcttaaccataataaaggagggaagcgatcttcagagacccaactcactcagggttcctgagaccagaaaataaagtaggctaagggaatccaggattctgcaggggaatgccagtactcccaaccatgtagaacatcccaatgcattaaggaaatttctgttaaattagagatttatagaggtctccttagggtattttacctcccagcatacttcaaaaggtcttatttttgcaagacgcggtggagagaataaggaagtcatacacacctgcatgtgaaatgcatgctacccttatcagtggtgtgatcataagcattactcttaggttccatttacatcttcaaaatggagataacaacatcactctgttagtgttattgggaaaattgaaggaaatgactaatgtcatttcctagcacagtgtctcacacattgtgaacatggtgattatgcaataaatattgtcatttttgttcttttctttcccattctgtgtgcttggcctctccttgccctatcccagagagaatgctctgcttatgtcagcatccagcaataagagtgctaggagtgttgaccaaacggcttcacatctgccacaggaatacttacaattttaattccttctgtgttatcacttgctctcttctgtttcccttacctgggggacagctgctatttcccagagacaagaaagtcttattcttccttggtaaggggctgcctttctaagaggagtaagtcaaagcaggtgctgagttaaaacaagctgtcagatcattctggctgagcataaactgagcctaagatttcatcctagggcaaccctacttcttggactaaaaagtcctccgcactcaagttgctgcaaactgctggttctggagttgctgcaaaggaactatgaggggagatttacagagcttggctaaatatttcgaacacagttgttcttgcagaattttgctgaggaaatctttcagcatttccttacctctaaatacaagcttatgggaatgctacttcatcaacacaattctattttacatgatttttttttctagcatgcacagttgtaaattgctgagaaccttgaaggacataatgtcacctcagtatcagcatcatgtggtactatgccaaaagtttctggacagttgcctagcctagccttcatcattataaggaagacatcaaaaaattcagtggaaaatccataaattctaatgaaagagcacaatatgaatgatgaatttcctggacagtaagttcttcaggataaaaaacatactttagatatcattaacaataataaataccatttactgagtaattgtgttctaagtgccatactggggtttttatataccgtattttcaattcttataacatttccctgcaacatgaatttattatcccaagttttacagaggagaaaaatgaggcttagagaggttaagcaaataacatcacacagagctagtaaattcaaatttgagattgtctggcttttaagcataaaacatttccaaagtgcttcccaataattaataagtgtcagttgacacagtcacatactattagtactggatgagatttgggtgttcatctagaaaaccagctgtcttacaaacagagaaactgaggctcaaagggttaactgatgatgaagcataacacataaagagtggcagagcaggcactcaaactttatgaagtcctcatcaaggtccacccggctatctctgaccaggccccaccctcctctccaggcatctcttttaatgaaccttctctcacagggctcaatgttccgggcaaatagaactgtgtgcacaggcaccaaggtgttacatgcttttctgtatttttcatttctgctcaaaaatttctctctttttatctgcttaacaaacacgtacaacatttttaattcaatttaattccgtcaaagtatcactacctctatgaagccctcactgattcatttctcttctcttcccaatcaaaaaatgtattaagaaatagattagtaatagccaatgtttactcattcatttattccttaaatattaattgagcatctaccatatgaaagcactatgctaacattttgttaatcattcatcaccacaactctctgaggtaggtgttatttatatcctcattttataaaacagaaaatcttggctgggcgcagtggctcacacttgtaatcccaacactttgggaggctgaggcgggcagatcacaggtcaggagtttgagaccagactggccaatatggtgaaaccccatctctaataaaaatacacacaaaaaaagaaagtagccaggcctggtggcgcgtgcctgtagtcccaactactcaggagaccgaggcaggagaattgcttgaacgtggacggcagaggttgaagtgaaatgaggtggcaccatggcattccaggaccagtgcgagactgcatctcaaaacacacaaacaaacgaacaaaacaaaacaaaaaacccagaaaatcttaaaagtttaaagagatgcagtatttttttccaagtatttcaattttttaacttctctgtggttcctctgtattctgaatatgcattcattgtggttatctgcagcactctctgaaattttgcttcgcttctaagttgtgacttacgatgatataattatttgtatatcatggtatacatggcatatcatttgctaaattttataggccattataggctgtaagctccacagtagtaggagagatatctactttctttacaattttattttttattttttattattattagtagtagtattattttcaagatggagtcttgctctgtcaccaggctgaagtgcaatggtgcaatctcggctcactgtaacctccacctcctgggttcaagagattctcctgcctcagcctccccagtagctgggactacaggtgcccgccaccacgcccggccaatttttttgtatttttagtagagacggggcttcaccatgttggccaagatggtctcaatctcttgacctcctgatccacccgcctcagctcccaaagtgctgggattacaggcgtgagtcactgcacctggccaatttttttcttttttttcttttttgagaccaagtctcactctgtagctcagactggagtgcagtgtcaccactttgactcactgcaacctccacttcctaagttcaagcaattctcgtgcctcagcctcctgagtagctgggactatggtgtgcaccactacgccgggctaatttttgtatttttagtagggacagggtttcactatgttggccaggctggtcttgaacttctggcctctagtgatccacctgcctctgcctcccaagtgctgggattacaggcgtgagtcaccacactcagcctgtttactataatattatacacacaaggcctgacagaatagtacatagtaggcattcagtacatgatagtcaaagaaagaaagaaagaaagagagagagagacagagagagagaggaagaaaggaaggaaggaagggagggagggagggaggagagagagagagagagaaaggaaggaaggaaggagggaaggaaagaaggaaaaagaaaaagaaaggaaagagagaaaaagaaagaaagaaagaaagaaagaaagaaagaaagaaagaaagaaaaagaaagaggatacgaaaggaaaggaagaaagaaagacaaatgcacaaaactctggtctctgagtctccactgttctgtgctgcttccctagattagtctgcactgggaagaaatgccacataaacaatgatggacatgtttcttcccaaggctgacactaacatcctagatgtacattttggaacgcacttttgggcactataattttctatttccttacctatgattatggttatattaattctacagatccaaatggaatgaaaacttatttgagagggacagaagctgattttcagacctgctgaggaacaacataatgacagagtcctgttagtacacagtaccccaaataacaggagtttggaaaagagccttaggaggaactcaagtcattactatggccctctgttatagcagctggaaatcacactgctgagttccacgtaatactgcaaatatctccgagggcaagatccaagctcccagatgcttaacaactctctggcacattctgtaccacatgtgagtccctgaactattttaaaacatgcactattcttctttacgctttatcaaggattctaatgtttagtatcattagcctccagctttaggttttacaatatttcacaggatattcccagttaatttaaggggtaaaaagtagtatcatgaaattctcaaaacagccttagttttagtggacacatgaatacatataggtacacacatgctcttatttttgtgataatatacgtaagtgtatagtactaacacatctctatataatttagatattagatgtatgctatggatgcatatataaatggaaacagatctataaatatacatatatcagtagttttgaggacctactagaagtaaaggaaataaaatttacatgaaaaaatactttatatggatagaatgcagcattctttggaagaacaagctgatatactctaggacagaaaaattgaaataatatagaactctaatttttatatgtgtgcatatatatgcatatatatacttaaatatacataaaatatgttaatatacataagtagttaggtatagtgagacatttgaatacatatattaaagtctgtgtgtatgtatgtgtagagacaattgaaattatttaacataatgtatttgaaagttttcaagcattggtgaagatggattaatcaatttagcatagcacttttataggactgaaatggtaaagggtggaaggttctggtaagtgaaaagtgttaaaacattgaaaatcctaaaagatatggtttcatagctccagtatttgtggatcactattagtcccagccaataatacagtacatgtgaatgggagggaaaatgtatagaaatgcttatgcaaaagaataaggagagatggtggctacctcaatttgttgccttcttatatgtcactggatctctaattatcagtatacggtctatttcaatccttgaaagcattaaatggctgtaagtttcagacaagtaggaggcattgttaaaaactaaggaaataaaagtttccctcagttgatgaaaaaatatgaatatttttagagtttgcttattataacctagtattagagatttgggtttgggaaattaccatttacgaaataaaaagtatgttacatcttggattaaaataattgcaacaataaagcaagtttgctttctctgctctgtgcaacaaccataagctagatgctattaagtaggcttgcttcctagcctatgtgagccttgagaatttaatgtaatcaatacagagatataagctaaagacatttaaatgaatgtatttgttaaagagtatatacagtgttcacaactgttaagactttttattcagtttggaattcatgttaactttaaataataactgcatttctaaatgtcaacttctattttaagccaaaccagtttaataataaaatggtaatgtattttttatttaaatcaggaggctgagatgctctatctctctaagcaaagcttataattccatgcaaatcaatcaaaggccatatatatggctatgcatatgtaactatattattaagaccagtgataaatgacattcttggaagtactttttaaaaactattattaaaattaaaatattctctgcacctgtcaccataacattttatttatgatcaatatctacttctccactatgctaaaatcatattaaaattgagattgaatttttctgcaaatacagcttttcttcaatacatattaaacagtcattgttctgtatgacagtgactacaggtgtattttatttatattttacagcatttgcaggaagttattttctctcctttaaatgaagagagaaaaaaatgagccaattttatttctgataaaatgatagtagtctgggggctagaataacctaggaatcaaattaaaggtatctgcacatctgctttagaaatgcgttatagaagaaagagagctatagatgttgatataaacttattgcttctccatgaataaattaagtgcttaattcttttattctgagtttaaccatcctctgttttgctcataattattccttttctttgtaaaattaattatttagtgtaaataattgttcttctccataactgaaaaggcatacagtattataagagtaaaattagaatagcatacttcaaatcactgttttctatagctaaagaaacaaatgttcttttgcctttaaagagatggaaagtttagttaaaatttattttttctctgctctttaaaaaaataataataaacaggcaggacagaacaaaagttaaaaatgattagaagtaaaagggctgctaaaagactatgataaaaaataatataacctgaggactagagaagttgaagaaaagtcagtgaaataaactgagcacggcatccctagactttcacaggccaccagaggtatgagcccacaaacatgtgtgaaaatgacaggtttttcttggcctaatattttacatacaggcatacccgtggtactctgcaaagtttccaagccattctaaccttaaacaacttgctctcactttcttcagacactcaagggaaagtcataaggaaaaggctcacctgtgctgggctgaaccaaccatgtgggcaggtacaatgctccccacaagtccctttgcccttggtgctcgtcttgtgggggcttttccgcacactgtcccacaaggtcctgttgaagctggaccccccggtcctgtttgaagctgggccccctggtcctgaggagggcatggtctgagaactgtacccgagcccctgacagttcctctgccagccacaagcacagtgggcatccctgatcagggtgggcgcactcctgacggcatccatcccatcggacccccggctgcagctgtgttgcttggtgaggtatgcattcatactgcactgatgcctactctttcctttggtcagctctgcacagaaatgtctcctccctcacacccctttcttccagccagttgtaaaagtcttttttccaccgtggattcctcagtatctttgacagctgctataagcagtgcatcgtgggagcagtgggagcagcgacagcagctccgcacagcattatctgcgggctggtagctctttgtcaatagatgactcaactcacagagcaacttgacagtatccctgctctaggcagaagcaatcaatgctccacacagctgggctacaagactgtacactgtgttacaaaccctttttggatggagccctacagtaaagaataactctttgctgtttggcattccggcttttccctttccttgccgatccccacacaaaatacaaaccttaagaaagagaacttattatgagattcttatgagattagtaggacccttctttccagaaaggatgcatctaggcttaaactttatagcataagcaataaaaaatgatgggaaagttaacctgtaaaggaattttcaacatttataagaatcacttatctagagagagatttgccaagacacagacccagtcatgaagtaactatataagatcatcaatattaactctgaagaacataaattcatttggaaaaatcattgaggtcacaccattatactagagtctcttaaaatttggaagtttgttttaaatcacgattatgcattttagtccaaacatatattctttatgctatacacgattattaattctttcttattcaaagcaaggcagttttcaaggtttaaaactgatgggttgggcttattttaaaacagtatttttccttaccccaaattattctgagggtttcctttcaaatactttaccataacaaatacattcaccacaaatagagtctgcgttttaaagtgaaagatgcatccaactctgccatacagtattttggtttccaaagacagaattttcaaattctttcactgaaaaatgagctaattttttctaacttaaagcaattgccttccaaagaggatttttgtgttaaattttagcatgcttgctgaatccatacatagtattttcagtgaagtgaaaggctaattgccataacattaataatttttattctgtttgaaactttccacatccatttccaaaatgtctatccttatcacacattactaaggaaataattttggtttaagtgtgcagccagttaccatccatgcagtacctaacaaagattatataatcctatgaaataattactttatctgtagaccatcagatgccatcaaatctaccttctcagtggattgaccaggtgctggggcagtataggcctgatttttgcctgagctggcaaggtgcttattgcaagggctgagatcatagcaagttctacatttgaacactaagactccctggataaatcactgttagacttaaaaatcttgaaagtaaggagtaggatcttctttgtccatgtatctccatataagggtacttttccaaattctgcacaaggggctgatattagcattgtgcccatcacagaaggtattcaaaacacgtttgttcaataataatggccagatatgtaagtttagagggcaggttctggtctatgttaatggccatttttctctaagcacctttcacaccgtccaccacaaaacaggcagtaaatacatacatatgtttgacggatgaatggatggttgggtggaagtataaatggaaggaaaaaatagagaaatgaaggagttgatacacatttttaaaataataatatttaattcagcaatgttctagaaacataaactattcctttaaagttaaatttagttctggtgttgaggtattcttgttaaggaaatttgtcaaaaatatatgaaacttgaactgttgggcagaaataacaaaggcattaatagtttttgccttcttaaagaagatcaagaagttaaaatcaatacctgaagacagtgacgaaaagggagaaaattatttctctctctctctctttccctccctcccccctttttattttagatcaatagattatacctgaaagaactgttgggtcgaagaaaaccctagagaactttaggcttttctggtataaccatgatgcatggctgtacagtaggatttgatgcaatatgccaatgccatcactctcaaatgagaatgtcggaaagtgataagtttggctgtctccaatcttatctaaccatagatgcttctctagttttttaggcagatatcattgcacaagggcccattggcatcttcagggaacacatgtccggttctcatccatttgcctctcaagtataagaatcaatctacatagacataagtcagtgtgcatccatcacaactttgtaatggtgtgtgcagcttgcagcaaggcagaaacaattttctggcttgacactactcaagatattacaaatcttcacagagacttaaatctgttatgaatgggttgttcagaatgcgcaatttcttcccatcacaagggccacagaatttctattttaataacttagcatgtcatttctttatagttaaatagcatccattgtataactaatgttattttgcttaaaagatctttaaggctaaagcaaacttttattaagcttactaaaagactatattgaaatcactccttcagtttagtacatgtaaagtaattccatactcctatctttccctccccacaaacaagacttttcttttcaaacatgacatttggctttctgaggacagcccacttaaacagataaatatgttcaactagccctctgtactataagacagactcactaattaatggtaatccaatttgatcaactataattggacaattgtaatgaccatgagatgacatgaaattctggccaaacaagaattagcgatgcacaagtacacatcctacttatcactgtgatttaacatgggcagatggtgcacagagcaatgcctagatgagatataacttattgaactctctttgacctggcactggcttcatagaacaatcactagtttcaaagcaagcgtttaagactaatatcctagcttgatttaataaaaaatagcaaaaatggataaatatattgtactgcactaaaacttgatacagaatctttttccagataaaattatgcatatgggaaatgaaaatattaataataaaaggagagctaagtgattgctaaagagtgactggtgacagacatccttatcagccacaagtaatacgccaaataatcataaaatgctttgaaaagtgtgtacagtctattcctatgattgcaaaaactagagatttataaatgctaagaaatccgcattcttttacatctaataacctttggcctagataatctccagatccaagcacatttccttcaaaataagaaagccaggaatacgtaaagtattttaggctctaaaattatttccaaaatatttaaactaatttagtcataacttttgtgagacaaaaacaagcaggaatttagtgtggaagaaaacatgcttaattgatgcaaagatttaaccaaaacagaggatttaatagaaggtagaaaaaacttttaaaatgtcccgaattgtaactagcatagttggatttgggtgagtgttgatggggaaggggttaatctgaattaattacaagtctaaattataaaattgtattcaggaaatgtaaatgtattatattctaaggtacttagtatcacaaatacagaaatcagaacattaattatgtaatatttcttaaagattctgaaagaaacactagtaaaaaggtaataatcacttaaaatttgcatatttttgcaattgaatctaagtgctaaactatacttctaccagaaatttgttctcatccttcaagattaaactaatgtcacttctgtaagcttttcagatccccttggcaaattaagtcatgctctacagtatttgtatacttgtctgtgtaaatatctttaacatttatctatttctttcaatcaccatgatgaccactgtgatgtctaacccagcatcatttctgtgtagaactggtgaaacagctttctaactggtctctcgcatacacccttgctctaattctctctcacacagcacccagagtaattcctaaaatgcaattatgatcaggtcctttatgcttgatacctgtcagttaaacgtcattttctgggactctttatcctcattgatactataatctttaaagtagtttggatggtctttaatcatgacccatgtgatctggcctctgtggctttttaccagtcttgtctgtgcctcacactcttgctctgtcctccaaccatacaggccttgaatacttgagctcaatcctaccttgtggccatggaggatgttcttttccccacttcatactttcacataattaattcctactcacccttctgtaggctgcatcaagaggcaactcccccaaagccaccgtaaataaacatacagtataatctaaaaagaagtgggattactatgcaacacagctccaaaataaagcttctagtctttacttccaaccagattgccatccagatctcttttactcagaaattctggtgtcttccctgtcctttggagttcaacttgcatatcatcacctcctcaagaaagcattccctgaataccgggtcaccttctaagatagctcatgtcatctttccattaaacactcatttagcacctgtgcttctctattacaacacttaacaaaattgtatttaaaacaagaattacactataacttagtttgtacccttttccccaaacagaaagtaagtggttgctagtagggcaatgaaagagctctcttatttgcaactgcatcctttgaactcagcacaaagtgtttaaccctaattgaaataaatcaaacatggaagaagacaaaagtatctttcaatgatcacatcaatataggtattctggtctgtgttctacttctcagtgtaaaatcaataaataagcattttgattttaaaaacaaaatggcaatgtgttcctacagtcagcactttagtggaacatttagtatggattagtggcataagtgtatgaactcatttttcaaagaaatttcctagtggtcttagcactgaagctgaagcagcttctgtttattttagcaagatattaattcataaaagctgcacttcctggcagctgtgcatttctctcaagctttttcaagagttctccctttatagctagatagtacaaaagagggagcagttccctaagtcaaaagccagttagtggtaaaacatgaagagaatcctaaactccaaagtcatattaattttaaaataatataagccaaaagtcataataatttcacaagaatttttttttttttgagacagtcttattctgttgcccaggctggagtacagtggcaaaatctcagctcactgcaacctccacatcccaggttctggcaattctcttgcctcagcatcccgagtagctggaattacaggcatgcaccactacacccagctaatttgtgtatttgtagcagagacagggtttcaccatgttggccaggctggtctcgaactcctgatctcaagtgatctacctgtcttggcctcccaaagtgctgagattacaggagtgagccaccacgcccagccgataatttcagaagataataaaagtgtgcttcaaagaatatgaaggcatgtaaatatctcctctaattccctcgcaatcaagtcacaaatttaaaaaatattaaacagaattattatccatagcaagtattttctttagttttttttttaagttgtggtaaaaaacacaaaacataagatctactctcttaaatttttaagtgtccaatatagtgcttttaactataagcacaaggttgtaaagcagatctctaccactttttcaccatgcatgattaaaagtctacacccattgaacaacaaaaccccatttcctcctcccccagcccctaacaaccaccattccactttctatttctttgagtttgactagttcagatacttcttataagcagcataataccatatttgtccttctatagactattccacttagcatattgtctttaggattcacccttgttgtagcatatgataggatttccttcttttttatggttgaataatattctgttgtatgtatatagcatattttgtttatccattcattcatcaatggacatttaggttgtttctacctcttggctattgtgaataatgctcaatgaacatgagagtacaaatctatatttcagatcttgatttcaattcttttgaataaacactcaaaagtggtattgttgaattatatggtagctctatttttcattttttgggaacctgcatactgtttcccatagcaaccgtaccattttacattccccaaaacaatgcacaggacttccaatttctccacatcctcaacaacattttttttgctttcttttttccttttttttttttttttttttgataatggccattctaacaggtgtgaggtgatacctcattgtgatttaaattcacgtttccaagacgattagtgaggttgagcattttttcatataccaaatggctatttgtgtatcttctttggaaaaatatcattcaggtcctttcccatttttaatcagattatttgttttttggctattgagttgtaggagtaccttatctattttggatattaagcccttatcaagtatatacttcgcaaatattttatcccattgtgtaggttaccttttcactctctttatcgtttcttttgctctgtagaagtgttttagtctgaggtagtaccacttgtctatttttgtttctgtttcctgtgcatttgttgtcatatccaagaaatcgcagtaaagaccagtgttgtataggattttctttatatttttatccaggagttttatagttttaggtcttatcttcaggtctttagtttattttgagttgatttttgtgggtggtataagataatttaattcttttgcatatgattattctgtttcccaacattatttgttaaaagagactcttctttccccatgtgtagtcttggcacctctgtaaaagatcatttgatttttatctgtgtgggtttatttctgggctctctattctgtttcattaatttgtatgtccagcttagtgccatagtgtcttgattactgtagctttgtaatatatttttaaatcaggaggtatcaagttttcagatttactcttctttctcatgattgttttggctatttggggtcctttgtggttccatatgattttttttaaattttcctgtaacaaataccatcgagattttgatagtggttacattgaatgtgtaacttactttgagtaatatggacattttaacaatattatctttcaatccatgcacatttacatttatttgtgtctttaattcctttcagcaatatttggtagtttttagtgaacaaatcattcttctgttaagtgtgttcctcaatattttattctttttgatagtattgtaaatgggattgctttcttaatttcctttcatatattttactgttagtgtatagaaacacaactaatttttgtatattgattttgtatcctataattttgttgaatttttaaattaagttccagattttttgtgtgtgcaatcttcagaattttctacctataagatcatattatctgtgaacaaatataattttacttcttcctttccaattgaggtttcttttctttttcttgcctacctactctggctgttacttccagtactatgttgagtagaatggtgagagtgaacatccttgttcctaattttagaggaaaagctttcagtttttcaccattgagtatggtgtttagcttaggacttttcatatctgatttttatattgtaaggtaattttcttctattcctaatttgttgaggttttttttaaatttaattattatactttaagttctagggcacatgtgcacaaggtgaaggttttttacataggtatacgtgtgccatgttggtttgctgcacccatcaactcgtcatttacattaggtatttctctaatgctattcctcccccaaccccctcaccctccaataggccctggtatgtgatgttcccctttctgtgtccatgtgttctctttgttcaactcccacttatttttttgaaatgaaataaatgtgtcaattttgtcaactgctttttctgcatctattgatataattgcattatttttatatttcattcttttaatgtgatttatccaattgattaaatttcgtatgttgaaccattcttgcatctcagaaataaattccatttggccatggtatatgatcttttcaatgtgctgttaaatttcatttgctattattttgttgagaatttttgcatctatattcattgacgatattggtgtgcagtagtatttctgtgattttttttctagctttagcatcagggtaatgctagccttataaaatgagttttgaattgttccttcctcttcaatattttggaagagtttgagaaagattgccattaattattctttaagtgtttggtagaatttaccagtgaagcaatctggtcctaggctttcctttgtggggaagcttttgattactaatttaatctgcttattgtttataggtctatataaattttttatttatgattcagttttggaaggttatatgtttctaggaatttgttcatttcatctaggttgtctaacttttcatacaagtgttcccagtattcttatagtcctttttatttccatataaccagtagtaacataacttctttcattttaaaaaattttagctatttgagccttctctttttttattggttaatctagctaaagctttaccaattttgttgatgttttaaaatatgtaactcttagtttcaatgatttttttcttttaattttattctttatttttttctctaattattttcttccttctgctaactttgtgcttagtttgtcttcctttttccagtttcttgaaatgtagaattaggttgtttatttgagatctttcttccttttaaatggaagtgtatattaatacaaactttacttttagtactgtttttatggtatcccataagttttggtatgctgtgcttttatttccatttgtctcaagacattttctgatttccgttttgatttcttctttgacctattggttaagagtgagttgtttaatttcctcatgtgtaaattttccaatttctcttcagccattaatttctagttttatttcattgtagttggaaaatatatttggcatgattccatcttcttaaattggttaagagttgttttgagacctaatatgtcatctatcctggaaaatgttccatgtgcgcttcagaataatgcatattctcctgctgttagctggcatgttctgtatatgttaggtccttttcatctataatgtcattcaagtcctctgtttccttatcaatcctctgtctggatactctgtccattattgaaagaagagtattacaatcccctaataatattgacttgctctgtatttttctttaattctatcaatgtctgttttatatatttgggtgctctgatgttaggtgaatatatatttaacactgttatattttcctgaattgacccttctatcattatataatatccttctttatattttttaacattttttacctatagtttattaccattttcctggattatatttttctatcctttcactttcagactttcagccaatgtatgtcactaagttaatgtaagtcttatagacaacatataatgagaatcttttttttttttttttttttttgagatggagtctctctctgtcacccagactggagtgcggtggtgcaatctcggctcacttcaacctctgcctcctggtagcagggattacaggcacacaccaccatgcccggctaatttttgtattttaagtagagacaggtttcaccatgttggccaggcaggtctcgaactcctgacttcatgtgatccacccgccttggcctcccaaagtgctgggattgcagttgtgagacaccgtgcccagctgagaatcttatttttaaaatccacttagctattctatcttttgattgcaaagtttaatccatttacatttaaagtaattatatattgataaggaaggacttattatagccattttgttaatagttttctgttttgaatcttttttgtccctgtttttctctcttgttgcttttgatttctttctcattttcttttgcatatcttctatagctatagttttgtggttaccatgaagcttacataagacatcttgcagttataataatctattttaagctgataataacttaacttcaattgcatacaaatactctactcttttactcttccccccacataagaactttatgtttttgattttacaaattacgtctttttatattatgtgtccattaacttattttttacttatggttatttttatacttttgtcttttaagttccttagttcttaacacagtaactgtagtactaaaccctgagctttgtgaatgaggcataaatatgctcttgtccaaagcttgcatcatcttgaaagttaatttattcaattgtattgatttaaatgataggatggcttttgattagacttttgggagactaatacgtgtaacatcctgggtgtattgtttccaagtgtctcttcccccaactcttcccgttctagatcctctactgactctttcctggttgccaaaagcagaaaaggtagtgtaggagagtgtggaggccctagaaagggcatagcatgtgctatcccttgcccactgcactgttttatgagggagaaaatgtatgaataatgatatgggtaaaaataacattatggtaatgagtcataactgaaaaaagcaaggggggaagtgaagaggaaaaaaaggaggaaggaaggaagttggaaggaagctagaaggaaggaaggaaggaagggtgggcaagaagaagaaaggaaaggaaggagggaatggtcacaaactgaggaaatacatctctttaaaaagataattaaaacacatagtagggtttaatacacaaaaccaaaatcaagtaaatataaatggacatttcttttactctgggacagtcttggacacaccactgaggcctccttgaagtagagtgcctggcttttggagctgtcataaccagaatttgtaatgcaatcataaaatggaatcagtttttcttcagtttaaattttgcaagttcttatttttcaaatgaataacttgtaatagatattttctaaatttatcaaacggttaaaaaaaaaagtctgggttaaaaataaaccagagtctgacttgccagtgtaattcatctacaaattggcctaaaggcagggtatggactaatataaattacaggtcctctttcatctaaatgatctcttttccttagagacctaacattttggtaaagtttatcctagctggctgtgctttagccagtacatttccaattcacatttaattaaccatcttctcctctgggcttatatcattttgcttttgtatttatgcattttattcaatatatgtttactgagtgcctagtttctatcaggaactatgctaaggatgatgtagtgaactttagaccaggtagaattcttgcagggcagaaagactttgaataaacaagtgtgctcagtgattaaattgagatgtacagaaacaacatgcaggatatcccttgctattgaacttgtcccattaaggtgagttatataattacatgtgggcacaactgtccttcttattactagatcgtaagctcttcaaaggcaagaactatcctttatttgtaaactcactctttctttcccattatttcacaatataattattatttctcagtaaatacttgaattgaacttggaaaatgtgggactttggtttaggaaacatgctgatatggtttggctatgtctccaccaaatctcatcttgaattgtagttcccataatcctcacatgtcgtgggagggacctggtggggggtaactgaatcatgggggcagctactttcatactgtccctgtgatagtgtgtgagttctcatgagatctgatagttttataaaggagtttcccactttgcttagcattcctctctcctgctgccatgtgaagaagggaatgcttgcttcctcttctgccatgattatcagtttactgaggcctccccagccatacagaactgtgagtcaattaagcttgtttcctttataaattacccagtcttaggcagtcctttatagcaatatgagaacagactaagatacatgctctagtttgaactcttccattgactagttatctcactttggacaagtcacaagtgctcatttaagggctgagaacattttcattgttgcataaatatttgaaggccaatggcctttgcttctcttctgaaacactgttttctatgtttgtgtataatgtgataaagctttgtataacatttacgcacctcatttttcctggtcataatggacaaggtatgaacttcagagtaaaacttctgggttcccaaaccaactctgaccattattagctatgaacttgggcaagtcacttaacctctctgtgcctctgtttcctcatttataaaataagctttcacaccaatctcatagaattgttgtgaaaataacataagctcatttctgtgaagtacttagcacattacctggcacataattatgctcaacaatgtctatttatgcatttacctgtctgtctattgtcatccctctccctatttccattgtaatttccagaggctgacatttaaaaattctgtagtgcttatgaacagagactcaataaaggtcagtttatttcaactgaatgtcaggattccatattggtcctaaacttattttctcaaattatattttgggcaaggctttctgcttctgggctagttgctaaataagatcaccaccatcaccaacatatctacagtatattgactacttacaaagtgtctcaagcatatgtactcattttatcccagtaaccatatatagtaaacattgaggtgacaatttaagatatagaaataggtttagaaagattctgtagttttcccatggtcacagcattagcaggagtgacaccaggaataaattaaggtccatataacattggagccatacaggaaaacctgtgcaaaatgacatctcatttttgtgtaagactttggttttttgaaaatactgttatagccttcatttctctacatcttcacaatagccccatatggtaggcagagcaggggagaaaactaaggtccattaccatgaaacaatgtgtctaaggtcaaacagctggtaagtgatattgttgaaaccagaattcaaacctcagtgttcagtcccagatttttacactatttcatcctgctttcctgctcagtacattccccttatttcatttctaggtatgaatatatgacatcttgtcactctctttgccatcaaaaactgggcaaaagttgaggtgcatttagtgaacctagaacataggtttttaagtttggtgtcagcacaaaatttgcatttgccttctctgttcttatttacagatcctaaggaaaggactgatcacgattttgagaggtctgatggaaatggttttctaaacttgaaaggcttaaatgaatataaaatttttgccttaattatattttctcatacaagtccagaagcatctgcagtttcttgcagccacaagcaagaggtttgaatttatgtatactccatttcttctggctgtggaacagcttcaatcatagcagctggagctaccatttattgatcatctactattaatgtgccaagaaacttacagaattagaagtaatttttgtaatagtcctgaaagtcccaatgttattattcccatttctggggtaaagaaattgaggttcagagaaactaagtaattgctcaaggtcatgcagctattaaatagcaaagctgcaattcaaatttaggtcagtcagattccaaatcctgatgcttcccacttcaccatgttacttatctcaaaaaaaaaaaaaaaaaaaataaataaataaataaaagtaatacaaatgaaacttctacctttcttttggtgatgtaagtactttaaatattaatctctgagtcaaacttgatggaggaggtgggtcggcaggggaggtgggcagtgggagaggtggggcggccgggtgggtggtggtgggaaacaaattctaattttataaaatccccatgttggtgagaaggccaagcagaaatgcagttgtcaattacatcggggtggagtttttcaccatctgatagtgagtattcatttaggcctgctgggctaaatgaaatgtggtattatacactcaagtgccaaagtgccttcgtgagacctttcaaagaaatcttctttatttcagatctcacgcataagccaataaaacataaattgcaaactacctgtgaattggtttctgaaaaattggtgttgggtccgagacatccaagtcggagcccaggaactgacactgaaaaacacatctgagaggtttcacctggtgcaaatttattaggacacaaccaacaataaaatattttcttttctgcagaaaggtcatttatttcatcctcagaatatgttcctttggtgtaatttgtacagcaaagggtatgcatcactttatgtgcaatttcctaaacaatcatccgttagtaaagaaaagctgaaaatcaattatctgatattttttcctctcttgtctacaacttccaattgaagacaaccgctttgcttgtcctttttttttttttttttctttttctgagacagagtctcgctctatcgcccaggctggaatgcagtggcgcgatcttggctcactgcaagctccgcctcccgggttcacgccattctcctgcctcagcctctagagtagctgggactacaggcgcccgccaccacgcccggctaatttttgtacttttagtagagacggggtttcaccgtgttagccaggatggtctccatctcctgacctcgtgatccaaccgcctcagcctcccaaagtgctgggattacaggtgtgagccaccgcgcctggcttttttttttttttttttttttgagacagtctcgctctgttgctcaggctggagtgcagtggcacaatctcggctcactgtaaccccggcatcccaaagtgctgggattaaaggcgtgagccaccgcgcctggccgcttgtccttctttaaacagctaatgtgtaggaagtttatagggcaatgggaaaacttactgcctatttgcatccaatctattaggtggtctttgtctatgaggtaggcagcacatcagaaacagcacctcgttccacttggaacaaattaaagtcaacacaacctaaagaggaccttgatgcaatgcccatatccttctccactggtatggttactgtgccatggcaggcagcccccctttcagttccagaaagcacccaggccattcaagagggagtattcaataagtctcaattacacagctacaatacagactcttgttgagacccagtagaattcagttgagtggatgagtaggagctttatacacctggatgtcatttatacctaccactcatgttctagcccacttttcagacatcctcatgactttccctatccattgcctttttgctgttcacatgcaaagtccctgttgctttataaagagtgctataaggataaattgaaaggactgatagtcctctgctgccttggtccaatgaaaggtcttttggaaattgcgttgctaaattttgatggcaccaaacaaagagaaatgtttctgaaaatgaaattgtgctgttaaacatctgcattccaaatagctccctaacaagtaaaaatacaactgcttttgctttaaattaggttctgactaaaatatgtgctcttacgatctaggaccacgtcaaccattgggtttggtccatgactgatttggcattcaatccacagtttcttttttgttacattactgatctctgctgtatgcttctactggatcagaaaagagctggccccttttcaaaagcaatctaaagcaatcaattctagtctgcaataacttttgaagctgccaggtacattcaaattacagaaaatttaaaaagctgtttacacttttttcttaaagccaagctccttaactgcgaatgaagaaatccacagaagaacagtattcacaataaaacagctttgtctctggccaaaaaaaagacagccatagtgatgataaagtctatgttcagttttacatttcagttctctgaaaatcagttctatgactccaaagtgttcagatctcctttaatcctagtatcactcatactgggaattaatttattctaaggatataaggtcttagacaaattatttaatgcttacaagtgcctgagaatattattgtcacaaatacaatgacactttttgaaaaaatagtagggttcgaagaaatgaaactaagttgaagacgtgagtgtcatgtgtcagaggtggtaggccagagggtgaggtatctgctaccaaactatagggcctgcctgtagaggggagagacacttctacatatgctgtaggctgggcacatcctcataatatgcaaatattaagcagaatttatcagagcaacaaactctaagaccttcattaaatcaacattcaaaatgagaattattctcaaaaaccttcttttataagagtatgccaatcttatgtttcagtctcctgcaatcaaatgcagtcaggataaaggaaagctattgtcaaaatgttgaaatatttgagttttatgaaactaatgctcatctttttccagaaatacatcccagaacttctgaggtctggcctgtatgagggaccatgcaagtttggaggttttaggggacactcctgtgcattttgctaattctttcaagttacttaattgccatccttacccactagcagatatagaggtgtttgtttaaccacttttctgagtttcaagtgacatattacaagttttctcagggtctccattagctttgaaaggtaatgtcactttttggcattttcaattctcaaaggtagcaaactacgcaaagttgaaacctgtctgttcataaagctaagaactaaatataggaaaacaatttgggtgtattcatttgttcaacaaatattaattgcatacctactataatccagtgctttgccttcaaaaggcctcagtttacagcattgtatcagctagatattgtccctgccctgatggtgatttcagactaatgggaacgaccttgaataaataacctcagagataataatttaactacaactttgatagcatgaataaaagggaagtgttagaggctatgggggtatataagagaggttttagggatgggttccttgagaaagtgacatttcggctgagaaagctgatgtctatgaaagtaaaatctattccactctagatcaacttggcaaataaaatcagaatatgttaaattaatttacaacctgtaatatatacagctctacaggaagaaatacattccaaaatgcaaatagctaaaatttgcagcctcaaaaatatatgatttaatactatttaaaaactgatgccatccagaactaagtcaaatccttatattttaattaaagtcctttactacaaaaaagaataaagcaagaaagcaagcaataaagaaagcaaaaaaaaaaaaaaaaaaaggaaggaaggggaagggaagggaaaggaaaggaatgaaggaagggaaggaatgaaggaagggaaggaatgaaggaacagagggaggaagggagggagggaggaaaaggtagacaaccattttaacatggcttcagaagtaatacaaagaagtttataccattgctggcactggtaacaacattgtgctggaggataatcttaaaaacaaaacacaacgactctctgattttgatagtaaggtcatgccccaagtgggaactgctacaatatttgagcaagtaggttgacaatactgattgatctccaaggaattctggatcagacatcaaaactgaggtgacccttgtaaagtaatatatacatgctgatgatttacgttttccaacagtttacgggtgttttatgtcattactacctacactgctagcaatatcacctttttcactcatggagtacacaaaagctctgaggaaggagaaattgatttgcatctcagctgcatcatcaatcagctgtgggacctcaggcaagtcacttaacctctttcagcctcatctaacttcatctgtgatatgaggataatgatgtttacctcttaggatagttgtaagaattaaattaggtaatgattgtcatgaacttggcaccatgcctatctagtacattgcaagggctcaaattttagggtaatatcgatgatgattatgatgaaaatgactttcagtctatggtatttacagggctggattaagaaatttaatcacctcaacccctgaaaagatactagccccaccaatataattcaacataaatttttattattttaattcacagcataacatgcatatccatattcatgtagcaattcaaatagcttctttcaagatttttctgattgtgaaattttgatgtatttaccaataggaacttttctcattttgggggggcccatgctttgccacttctctgagtgcacgcttagtttgcctaatgggtaattcaaattccccaacataaattaggagatgttaaaaagtaaaaccagagaaaataaataatctggttaaatgctatcacaactggaggatagctgttatagcttcctaatggataactatttaatttctctagcttcatctctccctgttccccaatcttctactgcaagcccagtgtcttttggacttgatttaattctgttcctcccaaccattttcaatgctcacagaacttcatgtttgcttgtcatgccataaaagagctcctactcagggaatgactattgactcataaagtattcctcccttacttccaactcacagtttggcctcacttagagattccctttaccaagaccacagagcctcatgctagtcacatggattaacttcctttcctggcttcctatgtttgacccattttcttggctctcacaagctctcttcctctggtgggccatcatctctagtactaagccacaagccagcaaccacattaaatggccagcatggctccccgggagccaagtctaggaaaacagccagtcttcccactctaaagtaggtctgtggctatgtacctcttctgggttcaagggatgcagaacatggctgactatagcagaaacagaggagaaaaagataagcttgatgaatttgctgagtggaatctctacaaattgagtattcttgctcttatcctcatacctatcaatttctaaactcaatccaaggggatgccttctctccctcttccctcactcctatatacacactacacaaatatatgcatatatgtatgtataatcttgacagaatttcatttgtgagattttattgtaattaacatgattgagtctgacattctttatcaggataactttcacttttattatgtgttttatatgtgcacattctatgtgaacatgggtaagtttattcaactctacaagcttcagttttttaatgtataaaattacgttatgggctacgggtagatgcagtatctaccccatagagatgttgtgaggtcatacatatgaggtatctggcctacttcttaacacagctaataaaagagaacccaggatccaagttcacgtggttcaaccccagagcagagcctatgtacttagctcaatagtgtacactcaataagagttggatgtcattactaggattgttgtaattatcatattcattgtagaaaagttagaaaattcacataagcaaagagaaaaattactcatatctccattgttagagatgacaatttttaatattttttattgtcttcctagactttttctatgtgtatatatttttttctgcaaaaagtactatcagattctacttcttatttttaatctgctttcacatttaatatattgttaagatttttttcacataataaatactcttctcagtagaatttgtagaaaaaaatagtctaaatgactatataatttggtacctctgactaggtctcccatctctgatagtggtcttaaacttacatattccttgtatcttcttatccttgttaatagcctctgaggcttgggggcaattaccctgttcactgacttaaataagaatttattaggcagaatccacaacagaagtaagatcctagaaatgaaggaaagtttctctccaacataccactattaaggaagaaacagtgctttacaaaatatcattatagcacagtgactatggatttcactgagagctggcaatttaacaaaaccaatatggcagcttgtcatggatggaagacagaaagatcaaacaaaaagagaagtaaactttattaagacacttggaaatatgaaaatataaaactcattgaaagtataggtctagtgaagtatcacaatgcttagcatacaacttggtaccaaaaaaaaataagagagatatttatttgttaattcacaaatcattatttggaagcacagtttgagacaggtatcaaatctgtacagttcgaagccagcacccacatgaatctaactccaccttcgtgcaattgtccacagacgtttacccaactaacatgctctcttttctttaacatctaccgagattccaaccccaagcctatttccttgatgaactctattcttagaaggcaacttgttcactctcttctctgaaaatgtttatacctaactggatctaaaacttagcttaatattttataacttatttttttttctgggacataaaaaagaggagtttccaataaattaattttccaaatagtttaaaattgtcctagctaatccctttgtaaccttaaaaagttccttaacaactatgagcctccgtttcttcacatataaagtggtgatattagtccgggcacggtggctcaagcctgtaatcccagcactttgggaggccaaggcgggagtatcacgaagtcaggagatcaagaccaacctggctaacatgctgaaatacaaaaaaattagttggtgtggtggcagtcacctgtaatcccagctacacgggaggctgaggcaggagaatcgcttgagtccaggaggcagaggttgcagtgagccaagatggcgccactgcactccagcctgggtgacagagtgagacttcatctcaaaataacaataataataataataaaataaagtggtaatacatactttgaagtacacatatgaaaattaaataatacatgataatccttaacatgtagtagtagttatcattttactagtcataaatgtggatttgctcactgggatcattcataacaaacatctcttattgtaataaattacattacagtgatgtctgcacagactataatggtttattttcatttatttcattaaatattcaagagctctatatcttgagcatgtacatttacatattataaagggttttagcgtttcttttctcctctgtatcacgacactgtttcagctattacttatttccctagccttctctttgtacttctatcaagctgaagggatggagggttacgggctgatcatctaaattataaaacttgttggaactgtgttaaaagcaaaagtaataggatgaagggggcctacacttatgaagcattaatgtgccagcaactattataaccattatttcgtcatatcctcaacataacattttgaagtagaccgtgttcatcatttccatcttatagttaaagctgagatctagaaaggttaattacttgcaactttttattcttatagttgatgcagtggatattcaacaaatgcttattggtatttgttcatctattttttctctttatttttaagaaaatcctagagcagagaattttaagacggtgatctctcctgctttcagttccattttggcacaagtcttatgtcaacatctcacctccctttgatgcaatgatatacactttttccaatttaagaaggagtctggactctgtggtgtcctttccttggtctatcaagatcatcccttaggaagcagagctgaattctggaacctggaattccagcatctccccatggaagtagccctcattaaaataatcccctttagaaaagagtcttatttttactcatagagcattgttgctacatgtacttcttagacctgaagattacaagctagattttagcaacatgtgaatagttttgcttttttgctctccagaaaataaagtacagaaaaataatcatgacgactttaatttcttcagtatcagtaaatctcctggccatacgtccatctaagagccacactggttacttagagattaggcttgtgtgtgcatggggactagtatgtttgctgaactgtttgaacccaattacagaaagtcacccagtaagtaaacacagccagaaatatggtcacagagaaaacgtagagaaaaagtaatgaagtattttgcaggagagtctggtttatttgctaattggtagtatctaaagaaggcaatattgaagaatgcaggcacaccaggagtatttctcagccaataatctaaaattgcttttaacacaaaaccccaccagttgccttaatctctgagttctactgtccacactgccccagtcttttactggacagacacataacgcctaggtctgcatgcactgtatttttttaaattgaattcaaatctcctctagggaaataagtgatcactagacaaatgtcagtggtgatgcaacatcttagtagcaatcattgtgctggttaagtataacttctcatacagagatgtaagaggtcagaaagagagaaaaaagatactacatacttacctagagtctatgaatcaggccatataccagaaaacttaatgcatatatctccagaaaagtaggtattctgatccattttacagatcagttttaccagtaagggcacaggctcaaagatctcgagtaatatctcaaggacacctggccagtaaacagtagaatcaggactgaaacaggtatctcctgactctaatgtcggcactcttcttgcttcattgcagggaaacaaaatcactgatgcttggccatgacataacttcagggtaattagcatatgttaggaggtaggtgcaaaactgaaagataccaaaataaaatcaaaagtatggggctagtgttaaagggccactcttgcaatcaagtagaaagcattatggctccatgagagagatgggaaatagggaatggttgaggatataagcagtgggatcagcatgattgaaggagagctacgtggaagaacagtacattctatccagatgaataaaaaattgaagagtatcttcaaatatttctgagtagtttaaggctaagggaaatccaacaacttctaagctaggtccccaacctcaaaggaacctataactgctaaggatcgtaagtgggggattcaggctttgaggtctctattccattgcatagtagctgtgagatcattacttctctgagtttcaatttcctcattattgggggttctcataatagtattcttgaagtgttgttctctcttaagatatatattaatacctagttgcaccactggagcctaatatataatagtggtggtggtggtagctgtggttgtgaaattcaaattggtggtggtagtagttgtggttgtgaaattcatattgccttaactaataaaagaaaaaaatggtggaaatggcaaggtaatagactgaaataaataggcatgcctatttttgttggcattgtttacataaaccagttcctgtcagacaggtgggtcttaaccttggctgcacatgagaatctgtttaaaaacataaaaaatggcactccctccccagagattatgatttaattattctagagatatacccaggttttctgtagttctgaaaattccccactatgtcccatatgcaacaagggttgagaatcactgcataacaagacaatgctgcccaagggcgactttaccttaaggcttctcagccctagataaacccactgctagaggtaaggaataaagtaaaaaacactttttgaatggcctgtgttttgcctttgggcattggtagtgaagtatcaatcaggtagaatctggaggcacagagccacagaatttctgtacccctttttaataatgtctagtgactgccttactaacctgtgtgtagatgcactataacaaagcacaatttcaaattagcagtttttacaaataacatgctgtaactctgaaggaataacaattttagtggaggagatatgacatttggcatcaaaagaaaaggattcacattctttaattcagttacttagttcatatccattctaccaaattctaacatatacaatgtcctaacctggacttttctttttttttttaattttatttagggtacttttctataagcacccttgggccagaggcctggtgcgtttgtgatgggtcatctggctgttctgttatttgaagctcacccaggagactgctcactctggaggcagcaccctgaagagctctgagtatcactaacaatcagactctagatcccaactggggagaaatgtgaattccacccacttgtttctccaatttaccagcaccagaaaggaatgcccacctacatttaaaaagtaagtactaatacagcaggagtgtaatctagggcccctgttggaaggagctatggttcaaagctgagcttattttttaaactattgccatttatttcccctcttttgacagaatatgggtgttatatttttaataatttgtgaatcagaggtggagtggagagtacagtaaataccaaataaactgtcttttgggtatctgttgaaatggcacaataataatttggtccaaggtaaagcctttactgccttggggtcaatattataatatctacctattaggtttattatgaagactaaatgtggacatgtatataaagcatttagcacaatacattaccccaaaccatagctattatgattagcttattataactactttttcagtaaacaccttttaaactcaacacatatataggcaacaggctcagggaaaagaaagagtttgggaacaccaacaccaaacatatttattgggtctaaaatagtgaaataggacttggcgccaacaccgataatatcaacatgctaataataaagccacacaaaaagctcaatcaggtaatcctgtgaatttggaatgtgtgctcattccagctgaatttgatgcttcagatcccttcctgataatacatgcagcgtcccaggcaccagggatgacacaatgccctgccctgtaggatcttttcagtctagtgaagaaggcagtcttaccaaaaaataatgacaatacagtgcaacaaaaacaatgagaaagtttagtggcaagtaatgtgggaacatgggtacagaggaaataactgtctggagaagagaaagctttgcagagatgataacccatttagggatttgatgaatcgatagacattcaccaggaagagaagagagagctggggcaaaagttagaatgaacaaatgcttatcacactgaattcttgcccagggccaacatgtaaaggtttcaagcttaattatttatgattgctattataattagatattacaaagttatatttattacaaagtttataatatatccccccaacctaagggaaaagccctgaattatgctgtcagctgttttcatcaaagcaagtcactagccttctcttgttattcactggttgaatgtatttgttaaatatttgctatttgtcaagaactctgccagaaactggggatgtagctgaagaaaggagaagcattccttgtcttcgaggagcttgaaatctagtggaaacatcagatgtttaacacacacggagcatttggagaagtgttcaacaggggatgggcaggaaatgcttttatacctgattttgtgcttcaaaaaatggcaatagtaataattttgttacctaatttccagggcgattggtacaggttatgacaatactttaaagcatggtaaaatatagaaaaatttaaggtgaaggtattattgttgtcactcttcttacatccacctaattgaatttatttaaaatagcctaaaatttacatttttttcctaatatagacattcatcagtaaaaaattgtcttgaaatattatttcttccacatgaagtactgaataccaactatttatattttcatgagaaatcagcataattattcttcctgtctagttatctagttatgtcctcttgaagaaagaaaatgatgccacctgttgagtgatgtgcccagattcatgcagagtgaggacagaattgaaagatccctactttatgttcgaaagaatatagcctatcaaatatttatttaaagtcagagaagaatgaagaaataaagacaacatcaatatcagtttgggaaacaaataccaacacagagtccagtttgaagcctctttgaaaagggaggaggtaaagtgaccgagccaacagatgctggaaccagactgagtccacaacttgcctccactgtttactaactatatgaccttgtgtgtaaaatgtctgtactaatttttctgatatctaacattggggtgataatagttcctactatgagggcttttggaaaggttcaataaattcatagaggtaaaggttttagagtagtgtactcagggctcactacatactatctactattattgttgttaactctcatgactacccttaaacctacacctcttctaatggaagaaaactggagaaagtagaaccaactcagagctctcatatttacttcttgatggagatggttgaaagctcagtgaagtgcaaccagacattgagaaacttgtcttttccacctattaaaggcaacagatttgtcaatttcaaactctcttctatctgaaaacaaaagacttccttcatctaacttaatcacagtaacttatctgtccgaagtcctccctagctatcccccagtgactcttttccaactaacgttccctgtctgaagaatatagatatccaggttattactcaagttaccaaaatttcagagctaaaaattacttgatagctgaaccctcatcagaaaggcaatttcacatttttactgcattttgcatttccatcattatttcttctaccgtatggaaggccaggttggggacaatttggattatagagggtaaaacacatgatatttcttttgtacatttaataaaagctgaagtgaaaaaaaagagagattgaagccttattatattactttttaatcctttgcaatgcaatactaatgctatgtatgtaatatttgagatccctaaccagagctcactttggctgagggtccaatcgcattagaaattaccttgagagaagtactgcaaatgcaaactcatgaaaataagagaaaagaaagaaaagaaatgtcagccagatcatttgttttcccatagatcatctttccaaatgtgggccagcaggaacaaattttatgctgacctgggaaaattactgcagcaatttgtatgtgaaacatggatttggaaattttgaaaccggtatatttgcagaatgtgaaagtaacattttggaataaagcaaaagtcctgtacacgagtaaatactaagcccttaacaaagcatattcaaggctgatttttaagttatgatatttaagctttttaggatattgaccctacttctaaactcccaaactactaataattttctaccctattagattttgcaacaggttacagaattataataaaaaccttcttcatttttaactggactgatagtggtggtgtaatatcccaagagaaagagtcacatgaagattcttatctcctacagtgagaatcaaatattgaagtgaagatggtgtcacaatctatgtttcttttcttttctttttttttaacctgaggtttcaaaatccttctctggtactttgtaatgacagagttggattacctgtgaggcttcatggtatagagcaagtgttagcaaattgcaacttgtaggccaaatccttctcacttcctgtttttgcaaataaagatttattggaacatggccaggtcatttgtctatttattgctgataattgcttttctgctacatcagcagacttgaatagtagtatccgagactgtctggcctacaaagccaaaaatatttacaatttgaccctttgtttaaaaagtttgctaccctttggtataaagggaaaggcagtgggttaacaagcagtaaagaaaagagtacttctgaaggtgttttctcttctatttatcaaagcagtcatcagaaacctgtagtattttatttttataaataaaaactactatgtgtttacatattatttcatagctgtgaaattttttctgaaactaattaccaaggtgaattccaacactctttccttcaaggctctcagttaagtcatatagtgcaaagtattctttgatactctcaaatggatctgaccattcctttctatggctaactcacatttattcctgtattagagagtatttcatttgtttatttatttataggtcttcccttcactctagcctataagcgcctccaaacttagcatagtgtcttaattaattttgcatcttgaatcttatatatgcctggtatacagcaggtatcagtacatgtttatgaaagttagctgggtaaaaaagtggtaagcgtaaatcttgagaaattaacttgctgaaggtcactcagctagcatgtgattaagctgggatttgaacctagatctgaaactaattcaagtattcaagtgctctttccatttatcttactgactgtaatctggagactgcagttttcttttttgttttgaaatggagtcttgctgtgtcggcaggctgcagtgcagtggcacgatcttggctccctgcaaccttcgcctccctggttcaagcaattctcctgcctcagcctcccgagtagctgggattacaggcacatgccaccacacccagctaatttttgtatttttagcagaggcggggtttcaccatgttggccaggatggtctcaatctcctgacctcgtgatccactgtccttggcctcccaagagactgcagttttcattttgattctactattgaaaatttgggtttcactgtctttatctgtaaagtaagtatgttgcattatgaaatgcctttcaagacctctttccctaatgttcaatgtatctaggatagtcgtttcactaaataattgcagataatatttaaaaagtaattatggctattttgtggttcatctcagggctaaaaaggtcacatacagccatctaataaaaacaccatctcagtgtgggggtcaatcacttctctggtagatggctgttaatgagttttgaatgatatggaaagtgtcacccagctgtgcacagacagaagcttggcagtaattggttagggtgctgctgaataaataaatgcattggggtgggggtgaaggctagagcaaatgacttcttagatgtgtgaccacttgagaatattaacatatgtaatacattgtatatcgagatttctatcatgcccacaacgtaagccatttacttggattttccattgctgaccagttctacttataatttttgttaagccagtagtttcctcctggttaattctgcccattgatatttggtttaccctctagagggaaatgaaatcaatctcaaccctctcccttgactatctccactataggttctggaaaagcagaatgtttttgatttctagtctttctcgcagcaatgtgtggtcatatgtttgaattctggccaatgaactaaaagcagaattctgtgacatggaggaaaaatctggaaaagcttctgtggtcatgacaaataaaacagacattattgatgcctccccacaacccactcctagcaccctatgctgaaatagtacatgatgttcagagatgcagagcccattttgtgacaatgaaatggccaagaggtttacagagatgtcagccctgatataatggcagtttacctccaaagttcataatatgtgagaaaaataatgtttatttgtcactcttaggcacattgctgcttgtagcctagatcatcactatctgatacagattgcataagggtttatgagtctttacagccaaaaatatctgggtttaaatccccattctgacaatttgtgatctttggtgagtaattatatctctaagatgaggtatgttaatctaaaatttggaacaacaataacattcacaagcttgttatgaggattaaaacagataacacaggtgagagtactatggaaagcatgtgacacatagtaaatgctcaacaaatatcatatagtgtcactcttattattacttatcattcttatcattacttataatatttgagccatgtgccaagccctgtacctaaggtaaataatttatttagcatagataaattattttcttttctagtactatttaacaaacttattaagtagaaataattacattcatttactaaagaagaaaaataaagctcaaggacgttaagtaatttgccaaaggtcaggcagttaggaaatgatagaattcaaattttattctagatctcactctaaattctacatatttgctttcaagtctatgtttttcttctatccaagaagaaagatattccatgggatgtttataggtatgctaggaagagtaatattcagggatctctggaataaataacttaggtttgttagctgcagaatttctcaaacccttaatatgctaatgcatgtaggtaagctatgacaggggattctaataatgaatgttttccatttttatggcacacatggtgtatgggttgaattaagtaccccaaaatgatatattgaagtcctacctcctagtacctgttgtgactgtgaccttacttggaaatagagtctttgtaaatgtagtcaattttaagaggtcattagagtgagccctaatccaaaataactgctgtccttaaaagaagggaaaatttgtacacacacagggatatcaccatatgaagacaaagaaacagagattaagatgatgtgtctacaagccaaggaatgccaaggattgcaagcaaaccaccaaaagttaggagagaagcatggaacagagcttcctcatagtcctcagaagaaaccaaccttgccaacccaccttaatgttgaacttctagcctctaaaactgtgagacaaaacattaccattgcttaagccaccaatttggggtactttgttttagaagcctaacaaagtaatacacatggaaaaacactttttggaaaagtttttcaattagattacctcccggttttaactttttgacaacctcaagttgttttagccattcctcgtgtggcaggctaagtgcatgatctcaatattgacccaaattattataaatatgattttcatcttattagtaaagccagaagtaggggtgctggggacagaatattgatgggtcagaaaatatttcccaaaggcatggtgtctaaagcaggatgtactatggccaccccctgcccccaccttcttttttgagttttgacttgaactttagtaaccagatgaagttctgcaactttgtaaggtctggggtttgaaaatggcatcctttcttttatattttatttcaaccctttggaaaaagggtctgaataatcagattttattagtaaaatatcactgcttaaaagccgtcatgagaaatatgcaaagctatgatatatctacattgtgaatgacacacccttggatgtgaaacttctatgctttgcacggtcatgtacagtaggtctaacatgacccatgtgccatagtgactataaatacaggcatccttcacaggtagttgacatacttttatcttcataaattctgaacagtcttaactaacaaaaggccctactaattgttgtagaagaagaaatacttatcaacaaatatacaccaatgtggtcacttttggcagagaggattgtttgagaccaggagtttaagaccagcctgggcaacacagtgagactctgcctctaaaatatatatatatatcgctaagatgaatctttattctggctttaaaaaaatccaggctaggccgggcgcggtggctcacgcctgtaatcccagcactttgggaggccgagatgggcagatcacgaggtcaggagatggagaccatcctagctaacacggtgaaaccccgtctctactaaaaatacaaaaaaattagcggggcgtggtggtgggcgcctgtagtcccagctgctcgggaggctgaggcaggagaatggcgtgaacccgggaggcggagcttgcagtgagccgagattgcgccaaggcactccagcctgggcgacagagagagacttcgtccccccccccaaaaaaaaaaaaaaaaaatccaggctaaaatgacgaggaccatacttttcaacaggtttttaacctgaagaggttaacaggaatgtcccaggggcttcatgaacctcttgaaattacatttaaaatgtttgtgttcatttgcatttttccagaaataggctccacatattttatcacatatgcaaaggagtaagtatcacaaaatgtatttaaaaccactgttctacagcatagagctttgaggccttactcatccacatctatgtaagagaatatacctaggaggacatattgagaacctacacctgaccacagatgttccttcagctaaccaccatgaagacacggagtggtcttccattcatgccattgtcaatactgggttattgaaccctcctaagaaactggagagaatggaatgagttgatacatttagcatatagttatacagttagcatatagtaatcattcaataaatgtttcctaatgttgttatccctcattggggtgattcctaatgaatatggctctacttataacctgccatgttttgcactgcaggtataatctattattccttttcacttttcatacttattaaaatttggctgaacaaatggtattaatggaatatttgctaaataatttgttcttcatctaggcttctagatactctaaaatctgtctttgaattaatctaggccatcagaaagcaatctatcagaccaaatcaatgttttcctattcctatccctccccttttcaatgtaaaaaaatgctttttagagagtcatggtttggcatcagcctatctacctgtattacaggattttattttttggagagcactgtacagtctattatacagaactttagatgtgaggacaaacaggaaatatttttctgtactttaaattccaggaaaaatatgtttctccagatgaaaaaaaaagtttatttcaaatcttacaggaattgtaaataataacacttatcatggtttcttttttcatttgattccaaaattaacccagaattaaagttttaattgacttttagtaaatacaggggatctctgtggcatatattatataaaaggtgctcccctgacttcatctgtttttcagcccaggtcctctcatatttctgactatttcccctaattttattcttatttttcttcatgcattatattcatatttataaaacaaattaaaatcctcctcaaataagaggcaaatatgcatacatactcacgtaaactttatataaataaataatgctcggaacctaactaccttggcaagttaattaatctctctgaactttatgtcttttaccttaaaaaatattaatggtacattcttcatgggtctgtgacatatataacagcatttgatttattgatatacagtattttaactgagcgcctggaacatagtggatactccataagtctggtccctttattgtccttttagagaacttgtaattttgacaaatttgtagtcagcagaaatattaatttgccagtaatcttaggaaagtggtgattccaattcttggcatgaggtgaagacttaaaaggaccttgcttcagcagatttaggttgaaacactaattagaacagactgtaacaatggaggagaagtagaatggacgcactatgctccatatataaatccatatagtaattaaaatatagtcatagctctcaagaatgacagctcttggccaagaagattcctgggctgaaatattaggattgctagattcagatgggatcttaaacaaatttcttgaggtaaatagtatccatctttgtgcctaaaccacatgatattttctcatagtccttgcctttggaaaggtttattgattcatagaacctttttaaacaaatgaggcaatgcagtctaaggaaaaaggaagatgggttcccaccaaccaaaagaagaccttctcccgctcttgctccacagcatggcatgaagtagatgtgtttttctcctactagctgaaaaagtgccaaactagaagtcctaaaaccttgatttccattatagctctaccacattctggctcatgaaccttgggaaagacaaggagtttccttataaataggggtaataatacacacaccacaaggttgctgtggagattaaatgaggtattatgtatgaagcccttgacacactattaagtgactctatgtgtgaagaggggaacgatagaaagaataaaatgcatagtgaaaccaagtgaaatgatgaagttgtttttgtaattttgtaatatatcaacttggctaggctgaactacatttcccagaattttgtttcctgtatgtttccagctagggtgagccacaaaaaaagattcctgcgggagatttgtgggtgtaagtgaaggagctgccattttgtaatatacacattgttgcttatctgctggctcaattcattggcgcaagtagtggttaggccaaggcactaagatatttttaatgtcttaaaataactttgtggtaatattccccgaaattctgggaaggggtaatatgccacctggcaactgtttattaaaacagacaatgtggaactttatgaaagagaaaagcaggacttgtaaaaatgaatggcagacagtgggtgctcacaaattatctttatttttgtcttaagtttctaaatctcagggacagctaaagagaacacatagaagagttttacttctttcttctgttctctggatcctactctcttccttacaacacatattactcttctgtcttcagaattttcaagttctcccattacactagatatttttccatgggcacttaaatgtgttcaaatatctgttccactttcaatatattttctctccagatatcattgtgtctccctcctatttgcaaacaaacctctcaaaaagagttttctctactctctccattttatcacctctcacttgcttctcaacttactgccaactgttttttaccgcttgccttaaggctaccaaagatatctacaatacctaaatccaatagacagttttaggatttggttagcaagacaatttgaaagacttagagacgcatcatacttcaaataccccaaactgaactcgccttcttccacctaaacttggactcttcctgcagtgttccctcccttggtgaatgacactgccattcactcagctgcacaaactatacatctgaaagtcattcttgacattcctctccctcatctccacacatgcatcagtcaccaagtcctgttgtgtctatctccaaaatatttttttaattcacccacacctccacgtctctaatgagattaccttaaatcaagttacagttatggctttttaactattgtctccttttattcaacagccatagtattctaaaatataaatctgctcaataactttgaaatggtgatcactgctatttaaatatcatttcagattcttaatgttatcctcaaggtcatgtttggtatgtttttgtcatcatttttatcttgtcttcttggctctgtgttcttctgtcaccctgactgtgttctgtcttctctcagaatgcaaagcctgattcctctgtttgtaacagcattttcccacaacttcatcatttattttacctaaccaacttctactaatcattaacattctcactcaggtttaatttatgttagatcttcctcaacctccctgattggtcagatagctgatataagatccccccactctcattcctctcctccatagcacttatcaaaatcataaccaaataattaaatgctcaaataacctctaggaggacagagggtgtgcctggtttgtttcttacttcattagcacctaacacaatgtaagttctcaaaaaatctgaattaatgaaggtgttgatttaatcattattccaattccacaatacagtatttttaagtaaatatttccttctttggcatctgagtaaaatatcataacatcaaaaataatccaatgtataaaaatgtaccaaagtggaagatttcagtagtcaactctgggttaaactactcaatgcattataagtattgagtagacatttgttaattgtgtgaattataaaggtgtattagactgcttacatataatgttttagcaataaatttgcattagtaaatttaaactaaaaaattctacttgcctgcatatcgtctccttttctcctactatgttcagctttaatttcctaattttgagaaggaaattgcacctttttttctcaaaacattttcctcctggcagaataactttgttgtcagggatgagaaaaatgctatttgctaaaaatatgaatatttcttattaaagtagataaactatagaaaattgctctcactgactccttagaagtgttgcctttagaagtacagaatcagagaattaaactcgagaccttagaaccatctgtcaaaccctagatctaccactttacatcacaccagccacctctgcaacccagagtcagctccctaaagagttgtgaagctggttattgtacagttaggctcactacatcaatttgagtcaaatgcggtttgactaggttgtcaatacttcatgtgaaaagttcataccatttccaaagagaagtattaagggagtattgaagacctgaaagtagagacaaaaacagaaagatggagaagtttcccaacatcagagggtatgggacatttaaaaaaggacattaccttctttgcctccttttaataaccaatttttgaacatttactatatagcaagcatgacttctctcctgaacaaggtaatgtcttatgggaatgagtggtaaatgcataagccctactttagttcacagtgtatagttctcctaccccagaaaataggatcatataagatgatacaagcatgagtaggatgttctggcaacagagaacctgtgaatgcttcttagaggtgttgctacttgtgctaggatttgaaggacaagtagatgagccaagtgatgaagagatgacaggatcacaggaagggaggaaagagattatatgaaggcaaaacggacatccgctattgctgtagatgtaatatttgtatccctgcaaaatttatatgttgaaatcctaaccaccaagatgatgatattaggaagtgggacctttgggaggtgactggatcatgagggtagagctctcatgaatggaattagtgccattataaaagagtccccagagaagtgcctttccccttctgccaagtgaagacacagcaagaaggtgctcaaggcagaccttcacctgacgccaaatcagctggtagcttgatcttggattccccagcctccagaactgtgagagataaacttttgttgttataagcttcttagtttatgatattttattatggcagcccaaaactaagaactatggttatagctttagagagtcattagtacaattagagcatgagaagaggtaagatgaagaatcagaaattttaaaaaaagatcacaaaggaccttcctctcaaagccactaaagatttgaagtaaatgagacattgtataaaaatcgtgccaaaagatagattagaagggttagtgtatcctgaagggacagaacatgacttgcacctgattttcccagcatcttgcatagtgtccaaatgtgtcactgttcaataaatatttactgaatgttatacctgagttacatcaaacagaatcctgttgaattatcactaagtgaaaactagattgtcaatacttcatgtgaaaatttcacattatttccaaatagaaggattaagggagcactgagaacctgaaagtagaagcaaaagcagaaagagaagtttcacaacatcaaagggtatgggacatgaaaagaaaagggttaaagcacctaagataaatgcttcagactcagtttttgtttgtttttggttttggtggggaaagcagtccactttatccatttctatagcaggaaattgtaattaccacaaatgtacataataaagaccagctttttctaggcactgaacaacatgctttgatgcactactattcattcacaaacatttactgagtatccaccatatgtgaggcattgttctaagccctgtggatacaatctgaatcacgaagcttatatgctagcaagaaaactgagaacaaacaaagaacctgtataagacaatcccaagctaagaggcagcaaaacatagttgttaagagcatggcatttggaaacaagactatctggccttaaatgcttacatgatgacttgctagctgtgtgactttgggtaagttacataatggctgtgtgccttattctcttacctgtaaaatgagatcaatagtaattatctatctgatttataatcatgattaaatgagttaaaatatataaagagcttagagaagagtctggaaagtagtaaatattattaataaatagtattattgatgttttcttattctaattattattatcaataacttctacaaagaacgctcaaaggaggatcaagggaaagaggatcagataatgccagggtagagaatgaacatagaaagaggaaatttagacagagggacctggaaaagtatttttaaaaagatgacatttcagcaagtgacataaatgaagtgcaagaatgagtcatgtgaatatttggaggggactattccagagagagaagagaaattgccagaaagttcaagggctattgggtagaaatcagcttggtttgatgtgctcaagaatgagtaagagagttgcacgatgagaaatgagtgagcaaagaatgtaggtggagtaagaggcgaggtaggagaggtgagcaaaaagtaattgatttggagcctcatgaggaatcagattttacctgagactgagagaaagccaccaaagggctatgagccgagacagcacagtctggatgtcttcttaaaaagatagctctggctgcctgtagacagcaaactacagagggatagaagacataggaggcaattcctgttgtctcatttaatccacacatcaacatgtgagatatacattactgttcctattttacagaaaacaccatgagccttggaaacataatgtatcaaaaggcacacagatgttttgactccaagtccatgtatgtcttcctctcctcaggaaagccttcaggaacctcgctgaccaggtcataccatcctattacatgttttcaccgcagcattttcctctccttcatagaacctatcacagtttaattttacatggttgggtgattatgtattttatgtttaagagcaatggcagtgcttgtgtccccaaggcacataaagcaggtgctcaggattacttgttgaatgaacaaataaattgtactgctaaaagtagagggggcagaatgagaggtctgtgaacaaatatggtaataacatgagtaaattaaaaactgaatttcacacagtaacaacaaagacccactattcttgactacctgttgtttcttttctaaatataagtattatttttcaaattattactagtgaaagtaagaaaaatatttattttccaaggcaaataaaaacaaattatttttaaatctttttttaatgaaggcattaaatgaaacatgtagtaggtaagagtctcaaatttcttaatgtacaggagggttattgtaataattttctagaagttggccacatctagaattaaaacattggtatatatacctacctggaaacagacaaaaatgaaataaaagatttctacatatacttttatagtactattataatactacaatgacaattacccatattttaattgtgctttccaatctacaaaaatctgctccgtatagtatctcattgctcattcagaaggtactcaacatgtcagccattatttaaacacatacatgtgtgcaggcacacacacatactcatgcacactttctaaatcatttctgcagctatgtcctttgcagtggccttgataaaagctgactgtggcattttattaaatgcagccctcattaagacttggcattgtttgaagccactatcagatgatgctgagctcagtaagggcacctgttcttataacttctgtcttcatcaaacagcaagtcccagtatttttttttttttttttttttagagctgagactaaaagcaaacctactttcattggtatatgaaaccgatttccatgccttcattttctttttttgtgccaggtaataagtagataaaaatgattctctgttttcaactctaacacctctgaaattaagccctggggaagctagtgataactctgaggtggtaacttctctctaggttatttggaaaaataactctattaaccacccaggaacaaagacttggctattatcacacatacatattaaatggctgctgggacacagtgaagaggtgagacatagtgtcaggaaatgttctgttccagctcccacaaataggacatactcagttttataactgaatgacttatgtgtaataccattagaacaaaaaggtaataatcattttgctgtataataactaattaaatccaacagcaacctatcagatgttattatcctccaaatcccatttctacatacataaagaaattgagggacatatgaattaagcaacttatccaaggccatgcaactagaaaataaaaaagctgagatttcaacccagatcatttctcttacattgttctttacttgtcagttttatgggggagagatacagcatgtcaggttgtgtggagacatgagcatatgagtatatataacaacaggcagaagaattagaacttaaacccaggtgtatctgaccccagaatttgacctccatggccaagaaaatgattccattttcaatacaataatatgcttccctagactgaataagcctttaaacatattctttttctggagtattacaaattttctccaagttggattgaggaacaaatatattccaaagaaatggtaaaactgagaaatgaatcaatatgctgttgttctaatctgtaactccctggttgtgctgtatttcttaacaaatctcattgaagcagatttacctttaatcttaacaccccatctctgctagacgaattaactcttttggttcactgcagaattactgaggaattggttggcttaaaattcattaatgttgccctgaaaatataaaagagttaatacatttcccgaaatatttgctgttattagcaaaggttacgtggcctgaaaattattgtctagggtgtctggaatttagtttttccaagtgaaaaaaagttcaacgactttcagagagtttatgaaactaaggagaaacaattctcatattttaggaaatccccaagcttccttacaaatgattcttcctaaagagatgtcaaaaacagtgcttattacactttgggcttctactctaatttatttagcccttcctatcaatgagtgagggataaaatgtcatcctttcttcttaagcatattagagcttcctatggctccctacactaagataatagatcatcctactattaatctattaagataacagattatcctattatgctttctccacagtaatacacttggttctaaatcttggcaattcagttcatcgaactctgataatttacattttacagtaaatttcctgatatatttgatgagttaattcttaagactagagaaaaaaatagcttctaaaactcttacacaaagaaaatgcaattggtagcttagtaatgcaatctattctagtttctaaatgtgtaattttaccccatcaccccaaaactattaatgggatgcaatcaatcgtgcaggtgaacaggtatcttttcaatgaaaggaaatgaaataaatatgcctctgaagggacaaatactaggaaaatatgagaagatgagagagaaaatgccttatagccacattatctcaattttttttaaagaaatccaattctaaaaaaaatgtgattataggggtagaaggcttgaaaagtaaaggtttgaagaagacaatcaagggaatagaaaagaaaactggttaaattcaaataaattattaaatcagatttgagggccaaattcctacttatacttccaaggctcaaataaaatctcacatcctcccaaattagctacgagggaaattgcccaccaactataaataactggaaaacaagaaaaaatatatgattcaacaattttcagtcatttgatgtccctatcatccatgagagaaaggaaataaataaggtgagctccacaattgccccagcttactgcctggaggcagttttcaggaaagagaaagaaatacgggactcaaacagagtctagtttctccaatgcactgaagacagaaattgttttgggtagccatggcaggtagaatttgtggtcagaataccagggttgaaggataagaaggactatcatgaacagacagagagtcagagaggtacaagtgtggattatgtaatcagttcctgattatcacccataattaggaaaaaaatgaattaatagagaaatgacagagataataaaataggtaagaatgtttaagaagctaattttaaaaatgtgctttacatatgtaaaaatgtatacaaaaacataaacaggatgaagagtatgagagaaatggaagatttttaatgaaccaaatgaaacatataaagataaaaaaagatacccaaaatgaaaaatacactagatgggatcaaccacagattaagatgctgcaaaagaagaaaccagttaactcgaagaaatagtgacggaaactgtttaaaacacagagattttaaaacactggaacaaaatgaacagagtgccagtgatatgctgaatgataccaagtacagtcctagaaagtgggagggaaaataaaaacactatttaaagaaataatgaccaatagttttccacatttgataactataaattcacagatctaagaagctcaaaagccccagtcagaatgaacataaagaaaaccatacatcatgatcaaattgctgaaaaccaaagacaaagtgaaaaatttcaaaagcagccagaaaagaaaaagcttactttccataaagaacaaaggatgacagcaacccctcctcataaataactattcagatcatatggcagtgacatctttaaagtcctgaaagaaaaggactgtcaatctagaaatctataacctgcaaaaatatcatttaaaaaggacaaaatcttataatattcattgccagcaaatctgtaccacaataaaggtcaaaggaagatttgtgggcaaagaaaaataacgacagaggaaacgtatatctatacacagaatttatagctacaacaaagaaatgaagaacatcagaaatgatcaatatccaggtacttatatttttgttgcatttttaatctctttaagatataaatgactatttaaagcaaaaatgatagtaatctattatatgacttacatagagaaataaaattgtgcacaagaggtatgtgcagagttaaaagcatattattgtgagtttctcacattatatgtgaagtggtataatattatttaaagatagactgtgataaattgtataaaccctagtgaaaccacataaaattaaaagaaatataggtaataagccaatagttgatctaaaatggaatcacaaaaaggctcaactcaaaagcaatcagggaaaatgggagaaaagaacagaggttagcagtagaaagcaaatagcaagataacatatttaaattttagcatattaataattatatcaaatgtaagtagtctaaactcttcaattaaaaggtagagattgatggattgaataaaaaagcaaactagaaaccaaacttaaatataaagatacagtataaacaccacaacagttgaaattcttcaaggatataggctttatctgattcaacttgtatttctcacgcccagttcagtactagtactcagaatctactaaaagttactccttgaaagagtaaatgccttcataaagcagtctaatggtaactctaagaaatccctggtgaattaatcacttcctccaaattaataggttcataagaagagttgttataacagctgcttttttaaaaatcagggttttaattcagaagacttcacatgtctggcaagtgtttgttctatggggaatttatctacctcacctgaaaaccagaattcaaataatcctcttttttttttaataattttttttttattattatacttcaagttttagggtacatgtgcacaatgtgcaggttagttacatatgtatacatgtgacatgctggtgcgctgcacccactaactcgtcatctagcattaggtatgtctcccaatgctatccctccccactccccccacctcacaacagtccccagagtgtgatgttccccttcctgtgtccatgtgttctcattgttcaattcccacctatgagtgagaatgtgcggtgtttggttttttgttcttgcgatagtttactgagaatgatgatttccaatttcatccatgcccctacaaaggacatgaactcatcatttttgatggctgcatagtattccatggtgtatatgtgccatattttcttaatccaatctatcattgttggacatttgggttggttccaagtctttgctattgtgaatagtgctgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgatatgatatctcattgtggttttgatttgcatttctctgatagccagtgatggtgaggattttttcatgtgttttttggctgcataaatgtcttcttttgagaagtgtctgttcatgtccttcgcccactttttgatggggttgttggtttttttcttgtaaatttgtttgagttcattgtagattctggatattagccctttgtcagatgagtaggttgtgaaaattttctcccattttctgggtttcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaactgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccatgatctatatctctgttttggtaccagtaccatgctgttttggttactgtagccttgtagtatagtttgaagtcaggtagcatgatgcctccagctttgttctttaggcttaggattgacttggtgatgagggctcttttttggttccatatgaactttaaagaagttttttccaattctgtgaagaaagtcattggtagcttgatggggatggcattgaatctataaattaccttgggcagtatggcaattttcacgatattgattcttcctacccatgagcatggaatgttcttccatttgtttgtatcctcttttatttcattgagaagtggtttgtagttctccttgaagaggtccttcacatcccttgtaagttggattcctaggtattttatcctctttgaagcaattgtgaatgggagttcactcatgatttggctctctgtttgtctgttatttgtgtataagaatgcttgtgatttttgtacattgattttgtatcctgagactttgctgaagttgcttatcagcttaaggagattttgggctgagacgatggggttttctagatatacaatcatgtcatctgcaaacagggacagtttgacttcctcttttcctaactgaataccctttatttccttctcctgcctaattgccctagccagaacttccaacactatgtcgaataggagtggtgagagaggacatccctgtcttgtgccagttttcaaagggaatgcttccagtttttgcccattcagtatgatattggctgtgggtttgtcatagatacctcttattattttgagatacgtcccatcaataccaaatttattgagagtttttagcatgaagcgttgttgaattttgtcaaaggccttttctgcatctattgagataatcatgtggtttttgtctttggttccgtttatatgctggattacatttattgatttgtgtatattgaaggagccttgcatcccagggatgaagctcacttgatcatggtggataagctttttgatggtgctgctggattcggtttgccagtattttattgaggatttttgcatcaatgatcatcaaggatattggtctaaaattctcttttttggttgtgtctctgcctggctttggtatcaggatgatgctggcctcataaaatgagttagggaggattccctctttttctattgattggaatagtttcagaaggaatggtaccagtttctccttgtacctctggtagaattcggctgtgaatccatctggtcctggactctttttggttggtaagctattgattattgccacaatttcagatccttttattggtctattcagagattcaacttcttcctggtttagtcttgggagagtgtatgtgccgaggaatttatccatttcttctagattttctagtttatttgcgtagaggtgtttgtagtattctctgatggtagtttgtatttctgtgggatcggtggtgatatcccctttattattttttattgcatctatttgattcttctctctttttttttaattagtcttgctagcggtctatcaattttgttgatcttttcaaaaaaccagctcctggattcattaattttttgaagggttttttatgtctctatttccttcagttctgctctgatttcagttatttcttgccttctgctagcttttgaatgtgtttgctcttgcttttctagttcttttaattgtgatgttagggtgtcaattttggatctttcctgctttctcttgtgggcattgagtgctataaatttccctctacacactgctttgagtgtgtcccagagattctggtatgttgtgtctttgttctctttggtttcaaagaacatctttatttctgccttcctttcgttatgtacccagtagtcattcaggagcaggttgttcagtttccatgtagttgaaaagaccaaatctatgtctgattggtgtacttgaaagtgacggggagaatggaaccaagttggaaaacactctgcaggatattatccaggagaacttccccaatctagcaaggcaggccaacattcagattcaggaaatacagagaatgccacagagatactcctcgagaagagcaactccaagacacataactgtcagattcaccaaagttgaaatgaaggaaaaaatgtgaagagcagccagagagaaaggttgggttatccacaaggggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaatactttacggacaagcaaatgctgagagattttgtcaccaccaggcctgccctacaagagctcctgaaggaagcactaaacatggaaaggaacaactggtaccagccgctgcaaaatcatgccaaaatgtaaagaccatcgagactaggaagaaactgcatcaactaacgagcaaaatcaccagctaacatcataatgacaggatcaaattcacacataacaatattaacttaaaatgtaaatggactaaatgctccaattaaaagacacagactggcaaattggatagagtcaagacccatcagtgtgttgtattcaggaaacccatctcacatgcagagacacacataggctcaaaataaaaggatggaggaagatctaccaagcaaatggaaaacaaaaaaaggcagaggttgcaatcctagtctctgataaaacagactttaaaccaacaaagatcaaaagagataaagaaggccattacataatggtaaagggatcaattcaacaagaagagctaactatcctaaatatatatgcacccaatacaggagcacccagattcataaagcaagtcctgagcgccctacaaagagacttagactcccacacattaataatgggagactttaacaccccactgtcaacattagacagatcaacgagacagaaagtcaacaaggatacccaggaattgaactcatctctgcaccaagtggacctaataggcatctctacagaactctccaccccagatcaacagaatatacatttttttcagcaccacaccacacctattccaaaattgaccacatagttggaagtaaagctctcctcagcaaatgtaaaagaatagaaattataacaaactatctctcagaccacagtgcaatcaaactagaactcaggattaagaaactcactcaaaactgctcaactacatggaaactaaacaacctgctcaaataatcttctaagtcgaggaccagcaaagtttttcaacagaggaggacaaaatagtaaatatttcaggctttgcaagccatgtgatctttgcagtaactactcaattctgccactgtagcacgaaagcagccacagatgatacagaaatgaatggcatggctgtgttccagtgaaactttatttacaaaaaccagcactgggacagacttggcccatgaactgtagttgtcaagtcccattcaagcaggatgattgtttgaagtctcgacggctgtgtgctagggtttgaatatttgtttcatctgaaattcatattggaacttaatccctaatataacaatattaagagctgaggcctttgagagatgattggatcatacatagattaatggattaatgggttagtgaagtaatgggttatcatgggaatggattatttatcacaagatgagtctgttaaaaaagtgagtttggctctcagtgtacccctcttgccatgtgatgccttcctctatgctatgacacagcaagtggacctcaccagaagctgaccagatgcagccacctgatgttggatttctcatcctccaggaccttaacgaataaatttattttctttatcaattatccagtctcagatattcagttatagtgacagaaaatggactaagacactgtgttatctattccgtaaatgatacatttatcaccactctagaaagctttgatcagagcccgtaatagatgcacacatctctttatttatacttaccctgtacctacattttctagttaatgcaaatagaaaaggcaagatctcagacactgacaggtaatttactttctatatctaagatctccaatgctgttttgtgcttttattgtattgtcacagtctatgcagccagtgactttgaaaacaattctaaactataaaagtgcctgatgttaccactatcagctcttctcatttttcaatgggacagaaggtttggtcaattgtatttattcacaacatgtaatatatgttctttttatatgctcaatctactttttcaaaatatcttattttagcttttttttcccagcatatcacaactttctacctcacattcttataattctctcatcttcttaaaattactaataaaaacaatgtattctatgtttgcctattcttcatggctttctatataaatattctcccaaggtaaggatttgagatttcaagataaacggtcactaaaaatagcatgtgctcaaaccatctactagatcaagtaaacatgtcctctatttaaagcaaattgctcattcagagaaaagggtacaattataaaggaagatcacgtatttggtgttaacatgtggtctaagttagatattaggagttcaggctttagatgcatcctggttgtatttattagtggcaatgtaacactaagtgagttatttatcttttatgattctgtcttattatctattaaatgtgaacacaaggtatacctcattaaagatgatgtgagatcaaatgagataatgcatgaaagtttagtagagttctgctttataataagtactcaataaatattgtgttaatttttaattttatgtgtttgaaacccaataaatattcatcaagtaacagacagaaaaagtatatttgtatatagtctagaactagtgtcttaccaattatttttatttccagagtccagtatactgcataataactagtagctactcaaaatattttttttgaaattgaagttaattacttctccacatgaggtaacgtattcacaatgtaatggctttgccttgttaaatcacgtatccatcccattagccaagagtataatttgaaattttcaatttgattgctccaaaatttacatttttatactgcaatatggccgtgttttatacattaccttatataacttagataagtttatttaaatacacaaatctgtgagtttaggtattattaacttagaaatgaaaaaaaaatagagagctccagactccttatcccagccaccacagttggtttggaacttaggtttgttatgctttggaactcattttttaaaccactgtgctactctgtctcttcaaaaaaaagtataagttcctgtaagttattcatgacttcaacaagaatgggaagaaaatgttaatatttctcatgcattaaaatacttaatttattagatctcatgacaacagtttgagacagatgtgatcatttctacttttcagatgaggcaactgaggcttagagaggctaacttgttcaatgtcatacaaagcttttcttggggggagatggggcgggcagacatacacacaaggaatagcttcatttactttaactgttttgttgaaagttggcccctgaagtaacttggcacttggctctctattcaataaaaggcttcatgccacagacatggttggagcattaaaaatatgcccttctgaaattttgtaatgtgacataaagattgctggttggaactgctgtataaaacccttcactgagaaaccccagggtcagatacgctaacagggaacacagtttgaggatcataagaaaggatatgaaatatgtattgagtgctgaccatgtgccaggagcatgcagatacatttgatattcacaacaatatatggggtaaactttatcccttcaccttactaatggggaaactgacattcacagaagctatttcacttgttctaggtccctctgctgctaaacaataaaaccagcttttgaatctgtttccactaaaacaccacaaatgaacaacataaataattataatgctgaagagagagggtatttacctcttcttcctgagatgagaatgttatatcttacaaggaagaggatatcccctctttcttggcaattatgcacttcctcatatgcatattacaactgtttgacatatacaatccattcatagactcgaatatataaccgtttcacagatctgagctgcctctcacctaaaagtggtatagggggaagttgtattttttttcaactttattaggtacttaaaatccttatgaaaatttgaaatattattcatttaaaagtggaaaaataaactatgtaattacacctttaaaatccaccatttccaaggaatctcctagttttccccaatttgaaataaaggaagtggcatggtaatagtaggaagtttggggtcagacagataggtagactaggtctaagttctagcacactagcaactaattaaatgattttagaaatcacttatccacataggattttggggagagttgactgatgctgaaagtgaggtgcctaccacagtgtgtggtgtacagtagggcctcagaaagcatcaaatcctttttaccactatgagaaacacaagacaggtttcttcttttattagcattaataacatatgtgtgtattctctcccacaagagtactatttctggaaagcagtgtctgactctttaccacctattaggtctctgcgttataggttcgttataggcgttcaagaaattattggtgaactgaaagtatagggagtaggttcctgagccagactgaaaggaaccaaagttcaaagcaaaatactgaatgctgatagttagcacatactaataaagaccactataatcgtacatgtgtgggcaggtggtgggaggagggcatctaggggtctattttatcaaaggttatatgttggagaaatgtgcccaccacattctcagtcactcttcacactttccattctggcttttttataaatccagttgcctacttatgtccaaaggaccaaagtctttttgtcgctttagatctaaagaggtcagtgagatgtgaataatgtttctactggttctttttcagcctttggtttactttactaaaaagaaaagacaagctgcgattttaatatggcactatttcactatttataaataagaagtcagataacacaaatctctttataaaccaaaagaaaaaaaatacatgtagtatacaaaatcttttttttttttttttgatagcctctgtcacccaggctagggtacaacagtggcacaaccatggtttactgcagcctcaaccacccaggctcaggggatcctcctcccacctcaacctcccaagtagctgaagttacaggtgtgcaccaccaagcctggctaattttttgtatagacggggttttgcccttttgcccaggctggtctcaaactcctgggctcaaaagatctactcacttcagcctcccaaactgctggagttacagctgtgagccaccacgcctggccacaaaatcttttctaccagcacagcaaacttgcttattctattggtcagaatcgacatactactaagatcaattaacattttaaaatgtaagattaaacatggcctaccaaacctcttccctcccaaaaaagattaaacattattcctatacttctcatggtgagctcaactggttagttaacaaaaaagtcctgatataatctatgaaaattttctacttttagaaaacttttgtaaacgtactttaaatttctatgagaaaataatatctcctgcatggtatataaggaagatttatttcatttcctctcagctagtctctaattttactttattaaaaagataacccacttcacggaaaagggcagtcattttgaaaaatcataatattctgaaatggctgtattttagtatgtgattttaaaaaattgcatgttcagatcttcttgttaggtgtcagacctttggcatttactttcaaggattttaagcggtaatttgtgtaaagtatatttacatttaaattaatctgaaaaatgcaaatgaagacataccaaacagtataaaacttacgacttacatttagattcatattgtacataggtgcattaaagtattgtttggtaatgatggaatccaatccaattagaatttttaaaattcagaaagcatctgaagtgtgttaataaattcacagctttataatattaacatcacaatttcagtgttgctttttatttcacaaaataattatgctggaccgcatatgcagattctaattatacacaacaaagaaagacttaaattggacctcctgaaaaggcccatttgcttataaaaagctgtgatgatttgccatcacacgaaatttgtatttaataaataaagacagaatgtgtaaattagctttcagtgtctttgccctacagcaaatccaaaattatggaaatataaaaattatagctttaacttcccatgaactatctgtgcattgcttcaatttgtggttgcttagaaacattataggcaaaggaattgattctttccagatgctactagtcaaaccacattttctgtttttgatttaaggctattctgtttaatagtgttataaatatacatttctctaaaaagtcacaaatgacaaatcaagttctgttagtagtgcatctcgggaatctattccttcttaacatggaaaaagtattttctgtgttcagcttccattagcttaactaaaggtaaacaatgttgaatgttattactgtcatttattcccaagatttagtccactagttcccatctaagtttgtgattcagtagcttggtagcactgagacattcacattaatttatcaaatgctcattgagagagacaatcaccttaccaaatacctaaaaatatagcaagagatgaaaccacgagagttactggcatatgtgaataatgaacttaactaataactacagactgtacttgggtggatactttagaaaaataactgaaggaaagagagacagagagaggcaagagaagagaggaatgagatggaagcaactgagtcctaaatgtgaacttttttcagtttgtggaggaaacaaatgcaaggccaacgttcaaactccagacgactatctggatgatctcaacaatgttacttaatttctctaaactttgttttttccaattaagaaacagtcaaaaaaaaaaaaaaacaaaacaaaaaaaaaacccaccaggcccggcacggtggctcacgcctgtaatcccagcactttgggaggccaaggcaggtagatcacctaagctcaggagttcgagaccagcctggccaacaagatgaaaccccgtctctactaaaaatagaaaaattagccgggcatgatggcacgtgcctggaatcccagctactcaggaggctgacgcaggagaatcgcttgaacctgggaagcagaggttgcagtgagccaagattgtgccattgcactccagcctgggtgacagagcaagactctgtctaaaaagaaaaaaaaaagaaaagaaataccagttagggtgcttgtggggaaaaactgaaataatgactagtgaaggaggaaacttgcttatcaaatactgtcagaaagtaaataatcgttgaattatcacattgttgaaacatcaaagatccttatttttaacttttagtttctaggagttgttgattatttttaagatgttcttaaaatcccccaaattcctttcaacttctgtttttctctaaagtttgaacaaaatatgtatactttcactaaatttctaataatgaagatcaaaggtaacactggatctaatctcacaaaatagatctaaaatataaacataaggatgataattttctcatttctgctttgtaaaaatgtatatgaaaagttattttgagcttcttgatactttacatgaacacatttgctctgcgttgagaggttcctcctgcttttttcacaggcagaaaaattatttgctttaatgaaaacccaccaaactgagtcaaatcccaaatagcttgcttgatatgttccttccaaaattatttgtttcatggggaaaaggatatctctaggacccattccttatagtccttcctgggttttaagcctccacatgcctgaaatcaagctcagggaactttttccccaaaccagtttctccaactattctcctaactcaatgccacagtaatccacccaatttgaacacttcaggataattattgattatttctcaccataacccataatgttcaactgtctctctgctttaattgattttatgttctaaagcaagcttgttcaactcgcagcccacaggctgcatgcagtccaggatggctttgaatgcagtccaacatgaatttgtaaactttcttaaaatataatgagattttttaatctgtgattttttttagcccatcagctgtcattaatgttagtgtattttatgtgtggcccaagacaattcttcttcttccagtgtggcccagggagaccaaaagattggacacccttgttctaaagaatacctgaaattgtcaccttgttgggcattcttactaccactagcttgattcatatctcatcaactctggcaacaccttccaaacttatctctctgcctacagtcccttcccagcttcatttttccccctcaaactaagtaacttgtaactacatacaactatatcaaaacctttgctggacacataaacactagagtctaaaagcccaagcttcttctcatgacacttagtctttcccatcttcaccaaacatcatatggattctcatctactgtcctctctcatgcaccccctactccaatcacagagaactgtgtattaacccctaaatacaatatgtattttataatttcctgtctctacaaatgtgcttgagtctcagattttaatggactattgcccagtttctccagctggtagacttatattcaatacccaaatttaaagttactacctcgagaaactctgtctttaaaaagctgtctccaaagcaagaatacccattattttcaaattacccacagcacatcttccatattctcattataacacttttcatagtggactgttattaactgattatgtgaataattctccaaagagactgagttctttaaaagaagggttcttgtcttattaatctttgtttaattagtgcttggaactatatctagcacatgatacaagacatatgatttctgagtgaatgaatgcatgaattaactgctataattattgcgctgtttttgttcaccaactggttctttgaaaacaatatatataaaacttaccaactgacaatgctgctgagtctgataacatggcacaccatgttaatgtcattttataatacagactttacatttagttttttataccttaatttatcttctataaatgtgcaataaaacttatttaataaaacattaaaaatcagggtttttaaaatgtggatatctatctttttgtctacagatagactgaatattaaaattttgatcatctgactttatccgttttagtattaacctaaaggttgcctttggaagagcaactggaatatttttttttttaattacagtgttagctggccatattttaatactgattgttattgaggctagatccttgctacctaaaacaacatctctacctctgctttgtcatttatacatttgcttttccattatgttacacacatttatcttagattatcatacatactttgtaagcagaatatgccttctttggttgttgaacacattattgcagagcctttcttttgtataacttattaattaaatcctgttcaatgacttgtttgtgattattttcataatttccatttcatacaaacttgacccatttgcctcttaaataagcttattgtactatgttgatgtcttcatttttttccacgtaataagatgttgataaaatataaggtcaggaagagaaatagccatgttaatgtgttcacaaagtattcactctaagtttgcttaaattatcatcaatcttttctttggcagctaagaaattcacttccatagagctttaattatctctctctctctctttttaattcttaatttttattattagcatgacttaaaaacacaaatcactatttgacaaatgtcttattacccatattagtttttgctatgtaaaggagattgaggataggcttgttatttatcccaactcagattctatggatgaaggcagggaggtgaagggatgaaatattaaaaataaattttaggaaaatcattctagaaatgtaggatcacattgaccttaaaggataaacaggaacttaaaaataatgacatcactaaagatagactagggtttaaaggactgagaaattcaattttgaatccttactaaattaagatctactcttgtgtccatatggaaggtacttatattctagaaaaagccaagtctaaaaacttttcatgaacccaagaaatacgaaacccaagtatagtgatgtggttagtattcttgatttttatttttgatttataatccttctctttataaaaacaccttgaagcttcacattataaaagccaaaaacctaatggaaaattaaaaaaaaaacaactcatttcagcacaggaggtagctagagtggcaaccatttactatgaaaattggcaattaaaaagaattaaacatcttctcctacacaaactgagcatcagagtcatctaaaatcttcgtctgtgaggaaaattttttcagaaaattttcatctgataaatgtagattaatgacagaattagaaaatcaccaaatggcaaattatgttgaaaaaatgttaaaaggcaacaatcatcaatagattgtaaaagatattatgtgaaaagactaatggggaaatttgtaatgtaagggtcaggctgacaaaacctgtaccaatgataaatttcaacatcactaaaattatgattaccagatatacatattttctgatttaatgtaatacaaattacatgcaccatctgtgaagtatccatgctaaagaagttgaatccaaatataatccaggctttatacttattttttagtttatagaaaatatgaagaatagaaaaacattttatacaccaaaagaaaacaattctataaggcaactgtcttagttttcaagagtcattggtatcattaaattttaaaaaaaggaaggacctattctagattaaagggaatttaaaagaaagcaccaccaccatgaaaggcaaaatgttgaccctgtttgggcccaaatttaaacaaaccaaccataaaatgacatttttgaaataataaggggaatttgacttatattcaaatgtattagataatagtaaagacaaattggtaactttctaggtgattatatagaaaatatctatttgtatggttatatacattagtattataaaatgtagtaattgatattagaactctaaaatattaaaataaaaacataaaaagaaagaagaagaacaagtttaagcaagtttgacaaaatgacgattatagaatctgagggtacattacatcgtatctactattgtattgacttctatatcacaaaagtctgagaatgtttatgataaaaaggttcaaaatacaaggtgaaatatttaaaacatatatattttaatgtttaactaatttgaacagaaagtatgggaaatcttgtgaagccaaaaataaatccagaggtggaactaaatactgaagccaccagcttcactggggacatctgccattcacaatcacctaaacagttaatctaaatgaccttataggaacaagagacttagcctagggctcacacaagttgaagagtcagaataaagattcctacagagagctgaaagcccaaatcctcattctatcactgaaagggcctactaggaaaatacctattccactggctatagactgaatgtttatgttcttctgcctccaaattcatatattgaagccgtaacactgactgtggctgtatttggagatggggcccctaagaaagtaattaggattaaatgaggtcataagggtagggctgtgatttattaggattagtgtccctaaaagaagagacatcagggggctggtttgctctttctcttgctctctgtctttccttctctggatgcactgcatacacacatcaaggaaaggtcatatgaggacacagtgagaaggcagccatatacaagccaagaaaaggttcctcaccagcaacctaatttgctggcaccttgatcttgaatttcccattctccagaattgtgagaaaataaatttctattatttaagccattcagtctgtaatatttagtcatagcagcctgagcagactaatataaccagaaaaaagatgatgaggatatttatcaatcttgggtctgacactcaatggggggaaaaatctcgcctgagaatttgtaatcacaacttggcccttttttaagatttggaactcaaattcacactgtgtgttctaaaaaccaccaatataagagttcaggccaggcgcggtggctcacacctgtaatctcagcagtttgggtggctgaggtgggcggattacgaggtcaagagatcaagtccatcctgcccaacatggtgaaaccctgtctgtactaaaaatacaaaaaatacaaaaaaaaaaaattagttgggcgtggtggcgcacactggtattcacagatactcaggaggctgaggaagaaaaaatcgtttgaacccgggagacggaagttgcagtgaaccaagatcgcgccacttcactccagcctggcaacagaggaagactccatctcaaaaacatctcaaaaacaaaaacaaaaacaaacataaacaaacaataacaaaaaaaaaaagagtgtaaagttgtccccaggtgtctggaagaaacaaatacacattatttcttttgaaactcaccttcaacccaagtctcaaagaattcccatagataaatacccagaagacataaactctaaataaatggggaaacaataaatccagccacaaaattttcaagaaagtgaatcatcatgattgagaatcagcaaaagaaaataacaaagtaaaaagctcaaacaattcaaagtgtaggataaataatatacaatatgttctaatatgttcaagacgtaaaggagaaaatgaaaggcataattaaggacaaaagactactaaaaacagagagctgatgtgaacaaagaaccaaataaaatttccagaaattaaaaaaaagtagctattgaaaatagcctttaaggaattaaacagcaggttagacacacctgaatagagcaccagggagtgaaaactagatctcaggaaatttctctggaagacaccacagaggataagaagatgagaaatgagatgaagttaagaaaagtggaggatggaacaaagtgattcaagatgtagaaacataggtagctcaaaaaaatacttttgagataattagaaaagaaatggtattattaaacaaatgcacacagagacaaggacaatacggtctgaggctcaggcactatttccctcttcatctgagtataaaccgtaacattattgaaagtatcttgccagtacacttttaatgagagtttcagtaatggaaaataggaaaagaggtattactaaaaaaaaaaacaagtttgctaagaattttctataacttaaatatacaagtccattgatttaggtagcacaataagccccaacagcatttatcataagaaatcaaacctagacttactatagtaaagctgcagaacaccaaacatacagaacagactttaaaatcaacccaaaaggaaaggtagattacctaaagtaacacaactaaatatggagtaagatggaatctataagagagtagagttacattttcaaggaacaccaaaaaaacaaaactagaattttgttgccatgaaaaaataagtatttcttcagaaaaaaagaataaaataaaaacatttttggacaaacaatgcacattttatgaccattactgaaatttcaaaatagatgctcatggaaacctgtaagtaataaaagaggaaaggttggagatactagaagaaacagaaagtacaattctgagtagcataagtgggagtcttgatctaattgacataaatccctactaatcagctagagaatgcactttcttttcaaatatacatggaacatttacaaaaatttaccctatactaggccatagttcaagcctcaacaaatgtcaaagagtctatgccatagaaacaatgttgttgaccacaaaataatgagaaatcaggaataaagaaatagctttgaaaacatatatatttttaaattttaaaagtccatttctaaataacacaggagttaaagaagaaaactaaacagcaataatactgaatattacaatatgtggaatgctgctaaaatgattgaaagaagaaaacttatagccttaagtatttacattagaaaaggaagaaaaagtatgaaaaccaataagcaaagtctccaaagtaagatgttagggggaaaaaaataaaagaaagttgggaagaagactgtaaaaaacagaacaaatatttcaaaagtagaaaataaatacaatagagaaaatcagcaaggcccaatttagtgttttcataacaaataaaattttaaaaattctggaaagatctctcaagaaaaagaagagtaccaggaacatcattttgcataattccaagagctacatttcatatcatatgctacataaatggtgtatttatgaatatattaatggactgtgatccatggaatctgattcatatagaataatacattgttaacagtgtcccttaaagttatgcgaaaggaaggaattggggaatgtaaaaataatattaggaatgaaaagggagacatatcaagataggtaacagaaaatttgaaacgataataagataatactttacaaagcttttctctaccaaatttgaaaattaaaaaaaatgacaaatttcctgacaatcataacttattaaactttgctcaagaataaagagaaaacctgaataatcatataaatattaaaacagtgaataaaaagttttaaaatattcttacaaggaaatactagacccagatagttttacagacaagttcttccatttaaccaagaggtgaaaaatttcacacttaaacatttctgtagaatgaggaaaagaggtacactcaccagttcaatttcagaatagtataatgtcaatactaaaattaggcaatctcattgtactcatagatgcaaaaacacttactaaattttaccatactaaatctagctatatacatgttcttcattttataatataaattcatcacaagcaagttgactttatttcagaatgtaaactgggtttaatattagaaaatgtattaataattcagttcattaatatgaagacaaatttatactttgtttcaatttagtagtgataaaatatgtaaaacatctaactgaatgacagctgatagaagttcaataaactatttcctcctccctcctaaaatgctaatgaaccagtgtatcattttctgtggttataaacaacgaactctgattaactaaatcagaaagagtctttatcagaaggaatgtgggaaagctttagataaaataaccagatatggaaaaagcagctgctgctagaatgattaaattccaactgaacttagattgtctatctgcctcctgtaagggggaagcatctgcctgaaggcataggtttcagcctctgggattccttcagcttctggagcatggggacacctgtctggatttacagtcatatcaaaattaccatcagtgggagacaggtgattcccaagaggaaaatggagtacaatgaggaaaagaaaaatgaatgttgggcagacagaaagacaataaatatccaccctaacatgtttggctagaagcagtcctgacatggaaggaaataaacaagctcccacaaatcagctttcctgctagaaatcagtttaaccctccctaatctagttcttcgtcactggattaatgtctacagtggtgccagttctttctcctcaaaccagtttttttttctcagtgtttagagaaataggtaaaaccaccagacagctgtcatcaaactagtaccttctttgtacagatgatcaaataggtatcaggccagtttctgctaatgggaacacctttccaactacctccccagtcttattccagcataaaatctttacttattgctgatgaaaaaaattacccaagattatactatcattttaaaattggactgaagtagaaaacaatcaagaggctcctgtcgaatgagacgttaaatgataaaatatgttggggctcctggcctttgtctactcattcaaggtagtgatcagttatccattgcaagcctatgccaggctgtagatgagagtatttgtctcagaagttttgttttatcataaccatttgtccttaaataccaatttggctttctataaggaatttagcacatttacagaaatctcagtgctctttagttatggcatcattaaaaattaaaactcatatatcacctgaaagaagtctactggctttaaatacacaaaaaatactcaatctctctcctaccactaatgctatataattgataccatattagttgcacctcctctccagtctaggcgacagagcgagactccgtcacaaaaaaaaaaaagttcccatatccagatgctactctactgcttgaattcagtcttccatatgactctaggactatagatagcatctcatttatttcccttcctctcatcttaacctccttccatctgtcctccacattgctgccagaatagcatttgtaccatgaaactctgaccatggtgcttcctgcctggtattcatccatttttcccttggcttttggcatactccttaattcacaaaagaaggccctttgtgatctgaccccgacttaccttctcaatactctttcacttgtctacatttcagcaaagctgttgtcttagcatggttcattttcctattatctactcataaatatcatgtgttagcacggcgtccattcccccgagaagattttctggattatatggttaggttttcttcagctctgacacaccccaagctaagatgacgcctaatatttatttctctgttccctgctgtccatgcatttacctagtaccttctccttgagttgaagtggtgattggcatctaaataatataatatagcaaaggtgatgggatgtcaccctctttattaggttacattaaatggcaaaaaagatgggatatcatgcccatgattaccttacattatataagacacacttcttagaagattggagagagactctcatgttggccttaaagaagcaacagccatgttgtgaactgcctatggagagggctgcatggcagggtactgtgggcagactctagtagctaaggcatcttccagccaacagccaataagaagctgaggctctcagccatacccccacaaggaaatacattctgttaacaatccaagtaagctggaattagatctgtccttggcttagcctcttgtaagactgcagccctggattccagccagtgagacaatgaagcagagagtcctgctatgctgtgcttgggcttgaccaaaggaaactgtgaaataataaacatggtttgtttcaagggactgttcgtggaaatgtgttacgcagcatagaaaatgaatgcattaacagcccaagatgcttttcattgggctcctactgcacttttcacatacctccatcaagcagctgaaacttttatactcaaataaattgtttcccaacagataaaaaatttcaagagcagttactgtgtctttttttctagcatctagtataggaagctctcgatgacgctttttttttttttgcaatgagaaaataatttttaaaaagaacaaaagtaaatgtggaaagctggaagtgtatttattgaaagcattttatcattgaacatagagctatttcaacgttaataatctataagcctacatcttaaaaatttaaatataggaaaaccaaacagggctattatttaatgagggcctattatatacttggtgctgaactaataaatatggaaaatgcaactttaaaagactcttacataatttctcatggttcatatggaaaaatttgagctttatccaagcaacattagttaaatgtataaatcttcaaataaatgttgtcgaagatagttgggatagtaagctttgcaaaattaagctgccctagagatgtttaagctcacacttcagtccctcctattagaatgataataaaaggaattcaaatactgaactgcgtaacctttgaggtcccttttagttcaaagatttcatgatccttaaaactgcaatttggaaaacattattttgtggcaggctaatgaattatagccaatgacatgataactatattaaatatatatatattagaaagataactccgaaatgcattctcacgaaccctacatattcctttaaataaagtatctgcccaaaaaacctaagacatgttgttccagtaaaactggaactgggtgctgattttcctctatatgtgctgcaatgactccagaagccacaaggtggcagagtgttggtactgtgtttctaattcacaagacttcacaacaggagttcatgatacattcaaaggcaactttaactgagattttgaattcttccatctgtttccatgtgccaggtgcaggggttggatggagaaactgagatgtatatttggaggctcttgaaaaaggagatgacaagatataaaatcatgtgtatttaaagaaaaactctttgttggcataactcccaatttgcctctgacctcaaaattatcacagctcaacctgatcactgacttctccaatcatttctgtaacatttacccttccacacttaaactggtacaaattcgcgaatctaacactcccatttagatctctaaatcatctaaagcagtaaaatttttttaatctctttaaagagttttaaaaaaaatcaaagaggcatactcttgtctttatttccatacattgctacaagtcacagccccaaatgaatattatttcagttctatgaacagggtaaagaacttgttctcatgctttgacctcaggctttagagatttctaatatgtaacatacttccattaaactcattcatcttcctctgaaatgtagttttctccagagctcatgatctctttgatagtatttgaattgaaacatactacaaggttatttttctttccacagatatttagagtactgtcacatcataatcagccaaataaatagtatgcataaggtggtgcctcctttggggaattattaatagtagattccaattctagagaaccaggaccctgttgtagtaaacattgtatctccagggcctggaatagtgcctagctcataatagacatttgagtgatactgatcaaataatcaacctaacctgcctacttattaaactgaaaagattgtatataccttgagtccaatgggagcctacaattaagacttgcaaatagtaattgctcgataaatcttaaatgaacaataaagagacctgtatgcacgcataattttgtgtttcctatttagaagggaaattgctatagaagctcaatcaatcaagacacagttatttgttactactgaataacattttaattctgtaagttacctcaaaggtaaccaatgcgtacccctaaggagttaactgtggaggagacaaatcacaagaggtaataagcgaaggactcagaatagcacgtttctttaaccaatttagggattttttacatctatttttattacttttaaagtaatgcatgtgaatatatgtatttgtatttccatgcaagctgtctagaaaagcttagactctcccagcccagccaatttttttaactcttaacactcctctgggaattgtccttactttattttttagggtgtctctttacccttatatgagtatacctctaattttttatttgtcaactttagtatctattgatttctatacatgaaaaatgaagatttagttactcacactactctcctactatatccttttggtatgtttgatatttataatattatttgagtcctgttaactctgtaactaatttcttaaaaatctctctcttatttcaatatttgacagtcttcctcaactccacaatctgtaaaatgtcaatattagtcatcattcttccttccacatcccctcttctgtcagctaaatatttacttctataattttaagattgttgatatttatattttgtcatacaaccataacaatattttctacattttgttacacaatattgctaaaagttgaaaatcaataaatggccatcatattataattgttttgtaaatactgttagtgccaggtcaggtaatatgttgatgcatttttttctttgcaaatccaatgtcacgaaccttggatcactcatgagagaatgtttctcacatcgaggtcaaatagatttttttccttcacaaaccatgcattttaaaatgcatcaaaatttgttttatatttgtatcgtcttgcatagtttgctttgtaggcctgaaaaatatagtacttcaccagccttcctagagtttttcctacgctatttgcctttattgcctttattgtcatatttttagttatttacagactcttgattatatcatttattctgtgaagtcactgcttttgtaagcttcctttagaagattctgaacctcttttatttaaattgattactctccaggccatttgtactcatgtcgttttggaactccccaccacctcttccttgctcttctgagtaagaagtggtggaagcagttgagtcccaggtcatcccccatcaccacactggggcagcgtccccaggcttccagtagctcccaggtgggcgctagagtccatgcatttacctagtaccttccccttgagttgaagtggtgattgacatctaaataatataatacagcaaaggtgatggatgtcaccctttttattaggttacattaaagttgtacataaattacctctctcctggaatagttctcatttgtacccaaaagtataaaatttttaagaaattggttatatagaatttataattataatcattataattattaagaaattagttatacagaaaaatattacaatctcctcacaaaaaaataaatagccaactatggtcagtgttcagctttgttgcctagcccctgaggcatctttaatatagaaacatgtctaaacataactgctcaatagtaggccttttgctaggtgtggttgggcatgcaaaagctaaatgagagacaatactcctgttccaagaagtgtacagtacccaaatgccacaaagatcaaatgttagagttacatttatcaatctaactttatcaacataatttgtatgttatattatggctttatatctataatatccctttgccttacgtatacttcaagtatcttttcaggtttactcagaagaccacgggatatggattacctgaaagtaaataaagctacaaaaacagttcttcagatttttctacttctacattctgatgaagtgtcaatgttatgagaagggctggctaatatctatgactggaaccttgttgccttgtcaaagaccatgcacatactctccaaagccaattgtagggagggaaaactttagtgtggagatgatttcttccagcaaaaatgtctcatgtgtttcttagagttaatgctcccccttttctatcagttttctatcttcttgttgttctacactgcaccattataggtgcaaccatacactggggacgtataataacaaacagcctcactgacaaacatatattcgacttatcctacagatacacagaattccaataataacagcagagaagttattactggagggaagtaccataagtagagggcggatggccgtgtcattaattaccaagaggctacagatcctattgcgtgatctaaactaaatctttcatattgtcaatctcaaagaatctatcaaaaaaaaacccacatctattccatctctaataattttccaaattgcctacagggggaaaattaaaagggtggtctaataacaagaacctcccactagtctttggtttgccattttttattgtgtatgttttgtgatgatgtaatgaggtgggctggatgggctgttttctggaattgggtagtagaaaagagggcagctatttcattttaatttatagattcctaatttattcaaatttcacaaatttaaacattttagattacaattatttcagtaccctgtgtttctagaaatgtcatgttttagagaagcccatctctggctacgagatgaagcagcaaatgggagaaaacctcaaaagagaggagcatgtgataaatgtgataaaaaaggaaacgaggaagaagagaataaagaagaaaaagtggatgtcaggaattggaagtagaaacatgcagaagccatttatctctgctactaaagaaataattatttataatcataaaaaatcatgtaactcttgctctgcttaaatttgtattcctttgttcactgactacattgaaattcttggatgtcactctgagactctcagagtatccagttttctccctgaatatttagcttagagattgagtttgctttcctccactaaaggatatactttaatttgcaggctttcatatagactgggttgttgcttctaaaagcctttatgtcaactccctgcattttattttctgcaaagtattagagagcaccatatctatagctaatctctacagctaatgttgctaggaggattaatttgaaaagaactcgctaacatttctgaggtttcctcagcaaagtccaatataaagggtatttcattgtatttattatgttgttgtattacttaaagtttgtaaccagagtaaatgagatttccagacttgggtactttgcacagccttgtaaagtacatataaatgtgaaattactagtgatcaagggaagaggggaggactctgatgtttttaaacttctgttcttcagttaaaactccataaaaacctgtcccaagtcaataccaaaatgctgaattcagatatttttgtacctgtaatataaataaaaatatattacatggtatatattgttttgtattaattgtatgcttaattttctttttgggccttaacaataattttgtttacactggaataaaattgaaataaatttagagttgatttatattcatagcctttgcatttgaagcatgacaatatcttgttttcattttattgcttcaaagtttccaagacaactggatttatcctccagaataatttcacacttttttatttaaatcaattaaatcaatgtgaaacataaccaagattatattaatatttgtctcttttgaactggtaagcatctagcctttgtcaacagaaataaaattctatttcataattcctacagtaagaaatgcagctagctctggcaggaacatcaaactcaactcatgaacatttttaaacacttcagattatctatgggcttacttcaaattcatgaggtaacaatatgcaaataattatctcttggaatgtgatggttcaaaaatgctaacaacagttattccaacttgattatgacttagcagtatcatttaggtatatatgttcaatatgaatattcagtttgatacactgtttttaatattgccttaagtggtataatcatctttggatgccatatgtactattgcataatccatcccagttacaaaggaatgcttccctaaatgttttaccaaaaattttatgagctacttttctacagcctttacatccaattctctaattaatcaacactctaagaagattaaaccttaaaactaagctgtgaaacaaaaatatcaaggaatactacggtaacataacttagtgaattatgagttcccctgataatagagtccactggtaattatttattaaatgtcaactgcacaaaaggcactattttgttgtaggaaggggctataaaatgtaatgactaccaccatttgttgagtaccgactccatgccagacactttactgtactatcttcttttatatgttagtgtggttaggcttgaatgccaggttagaaaaatctagagttaatcctgtaaactgttggcaacctttaaagggtttgtaggggagaggtcaggaaaaactgtatgagtttcgaatggcaaggagaccgcaggtggtaaacaggaatgacctaaacctgagcagcatctatggaatgtgaagcctgggcccaaagggggagcacttggataaattatagagtctggtgatcacctggtcttagaggctgtgagaaagagaagttaaagctaaaattccactgtggggaatttatttcataaatacatttgtgcacatatgaagtagtgggtttgtattagtcagaaaacaataggtgataccatggtaaccataaaatctcagcggcttaccatgtggacagtttatctgtcactcatagaagtcagatgctggtgcggcagcagggcagcagcgctccttcctcttgtaatgataccatctgaaaggtgatttctaaggggtctggcaggtggagagaatgttggagagttgcagacaacagttttaagagtcaggcctgaaactgcttatgctaattctcttcctatctcattgattaactgagacacgtgtccccatcctacctacacacaaggttgaaagttgagggatacacctatattcagtgaatgttaatgtcactaggtttagttgtaagaggacattattagaaacccaaatactcatcagtaggaaactacttaataagttatgctacattcatacagggaaagctctaaaaacaagtgctgatatgggaagatcttgacgatatattattaagtgacaaaaaattaaaatgcagacaagtatgtacgttatcctttatataaaaaatatgaaatatttgattggatgataaagaatgtctgaaaggatacataagaaaccaatgacaatgtttactcatttggggaagaggttggatgaggtagaccatcctttgagacagcttagttctatttttaccaataacccaacccaaacaaatggttttgatatttcatctttccaacaaccagtctttatattacatttcaatattaagtatcaaacaatcgatattttaccataacctaatgaacaatgaattcaagcataactgaaagttaatgaactccaagacaagacaagggtggcatgctagtagagatgtgaatttgtctgaatacttcctgagcatttaatagtatcactacagctgattgtattccgagacttcttaatggaaagcaaacaaaactagatgctgattattttccctcgaattgtttcttcctaaaaaccaaatttaaatttagcttgggattttctgttaatgttaaaaaaaaaaaaaagccaaagcagctgtttgcagtttagtatgctagaatttggctcacagtggattttaaattttgccagctaagggggtacaaagagaaccataagtgccaccagcgttagttttccattccatgggaatctgagtgggtcactggaaatgaagaaacagcttcacttatccagtcatcctctctgaatctcagctttcttatctatacaatagggatttggtatctacctaatggagtctttgtgaagaatcaattatgacacaatgtatctgtcacagatttgtacactagtaagtgctaaatatgactttttccagggaagctttcctttacaccttaaatgagacctggatctcctgttcttttgctcccattgtgcccctgtacttcttcttccaatacttagttgttcgctttttgttttccccgctagcgtgcagagcctcgcacactactatgttctaaatgcctactacaaagccagagacgtagtgcaatatttcagttttgaattaaactgatgattgcaaacattctccatccctctctttgattcatactctattcacaaggtcagcattaaatactagaacccctcaaagcaaaaatgacatccatgacattcatatgccaatggtcttagaggtgtaggttagtatttgtcttgtaggttggccatattatattttactgatcatacttacgatgttcaaggaatgtgattttcactgaggtcaaatccattttggtctattcttgtaataataaagtatttgcaagcatgtattgaacacttactatgtatcagacgttgtttttggcagtttacatgtaattcttgcaacaactccattgggtagattctattattgttctcattttacagagaagaaaatagagacaggtaaaatatcttaggtaaaacatcttgtccaagtttttgtagttacacctttgaaattataacgtttacttatcaaattctaaacttagttactatagacagagctaggattctaatttgggcagtttgggttcaggagccatgttcttcacccttcggctgggcttctttgtaatgataaacttttttaacatagcataaatatagttgaaaatatataatagaattgcctattaaatttgcttcaaaatgaacattttaaaaaaagtatggatgcaaataaaaagacattggtactcatgcatttctggtggcataaggtgacattaaatttttggtaaataacttaataacgtgtgagctataatgtgtattcactaagaaaatggcctagaaatcagacgggatcgcctttgaatcactgtagttaaggaggctaaatatataaatatctttcaccattgatctccattctgagcatttactttaaagaaataacacaaaacatgaagaaaaacttgtatagcaaagatgcatatggtatcatttatttatatataaacttatcttttggaaacattcttattagaagatatatgtatataaaacatatatagaagagtatataaaatatgtgcagtttaaaaagtagttatgaagtatcactctaaatcctttctgtctgtctacagctaagcactactctaacttttgtaatagttatgttcttgtttttctttatagattttgccatccttcattctttgacaatatagtacagtttacctattttgaactatatagaaacagaatcacacaaaatgtgacttgcctatttctcttaccattacattgtgagatgcagctatctagttttgtgtagcagtagtttcaataatgtttaatacaggaagctacatatttggctttctagctaccttatttttgctcttaatttgcccaaactgttttgtgtttatttttttctttcttttagatgactttttaaaattatatagtttatttttgtttccctttttaaaagtggtcacccttgaaattataacgtttacttatcaaattctaaacttagtcaattttactctcctacttcttattaatgtatacacatcattaatacattattgtcatcatatttttactctgttcaattttttttgttgtttgtttagacagagtctcactttgtcactcaggctggagtgcagaggcgtgatcttggctaactgcaacctccacctcctgggttcaagcaattctcctgcctcagcctcccgagtagctgtgattacaggcatgcatcaacacgcccagctatttttagtagagacagggtttcactatgttggccaggctggtctcgaactcctgatctcaagcgatccacccgcctcagcctcccaaagtgctgggattataggcatgagccactgcacctggtctcaattttttaaccacacaaagcaatgtttttcttttataaaatatatgttcatttagattaattcagatacatggcactctaggatcactttccttctgcctatggggcatttttttagaacattctttagagaagttctgctggtgccaaagtctttcagtttttttttttttccctgaaaatatctttatttagccttcatttttaaagacaaaagttatagcatgacagttattttctcaatatatattgagatatacactgccctctctgcatccctccctctcagccaccttaccactcttctattaagatggctctttctcattttcaccatgctatgtctgggtgcagacttttaaaaaaatctgtttacaattcttgtttctccttgaatctctgtatttgcgcattttatcaattctagaaacctcttgcctacttactttttcttttttttattttattgagatggagtcttgctctgtcacccaggctggagtgcaatggcgtgatctcagctacctctgcctcctgggttcaagcgattctcctgcctcagcctcctaagtagctgggattacaggtgtgcaccagcacgcccagctaatttttgtattttcagtagagatggggtttcacccagttggttaggctggtctcaaactcctgacctcgtgatccatccactttggcctcccaaagtgctgagattacaggcgtgagtcacagcacctagcccttctcttttcaaatgttgcctctgccacatgctgtttatcccctccttctgtaatgcctgttggatactcaccagtcctcacctagctcaatgtcctctcacttctcatatttcccatctttttgcctctgtgaattctggataaattttctggactagttgattcattgtttcttcagctttgactaatttgctgttacacttctcaacttgtttttaatttcaatttgtttattttattaaagttctctttatttttttttcaagtcagctgggcggtttttacaatttcctgtactgtttattcaagttcgtctttaattattttaaacaataagtattttataatccatatcccacaattccaatatgaagtctttgtgggttgatttcaaagcttaaattcatttggttgcaaatgctgtcagggcagaaggggccttagtgcgacaccaaccctctggaatcctgtcttcacttaggtttctttcttcttttgcttttttcctttttggagacagggtctcattctgtcacccaggctggagtgcagtgttgtgatctcggctcactgcagtcttgacttccaaagcttaaacaatcctcccacctccagcctcttgagtagctgggactacagatgcacaccaccacacctttctaatttttgtatgttttctaaaggcagggttttgccatgttgcccaggctagaggtttctgcctgacaatgcttaactatcttgttagttgtctggtactttgaaggaattaattttttagttaactagatttaatcattccgcagtgtatatgtacctcaaaataccatgttgtacatgataaaagcatacaatgttgtcaatttcaaataaataaataaaagttttgttcgtttaaaaatatattgtatccaacatttgtagttgtagtcaaagggatggttggtccaagaaacatagtccactatttgtcagaaacagaagtccttgttttgaaaggtttaataattcagctgcccaagggcaatgggctaaactaatctttcacatattttcccctattatgtttatagaaacattacgaggcatcaaacaataagaagtctaataaaaggtagcctgctcttagattttgacctggaaattaggagttttgagtgttcttttaggccactgacattctactatgtgatgttagaacttatttacttattgcttttcccatttgtaatttaaaatttaaaaaaatcctttacttatagctccacttttcccataaatcaaatctcagctaaatgaagagtttccaggaaggactttgaagctactctatatattcaaagtactgtactaggtttatacgggctacatagttttatagttaattttcattgcaaaaatgagagacgttaccagcaaaagtccttaaccatatcttcagaggaagttttcataaaagatactttaaaaaaaaatatatggtgcaattgtttttgtttttgtttttccataagaaacatcatgtaccagacagcacaacataattttcttttgtttcgtgcatgggcactgaatgagaacccttctactcaattgtgacaaattcattcaagctcaagcctcaatcttttagatgttttgcaagtgtctgtgatttatgtgcatacgtcaaagagaaagcacacttcacagaaattagggacagaaaaacttcactaagctctcctgcctaagaggtacaactaggcctctttcctggtgcagatgagatgagagacttggtgaaaacaagctttcttgtgagtcatccttaataccattgggaaaataggcatcgcattccagtggactgggcagctaacaaccctcacccccacaaaatggaaaatctgtaaagttcttttgattcccacaaccagagatattcctcttctcattcaactcttttattttgtgacggtgcaacatcttttctgagaatagcttaaggtttgggacccaaaggtcctaaatttaagggggtggaaaaggtttaatagtaaatgtcacgtgcatgaatgtcctttatcctgtatttattcataaaataataatagttatcatttattgaatactccctatgcagtatgcattatctcacttctatcattacagtgtctttcctgttaagtaccttgattcttaacgaatgaatgaaaaaatttaaagataaggaaaacaggaaaaagacctcaaggaggataaatggctagcaagagtaaagggaaatttgaactaagactgatacgactacaaagcccttgcttccaagtattatacactctgcctctctttaaacttcttaagggagaaattttttaaaaatcagaaaaaggaaatgggaattatactgactaatacaattatcacttcattctaaattataaacttctatctgagacaatgctatgtgctcaccaaattgttttattgtcttcctggacccacagatgatgaattctcttagccttgtttgcagttattttggcaccattcattgcgttccggccaatggaatgccagtagagatgacgcgggccatgtccaggcctcctcatgaaaccacttgtgcaattctccatgctctctctctattttttggcaatcttagaagtcaactgatgaaagtggtagtgacaaaaatggaaggagcagaggtttctgcatgactatgtggtcaacagccctatcgccaactcagttgaacattgacgtgagagctataagtctttattgcactgtcactgatgtttgttgtgttaccacagttagcttgcatcacctcacatactgctttttaaccatgagaaagtacattcataaaagccactaatgtcatgctgacatttccagtttcttctctacttttaaggattcaagcttattcctagattgtgtaagttgtaataactactggtctagtttaggagaaaaggcttttgtcagtctgtggaaattaacaatattttcatcaggaacacatgaaccataatttgttttgatgcaaaaatcaattatacatgaactctttcttcataatgctttatttttataatagtggattctgtctaaggacagattggactgtgggaatctaagtgatactgttatttaaagcagcttagttctgaaaggcttccttgtacttttgctacaattcttttaacaagttgatatacagcgctttggcaacatataacaatattcgaaaaacaaatatgattgtgacaagatgactgtaatggattcatcagatcacctgcagagggagtgctggccaagtgttatgtctgaaagctcttaaaaagggagtgtgtggacagcatcagaggtagtgcaagaacaaggaggaaaccagaaagcaaaattgtcaagaaacaggagaaagagaagacgatattagtagtactataaagaataaagtagagctcatactggtatctaaggttttggaagtaatcatcaaaattaatggtgaccaggaaggcagaaaggactactgttcttcatccacttgtaccctgaaaactgggtaccttataagaatgagtattttttaagacccacatctcagccttaatataggatttgcaataaatgcatttgcaatattcatttccttattaaaacctctgttcatgttaagaaggtgttaaacaatccagtagtgtaggtgatatccccaagtattttagatggacagcaaaggtaaataaaccaaaataaaccacacactccagtgtgaaacaaaataaaccattcagtgaaaaaaagagttggtgatgggtttacacaattcttactgtgtaaaataaactatcatatgatctgtgttgtaacatcagttgcagtattctggctcagcccaatttatgaagcacaagatgtattctatacccggaattactgtggactcaaaacactctcagtaaaggagcagcttaaagagcagattttaattttctatttgggcttcgactgtgaattcattttcagaactctatgacactttctcagttatagctttatattttcactttttagtatgcatagtatatataagaaaattttagggttggtgttcaaaaaatgaaggaatcattaacaattaattatcttaattgtgtctttcatgaggtacacacatctcttagtctaaacaaatatcagaaacttcttaagacagatcatcatacaaaaatagggactgaaaatgccgggaatgcctttccctctgtatcctcttcactaccctgctagtgttccttcttctatatgtcacctttaaccctcctgagaagctatctctggcctcttcaggggtctcctttttaatctcatagccctttgtagacactttcattcacagtgtctcaaattgcattatatgcttgtttctctcctcctccactaaatggtggactcctacaggataggagccatgatggcactaaaaaatatttatttattcatttatttatgtgagaaagagtctcgctctgtcacccaggctggagtgcagtggtgtgatcttggctcactgcaacctctgcctcctgagttcaagcgattatcctgcctcagcctcacgagtagctgggactaccaccacatctggctaatttttgtattttttagtagagatggggtttcactgggttggccaggctagtctcaaaccccttacctcgggttatccacccatctcagcctcccaaagtattgggattacaggtgtgagccactgtgcctgacccatgatagcattttgacactcattaaaagtttgctccatgaacataagacattggactatttttgtttgtttgttttttggttctacaaaaatccaaggggcttgcctatgcttgaatttgggtctgatcgataaacccaaaacctttgttcagcacgtctggcccactacgtttggctgtacgtatgtctactgatgctacctaacctgtttgtcaatatatcgactgctagaaatattttgttccttgcctgtgaaggcaagtctgatttcttcaactatggtagatcctcaacagctcagttaatacatgtttgaaaattctgctgtgtttacctactggggggacactaaaacaaatacggcatctttcccacactcaaggagcttataaatggcttgggaaggcaggaaatttaaatgtaaaaatataagcccccagttaggagagtaagattatgaccaataattttaggtttgtctagtgctttataatttcaaaagagcattcatatgtatattctcattcagtattaactatcccttgatatattacatctacccaaagtaggcatatttcataaagtaaacatgttatttatcggctaaataagttaggtgtcattcctgtcttacaaaagaagaaacagaggtgcattaagattaactagaccatatagctcactggtgaagtaaacctaagactggaagtaaagactgctggctcaaatctagttctcttttcactttgtcaatttcctgctcattttagggcttcaatgctaatttgtttgtctctccaacacgtcttcttaggctcctatgcccactctaacaggaaaaccctccttaccaaattctttattgacagttatccaaacgcttaaatatcacaattgctttatcaccaaaagtgcagaccagaattggaaactaagtttccttttctcaaatgatacctcaccctttccctttcttgttcaaattattggtttccattagcacacagtaaaaaaaaatacagactagacagcagatttagacattgctttttttgtatgtttaaggatttttccctaatattttgattatagttgtgtatttttttctaaataacagatattagtctgagtatcaagactatagaattctcattctgaattactaactttccctctaccctgtctactgcaataacatcagcagcatcatcgtcatcatcaccatcaccaacttcctcctcctcctcctcctccccctttctgccaacatagttaacattcattgagcacataacatgtatcaaacacatggttgattccttcatttaatcttcataatagccctatcgggttagtatttctgtttcattttatggttgagaaaactgaactctggagagattaaacagctttcctagtgtcagacagcaggcaagttatttatcaggtaaaactgcaaagacctgcatagaccagcttcccccatagaagatgcatagtatattaaagaagactgtaagttcttcaagggcagaaccttgcagactctcttaccacatgccctcaaaaccccctgtacttttcctgcatggaaaagtattattatacacttttcacaacttattatacttatttttgtaatcatttgtttaatgtctttcctccacccccaacccctggactgtctcttcaatgcggacaagggctgtttctatattgcttacttctgtttgcccaggggttagcagagtgcctaacgtggtaggcactctataaatacccattaaataaataactctcctttggccctattgtcaaagcagcttcattgaggatttctttagtacatttaattaatattttagtactcaatgtaaatatctatggagctcacttctggcagaagacaaaagtacactggacccagcaaaagagttattctgggtggtgaccctaaataactttactacactctagctacagatacacttttgaagagaactgagtcatctttttagcagcgatgtcatcttggctcaccgaaagctccgcctcctggcttcatgccattctcttgcctcagcctcccgagtagctgggactacaggcgcctgccaccacaccaggctaattgtatttttagtagagacagggtttcacgtcactttttagcatattttatttgcacgtttgacatgtttgaagcagatgaacttccataaagtatagaaactgatatgaatttcaagaacataaattgtacttttctaaggagtaacctatacattttgaaaattatgtttttaatgtcaaaaatgaaatgcagccttgttttttctcagttcattggagttttcagataagccatgcctctctctaatccaatggcttaatcaaaaattaaatacctgaaaatgttttccatcaagagaaattttgaaactgtaggaaagaaggaataatgaaagaaaagctttatgtaggcagaataactaagaggcattatgttagcctaaccagtaggctagtattttaagaggaataaaatgtatctatattatttatccctctcaatcctctaccacagtgagggcagttattgttaaagaacaagttcaaggtcattgaatggttaagatctggagtcaagatttgtctctaggtttgatgggaaatttaaggctgattgatattaagtggcaacatagattatattgctgataaataacagagataaattcaaattttgctctttgtggtacaaatccagggctttttccactactggcactgcctttccattcacatcatttcatgattagtccttcatgtcaaaaaaaaaaaatgtaaaaaggttggcaataaaaaaaaattaactcggccaggtgcggggctcacgcctgtaattttacccagcactttgagaggccgaggcgggcggaccacgagctcaggagataaagaccaccccggctcacacggtgaaaccccgtctctactaaaaatacaagaaattagcccagtgaggtggcgggcgcctgtagtctcagctactcgggaggctgaggcaggagaatggcgtgaagccgggaggcggagcttgcagtgagccaaggtcgtgccactgcactccagcctgggcgacagagcgaaactccgtctcaaaaaaaaaaaaaaaaaaaattaactcagaattcattatgtatcttacatgttgtattaatagcataagctttatataacagaaaaggaagaattccattcccccactccaattctctctctctctctctctggctagaggatggagtggtataaagtgttctcagactgtgtttttttttaatatctgatatttcaccattctcaagttcatttccagaagatatcctctatcagtaggaacagatggttcagttgattgctaatagaacatggagataattgttagtaggttaacatttaaaatacagtccatttgggagtcactcaaaaactgctgtggtagtgacaaagctattcatggcatgtaggcaagatatcatgtggttatcactctgtattccagagcaccaaattcataccctgcctcaaagatttgtaccaaagaccaaataaaatgaagtattgacaatgctgtgaagtctttaaacggtccccagtttccctgacagccaatcaattgccattactgtttattttatctccatgtcttttgtatcctttacattcccactgccaccaccctcattcaagccatgattggctccagccaaatcttttgtgctagactaccaactgttctcattccctccaacctctattattttctatcactgttatatgttccttcctgattaacctccctaaaaaaaacagctataagcatgcacttgtgggctcaaaatccttcaatgacgcctactagcttacccaataaaattcacatagttaaatgtccaaactcttcaactctaacttctactcttcaatctatttctcactcatttgattcgggtgtctgtcccatactttagccagaattattgacttgctgtttcccatacatcacctttgctttcacatctccctgacctcctaaatattggtcttctgttgaaaataaccttgataactcacagttcctattcctgcatactggaatcctaccttcttttcaaagccaagtccaaagccacctcttccattcatccttttccaacatttttaacagaagataatccctcttctgcatttttatctaatatttttatatcactcttatcctttcttttttcactccatctacttttgccatactccaatccagtctccaaatttcaaattgtattattgctttaccgtgtttataagccttattgacttcccactgctctgaggaagagcaaaaaccttgatgtctatccttgctggcctatagtattctacatgatatatcttggtatgccgctctcatctaacattctccttgctgctctcatcttctcatgtattcatcttttaataagacatgtccttttttgtcttagggcctttatacatgctgtttcctctgtctagacacctccttcccatctccaccttttcctacctagttcatttctactcagccttcaaaactcgactcaaatactacctctttgagaaggctttcctcaatccctagacaaagttagcaccctcacctaccttttcattgcagtacgtgccacagtcatatgtttgttttctcaactagtatggaaggatggaaactctgtttgtcttatttcctattggacccacattgcctaacacagtgcctacacctatagtagctattaggtaaatacgtgtctagtaatttaaatataagtagaatatatactagatatctatgtacaggatgattgaaagttttgtgtttgtcttatttcctatctttctcaccatgctgtaaactccctgatttacttttgtacctgaaacaactcaaccagctataattaatatgtgcaaaggaaatatgtgttgaacaacagaaaaatgaaggaaggaaagaatgtagaaataaacagactagtaaaatgcaaggtaatagtctaacttttcatataatttccaaatcctcatgccttttaggatattttaacatttctagataggaaaaataacctaatgtcacttactttttatagaccaatagcctagtgtttattgactgttgatgtttattgagggacaaaggaaggaaggaaacaaacactattataatagggaaaagggacaatgttgatatgtaacacccaggttcaaaggaaatgaatatcctctttattcttgtaataaggaagaggggggagaataattcataaatagggacaggcaaaggacaaaatgaatgaaaacagtccttgcaggaaaaaagaaacaattgtttcaatatctttcaattacaaaaagagatcaaaatatttatctgttttatgttagcaattttcaatttagtaatacaaggactgccttgcagctgtagtattctttccacagccaaccttagtatctccatccttatttcctttcctcaatgtcaatgagcccctggaagaccaagcaccatacattcacatactctttacttcctattatctctgcctgacatgctctatgtcttgggcaagtcacttctgtcttccgtaccatgaaggagacatagtcttgtgtctacaattcctttcatgtagaatattgtatgattggaagtcttgccttcctataagttttggtccatgactgctggtgctttgatttcatacattccatatttaatatctaacctattgaaagccagaaatgttcaaagtgcaaggcattaaaggataaaacaatgatcttaaagacaaaatctttgcccctcagaggtacattctagtggaaagagacagacaataaaaagatgaatgaaatatgtgaaataatagagactagaaagtactaagggggaaaaaaagctaaagaaggggactaggaatgtggtgggaatgttactgaacaagtacgcaggaaggcctcactaagaaggtgatatataaaaactcaattcacaattttctagttgtctgcccttgtctcctgtgaattgcttgtaacttagttcagttacatatttgaggatcccttacttctttgccttaaatctaactgtctctgctcatctctatcgccataaccttggttccatctctgccatctcttgccaagatcatgagcaatagcccccttcttggtcacagttttgttattcactctatactcccatcttcccttcttttctgccaagagtcattttctttacaagcaactctagtgctacctgaagtctgaaaactccccatttattttgtccattgatctctgaaaactccccctactgccctagctgtcaccacacttaacccctgattacctgaatatgcccattccttaacttcatacctacccacaaacacaggtctctcttctctgtctgcccttgccctgcctatctacccagcaaactaatacctgacctttttttgttgttgtttttcttgtttttgtttgtttgttcatttgtttgagacagggtctccttctgttggccaggctggagtgcagtggcataaacagggctcactgcagccttgacctcctgggctcaaatggtcctcttgcatcagcctgccaagtacctgcaagtacaggtgtacaccaccatacgatgttaatttttgtattttgtgtattttatttcactttgtttgtagagatggggtttcaccatattggccaggctggttttgaactcttgggctaaaggaatccactcaccttggcttcccaaagtgctgggattacaggcatgagccaccacatccaacctaccttccttttaaggctgttcaaagaattcctcttggcctgcctttttcaattctggagggagcagaattcttgctcctccattctctctgtatttttcacatacctctctgccacatttattccgttgtattgtgattatcaatttccctgtttttcaatatccttccagagtacattccttattcattcatactttgaacttggtaaaccctcaatgaaatggacagggacagagagaaagagaagaggtggaaggtgagagagggaaaaggagactgtcagtcagttttcaaagatgggcagctcacagataggagaaatcattgcttcctaaaagctgtgaattagaagaaaccttaaagtggcccaaattctaaaactttaggcctcatcattaacctattattcaagccctgaccttttgtcccagttatcataactgggcttccgcacctcagtccccacctggtgccccagttctgataactcaccttctgtcttgctcttctctgcctgaatctctcttttggagacatgcctaatatgtcaggctccccaaacctggaagtctgtctcgcttttgtttcccccacccctcccatttctccctttttaatctctgccccgcctatgaacccaggcaggtggccagggccctgctaatccctgacagacttccatgattctgacttctgagcattacatgctcctgggttcttttgttgcctttcacggccttcctactgtggccactatctctcccatcctccatgccatctgactgtttggatgaccacctgctctctaaggccatacattttggatttcattctttgcctgttcccctggcctgcttcccaaaaacctctggacctaggtcaggttatgttgttgttactgtttctttctatttttagttcctagacctaccttccttccaaccctgctctgataggactggtgacactttaatgaaaaaaagagggccttgacaaatcactggatttgtccagttgactttaacatatcttatagcatttggatacatgggatatttatttgcagtgctagtgtaacactctgatttcacagataaggcactgaaactcaaaaggtaaagtgactttttcaaggttgcaccgatagcctgtggtagaatgacatctagagcccaggcttcctgtgtcacagtcaagaactgtcctttccccatattcaatcatcactgtagacctactttttacaaattagagtgtattgcaaaacaaggatcatagaatcacttgtagctatcttgaagaaatgagggtattaacctatagccagcacctttacaagttaaacagatcctactagattatcctttttcaaggacctagatgtatgtgaagaactaggaggagacaacagctttaatttatcccagatagaacaatattttaaaatttttattcagggtgccaatgagctcggaaaagatgacctggagattcagagaaattaaccaattaaaagaaggaaataaatcagacattagttattaatgaatcaaccaacgggggcagaagtggtattccaaaggagacatacctgagaccaatgtctttataaaaaataatgtaatctgtggccaagaagaagaaatgaaatatatgcccaatatttttgtctagtgaaatgacaacttgcacatgttatatatatatatatatattattatactttaagttctagggtacatgtgcacaacgtgcagatttgttacatatgtatacatgtgccatgttggtgtgctgcacccattaactcatcattgcacatgttatttaagacaattaaccagccacttgcttgggactcagggttgcattaaacaacgtcttcatcttgatgagcttaaagtcaatcgggggttatggctatgtgcacaaataattataattcaaggtagaaattatatagataaaaatgcaatgaaattattgcagaagtgacttcttcctaccaagttggactagcaagagcttcatggaagcaagcacatctgtgattgcacaggtagccctgacctaatgagccatgataaaatcttgagggtcaccctgtaggccactgctctttgaccacttatatccaggcagtcaccatttcaatttcaagacctaaaacattttacaactcagcattttcccttgtgctgctgtcttagttcagggccgcctctttctctgtagatgtctacagcaaggcccttgctcatcttgcatctacagtctcaccttccttccattcatcctccacactgctgacagaacgatcctgctgctaatctgatcacatcactctaaagtttaaaatcctccgatgactcaccatttacaaaggccttcaatgatctggccactgtttactgctcaagtctcatctcctgctcttcctttccttgcacattatgttctagcaatattgaattccttgcacttccccccaagaaagcgctcctcttttatatcaccatgattctgctctgagtgcttctctattctgctctgcaaaccagagtactaagcagagtgcatgattaacagaccagccatttagcaattaggatgaatcacatgcacttcaggacttagaagggccctttataccagaggttctctctcctccacaggatctcctaccaacagcatgcaaccctaatcagcagcaagagtggaatcctaaacttttgtgtggctctttgtttgaaggcttttgtcaagtaggagtggtattgtcagcagggaaatgatgaaagccggttatagggaaggtaacatgataataaaaaagaaaattaacattccttaaatacatacaacatgttgcacacattcaatacaatactttctacatgtaccacacttaatacttacaacaagttaaaaatctttgttccattttaaagataaagacaataagctttatgtaaactgattgtttctccattacttagttagtgactagggaggaaaggatctcattctaagtatttttttcttcctaccaccttatcagggcaagcattgtaaccatgtctccaaatttctttctgaatcattccagatcaatatgtttaatttagttttagtgcaattatctatttttttctgattatctgaaaatggttcatttgtatgttataaacgtagcacaattcctccctcccttcaccgggaaggccagagaggcaaagacagagcacagaccatacaagcagcttctaatctctcccttcttgatatggagattagaattgtgacttttagaactcatattgactcaagaggctattcaatgtaatgtcatccttttagagaaaaaataaatagaaatatcatacagtacatgaatgacaaagctaggactggaaggtaactcctaggcaagaagagctaattactgactgaaccctgatggctgagcattctcatatgttgcttctggtaatcttaacaacaaacatgtgaagtgggtattgttatctctacattacaatggagaaagtgaggctcagagaggttaaatgactcatgccaagtggctcagagtgattaaatgacactccaagtcacatacctggttaggcatgatagatcaaggattaaaactcaggactcacactgtcaagctgatggcttcaaccccactccccatgagcatttcaatcttcattttcaaatatccacagatatttgaaatatagcacaattccttccaggaccaatagaggggcttgtatgagaagtgaaggccttgtgactggaaagtcatcagtcaatttagacagcttctttggtggcttattccaaaaaaaagaaaaagtgtatagaaaacacctatcaatgactctactatataaacaatcattttttaaaaaccacataaactttttttttttttttttttttttgagatgaagtttcgcttttgtcgcccagctggagtgcaatggtgtgatctgagctcactgcaacctctgcctcctaggttcaagcgattcttctacttcagcctcccgagtagctggaattacaggtgcccaccaccatgcccggctaatttttgtatttttagtagagatgggctttcaccatgttggccagcctggtctcgatctgctgatctcaggtgatccacctgcttcagcctcccaaactgctggaattacaggcatgagccaccgcacccagccaagttaataaatttttaagagcttatggatcttatgttaatgttattaaaatattgttacttattgtcttttatgtagaatatcattttcctgttcattgtgctttaaaaacagtgactgctaatttctaaaaataaaatcaaataaaaaccacataccctgctccatacatctaaacaaaccagagctatgcagtgaaaaggcagaacacagcttttcagtaaacagaggtagaatttcaccatgtggaaaaacatacaccctgctaaagactgcagaattttacttctatcatttagaagactccaagggcaagaaaaatacatgaaatgctgattccaaaaatccttgacaaaacagcagtctagaaattaatatttaccacattttcagtgttcctgacacaacagctccttatatgctgatgtttatgaatacaaatttgctggcactgtggacatatattatcttttcagaaaataacaaggtaggcaggtgccttcctacttctggttactagagctaaaaaactaccacaaatgggcagcaacatttatgacaagtaaaattgaaatcaatggaccacataaatcttagttgtacactgatttaattaactataatgagaaagtgggcaatgactctgttactatttaagactatttagaagacatctgtggtactttttttttttgcctcaattcacacttggattaacgtaggagaaataagtaagaggtggatggtagtaagctagggttcaattgttaatagaatgaaacacattttcattttgtaaggtgcagagaacataagatcatgtccagtagtcctaaacaaagcaactatagtatcatagtattacacaacacatagtattgcatttcaagtatcattatcatgccacagttattgcttactatttcctttacttaagcttacaaatcctagaaaataaaaatgaacaaaccatagactgactttattccttgctatagattttggggacattctacatttattttctagctgagttattcttttgttcaacataccctgattgtgccaaatactatgtactggattttacagtctgacagaggagtgcaagttctacactattgacatacagatggaaatgccataatggaggagtgtgcgaacccaagctcctacatctgcaatctttagcaccctatagctgggcttagctaaagtctgccccataacagatggtaatactgataatggcaatagtgatggtgatgatgattatgagaatgtgatgatgatatcagcaaaaattgaaactctactatgcatgttatagttcataaaaatgttcataaaaatgaacaaaccatagactgactttattccttgctatagattttggggacattctacatttattttctagctgagttattcttttgttcaacataccctgattgtgccaaatactatgtacttgattttacagtgtgacagaggagtgcaagttctacactattgacatatagatggaaatgccataatggaggagtgtgcgaacccaagttaaatgtttgttcacttactcagaacaacctgaagaagcaattaatattaatctccactttagacaaagcaacctaggcttggtaaggttaagagatttgcccaaagtaatacaactactaagtgacagagttagggtacaaaaagatagatccaaccaatatggacataagacaaacagtattgtaaactgccacatgccctaggtgagggagctgagcaccagccacccttccttactggctgttcccagtttgctctggtggcaagctaagcacctgccttaaggctccatggttttgagctttaagttttcctcattctgctacattccagttcccagaatagagttttgccttggctgactctagtggcctctgttctgaggactgcaggcccagcatctgggatttaccggaaacctccaagataacttcctggaatgtatacttctctaagattcctccagttattatctgaaaacccaatggaaaattcttttattcatcttggtaacaatgacacctattattatctgaattataatatatttcttagtatgcatgccttctggtacagacaatttgaaagctagaaataagtctttcaatcctactgacacaatgcctgacactgaataatgatgaatgaatgacctagttaggctcatagactcagaagtcactgtctcattcactggatctatttcttgctgtcagatgtctcagcctggatccattctcacatccagagcccacctaggtctattccagtcctctatctctccttatctatatgtctcatgataaaaccatcatgtctccacctgaatctgctgatatgaaagaacagcagaaagcacggagtcaaatgaactactagtttagaagtggtatttcaattgggttttaagaaataattaatgatcttcccaaggaaagaggaggcataaacaaaggcagaagatatttgagttgctgttgcatttgaagaatgccaggcagccttgagaggttaaaatacagagacaacacttttgtggtagcacaagggtagataccaaagagatccagaaatgtgatgtgtcctcactgtaaactcacctgcaagacacatgaagcattcatgggaatatgaaataaatacagtcaaatctccaacctacctgttcccagactgctttttgttttgagggcctttcatacttagtaaaatccctgcagggttcagtcacaggttctcagaacacactcaatcacctgctgacatcagctatcaaatgggacattacttgaaaataaggaatatgattatccctgatgagggcagctcagtgaacctttcctctgcacttatccatccttctccctgacagatatggtaatgcagatttttttttcttcagtataattatcaattcagacattctgactcctccaggaggaaactagctgagagctggctgggaaccttcaatttcattcaagggtatagaacaactattatgtgctgagttctttttatcataatagcaacacaaacttcaaaggcaaaacccaagccaattcgacaaaacacccatctcttatatatgcagaaaacaattatatgcaatttgtactatgttcttcaatttctcatcttttaatctataagatagatcatgctattgtatacattctaggtcacttaactgttcagtttcctcgtctgtaacacaagaataacaatattaaccttttaagactattgtgaagattaaataagtgagcatatctaaattaattaacatagtatctggcaaatgtttactgttatcattttattataatcattattatcaataaagtattcaggatagtctgactacactgaactgtgataaactacttgcttgtcacagaagacaagatttacaggcaggtaggtgaatctgaactttctatttttactattgctgcataaccataaaagaaatggcttatctcctatttttgtgctgtagggattcaatccacaaactgcctgagggacgaacttggaccatcttaataatatacatagtaaattccattccggtttgttttgaaatgggtattatattcggactgaacgttttcctccctagattttatctgaacggcttacatgagtatcctttggtcactctgtttaaagcacatattcaaatgcagtatataatcaagactgatctatctaatgacacttggagaaaataaaacagatataaaagcagtcctaatattatgcgactatttacaaacaatctcccaactcaggatgctgctgcaaagtagcttcttgccacttccaggttttaatgccttaattaattatggaatgatgtttaattatgtattttattatgcatagcaaatataaattacatacctgattgttcacaattgtattaaaaatatgtatcctttatccttgaaagtgaaagacctttttcaagatggataaagctgtttggggaacagagtatgggtggaattaattgtccccacattaatcatttattttataaaaatgtgaaggtcgttctccactttaagacacttcctgaattcctctagcaaggtctggcagccaaatttcaatatgcaaagcagaggattatgcaatgtgcactattattcccctaaaggcaaacagcttttatttaataaagatgttattctaagaagatttactgtggtattgtcacatatcagaacttgttctggaaatgtgattcttattagtaagaacagatgacctttctctatgggtagaagaactatggatgtcattgcatgcacctgctaattttcctagaatcacagggtgttaagaatcacaatgcaaaatccacagacaccatttattaagcattctttctgggaacaaactattgcattaaacacatgatattattatcatattgagtgaaccattatgaacattatgtacaaagcactaatatagaagttttctattcatcttatataatcttcatttttccccaattttatagaagtatgcctcagtaaagcatttttctgaagattatgccgctagatgaaacaactgccagactacaaaggccaagttttttcattatcaatgaatgcatattgtcataattctaagaattaggattcgtgattccaaagtggagatttgtcataggtgtggccagcgccagtgaaacacatggggcttcttcccagaccctcaggcttgactcacttttttgatagtcaagatggtaatcagtgggcaaaacacttgggccagacagaaatggacttctggctccactggttgtgtgaccttttacaggtcattttgttgctccaaaactcactttctcatctatacagcactgataatagtacctacttcatatatgcattgagaggattaaataagttaatcacatgttgagtgctttgcctagggtgccacgtatcataagccatcaataaatattagctgttattgctgttatttttttcctccttctctaataattttaattactattttgggtttttgcaaactaatcattggcttctttccagttctttctcctttcatcttaatctcaaattctaaatgtgtagaacctaaaacatcaaaagattaataaaactcccttctccattttgtgctccagccttgataccaatatcctttcatgaccctatattcataattttttgttctatttagtttcttcacaagatctgtcaaaaataaagtccacaatattacttctgagtaacttagagagagagaaagagactaacattcaatgcttcttaagaatttccccaaccaaaaagaaactgaatgtcacattttccatccaagaaaaatcagtgtttccagagatgtgtgctgagatgtctatggatgtacagcaaaactgattttttttccttgtttcccacttaagcaaaatgaaactgtcttcttcaagcacagtaatttaaaacaacagtaaccaactccaaagagcatgaattagaatgaaagttcactgggagcaaggatgctctgaataactgactactctgacaaaataacatattctgctagataagaaggcaatatcacctaacgattaaaaacatgtggtttgggataagacattttgagatttaagatcctggtctatcacttaactgtgtgatcttagcaaagtcattgaagctcctgaagcttgagtttccatatacataaaacagtcaaattgttccaactcatgcacttctgctaaagattaaatgagataatataaagcattacattaacacaagatctcacacagtatatgtgctcaattaaaagattgttattatcaacattattataccaatatcaacttcataaccattacagtaaataacagaaataatggaatgaaactaataaaataatgccaaatattgaattttgtgttttcttggggaattgaaaagaatggattgcaattagtttataattattgaaatatgaatttggattcgacgaatactgataaagtagccacacaaaagcctatttaatatttgagaaaacagtcacagaaatgcagattccatgattaggcagctagttggtgaacagcaagaatgtgaagacagcaacatagtgtccagcacacagtaagggctctgtgattagttactgaataaatggatggatggagatatgctgtggtttagcggaaacactgaatttagactttctgattgtgaacactttgcttggatttcttaattcacacttattatatgatctatgaaagtcattttaaatgaaattcaacttcccctcctataaaacagtgataatagtatctgtccacagaattaatgtgaggttgaaatgcaacaagacatggaaagtatctagcattatgcctggtacatattaagtgctcaatacatgcgaatttccttcccttttctccttgtactaaagtccatctctttcccaaactatcacagccttctttaaatcatacatagtccctcatcggtactttcctttctccccagtacaatcatctatttgccttccaggtcagtttgaaaatccaaggctcttgatgacttcgtctgagtctacagccatttgctagggtgccacaaacacatacccaaccctgacccatgcccatcttctctgcccaccttgcccctttagttctttaagatgtcatctcacagcctatcctcagctcttcatttctcactggatgcctctgccttcttcaaaacaatgacagaattcatgaagacgtgttttttttccccaccattttatgtattattttcctggcttttaaacagcattagaatctcactttattcaggaagcctttctggatgaaacttataaaactgaacttctttttgtacactgtaacacctgggaatggacttcctatctccctatcccttaacccgattatactcttacagtatctctcaacgctaaattatacactttacatgtaatataaataaattccttgctgtctattaatatactgagttaagagccaaactcaatgtccaagtttcttataactaatcttaagataatatgagtttgctctttgaccataaccatttagagcgtagtgattggttcatatttcaaaagcactttaaaaggagtttgcatatggtgctaccatacggcagcacaattccttatttgtatgttgggctcttattcatctctgtgttgctaatactttccatacatcctggcacatagtaagacttacaagatccagaatacaacgttattttctagtttagttctatgaacacataggggctgaaaagtcccaatgtgaagtgacagtggaaaagatgataaaaagaagagcaacaatactagtccagaataatagttggatgatatatgaaggactttatatacaccatttaatttcgtccttataccaaaaccatgaaggaggtatcattatttttagagatgaaagaaatgaagtacagagtcatgaaataacttactcaaaattaaataataaacaaagtcctgagtttgaaatcctggtggagtccatgcttttaaccattattgcactgtattttcttgtccaaatggtttttgaattagttataccatgtctaccttctgttcatgcaattaggtgctgctacctccttactacagcatgcaaggctttccccaatctggtcctatccttccttcccagatgcaactgttagttccctcctctataccctattctcaacctagaataaatacgcttaggttccctaaaatgctcttatcccgttgctttccctgttttctcaccctggaatgctgtcctaccctcttctgcctatcaaaatcctttttcttctttataatcagttaattttccatattttccttggaatattctctatttttagactggaatgatgtattccctctttagtatatgcaaaacttttggtttgacttggagacacaaattgcttgcctgcctcttacattaaaatgtaaactccttaagggcaaatgttctctcttatctgtcctggtatacttaatgctctacacattgcttggtagacacaactcaaagttttgtgaatatatgaaaaaatacagaaaagagaaggcgagagggagaaaaaagaggggaggaatagggagacaggcagagagagagagagatattatatattactcaatttggtgggcttgtgtaagatcactggtgcttaattaactcaaacttgtgcttactttgaaattaaaatccatttaaagttctatacatgttttcaaaacacgttttgtattcaataatatctccccaatatctatccttatgcctgggagaaattacacaaactaatataatagcattttaccttcataaacatttatgagctgcaatattaggcaatcacaccaagtgcttacagaagtaaaatctatttattctggacatcatttagaacatcctgaacatactgtctcatatacaaaacaaccctgaaaagcccttccattaaaaacacgtttgagaaatgccgataattttatgatcatttctctttcaagacagacacacagaaagaagggaaaaaagtcctccgaactagacaataaattatatcttcaaaacatccctctataagatccccacccccagaccagtgcagatttgcagggaaggctctgtgcccctttagtgcgagtaccatctcaagtgtgaggtaatcccattatattcatcgcaattagcctgtgtcctgagcctcctgctgacaaaaggctacccattttgctcctaattaagagcagaaaattcttcccaaactaccttcattattacacactgcgtgcttggctctatcaggcaataccttcacattctggaagaatcaactacctctttttaaattggagataaccacaccagtgttaattatgtcaattaaaaccttttcctacactcagcagatgaaactcatttcactagaacaacactggggctacaggaaagagaaaccttcgttacaatgaaaggtaattagagagatcatgtttgccttaaaaacaaacacacagaataaacagaaacaggagaaaaatcttgttcaaccaaaagaaaattatcacgtaaaccttcttagtaaagtatacggttactttaaaaataaaaaatctgaaatggtgaaacaagtaaaactcagccaggttctcctttgaccataatatagctgaaaacggaggaaatatgcaagactgcaagagccgcactttatgttagacagcaacctgcttagataaccaactctgtgaagagacaagtccctttcttcccccactctgaatggaaaacagtggaatttgaaatacgatattcctaaggatatttactgcattaacagtcactgagaaccacaggtcacttttactcactctgaccctagtagaaaacagctggttcactttatttcccccaacacccaccagcatcatcaaatgcctaaggcattgtgttattcaagcaaaatttcaggaggaaaaaatgtatcacgagggtgcttccaaccaatcaggcctttagaatgagatttaatttgccgcttgtatttcactgcctcagcacagtgaccaatgcttgttttcttttttttttttttttttttttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgtgcgccaccacgcccggctaattttttgtatttttagtagagacggggtttcaccgttttagccaggatggtctcgatctcctgacctcgtgatctgcccgcctcggcctcccaaagtgctgggattacaggcgtgagccaccgcgcccggccccaatgcttgttttctgttactcatccgtagaaacctaatcctcaatgcagtggtattaggaggtggagctcttgaagtccttagggtggagcctcatgaatgggattggtactcttataagttagttcccagaacactcccttccccttcaaccttgtaaggttatagtgagaagacagctgtctatgaaccaggaagtgagctctcaccagatatggaatctgcttgtaccttgatgtcagactttccagtttctagaattgtgaagaaataaatattgttgaagctacccagtttatggtattttgttacagcagcccaaactgattaagacaggcttttatggtatatttatgtctgcaattgtcaaaacaggatcccagagcagcaagcggggccagtaaacttgttaagaatgcaaattcttccccattgcagaccttctgaatttgaaactctctgggtagagtgcaacaatgtgtgttttatcaagacttccaggtgatttccatgcacactaaagtttgagaatactgtaaacgtctcctaaagcgtctccttgtctgtactcttgctcatttctaatacactctccacattctgctaccagataagtttttctaaaatctgaatctgatcttatcaacctctctctcaccttaaaacccatcagtgacactgttattccatcctccatcaaataattcgtactatttagataacaaaccaaaccttttaccatctggccccagctgacctaagcaaagtcacatcttcccattcccttgtgtacctgctctgctcaggccaagatgaatttcctgcagcttcatgaaaaagccatgctctttgaggaatctgtgctttgctctttttctctgctcggaatgaatccctcaccgcttctgcctgtcaaacttcttatgttaagtattttcgagcatcatcccctctccgaggcctcctgtggctccactcctttctgtctacttctcctgttgtgcctacaaattgtgttgagtctagagacctctataacgcacaactttgaaaaatacacttgaattgtcatgctatatggtcgtccactcaaacatatctctccctcactaggcgcttgaactcttcagagttgaggaaggtacttgggcaaattatgtctcttttatttttagatacttaaatgagaatacattatgcatctatcattcattctaattactacttattatagtgaatgaataaatgaattgactctggagcacttactgtatgcagcactgttatgctcgtgatttacctctagtatccctattttacagattagaaaaagaacaatagcaacaaaactgagcctcagagatcttaattatgatgttttaatagcctaccgcagttctgggcacattggtcatgctctttaaaatttatttgattgtaagctatagcaatggtgtcaatcctcttgaaaaattttctgtctgaataagggtatgaagttgaccataaagtctctctccttaatgcatatttaattctggtttagatttgccaatcaaaatttataaagacagttggaaactaacttatctttataactcattacgcacattcaattttcccaattttattcatgattgggcacagctaaatcattacagcagttatcatagttgaagttgttttagtttagaccctcaaattaatatatactaaggaagaatttaattagctgaaacctaaattgtcattattaatttactagttatattacaataccttgtaaaacatttatgttccagtaaatggagtacctactttccagtgaccacatggcatagctaatttagtatacaactaaatatttaattactaatcttagtaaagctaaaggtacttagttgaaattaaattgtattacttgcaacaaaatgcttaaacatcatgactctagacctacccaaagtcacttctcctgctttcttgttacaaaatcttatcaaagtagtaatggaagttgaaagatttataagtatttctgaaacattctcagaataactgtaaagggtagatggaactattgtaaattagtcagcacattttatggcaaggtcaaatggggaaggtctgaacattttttcattaatgttaatattcagaagggtacagagttttcatttggtatgatgaaaattctagaaatggatagtggtgatggttgtacaacattgcaaatgtatttaatgcccataattcttcacttaaacatgattaaaatggcaaattttatattatgtttatattttatcgcaataaaaataatacattcaggtttgataactaaatgatattttgtctcacttagtacactaagatacttaatagttcgacttaaattcaactgtgtccatgtcatgcctggcacttgtctactgtaactgatgtgttaaaaaataaaatcccaaccaacctactttatctttttatcatctaagatggactacttcacagacttatgaagtatttactcaatcaataatggaaatgtataaaatccctaaacacatcatattcatcacactatgttgcaattgctcctttattgttgtcttcctcatacactgttgaatgttgagtactgaataggccatgttcaccatcacatcccagcttctcagcatactgtgaggtagctcttaaatgaattcatttatagattgtttagattatcttttaattactcaaagttagtgtccagtttctttaaaaaaatagttcagaaagacatgttctttgctcaactagtgattcaattacataaattataaataggtgtgacatgaaaacatacataggcaatacacattcaagaacatacaatgttaatcataaatgcaacagtaagccatcttctgctatttgaatgtacttacctccattaaacattaaacagtccataaatgcagaaaaacacattgaagtatctatataattgagcaacaaatagtgatgctggacactgacttattttcaaaagcagaactggtgctttagggagacagaagtctattatactaattagaggccattgccctacctccacagatgatgctctcttgggtagatatcaaagcagacactcttgaatagatgcttttcaagttaatgactcaacaatcaaatgacagtaatcctagtatctctggtaagatcaactgcttaaatcagagtcaccttccaaaagtactgctcagtgacagtgaaactcaaggttgctatattagggcagaaatgtgcttgcccatccatgctgatattgtggagcatgtgattacaaagttgttcaaaatagtcctactacaggtcaaaatcagaggcagagaatgacatgaaatagttggccaattagctgagaagctccaaagaattgtatgcaccccataatatctttcttaatgacttgtcacattatattcatttaaaaaaaaacttaggtaatacctgttattcaaaaatatttactcaattcttataatagtgcctatgagacaggcactattattctcattttatagatgaggaagcacacgaggtttaagtaacttgctcaaagttccacagctagtaaatggcagtgctgggatttgaaacaaggaaacctggatctagaaaccatgttcttaaatactctacttttatgtatcaatatattttaatagaagtattaaaaataagaacagtttctttaaggcattttttggggtgggtagaaggacattatggacattcacatgtgcttcctaagaatgtaatcaaagcacgtgtgttttattctaatcttggagaacagggctcagtgaatgaatgatataccaggtggtgtgcaatcaggcatgatcacagagctcaagaatgttaagattcagcaaataagcaaagagggtctgggcaagacagaataaataagagggaaaaactggcatattgtttacactgtttaagcagtatagagtttgctaagtgtttgccttaattgtgtatgcttctttttagatttttccaatctatacctaaacttccctaggatagggaccatagctggatcatttctgtatccatgcatcattgtaagtcccagcacagtattattaatattactgtgcaaataagtattttttaataccaaggggcaaatgagtatttgttgaattgttaattgacttcaaaggctgcagatgatttatttacctgaattttattttcctggggtcagtctacagtcaacctggaaagatagagaagatatgactttcaaattgttcaggacaactacataggtgattttaagaaactggagaatggaaagcattatttaatctggattgtattggaatttgctttctaaaaggcatagtgtagctgataactgctaacaagcattattcatcatactacattttatcctgcttttttcaaaacactcactaaagaaatgactactgctaaaggaaattcttacttgtgtattacaaaagccattttcataaagcctttgtaaattctacatatacataaagaaaaacatcaactttaataaaataatggatatttgaactaaacatgatattcaaaatgttatacttgggaagttaacggaatgctatatgctgagataacaagagacaaaatcatcctacaacatcccctatccttcataaattaaatctgagaacattaaaaacagtcataacaatgaaaaggattacttatggaaagaaaacagaaaagagaaagtggttagtgaagatatttgcctctgaagatctcaaaactgtgcatcctagagcagaggtaataaaaattgttatttctaagaaatagatccaaagtgactccattcaattcacagcaggaacattcaaagtagcaattaatgcaaccactggtgtggaattgttttccaaatgccatcctgttgggtgacttttttgttgttgttgttgttttttaatggaagcagggcactgaagacatggtaaagtcacatcaattatataactgaaaatttcatgaaagattatcaataccaccactcaaaaatatgaatataaccaataatacttttggttaaatgaaagaggaacttagcaggtactgtttaccaaagacattaatggtagtgcttgaaactcctcaatatttgatcatgagaaataaatgtaggggcgtacatcttagtggcgcatgaagccaatgaggccgaagtttggaattgcgaatatctaggttcaaatccccaaaacttggccatcaatattggggagatattggaccaaaaaaattcctaaacctcatattacctggggactcagcttactcatttgaaaggcatgagaagttactgtagcatcatggttaagaatttggactcaggtccagatagcttgggttgaaatcctggcattaggacatgctaactgtgcatctttggacatattaattgacctttctttgcctcatctgtaaaaatgtggatataatagtactttgcatatagggccattgtgaatattgctaaattagaacacataaaatcatagagtagtgactggcccatagtaaagacacaataaatgttcattaatgttattattattatctacgaaaggaaggtcctttctagttttgaacttcaatgtaacattgcatgggactcttttctcttttttcccaagacttgaaataaagcaacaaacgtcaagtgatacatttatcagctggaagataagcatcttgagtcattcagcacataatacttcctttcaaaggagaagtgatatgtcttaactggcactcacgaaacagggaatccctctcttaaaagttgggtggtatattttgaaagagagaatgtatgggaaaggctgggagcagggggacaatattttataaggaggatctagaaaattatttaaaaggaaataaaaacctagaactctctcagagtcattatactaacaattccaactagttaaagaaagatgttcttcttagtcattttctgcctctagccaaagacagagatataattacacacctcctcattttataaaaccagggtgacagagaaagttcattcggaagcccagggggatagtagagtaagaggcatcattggtgaagaggtaaagcagaactatttttcattctttctagaactaggcagaatatttaaatgaatggtaggaagaaaggaaaaagggaatgaaggaaggaaagaagagagggagggaggaaagaaaggaggtacggaagaaaaagtttttacaataggtagattcttcacatgcagttttaattgaatcataaacccatgaaaaggtggttatcaccatttttaatacatgagagcactaataatcaaagaggtgcagtcatttgctcaaggtcacccaaccagtcttgaagccaggtctacagtctttcactgccttactgttcttgggtggtgtgccaataagaggattcacaaaatgggtaaaggacagaagtcaacgaagatgacaaagaacttttacaggaatcttggggaaaaaaatatataggaaagtcagtcctatgccaggataatgtccaaataggaaaggaacaagaaaaagacttatttttctcaatcttcttaaactttcccaagcactgtccctccttcaactcccctaaccccaatatactttttttcctttccacagaaaatacatttttacccctcccatgctagggaatcaccaaaatgtctgtcaaatcacatagatctgcactgctaacaagcacaggaataccacggacctcaatacctctaacagtacttgttttgtcatttcttgctgcaaaccctggtgaaaagttaccagcccttctgatagtaggaactttctccaagactagcttgtgaggaacagtgaatggtatgatagggaaaatcaatcaattgtttgtaaatcagtgtgacctaatgtaacaagtaggtgtggaagagaagaaaagtattttgtgagttatatgtattttttgttttatcaagtttgttgggtgaatagtttgcattcattttgcctcctctgtagcttagacaactataaagacaaccaaagctatcctccaaaagcatttcattcattccccttaccctctacttctcctttttaaaaaatatattaccattttaaataacctctcatagctccttcaaaagattgagtggtgttaactctgctgaatccatgtgtttatcagaacttacatattttgaataaaaaagaacactatttctacccggtgttgataggctggccttgggcactaaaaaccactccttattagacatcatcatatatatctacaatggtgggaggtggtataacaagcccttagcttgggctgccataacaaaataccaggtattaggtggcttaaacaaaagaaatttattttatcacagttctggagactgggaagtataagatcaaggttctatcagggtatggtttccagtgagctctctttccctggtttgcagacagctgccttttctctgtgtcctcacacagtggagacaaagatgaagaaatctgtctcttccgcttcttacaatgccaccaagcctatcagattcagaccccaccattatggcctcatttaaccttaattaccacctagaagtcctatctccaaatacagtcacactgaggacaagagcttcaacatatgaatttggggaggtcacaattcagtctgtagcaggtgggatggagattctctaaataactggaattttaggattgagagtgttcaaacaataaacatttcatcctcaactataagcttgtaatgatatggcatgtgggataaggcagctggaaaattttagtttgatgtcattgttggtggctgaagaagactctggctttatgctagttactgtttgttttacttcagtgttagtggcatggagggtgagaaaggaagagaaccaaagcctcaaacgcaatgctataaaatgcctcataattcctctttctccaaagaaaaaaggcatttgaaaaagaagagcccctgagcatttttcatcttgctctcactttgaaggtggacagagtctcctttacattcttcttactaatggtcaaggaagttccagaccttttgtgtatagtcatttggcataaatgttctgtttcatctagtgctaggcgttttgctaggtgctgagaatacaaagacaaatgagtacaaatctttccctttaaggattctgcagtcttatagaaaatcagaattagaatcaaaaaatgtttgagtggggaggaatctgcttgcagatgaactcaggcccatgaaagcttggacacttaaccaaggtggcacaggttgtggggcagagccagttaacacccaggcctactgacctctaatctggtcttaattcctatacttaatacagctgagagtgtcccatccaagtgaatcatccaaccagggttcatttaggaccttatagatgctaggtgtccagaccaaataggacagaatttataatggtttaataattaaagatttaataagatatttgaggaaataagactacctcagatataagcaaatactacgaggcattttttaaagcgggatggcttctctaatagcctcattcctgcaatacatgtgcaaataaaacatgcagattatctgattatcaaatttatctttacaatgataatcatgcttaaattaatcttgctgtgttggagaatgtctcctttcatcttcattttccaacgtaatatcactcaacaatatcaggtagaggaatatcattctaaagttatattaagaaaaaaatgcaattaaagttttgtaaactagactgaaacaaggctatctggatacctggtttctgaaggaccataactgagaagtcaggtctcatttccagcttatctcttctccatatcagaggtccatccaactgaaggtaggtttaaagaagaacataaaatatgagttggggctagggtcacaggctgtagattcagtaaacctgttcctgaatgctggctccaccacttgtgacctatggcaaaatcccataacatcttataccttagttcatctatgaaatgcagctaatagccaggcacagtggttcacacctgtaatcccagtactttgggagtccaaggcaggtagatcacaaggtcaggagatcgagaccatcctggccaacatggtgaaaccccatctctactagaaatacaaaaaaaattagctgagcttggtggtgggtgcctgtaatcccagctactcaggaggctgaggcagtagaattgcttgaaccagggagtcggaggttgtagtgagccgagatcgtgccacttcactccagcctggcaacagagggagactccatctcaaaaaaaaaaaagaaaagaaaaaaaaaagagaaggaaatgcagctaataagagtacctcagaaggctgtagtaagaattaaatgagatggtatgtgtaaaatacatgtaataatgctcgagtaaactgcttaatagtcattcctacaactagtcacaattttacagtggttttgtgaccaactatcttgccctccagcctactcctgccttccttcactttggccatttctctgatcctgccctttgtctactttccctgaccttataacagttgtgctttttgctctgccagggtgggcagcagttctgggacctcagaacaggtgctactgtccattttgctgcttgattcaccttccaggtgacagaggagaactgcagcagggctgcgttcagcatggacaaacacctgtcctctctgtcaccacagctaggcagacactggcgctgagtcatgctgctgctcacaactgaggagctttgagagactcacaagcctctaagaaagggatctaagaggacaatctgttcatccttctctccaggtcagaccactcttcaatctactatgaggcaaaaatagaaataaaatgatcactgaggactggtgaatcttcaatatcaggacactacttatgcctgagataaatttcagattttgcatttaatttttaaaatttatttttcacaggaaaaataaacttagtatctaactcatcataaacctacatgattttataaacatagtataatatgtattacacataacatatatatacacacacaatatatagtatacgcaaacatacagaagcagagtattatctaccagtgaggagatcaaggtctagaatcatacaggatgtctaatcatagtcacctactggtgatatgttttctctctaaaaactagtagtaataatctcactgggtctttatattcacagttctcagctcatagaacaaattcaataaatattaaccattgttgtttagacatataaatatatagtgggagtctggaaggcttcttaagttttctcttctgcaatctaaatggttccagtttgattatatcttttaattcatttcataatgttaattttcatttttttcctttatcatttaccttcctaaattcagaataggacacataatatttgttgagtctgactggcacaagtcaaaatatatgatatatctcagtgttccatataatactctgtatgaaaactattattaatattaccagataaataaaaataatttgatagcaagtataatattttaaacactttatttatattaactcattttatcctcaaagtaaatcattcattcttcaccattatgtcatatattattaattctaagaataaatatttttcactttttaacacctgtgaaatcaagatgcatcttgcaattcatgatgtgttatggtttcattggcaatcttttttttagtaatagatgaaataatgacacatctcaaaattgatgacaacttcaaatcaattaaatatcatacgaaagacaactatgtgtcaagcattcttttagaccctagaaatatgttgaataagattgagaaatcattcatttcaaatctactgaggattgtagaaaaatgaagataattacaacaaatgcacaagttgctgtgggagctgatgatagatccatcctgggctttagaggccaagaaaagtttcctagtgatggtgatgtcacctaaggctagagtggaataagtgatggatacagccaggctgtgattagctggttagccaaacagattaagcaaaatcctggaagctagagagagcatgggccatttagggatttgaaagtagttcagaattctggatttaaagtgctgatagaagaggtacaaggtatgatgacagagaggaaagcagaggccatatcatgatgggttttgtagattatattaatggtttgaacactgtcttgaggacattggagatctactgaagcataaatgttacttctatttgacagatgagaaaactgaggccagagaaaccaagtgactgacttcaggctggatagcaaagagcaaggctaatttaatcccctccctctaaatccttgcctgaaacctggtgccccttatattctactaagatcaccaggacataattctctttccttggtcctactgccagcaaatgtattactagtttatcctccattttagtttttgttgaattaatgtgtttggtttagacaagggggagagtagaactagtgtgctggtttttaaaaagttttccaaggtgggccaggcatgggggctcacacctataatcccagcactatgggaggctgaaatggattgcttgagtccaggagttcgagaccagcctgggcaacatggtgaaagcccatctctactaaaaacgcaaaaaattagtcagctgtggtggcacatgtctgcagtcccagctactcaggaagctgagacacgagaattgcttgaacccaagaggcagaggtttcagtgagctgagatcacatcactgtactctagtctgggccacagagtgaggccctgtcaaaaaaattcaaaaaaagttttccaaggtgagtatggcctaatgtcaggatatgtggggttggttacatcactcataggttataaactgccaagctcatctacaggtgtgtctgttagattatgaatattgatactagtctttcctaaatgcatcatgaaagtacttttcataatgtgcactaaaaagataaatataaaaattaaaacaaaacaaatgaaataagcaatatattgctgacggggaagtgaaggttcacaagttttggtattttaatactcttgtatattactacgtaaccagaaattgcactttcaatttatcttaaagattcttcaactggccttttagagtaagacaatctggagattgtctaattaagagatttaagttgaaacgtgacaacaggcatacaagtaagatactaacttctgaattacttacacagggtcaaaacaaagaagaaaggaataattatttgaatggaggtattctatcccagccaggcaatctggatttcacattatcacttttaaaataattttattcagagaatttgttggtacaaatgaacttttaaatgaaagaataacaaagaatctcttatgtagcttatttagaaaaatgtcaatgtgaatcacctaacatctttgacttttttcaaaaagagagcacatgtacaattgccaggcatttaggtcctttttgattaaagacatttttggattctataggaataagcaatgagtacaaatgccaacgttaaggttaaaatgatatgacaattaaaagctattcaaatagaataataggtgtcccagcatggtggctcatgcctgtaatcccagcactttgggaggccaaggtgggcagatcacttgagctcaggagttcgagaccactttggggaacatggggaaacctcatctctacaaaaaaatacaaaaattagccgggcatattgacacacacatgtgttcccagctactcggaaggctgcggtgggaggatcacctgagtctggagaggttgagactgcagtttaagcagtgattgtgccactgtactccagtctgagctacagtgagactccatctcaaaaaaaaaaaaaaaaagaataataggtgacaaaacaagtttgctacacttaaccaatgatagaggacaaagaatgtaaaatctttaacaacatgaaagaaaactgtttattcaatatagtttatgtatagtcttatctgaaataaagaggttgagttacacaatcagtaactttgattctgtaaacattatcactttgaaattctaatataaaagagagggacaagataagaaaagatgagtaaccttattcagacaagacagattagtggatctagaagaatgatgagtggaaggaagaaggcgctagagacacaaggagtcagttttggaataccttgggctgacttggtgcaaatcccaacactgagacttaccactaatcctgtgaccttgggctagctactcttctctctaggattcaggaaaaataatttctatttaatagggctgttgtgataattagattaaattttatgtataaagaagctaatgtataagctgtatggagattactatcattaatattattattgttgtgagcattatgatggtcattttgtgatgctactgagttctagtgacattagctgaggcaaaacagtagacaagacaactagtaataagtcacactgagtgtttaggatggcatttagtcttgcatgttcctaattattaagagcttttcaattaaccccaaccttgaggaaaatacttttcagtgttaaaatagaagtgaagggctatggtgagttcaggttgttttattagagtgtgaagaaataaactgtcacctactgaaaaaaaaaaaaaaaaaaagaaaagcccagaatttatagagggtactaaaaatcacaatcattgtccattgtaaagatatatctccccaaatgctaaaatatgatctttcacaattaagtatactggtcattttctaaacaaaattcaataataatcttattttatacatcttcttccatctgttgataaaccatggcaacatatcgttagtagcactttacatgccccactgttttgcaactatatgatctttgatattataggaatacattatgtaaattaattcagcttgttgtattatttgttaactgtcttctcagctaaagtacatactgaacccttagaaaaaaattaatttaaaattatagttttaaataagctatgttataaaattaggtatacaaaataaatgaactatttccattcaccaggcatcgactgagtgcctacattttttgaggcaacacaccttttaatttatttcaggaactctgtgaatacaaattccattaaaaaataccaagatgttatttcatgttgcttatcatgacctaatgttcaaaattaactcctcctagctctcttcctagcacaaaggcagtagagttgttatttcctttggtctttgtcactcagagagcaaaccttcagttctctaatgtagatttcctgatgtaaatgtatcttactctctgagtaaggtaattaaataatttgaacccttaaaatcaaacttggtttcttctggcttgttttaaacattagccatcacagaaatggatgggacagattgaaagccccttactagctccttaagaagcagaagctcagattactttgttgtatcaatgtctttttaggttctatacactgaattttatagagctgctatttcctacatttgggtccaggcttgaaataagtgcttctgggagattcaactttctttgcatactaatttggcataagacattatctcccagtggctgtcagagccatttatggtctctgacagttctctcatccatacaacttataatttttataggaagaaaggacttttctaaaacatttgttccaataaaagacccacttacaagtctctttcctgcaaaattacttgaaagtcaaaacaaaacacaacctcaaaagccaactgttcaatatatatgatactagttgacacataatagttaggcttgtaatctttttatctgggctatatagagtggagaagagaccaattccagcccaatcctcccctccctcatccaccaaaagtgttattaaataacaagtcagttacgttctaaaattgtcagatctggacattataagaggctctaaagtcagaaccccagtgatattttctcttctaaagctaaaaaaattcgtatcttggttcatcactggattcttgttcattttatcatttccactctgaaggaatgaatagcaagttatagtgaaggcatctttctaggtgagagaaaacactgtgccacaggccaggagagccatctctgggtcaatctcatgagtttacataaagcagtaaagatactgggctgaagatcatatcctcagaggaatatgaaaaatctgtttcacaagattttgttacctttggaagtttccccaatgcctaccgcattggatattgattccctaaatatgacagtttggacagtgccccagaaagcactggagaattagagatgtaagctatcatcttctgttatctccaagcatgtaatataccttaggacttacaggccattttaatttctcagggaaatataactaattaggtaagtctacacagagattctctggaaatgactggtcatgctgaatacaagaaatgcaaatctattctttaaatggccacaactacctgattataaatataattcttgctcattgtgaacacttttgaaacgatggcttagtgataagataccaagcacccctgtagagtctggtcaacgttactgagagtcccagatatatgttcctaggacacacactgtaacacatgtactagagaaaggctcaggtatttataacgcccacttcagaaccaaagatcacaataataaaaataatgcagtacagcaacaagtttactagagagctctctgaacaagcataaactgcagctgctcaattgctttcatcctatgtaatttaaaggaatcttaagtctctgtgaagacactgtatcagttgatgatttcaccacgcattttgaatagccaatgatcttgcttaacccttaatgctcccctcccaagcaagctaggctctaagtgttaccccttttcatagtggcaaggaccacattcacagtgagaggcaggttctcactccaagcaaataaagactgcgtctgtactcagaccaatggtccagagcaggcagttggcaaaccggaaaggtaattttcaaccccactcattccataccttctctgatttcgccttcctggcattgtgcacgaacctgcgacccagcttcttagcataccagatagaggcaaacatagcgatgccaatggaaggaattcacaatgaagctgccgcacaatcaacttcccacctcggctcagagacgaacagaatcaggctggagctgtcacttgcaggctgttgctttctcagttcctctcatgctggttagctgagggagagggtgggaggagggaggggttgggggagaaaaggcagtcctgtttggccagtctgcaggtatatttacatcctgccagcaggaggtccgggtgaggcaggcgctgcctttgtagccagctcacacacatccagttggctaagtatttgtctgcagttcttcggcaccggcaccgtcgccaccaaactccatgtgtgtcaggaggaagggaagctgcagtcaagtccggaggcagctcacctccctctctaggcttgggcagttacaatcctcgctttggcttccctctatcttgacagtacgtgctggcggcagtggccacataaagacagatccacatacagcctcgcaggtaaatcagccaatacaggaattgccaggcatggggaagagagctgccaggcaaggggagaggcagaaccaccatgaatctgcccctgcaggcacaaacaggtgtccctggaacccaatcccactcatatcctccaagaggactaagaggactatcagggctgttagggtgactggaaacacaagcatccttctcttttctcctccccagctccatttggtccaaggaatatcacttctctgcccaccagccagccttatccacaacttacaaggtaaacactttatttctttagagaatggcctgggaccaagggcaaagtgagcaggatgaagtctcctcccaaatgcctgagtgaaggtccgtagttttagaagtcattagttgtacctgtaaaagaactgaggcctctattacaggacgattttttgacatagttactggaggatggacaggggttcaaatcgagtgttaaactaaaaagagcaaactactctttttaaaaaaaataaaaaataaaaaataaaaaaacccaggttttcttgtagtgacatccagtgttcagtggatgactgaaatatcacctttggggaggtagatttatggcagcttttaaatcatgctcctttgaagaattttcacatttgattctaacattaactacttccattatcttattagagtttagactattatgtgaggcacctttaagataaggtcaatgctaagagacaactgtttcttccaatgagagataaggttttagccctttgccagtcctaccagaggacaaaaataaactgctcatgatggcaaggaaagcctgccttccagtggcacacaaactagactcaatatagtaaatgttttccagctgatctgacagaagtgccctatgagcaatgaagaatcaaagaatgtcaacacacttgcagacacttggaaaagaacttccttctcttaacaaagtcacttgaggtctatcccttaagagagtttcatctgtggaatcaacaacaacaacaacaacaaaagtatattgtaaaggatgttgaataccctcataggcaattggaggtagaacaagacagtgtaagacaggacattggtagtcagaacccatgttcatgttactcacactaaggtaactcctgtgcctagaacagtgcttagcacaacacatttaatctacgtttattcaaggaatgaatgatcttgtttctgaccctgactttgcttctaatttatttatttgttttctctgggttcgatgtgcctcatctgtaaattaagagaattgggcagatatttttaaagttcctttcctgccctatgagtctatgatcattattgtgggtcttcaaatgatattgaacagaaatctcgagtgctcaccggatacataggctgtggtgaaatgattcagtgtcccaaaaagtcaacagtggtacccctggggtagcccagcttcttctacctcctttgacatgccttgctgccaaccagggtttggtttttccattagctatttcttttgctctatgctcctacaagcactcctttcctttaatttccttttgacactctaaggcaacccctgtgcaaatttatccatattataccctgtactctctggaggaaaagtgccacagaaatccaacgaataaatatacatggtaactcctgcttagttttcaaagagctactcagcaggaccgtagcttactctaatattgctgtgatgtaaaggtatttattatttctgcacacaagttgttccaagccatgttgtagttaaaagtgtattcaactaaaagactaaagtagataaaaagaacggggataaacaatcatccctaagttaatgattagaaaattttgtttttaacaccttagacagaatcagacaataaagaggtgagacaaaatgccttgaactttcaaaccactgatatcatagagagaatcaaaggatgttaatttactctgatgggactgacattataattttttatatctttctataatttttgcattctcttcatgagttaaaacttcatggatcactaaaactaaggcttggagagatctttgatgtttgatcaatttgtttactggttttgcctttatgttgaacctttagtgaccttttttacacacctgaccaagaggctttataaatttttttatagtacaagatccttataaaataaattggccctgccagctaagatttaacttatgacagtaataactattgtttcttaaataggcagttggaggtagaaaacacagtgcagttaggactcgtgttcatgttatgcaaatgctcagtaaacagtagatactcaaaatatatttgtcaaatgcatctatgacaaaatagaaaaatccacaaactgagaaagaccagaagactcaatagaagaatggccataaaattctcagtagcaaaagttgcttgaaagatggatataatgtcaactgaatgaagtcattgccatatttatacaaccatcttccctggctctctgtgggcagatgtgtctgctgtaaaggtggcagcttcctacagttaatcctactagtctctaaccattgctctgctgattgagataaataacatttgcagctctgctgtataagtaaaacaaatttttcagacattttccatctgtatataatcagtacctggacagaccttttcctttataattttatttttaaagcctctcctatgacggaaacctaccagtgcagctgagtttgagatgcaacagtaatccatttaagcagctttgggttcatgcctcaacacacacactatgtgagcctcctctgaattctcaaggtaaatacaatgtttaaatcaagccattaactatcatacattttctgcctagcacatgaatgatttttgtttaaaaataatctatttatatcagagataattatttttaaaaacagagccaaaattcaatccaaggaattaatatctggtggcctgaaaagctatgtaatttcagtgttgaatatagaccaaacaaaataactattgagacataagtaagttaatgtaaaaaattaattgtacaaagattttgattggtttgtttgcatatttgatatgtatatttgatagtcctttggctaatgtctgatgttagtaaattattattattattattattattactattttgagacaagaccttgttctgtcacccaggatggagtgcagtgttacgatcatagctcactgcagccttgaactcctgggctcaagtaatcttcctccctcagcctccagggtaggtaggacagtaggcacataccatcatgcttggctaatttttaaattttttctctttctagagatgaggtcttgctatattgcccaggctggtcttgaactcctggcctcaagtgatcctcgtaccttgggttctccaagcgattagctgattattaaacaaaagggtggaatatatagtacgtagaatattttggtaaagaatatgtacataatatttaacttcaattcagaggaatgccaagatcttgatattagttacttctatacaaactagtagaaaggggaagattaaaacagttatattttgctctaagtatatatgtatcatgtgactcatctacataacatattctcattagtacttgtgtgactgaaaatgtaaacaatgcttttccacaaaaatgtattgagtattactacatgtcaaaccttaagggcctataaatgaataaagtacaatctttttctcaaagagccctatatagctggggacacatatctatgaataaataaatctcaggtgtaagaaaggggtccagtttcagttttctgtatatggctagccagttttcccaacaccatttattaaataggggatcctttccccattgcttgtttttgtcaggtttgtcaaagatcagaaggttgtagatgtgtggtgttatttctgaggcctgtgttctgtcccattggtctatatatctgttttggtaccagtaccatgctgttttggttactgtagtcttatagtatagtttgaaatcaggtaatgtgatgcctccagctttgttctttttggctgggattttctcggctatacaggctcttttttcattctatatgaaatttaaagtagtttttttctgattctgtgaagaaagtcaatgatagcttgatggggatagcattgaatctataaattactttgggcagtatggccattttcacgatattgattcttcctgtccatgaccatggaatgtttttccatttgtttgtgttctcttatttccttgagcagtggtttgtttttctccttgaaggggtcctttatacaccatagaatactatacatccataaaaaggatgaattcatgcagggacatggatgaaggtggaaaccatcattcttagcaaagtaacacaggaacagaaaaccaaataccacatgttctcactcataagtgggagttgaacaatgagaacacatggacccagggaggggaacatcacacactgaggcctgtcagtgggtgcgggaggctaggggagggatagcattaggaaaaatacctaatgtagatgacaagttgatgggtgcagcaaaccaccacggcacatgtatacctatctaacaaacttgcacacctatctaacaaacttgcacattctgcacatgtatcccagaacttaagtataattaaaaaaaaagaaagaaagaaagaaagaaagaaagaaatttcagtgaagaatggccttgttacaaatgtatgatgctcagggataaaattactgattttcggtatttatatgatataaactcactaataaatattagctggaaaaagtgcaataattagtgctaatgtatattaaaaagcaaagcaaaggaatagctacatgtctttgcatgttttatcactatggacaataggaaaaaattgtcactatgaatttatatgtatatcacagtcaatgctacaaactggcccggctgcagatggatatatttctgcaccgaagaaatacccagttatagataagtgtgaaaaaaagattccaaataataaacccactaactctaattataaatgaacaaagcctatatctttttctcctcttaaaatcatcaaaactcattcttcaacagttgaatgtataatgtgcctcttctttcatatgtttaatcataacatacttggcatcagaaatgtaaagaacctaatgtaacatttaccttccatccagatttaataaatgttaatattttgtcatatttgattcagattaattttttaagaaataagttcttcataatataggtaaaatctccaccctacctcctcaaattcatttcaaaataattttcaataaacactcttgtagctctctctttaagtacatacaagtttctttagagcaggtccttcaaaatgtaattggtggatcacagaatatgtccagctttaatgctattcattacaaattgttctccagttgccattattagtaatttaaatgagtagtatatattagtagtttataagagatcagtattctatataacacagtgtaatcagacattcatgtttccgaaacataatatataatgttaactctttgtagtcttgatatgcattttcttgattactggtgagacttaagatgttttcatacatttattggttatttgaacttccttctgttcataccccttgcccatttttaaatagggttatatttttcttattgacttgtgaagtacttgatgtatactgaacactaatcttttattatgggttttgaaaatatctgtttccaatctctgacttgtcttagttttattcatgttttgtcatacagagccttcataaaaattaaaaggactgaagtttttcagtgttttatgtttacatttttatcatttttttctctcttctaagtttataaatattttattttctttctaagcaatttaaatgttttgcttttcatcaataagtctccaaagttttttttttttttaatttacagtgaaaggaacaagatcttgtccttttcagggacatgaatggagctgaaagcctttatcatcagccaattaatgcaggaacagaaaacccaacactgcatgttctcacttataagtgggagctgaatgatgagaacacatggacacatggttggggcagggtaaacaacatacactggggcctatcgggtgtgggcagggaaagggggagcatcaggaagaacagctcattggtgctgggcttatatctaggtgatgggttggtgatctgcgcagcaaaacaccatggctcatgtttccctatgtaacaaacctgcacatcctgcacatgtacccaataacttaaaaggtgataaaataaaatattaaaataacaattaaaaatagtaatttatggtggaaggtaggaatctatatttttcccatatgtatggccagttttatttatttatttacttatttatttacttgcttacttcattagctgatatataataatgcttttccttttccttactgatttctaatgtccctgagttatatatctagataatatgtatgtgcatataattgtttcctggctttttaacaattatcctatttttatttacctgtgccagtactacattatgtatgctttatagtaaatactgttacttgaagggtgattcatccttttcacttgatctaacttttcaagttaattttcataaatttgtacaatagagcacttttatagtatctgcaaaatgtcatgttattattgtatacttttttttttttttttctttgagacagagtttcactcttgtcgtccagattggaatgcaatggcaatctcggctcactgcaacctccgcttcccaggttgaagcgattctcctgcctccgcctcccgaatagctgggattacaggcacgtgccaccacgccgagctaatttttgtatttttagtagagacagggttccattatgttggccaggctgatctcaaactcctgacctcaggcagaccaggtaatccgcctgcctcggcttcccaaagtactgggattacaggcgtgagccactgcacttagcctattgtacgctattttaattttatcttgctatagtagttacattccccaccaaatcagtcattattattatcaccattatcattttttgttatagtttactcacaataactatcagttaacttctttatttttagaatcctaacccctctttctggattaaattttcttcttacagataaatacattttaatagtctttctgcaaaaatcaatgatgtttaaacatacccaatcatttatattttccctgaactgaatgatagtagactagactttgaatgagagtatagaaacagatttgtaaatcgacaatgattttccctcagagctttgaagatattaacctgctgcctatttgctgcctgttacaagaaatatgtctttcttaatatggtttgcataaatacttttttttgcctttcttgaacttcggttttactataatattttcttttttaaaaaatgtacatggaactcattctgtttctttaatctgattatttataaaataagtctcagtcatggccgggcgcggtggctcacgcctgtaatcccagcactttgggaggccgaggcgggtggatcactagctcaggagatcgagaccatcctggctaacatggtgaaaccccgtctctactaaaaatacaaaaaattagccgggtgtggtagcgggcgcctgtagtcccagctgctcgggaggctgaggcaggagaatggcgtgaacccgggaggcggagcttgcagtgagccgagatggtgtcactgcactccaggctgggcgacagagtgagacttcgcctcaaaaaaaaaaaaaaaaaaaaaaaatacgtctcagtcattaactcttcaaatatttattttccctcactctcattattctcttaaattctgttatgttttttctggaccattttattctacccgtactattgcttcatagagctcatatttttttctccttcctcctctgtgctgctttcagggtatatcctcagatctaattactattttctaatttctatttttaccttaaatttcaatttattgttttttacctacctacagagtatccatttttaatcaattgtttataccatttttatttttagacattctatatatatttttaaatctatcatgttctgtttttattatgatttttcttcctttatcatgattttaatttaacacatacttagtttgtagtctttatctgatatttttattccctaattttcctgaacgtctaatctcactggtttcactcatggtgagtattttctgcatcgtattgtacatttttattctgagattatctttagaaagattatagtttctgtgggagtccctgcgaccttcagttgtgcaactgttgctacagaataattttgcacatccctcttctagttgtccagagatttcactagcccaagagcagtttcatatcaattttttttttttttgacttggagctatactctccccacaaaatagggttgggtttaaatttactctttttttttctttttccactcctaatagaaacatgcatccttgttgctaccctgggctggtgaataaagtttttaaaaagtcctttcacaaatgagaatccttttatgttttcagttttatgcaacagtctcagtttcatttcccttcctttggtgatcctaacgtcaagtgtcctgccctgaatgtccatcaaaaccctacactctcaccctaaatgcctttattgagtcccatacacccctgggataccatagtcagttcaggatctcactgctgtggccatcattatacacaaacacaaacaagtccacgtggcatccctctaaattaacccaaaatcaaactagatcatttaactagcctgcaaatgaggctttagagtttaataagtatgtgtggtaacaacatgtataagatttattgttaagtgtttcctgcaagagatttggggaaatcaactaattaaaatgttagtcaaaagtcaccatattataatagttaattagctaaactacgctgtaagacagaccaccaccatcattattgtgaccttggaaaagttatgctaactttataaaatgggggtaataacggaaactatgtaacagtattgataataggagcaaatgagataatacatatacactatttggagtagttctggcacatagcctgagtgcaataaaaatactgcttttatttttattcatattccaatctttaaggaagacaaaatcacaatagtctagacagacagtacatgctcaatattatgaaaagaagccgaaaagaatgatttctaaaagctctttataattctgtttaatcatcctgtgaggaaagtctaccttctttctgcttcagtgttttctccccttttatgccattagcaaagaaaacaaatcagttgcaaacttgtaaaaatatttcataaatttaaagtcttccaggttcccatgtgtctcttttctgagacaaataaatatcttcttgagccttatgagtagttttttctttctttttcttttctaagttttatttatttatttatttatttagagaatctttccagagcctcaaaagaaggcttgcaggacctcttgtaagaacaaaaactcaaatgggtcctaaacttatatagtagatctgaattaatatgctgtgatttaccacccatgtgttcatgtgttcaaaattaaattttcttacagcagaaaaatagactgataatggcagtaactatcaaaaggaacgtagagctgggaagacatagctcctcacgagcaatgtagaaaaatatcaagccagcagtcaagaaggaatatctaatggaacattagaactttgacttgtgagcacaaacaacaatgcataaataaggccatttttttgaaacagctacacagtgctaaagatgcctaatttaataatttagtaactgagaatgcaattcaatatctttaaattcacatgctcttccaaagcatgcaaaaaacacagacatttaaacaccactcacctaacctgactgctttggaatgggaactttcttttaagtaaaattcagttagcctggtattctagctatctcaacaacagaattattttcataattcatggaggtgaagtgctagttttggaagcaatagtcttagttttaatttcatttccatcagttgtcacatctctgggtattgaactacataatcaattccttatgagctcaaataatgtattagtccatgacatttatgagcaataattaatgagtaatacaataatctcttaaatccggtggccatttttgatgaagttgtatttttgccataccatccctttggatcttcacaaaattattttctgtttccccaatgtgctctataaatttgtacctttgaacatgctgtttctgctgtctgcagccctatccaccttactttctgctccttgtcattttatatgtgacaaatcttgacaaattttctgagatgtggctaaataaatgtctatgaaaatttttccagataaccaccagacagagccagtaactctcttctatgtcccttattgtactttgtacataactcagatttagttcttattatatttacttgtaattactttgagcttatgtttccctccgaacgcctatgaaacactcaagaaaagtaacataccttatttattttcgtatcctcggagacctacatagtcctccacacgtggtaggtaataataactatcttttgaataatttaatagttgtttgcttaatgaatgaacaaatgaatgaagcatatcacttgaatacaacagcttcacactcctatgagaagaaaggaaggcactatacagagacctatctagcatttgttattaccctctatttgcatttttaccttatactcatcttcataccataagagacaagtcattgtaacaagtgttcaaagtgcttcagaaaacaccatttctaaaggtaaatcactgacacttattgatacatggacctataagctgtcacattttttttactttgtaattcctactctttcacagtaacaagtgatcttttgcaaaatacaataaataaaaccaatttatacagtaataaataaaatccctttttatttccttaaaaatgagatccactaatgaaaacatacaaatcatttcattttccatcctgccacctacataaaacagaaagagcagctgctgaaatcttcaatgccaatatcaattacagatagtgttgctgaaaatattcctgatattaactgcaacctctctccagcttaaaaaatatacaaagttttaaaaaaggtgtaatagcatcatcttgttatatacttcatggctaactagatagaaaaggggagactgaattgttagttgtattctatatgtcagctatttttatgttaagcatctttatatgaagttaaaagtgccttgactttaagatgcacaaagtattttgtccactaaagtacttaacatgcatttccttagtattggtctaacatcagccatttttaaaatgtttacatactatctttattgttgtttacttatgttattttaaaatttaatttgactcactttttatttaaataaatttattttaaaagggaacttattgccatccgaataaacacaagggtttgttttcataaataaataaccatataaataacacaataaaaataaaatactaatcacattaagaagtaaaataaaaacaagtaattttaaagtctaattgaaaagatgatggttgatactgaagttacaatttttaagtaattacattaaaattaaagtataagtatgtttttaaagatgttttccatctaccatcttatgtatatcatacttcaagaaatactctcaactaatttaatcctcacaaaaaatacctgagtcagataatatcaaattcctttcacaaatttaggaaactaaatttcagaggaattgattaacttattcaaggtcatttgcctagaggaattaagctttgaatcctggtttgcttctcacttgcttccagattttcaaaccctgtctgactctcaacatccttatctttaagccatggcgtaacagtacaagaaatgtcatgtggtagcttatgacaaaaaaaataaataaaagcagcaagttctatgagttcagagaacattagcccatgagttggattggtgaagacaggcttactgtgagaaagaaaatttgatttagtacttagaaaacagatcagaacaagaagtacttttttttttttttttccagaagaaacagcaggagcaaaagcaagaaggttggaaaacatgagatgtgtttgaggagaaaaataaggcagaaaacactgtacccataattagacaatgtcaataaatgtttaatcatgacaaacatggtcagatttagagatcagggagaatgatgaaggtggtagaaataatgggggccttaattagggggatgatggtagaaataaaggcaaagaccaataaaagaaacattatttcttaatgtcctagactgagttcaaatccctggcccattctcttagtaaaatacactccttttcacaatgtttatcatgttgacaataatctatttaatacatctatttttcatggtttccttgtagggcattccatgaaagcagaggccatgcctgtttattcatcattgtagcctccgtgcctaacaacatgcctggtgcataataagtgttccaaaaaaaaaaaagagttatttaattcatgcttgaaagaagaaataacatagggaacagaatgtgtataactgatctgtaatccaaacctcagcatcacgcaatatacccatgtaacaaacctgcacatgtaccctttaatctaaataaaatttgaaattattttttaaaaatctgtaaaatttgactgctgctttataggctgagaaaaaaaagtcaagcagctaaagagttgagcccaggggacttcaagttatctgtaagacgaaggaaaaattttcatttgcatggcctcttctttcattataaatgtttgtatttcttcccttgtctcttcaatccttttaccttctaatattataggctgcatctaaactttcgttaaattaatgtcttagaaatttaattatctcattaaatttctcatggtccacaatttccatttaaggcttctatattttctttgtaaactcttctaaagcagataattattttttcttgtttttgaaatggagaagtgttgtcaattattttattttttctaattcattgtttgcccttgggagcttatgctgtgcctagggggacatccacattcatgtaaaaaatgaaagcgttcatgatatgctaagttttagatatattcagattttaatgcccctggaaaactcgggagtatatatgtctaataagcaatgtgataaagtaatccctcctccacttatttatttattcaacaaatcctaatttgaatgttacgatgcaccaacctgtttataagcaatggggtcgtaacaatgaacaaaacagacaacaatccctacctcatggagcttacattgtattgcagaaaagagatagtacaaaagataaatagaaaaatgtagtctcttcaatagtgatacaagctaaagagaaaaataaagcagataaatggaataaaaggtgttgggaatggttaaatttttctgataagttgattaaggtaaagctcagtaagattaaggaagtgacagcaagccaggaagatatctggggaaagagtatgtgaaggccttaagaagggactgtttgaactcacagatctatcacattctagatatggttttttgaaaaagtagatgaatctagatgaatgaatagaggtatattcatgtgaaatatggtgaatggtcattttcatcttcaagtaaaattgtaattgttcctgtattaaataaactgaaaggttaacaaaaaaaaaaagaaggaagaaggaggaggaggagatgaggaagaggaggaggagaaaaggaagaggaagaggaggaggaggacgacgatgaagactagggctaccatttgacaacagtaaggagaacagcatggctaaaacagaatgaggaggaaaatggtacaaaataagattggagagctagacaggtaggtgaaggaagaagtgtggaaagcagatcttgtaagcctcataagctactgtgggcaatctggcttttgctatgaatgagacaggaagcaatctaagagcaataccatgatatgactaatgttttaataggattactcctgctgtcttaaaaattttgactctaggggatcaaggcttggagcagggagaacagttaagaattattacagttatcaaattcaaaaggaatagtaacttggaaaaactaattaatatgaaaatttttaaaaagtggttgggttctggacatagtttgaaggtagatccaacagattgtatgctacactgaatgtagcctgtgagaaaaagaggagtggcacagatgactccaaacattttgacctgataaaccagaaaggtcatctcatcaccagctcaaaggaaagctgtggatggagcaggttttgtaagaaacataagaagttaggttctgacaacctggtatggtggtgtgcacctgtaattccagctactcaggttggggcatgagctcaggagtttgagttcagcctctacaatgtagcaagaccccatctccaaataaataaataaaagtttaaaaaagaattacaaatggatcgtatactcagaaaaatatatttaaaaaatacagaaaagataaatatttaagattataggtattccaatcaccctgatttgattatatgaacgtatcagattatcacacgtaccccaaaaatatgtatatctactatgtataaattttcaaaaaaaaataaatttaaaaaaagaagttaggttctggacatgttaacttggagatatcttttagacatctgactgaagacatcaagtaagccactggatatataagtccagagtttgaggaagatatcaaaatagaaatggtatgtaaagccttgatcactggctgaagtagagaaaaagcttaaagatcaagtccttgagcatttcattgtttacaattatctatttaatacatgattttcttactgaactgtaaatcctatgaaatcaatatactgaaagagggataagaaagttgaggttctatgtaatggaactggttataaagaattttcctagagtttaagcttggtagaaaaggtagtaaggctagaagagaaatgggaaccagataaaagatgataggatcaataattataagaccaggtaaggcccaaaagtttgttggagttaaggttccaacaagtatttcaggtttatattgtagatattttgcttcgtgtggttaagatgactaccaaatctaacatttatcaagttttaaaatatgaatcaagtacttaactacttatcttatttaattttcaaagaattcagtgtggtaactcctatttttgttcccattttacacgtaagtaaactaaaagaaatgaagtaccttgttgggggttgacactcaaccaacaatggcacattccgcatgcaagccaaaatctaactcagaatctctgctcttaaccacaagtaggggcagaatgcctatcatatggtctctgttttccttggaggagggtctgtagcctctgtgaacctgttagctatgttgaggatcagaagccgttcttcttattttctgtactcatttcctttgttgttttctttggtatttggtgcagtctttgcaaaattctattctgccacagaggagttgaagaaagtcaaataaaggctttattcatgacaggctagatcatataaggagatagttctacctgaggttgcctcagggaaaaaataattcaggaggactgagttagggtacttttatccagtgtcccatctgcacagtctcataaaaagatgactaaagaagataattagccaattagcagtatgaattgaaaagctgaatctccagaggaagatgataaggtacaaaggaaggaggaagaagaaggcaaaaatttaggagctattctcatggaaggaatgactgtcctctgagaagaaatagatatattcttactacccatggaactcaggaaattgtctagcctctgatactttcaaaaatgtaaatgtagaatagaacaatcgctttgggaatgttaaatactgcaaccacttcagaaatgtttgggagtttctgaaaaagctaaacatatgcctaaaatatgagccagcaagtccactccaaagcatttaagcaagagaaataaaagcatatgttcattcaaaattatacccaaattttataatagctgtattttcaatatcccaaaactggaataaaaaaccaatgttccttaagagggaataaatatattgtattgtatttataaaatgaaatactgctcagcaataaaaagaaccatattatttacatgagcaaaagcatggacaaatctccaaataatccagctgagaaaataagccaaataaaaaagcacattttgcatgattccatttatataaagtactggaagatgcaaacaaatttatagtgacagaaagcttataagtggttgatcaatgataggatgagagaaggaaggctttacacaagagcaaaagggaactttaggggatgatggatgtattcattctcttgtttgtggtgatgattttacaggtgtagatatatgtcaagatctatcagattgcacttgaaatatgtgcaattttatgccaattattcttcaataaggacacttagcatctaaaacttgaaaacgttttgctttcttaaaaaggtggaataaaaaatgacttcataataaagaaatataaaataataaagaaaacagggggaaactaaaataatttgtcaaacatttctatttccttttttattctatttcagcctaacttctgttcttctattcctcacctacagcaattttcctaatgaaatttcacacctgtccatttctgacaccatttaacgtttagtaataatgcaagtgttaacaatgtattttgggtatatgtttctgtgtggcctgcattgcaagtagattcataaagaatttcagaaatcccaattctatttttcttttccattttattcagtttggttttggtgtagaaaaagacttaagcagtgtacctaattttaatttccaaaattgattttctactctattttctgctgcttgcttaggaaacaaaatttaccaagtctatctcctaaatgattaacctcagcaacctttggcaagcaaactattctaagagaccctgggactgtgttatgctccctctctttgcccaaatgcatttttaaaaaaagttagaaatcaaaggaaaaatgtggaagtgaaaaagaagccaagtggttaaaaaaaaatagaaagaaagtatcactaaggatcatacatacaacacatactagacttttattctacttttcattgggcatttaaaaaggcatagccgctatttgaaaatatattcaagggcttaacagcaaatccaaattaggactccacatccaggaacatttgggaattcaactgtatcatctaagaaagtcttttctgatggggaagggctgcttcagattcaggaatacaggccaaaaagatcaatttgtttcctgtcggcacagctcaaattgcattcttgacttcacagcactgagatctttccagcacatccattaaaggaatttggctcacattaaggttgtgtgtaagacctaacatccatgaaaatgagcataaccctcatcaagcaagtatggaacactggattctgagcaggagggccttcatgtcgctttgcatgaaaagcctgttgacaatcttatggtgactatattcaggcattttgataaggcaacttacattccctcagctcattcactgaagctgcatggaccaaatttttaataaatgtatttagaagcatggataagtagttacccatgatatgaatcatgacaagtagctatgcaaggaagtaatgccttagaatcagatacgtttggcccagacatatggtggaagaatgccctagttttcaccctaaatagacttgtgtttctttttctacaaatgttctaggagcctatctcatataattcccataatgatgataaataacattaattaattatttgatatgtgcaaggcattgtgctaagtgctttacaggaagttcatacctcatcacaactttgtgaagtcatgaactaactttatccttttgctacagatctcctaactggtcactgctttggtccttgggctttaaaaacaccacatacattatcttctcaggtctcattctttgctctaacctattcctgaaattctctttcccaaatattcatatggtcactccttcaagtcttcactaaagtgacacattttcaatgaatctgttcctttggatgtgctcttatttttaaacattgcacttatcagcttctaacagcgtatttcacttatttattttgtttcttctcttcccatcctcactagaatgcaagttctgtgaagggagaaattttagccttttttgctcattagatagaaggatgcttgatgtattgtagatgctcatcaaatatttggaagtggtaaaaggaagtgatgtggttttaagtaacaaccacttgttataagttagtatttaaaaaaaaggtacagcaacattttaaaataaattattgtttttagtttaaggttagccaagagttatgctaataagccatattcagacaattttatccaaacttactttgcaaaacaacaggttaagcaatttaactaagtgggcaataattctgagtttattaacaggtattaggtacaaaaaccatatgtgacctcctaaagtttctaatcttgttgagaacagaaaacataaaacctgaaataattcaaagacaatatatcaaatagttatcatttattcattcatataaaaagtactatctccatatgcaaggaattctgggctagatgcaggaggtgtagaaatgaataagacatagttcctgacttcagggagttgacagtctggtaagagattggatatactacaaaataaaacttgtttagtggaataacaactcgataaatggaataaaatgtgctaaaattcagtaaaaatacaaaatgttttgagaattcatagagggagaaattacaaagacagtatattacaaagtgctaaactaaatataatcaaatgccaaactgtatggcagagacactaaaatgctattgcctgttactcctgcaattgaaatacaccagggattttagtaagctttcatgcagaaaataacatatgccaagactcatatttctcttatttccctgtgaaaaggcattgaacattaaacagagtgcgaccctgaatgatgtttccagctgtttctgagagcaatttcataacctcagttttattcttctctctcacgttttttcaaacgaactaaagagaaagcctattgttaattttccaaagttatatttataattaaattcgtgcaaaattgattaaatacaacaaatctcataaataccaatttttacattgcatgtaaactattatcttctaaaaatgaagcaatacatagaatacatctatattttaatatttgtcttattttttctaattttttaactgttgctgattattatagaaaatctgaacacatacaacataaaaataaaattcatctgcaagcctgttatctacgtaaatgatagtaaattggtatattgctttctgtatacaggtacagatatagacgcagatgtagatataaatgtagagactggcatagctactaattataattttcctaatctattagtgtaagaaattgtacaccatctaatgtgcttcagagctatgatttcctgtggctgaataatattccatctcatgaatgtgtcaactattacaaacaatactgtgataaaataagtatacaaaatgctgatttggtttcctgattattattcctggaataagaattaatgactaaaatggtaaaaatatttttgagacttctgctaagtgttgccaaattgccttccaaaacattaaaatgaagtaaatcctgttcagaagtatccaagtgatcatcgtcctccagtcttgtcacctggaatattgtcatattcttttcctaatctttgccaaattgatagcttaaaatcagtacccattggtattttatttatattatcttaaatgctgttagaatgttattaatttatttgaatttgttgtaatttttgtgaattgtttaggatgttggtgatttttgaattgatctgttaagagctctttagagtttaaatataataactttttttatttgtggcttttctactttttctattttaaacatagtattttgaagttcttatgtagtcaaatctattcattctttgtgaattcttctgttgcatttacgattagaatgtccttcaaagccaagatcagttaagtatgaagttttcatgattttatttttacattagcctatcaatatctttgtaattaagttggtatttaattataaaaattactggtaatatttattgagtgaatactttgtcaagcagtacacgaaattctttacatgaattatctcctacttagtcctcataaacaccttatgaggtaataacaatccccatttttcatgtgaagaaactaaagttcagagagatagaattacatatccaaggttatacacctagtaaatgatggagtcagagtttgaactccagcagtccctaagcctgcactcttaactactctttttttttgctaatatgacatggatctaacaatttttcagcacattgtcaattttatgaacactatgttttgaataatctatcagtttcctctttgattcgcatttcttccttcatcatatatgacattaccatacatactaagctctattccacacgtagccattctattggtctgtcagccagttcttgcaccagcagtataccattttaattgttgtatctttgtaatgttaattaatatataataggacaaatagcccacttactgttataccttttgacaaataatatcacttctctatttattatcccaagtaaacattataatcctttcattagttaaaataatttattatttggccatcaataaattgtattaagtattagaaatttttaggtgtatgtacttatggggtacataataggttgtttctgaaaaaattaatactagaaaatttaactttttttcaacttttatattttatattctggaatatgggctgccccataattttgccattaagttgaacgacatttgacaagagttggtaagattttgtagttttattcatctatatcctgcatagctatattagagttatttctaggtaggttgtgttttctgttagtgttataaatctaatttaaaattatattttccattttttgaagtagttagaagtatacatcttttaatacttctatttggcccatatcttgagtttttgacaaaaatacagcaatttaaccttctccctgagatgtaccttattctatttcatgttataattaagttgtcagaaatttcaaataatgttaaagcataataggtatgacaactgtccttactttttccaacttcaatggagattcttttagtctttcaacaataagtatgacagagattgttagcttggagtagcttttctacactatgtcaaatagtgtccttctattttaggttttctgagaaattttgtcaggaatgagttttaaattttatcaaataggattaatatgttttagaatgatacttttttatttttttgatcttcagattctatgttttatggtaatagatttctaattaaaacatctttgccttccagggagtaaactctatttattctaatagatgattcatcaattgactattgcgttgtgtaggatgcattttatttaggatctattcatctttatgaacgagggtaggccatagaattatttttgttcttatcatttttgacatctgggtaatattacttcatcaagtgaagttaatattgcttcatcaagcaaacaaatgaacaaagaaccaatcatatttgaaggatgttctagatacagcattccaagaatgaagatctaaaatttgtactatacacagagttagctcaggtatcacacatctctctcatgttcaaattcactttcttggtggtgccctgttcttagcttttctattagaaaaattatcattataatcagttgattaatacatccatgaattacaacctttttaacactattacttcaaacattaataaatgaatttgggtcagtcaattattaaatatgagtgcatgtgcatgcatgtgtgtggtaattttatttaagtctcagagtagcctaattcacttattcaataaattttatgaagtatatattatatgctaaccatttctctagtgctgatgaggaataagacaggtgaggttcttgcccttgtggagctctttcttagcccatataaataaaaaatgtgaagctgatcaagtaaagcagtttgcctaaatccacattctaagtgaataaattactgcactgaactaccctataagagactcattgaaacattttttaagaagcagcttttgcatatgtgtaacatactttaatcagttcgacctaagggcaggaaaatacatgaaatggcccctgaaaatttcttcagctatatttctggtagttcacaaactctcttaatttagtgaaactgcattaggaagactatgaaaaaaataagaaaattataacaatatgaattttaatccctaaaggttaagtaggagttattgctattacttgtcaagctcaccttcttccaagcctataccatgtgccactatctcattttagcattgtacaaacttttcaaggaagatgttatcactattttatacataagaaaatggaggcttagaatttaagataagatggccaatgaatgccacacatggaacaattaacacagaacacaaatccaggttagtctgtttctataggtattatttttgcctctctgctatgtcttttctatatgcatgtcttatgattagattagttgtaagagtgtagtgtgaaaaatatgttctttttaaaaatttattttaaattatgctttccgataattttaaataaatgaccagaaatagggaaaagttaattaacctgtcaatcaatcatgtataggcagtaatacaaaaatgtttttaaaaattgatataaaataattggatcaatattttcaggacttcattgaagacttgataaatgttcaagataggctttgggtgagaatttagaagtaatataaagagtgaagaacacaaaattaaaagttaactggcagggcttcagcacaactgtattgaatcaatgtatactgaattttttttttcagaatggagaaaggtgccagtttatagtttttttcctgtggtagatagagcaattagttctgggagggcagcaactacattttatgtattgtgtttctaacacctggcacaacacttgccacatagtagccattcagtaaatgcctggataaatgaatgggtgaatgagtctctgtagtcctaaaaaaaaatcagttcagatgataggaaaagacatcagaaagacaggagatcaagatccttggcgaaatgtcatcaacgttaagtagattcttgacttctctatgactcacttttgtcatctgtgaaatgaaaagactgaactaaatgatcccacgagtccttattaagtatataactattataattctataatttataattaataatttcagtttcttactaagccttcttacccatcaaagaggaaaaggtcccatttatcaaaatggttcccaagcagtcagggactttaaccacaaattaaacaatttacaatcttcctggaagttcatgcaagaggtcctatatctcttttatccttagacattctatttgatgactatatatactaacatttttttaaaaaccttttttccaacaactacctaataatgcaaataaacatataaaataactgaaattaattgataaacacagtgaccactgtgcttttaagcatgtacataaatctagttttcttggtagaagaaacattgcccagcctctactactaaaatacttgtccaaaaactaagaaatgaacctatgttaagaaacaaacccttcatgtttcacagggctgtaaagtcacaatttatcacattttcacactcagagtaaaatataagtattaagagggatgccagtttagttccaaagaaatgaaaagacaataggagtggcttattactctctctgttttttaatggtgaacaggaaatgactacatcatcactcacgagggttgaaaatacaaaaattcaataacatgtctaacttcagttagacttcagctgagcaaaactattagtggccaacgtaacaactggtcccagtcttttaaggaaaggtttcagaacctacaaagagtttaataggctactacagatatcacacactgatctttttgcaatgaagaatgatttttgagttttaccaaatttttaacaacgtaagagctagctttcggaagtgtcaagtgcataaatgggagtaggtatttattatataaaatccaattctatttgttacaaggcagtcttcaaagagatgcaatattagagcagaaaagaaatctctgagccagcacctttgacttagggaaaaaaacaatctggatctgagagaggttcagccccttgctcaatgtcacgccaaggagtagagccagttcacagaatttgctttcctactttccagtgcttaattcttttctcttaccaggcagtgtcttttcctcagacagaggcttgtttactacagtattcctcatgggatgtatcctctgagaagccagctgctctgaataaaaataagtcagaaatgagagggtcagagtagggcccatcctcctcaggaatatcagagaagtttgaagagtgggagaaaggagaagagagaaagtgatgctatctcaagaaaaggcctcttgtaggttggtcatatctgagccctctgtgctaaggactgcactcctaatactcttgttgtctggaaaccacaattggcagacagtgcctgagctcaacaccgcttgagacaagagaaggggaggatgaggtagtattgatggactattatttctttgtagatgaaactgcccccactatctgggtgcattgtactttaattacctgattatgatacccaaattaactatgcattcactgagggaagggactatgcccaactcatctctgtatcctcagggtctatcgtgtttgatgtacaatgaatgctggatgaaacaaggaatgtgtgaatgatgcatgttgtacctggaagaaaatccctaatcttgaacacacccgtgggttttcaatattatctgtgtccctgaaaataagaggcatacaataccagacttgatcgacctattatactcttttctttagtagactaagagagaaagggagaagggggaatgtaatccatgtcctcttgccctccacttcgggcataaactgaagttcacctttagtgaatgaattagcaattatgtatacagcaacatacatcaaatatgcaaaatttcaatctaattttactctaaaatattcaaaaatggttacccttgcaatgagttggtcatacagagataatttgtattgggaactaaattgaccgattcgacagacattactgagaagctactatatattaagggctgtgctctgtgctctgggagcatatatgaatattacaagatcctagtctcaagttttgcatattggcatcaggtacacaagcatatcaacagagaataatatgtataatggcagctgctacaacagaggtatgaacaaacaactacagggataaagaggaggcaacaaatgatgctgggtacattcagcttcagacttaagcttctcagtgtggtggtttgccagacagtaaacatgagtactaaccctagctttgtaagaatctagttatgtgatagagcacagagaattaatatccctatatctcaatctcttcagagtttggactttggcatcacatttaagacctggcttaaatggttctatgatttaactatctgttttgactttaggtaatttttttcagtagtgtagagtttagcttttttatcttttcagagcaaaaattatgagtttgcctgcatcaagaggtgaaatgtactgatcatagttcttagcacataataattgctcaataaatgttaactataattattaatattaaattaagataaaaagcttatagtggacttgaataagcttcttctgaatgaaattcaacataaatagatatgaataagagaaaaatgtacacatgtatatagatatacacatatctacatacaaatatgtagtaattaatgttatgttgggaatactttctcccaactcttaagcaaaaatctcaagacaatgcataggaaagggacctcggaatcacatgaatgaccctaaatataaacaaaaaaatccgttataggtcatgacatatttatgattcattgccaaaactgacagaatattccaggttgaacactgttggcccttggaaagtcatagtatgtagaacattaagtcgtactatgtagactatcacagtaaatttaattcaaataataaaccgtcacacacttgattcacttccattatcatggctccacagcaggacatgctgcctgctttggtaactcagagttcttttgtgcaacgaactgtgattacttcataaaggtcaattctcttaaatccctggaaaccatggcatgccaacccaccaagatcacagaagcaattaaaagtgtttaaccgggaaagttgccaggaccagatggcttctgccagtgggtttttgtttttattttaaactgcttaacattaggcaagtggcatttatttgcctcatatctacttactagtggatcttcttcatatttgtaaaagaatgcacattcatcatagagattctcatgttacgtgcaccatgagagacaatgagagtgggccatagagacaatgatagagactttccccatcctcaagcttcattatggcttaaatcagtttaaagtttgccatttatactctaataatatttatgcatgtgaaatctcgcttctataaagggttattcaagaatttttggaattatagtacataggaaaattcatgtattaggaaataacacttttaacaaaataatcatttttatggtacaaaactactctgtgttcttaatatttatagtttaagctaccccaaaccaccacttattcagagtacctctctgacataaatagcagatagacttatttgactgagataaatattttgcctaaatgtatacttaaatcctaccaagacagggtggccatagatcaaatcctagctctgatattttattaataaattgagttttagcaaaccatttatctcataaagcttttgactcttcacttttttaaggggaggctattattatctataattaaaataatttgatgttgccatactactcagattgaatacagaaataaggttgagaaaaagacccagatatatatggaatttagtgtatgataaagttgacatctcaaatcagttataaaaaaaggaatttttaaataaataatattgagacaactgtatagctatttcaaaaaggacaaaactagatcagtacctcacaccataccctaaaataatctccaaatgcatcatagaattggatgttaaataaaggaaaatgtacaagtattagaagaaaagaggaaaacatgattatgaataattttctaataacctaagagaaaagaaagcttttgtaactatgatgcaaacatatgtgctcaatattaaggacatttttcccctaaagatgaataacaaactaaaatgtatttgcagcttatatcacaaacacaaagatctgatcactttaatatagaaagagcctccagaagtctgcaagaaaaccgctaaaagcccaagagaacaatgagcagaagacacaaacgactacatatagaaaaacagaaagacaaatggctcccaaacatatgaaaagatgttcggcatcactgataagagaaacaaaattccactgagatactctttcatgctacaggttggtaaaaattctaatttgataacacgctctgttggcaagaagcagcaggaattctcacatatttctagtgggggtactaagtattagaatacctatgagagtacttttagcaatatctaacaaaagtacatatgactctttcctataattcagaaatcccgtttacaggattctactctatagccatacctctgtaaatacaaaacagcgtatccacaatgttatttgtgacagtatttgttaggataaagtgaataagtaaaaatactaagaaaacaaaaattttagtgtaacagaaaggagtcacaaatataaaagcaagaaattttaagggaacattatgcaatattagatttgaattagaaatatcaatatctacttatgacttttaaaatatatataaatttcctatctttgctcactaaaaggcctaggaatcagtgataccccaatagcaacgaccgtatctagcacaaagatcttggtgtctatttatcattttctactaaaaggagctaggacatcttgtgaaatggctgactctgtatcttgggcagcaaaagttccagaacaagaaagtcaatttgaagggattcccctaggaaaatctgataacaatttgagtatcaaaaagaatgataacgcttttttaaaaattgagaatcatttgtcattattagaattgatttttacaccaacttcttattctaaaagttgctagttaagagaaaagcagtaagtcatagaaataacattttaagataatgaaagaaaacttatttatagaaaaaatgccatgtagaagaaatgacagaattagaagaagcaagctagagagagtaaacgtggcaaaacgctaataattggtgaataaggtgaagcgtgtaaagggatttgtttacttttttttaaacttttctatacgtttttaattattcaaaataaaagttgggagaaaaggccagtggcataggagaaagttggggagacccttttacattaaaacacaccaaacaaataagaaccaaatgaatgcatgaaccataattgaattttgctttatgaaaaaaattgggataaataatttgggtgaatagtaggggaatttgaatagggactagctattaaataatgttagaaagtaactgttaatcatctcttgtgtggtaacaccattatagttttatagaagatgagtattaaaattactatgtctgcaacttactttcaaattgttctgtgaagataatctggctatctacttagggaaagatacatcaaaagactgataattcaataggtagatagataacacatatttggcatactgctaacaattattgaatccaggaaatatgaacatttattgtattattctttcaacattccattcagtttgaaaattaccataataaattgctggaaaaatacaaattaaaaacaatacctactttgcagttttataatggaattaaacatgaataacctaaaaaacaaagtgcacaatacctgatggtgagcagattctccataaatgttattttactcttttcatctttcatactacattttataacacagaaatcaattaatataaggaggagattgggtatgccttattgggttgagtggataactttgggtttagtgcacatgtgattaagtatgttggattaccataaaatggtcccttgacttccatgtgtgttaattggatcttgttggctagttctgaatttcccagaggaagaaaggaatgcaaattttcccactctctgttctagtccttccattcaaactcagccaagtgagaaacaacagtaatcctccctgtgcatgttccctccacacaccaaacctcccacatgtatacccatgctgcaatgatttaacacaccagttgaggactccaaataccacattcttatatctttgcctttaactcccttactcccctgcagccagaactgctgttagtgtttgagatgagtgccttttaacactttcaattttgtccataactgggtccttatcatgggatttaaccaagacatgctttagatcttagctctttctttaaagcaccatgtttctcaaacttacttaggtaaaaaaaatcaaatttaccaagtaggtactagaatatttgtaaaatacacaaaattttagagtttaatatacaaaccaagttccagtttctcctttgttattccattttgctttaaatgttttaatccttgctatttagcctttcataactattccattttgctctagagcagggagactcattgactaatgtaaggaattagtaggaaattagaatcaggtagtaaattcctagttcacctccaagcaccaagtgaagtgacatttcctttgtgaatcttcccaaacactcagacagggaccaaaccagtctatcccagtacttagcatattactagacaacagtcaaggactcattaaataatgactaatctctaataatatttatcatatcatggtataactatttctaatatcagtctatcttcaatggacctaaaattggaaggttttattctggtatagttaaatgatgaataggtttaggaagattaatctggcaaggattaggaagaggaatgagtttgaggaagaacacactgaaggaatagagaaagttgactataagtcactatatgaaatgccacagaaaattcctttagacctagggaccaaatcaaagatcagaaacaatctatacctatccataaaacattaggctgatggcacaggaaagcccagagtcttatttgtatggccttggaattaaagttaaaattcaggaaatcatttaaacctttaaagcctcagcaaaaagtaagacatggtaggagagctatttcagtagcaacaaatccttgcagtagacatttgcatcacatattggtggcaacttctttgttctcattctgtatattgtagtaaatcaacattactatcattaaatatttatccagtacttctgctagattgctgtagcaaaatgattttctaacttatcttcctatctaattatagacaaaatagataatatgaatataaagaggcatgaacacacaacaaataacattaatattgaaatatttgcagccttattaaatagtcacatgggtagaactctatggaaagacaaaaaatataggaaatacagcctcataaaaatcaaatgaaatagagtcatgggttgctgaacaacagagatacattctaagaaatgtgtgttaggtgatttcggtgttgtacgaacatcggaatgtaattacataaacctagatggtatagcccaatacacattgagactatgtaatatagcctattgtttctaggctgtaaacctgtacagcatgttactgtactgaatactgtaggcaattataacacaatggtaagtatttgtgtgtctaaacatatctaaacatagacaaggtatagtaaaagtgtgatataatcttataggacaattgtcatatatgtgatcaatcattgttgactgaaatgttgttatgtggtacatgactgtataaagcacaagtgttggtaaacatagttgaatctaaatcaggaaagataagaggaaaatggaaatactagaaaagaaggtgatagaattggtaaggataagccaagatggatttcaaagaagaggtgaggatagaatggatttcatttaagttgctttcatctgctcatttaatttaccagatgttcataagaactttttcctatttcagccatgttaggtactaaagatctagaaataaataagtcattgttcctgttgtctaggggttcgtagtataatggggaagaatggcatgtcaactaacaattgtcatttactgagataagtgcttggggaggagtttgcagtcagggaagacttcaataaatatatatttgaggctgagtaaaagttggaaagcaagaaatcaaagaacatcattccagtaaaagtaagtatgcaacgtacctatgtaagagatacaattgcataaatggtaaggaccattctccctggcagaggtaaatatatgcacaaataaatgcttgcagactgaatgataaaggaagtttgagatggctcgagtgtgtacaaagaagtgataaaaaaaggtagatgagtaactttatggagggcaaattggaaagaacattttgtggtatgttggtgattttgtattttattctgtaagtactgggcaaagtttctaagaacagacaattagacaaacaatgtagaatgtattaatatatgtattttcaggacaaagatgggcattcctggcactaagacagacagggaaatcaggacagggagccctccctatttttcttatacactgtgctgacttatacactgtgtttccctttttgcttgagctaaaatccccaataaactgcctttctcaagaccatctcaaactcttggtctatttctcttcactgagggccaagaacccatcagctagtaacattctggcaacccagatggaactggggttcccagacccctgacttaatggacaattctccatagtagtagacaagaagccccctgagcactttctgtggtgtctctgctacctagtgagttctctgacagctcagagattacaagggcaccccttgagcaatgctgttcaccccttccctttcctccttatttgtaattgctgctctgatatctccttactctacttttccccttttcctttccttctcctgtagccccctctgtccttctccaacaaccctttctcttttactttctacttatttggctgaaatttaatagccattggctcctgggttctttctgttctggtctggtcagttatggctgaaatctgacagcctttagctctggaatactctcctatttggagagcaagagttgtttgaggaaaggaaaaggggaaaaggagtgaaaggggattccgtagcagcaattttaaatgaggaggaaagggaaggggtgaacagccaatttgaaatctgagctctcaattaggttgtcacagtaaggaattccttcatctgctgatgactttgttttggaaattggtttctttttgttctggtctgtcctcccttcctcaactccctcactctttctatccttaccccctactttcttgtaaaactctctatcttcctcctttctcctcctgctttgaatctgctgttaccaagctactggtgttaagataaaactcactgttgcaaagttacttaaaagattttgtttttcttatacagttcagccagttctggctaaaatagtagcattagaaactgatttaaaattaaggaaaaaaaaagaaagataaaagaggttttaaaaatcacaactgtcatgaaaatgacattacccaaattccggtccccaaatttccttgaattacctattggagcaaatcaagtgtagccatgtgaaaaggtcccagtttcgtcagaaatatttagaataagctatctttcctaaaatgattagttcgtattgctatcttatggctacaatcccaacataaaagcgattggatctcagtgtgcctgtatacatgtttaaatatgtttatgtgtatatacatataatatgtattgtgtctagcatgctacctattggctcatacataaaccagcactcaaaaattaagtcaaaatgcttttcaagttcacatgaatctttaggatataaaactggttttaaaaatctttggtgagataaatattaaaatgttttcagaaatatcagcatacagttgtgtctcgataagtttaatatttgcctctgctaaatgtttaatatgtcagattttggcacagactttataagactataaacccagccaaaacagggtaatttttgtttgtgtaatccttttaacaaataagactaatttaaaatttgtagttcaataaaaacaattaaatctgaattattggcaaaatgtatttaacttcaaggatcttatttagatgttcacctaatgttcatacttaagcccatctcaaactcttggtctacttctatttattgagggtcaaaaactaggtgttgacaacatatttggggtatacttaatcaagggcaggttgtgagaatatgaccataccagcaactgaaaatatatttctgataaatatttatagatatatatacttctgataaatatttatcctcaaatcttgctaattcgagagattatcacttaattttttcacaaataaaatatttatcattatagttacacaatgaattatcactaaacctcattcttgcaacacaagaataaacgttacaacatgtaaaatacttcaagtaagccagaaaaattgcccaacatagagtggcagtaatgccaaagctagaaggaacttagagtgtgtctagtctaatctccttaatttacaaatgggagatagatatggagagttgtcatatgacttgtctaaagttcattcacctcgtatttggtagtaccaaagctttaaattttcttttctgactcctgattcaatgcttgttctgcaacagttgactgacaccattcaatgaagggggggtttctctaagaatgtggctctggtgaatccttgtccactaggattgcattgcagtcccctcattttgaggccactaaagcctagctctcacacaaattgcctaggtgaatctaacagcatttttacctcctgatacaaaaagatggttctgcagaatgacatgaagcttcttggagggaagtgtgcaggtgtctcttcttaagacattgttcctggagaaggcagattatcctaacagagactaagtgtatgctctaaactactatcttgatgtcattgacagaaactatacaataaatgggtattgcatggaagaatgccatcactcttacttggtaatgtcatgtgagcagaaaatagtaagaattagctctattagaagtattctaaagccattttctccagaggtaattgaaaaaaaatctagctagctagcatatccagccagatttgcttttgaaaacactttcaaaagaaactctctgaaaagtaagtgatttccctgtttcctttatatgttgtagaaatggcactaaatactttaagtcagagtaaaagaaggaatctgctgatacctggaaacacggaattaacataagtttttaaattcattgttattctaagcatcctcaatatttatgccttaaaagcaattatttctccaaaggttaatcagagtattaatctttatatctaggtaaaactcatttatgttattcactattggtgagctatggattttcagctgtgtttctcagagaggtggtaaaagtagttcattctcctatttatgtcatcctgccacaatgagcatgcagttgttcaattcataccttccatgtggggtatgactctgaaaacctcctctttcatacttatttgtttctctcaacatcacctttctcacaatcccatttctgatcccttgtatcaagtgggatctcctctgactctgaatatccacagccctctccttattataaacagtgccaggatggggaagaaagggacaaacatgtatgtgttccttcattgctgcaagcagtatgtgacccagtttacagatgcacccaacaaaagattaattttcattaaataattttaatgctatctaatttaatcctcacaacaatgatttgatgatattattaaaaactgtacatactatgacacttcgcatttctctggaagcctttctgttttattattgtgactcctctaaggatgatttgtgtgtaaggagaattaagaggccccagggctgttttctggcacttgcttgaatttcactttttgccaatgagtgtgttgaagccaactcctatagacaatatattctctttatcatgtgagataggattcccattctatacatgaggcaacaggctcagataaataaatttgtccaaattaacacagccaattggtagcagattctgaatacaaatatgggttttctcttagttgctgttactgctgctactactaccagtagtagtagcactattattttacaactatgatcttatgccacagtaaattgtttaagtccaatttttaaatcataatcttcttgaagagtggggccatggcctttttatatttgtcaaattcaagtgaatataatagaatcaaagggaggtcatattaacttctaaccaaacacttgcccttattgaaaaatgcttttgtctaactcttacctcctttgtgataagatacagactatcaaaaccaaaactgaagtgaaatgaaaaacaatccatcagccaggtctcttgttataattcactcttcatttctgtaatttaaaaatgacatttgctatgaccataaaatctgctagatgttaccaaaaatatagaagcatgagctgatagcacatgttgagctccaacgagttgtaaccaataggttattttgttcttggctggcacagcctggcttctgtgtccaagataagacatgtgacgtctgtctttccttctccaaaaccatgttgtagcagtgtatctcattaaaaaaaatattacaacacatttttcttttctgatatgtgatgttctaaaatgtttctgtcttccaaagggtatcaataagcatttggggagaaatactaacattttttgcggtcaaatagacgtagtttagaaagaaaaaaagcaaattacctactgtgacactggccatatctctggaaggctttctattttattatggggactcctctaagggtgatttgtgtctcaggggaataaagtggtcccagggctgttttctggcacttgttcaaattttactctttgccagtgggtgtgttgaagcagtctcctatagacaagtgagagacaattgttttgcaacctagttgttaacatgttggtagcttgtgggagtattcacaccatagatatcatgctacaaatcagggacccccaattttttgagagcctgtttagagagcatcactgcatttaactctggtaaattgtatacaaacaactagtgtaaaattataaagagataggaatgcactggggcacaatgtctggttgtgcaagctgttgtgtgcccaaagaaacccacctggggataagtgaaaacagaaatgcaattcacactctggtgcccaagctgtgtgctgtggcatggtactgtgacctcctaggggaggttatatttttccattttgcaaaaatgtgccttgtgagttatcgatggttctgtttaagtccgattgtatacatccctacactgatgctccccaggccaccatctgcagtgtaacaactgctgattacatgaggtatataattctttatgcaccctgtacttcaaataacaagaaataataagataataaaattctagttattatctactctctaagaacatatgtatttattttatacatgagtaccctgttgttcagagaagttaggaaacttgttcaaaatcacataactaataaaagagcagcagttcaactcacatctatctgactctaacatctccccaaatggcttgtgtgctgaccttcacttgacatgactggaaattatttctttagagtacaagttacaggaaaaggttttaaatctataataaacaaacaaatacttacaaaatagactgcattttttcaaaacaaatatttcataattttcctcttttaatcatttcaactgcattctttacttatttatggagaacaaaatccaagctcagaaaaattagagattaagaaatccaagctcagaaaattagagttcattaatactgaaaagctatgacattcaaccaatcaaacaccaataacaagcaacacttgtgcagaattttacagtttacaaatgttaattgttcaagaaaaaataaagcaagagtgatgctatgtgatttctgaagctaggtcataagatggatatgaattctgtttggctgtctcccaggaggcttgcctttggaattcaacctttatgttgtgagaagtccaggccacatggagaagccatgtgtagctgttccagactatagtcctagtaaagaaatcagcagagagccagcaccaactgccaaacatttgaatgaatgaaccagcagatgattccagcctctttgtgtcttcccactgagggcttagacattcagagtgcagacatatcatccctgctgtgtcttatctgaatgcctggccacagaagcatgagagataataaatgtttgttttaatacactaagatttggggaaatacactaatacaccatgcagaatagataacaaatacagtaatctttagacagaccgcaggaaacactagcagacacactaaaatcgtgcctgaaatatagtggacactgaacaaataattgttgaatgaataaaagaagcccaatataaaaataatgtaggcttctatagtctgagtagaaccacaacttttactgaccaatatctctttttgtcttttccttttaaataatggcaactttgggctggagggagtgactcgtgcctgtaatcccagctctttgggaggctgaagtgggtggataacctgaggcctggagttcgagaccagcctggacaacatggagaagccctgtctctactaaaaatacaaaaattggccaggcatggtggtacatgcctgtaatcccagctactcaggaggctgaggcaggagaattgcttgaacccaggaggcagaggttgcagtgagccaattttgtgtcattgtactccaacctgggcaacaagagagaaaatctgtctcaagaaaaataaataaataaataatgatggcaacttcctctccaaaaccattaagaaaacaatcccagaatgagaaagccctgcaaataactcagagtaaagtactgaaaaatctccacggattagagtgcaaatgcatacgcctattttgttttgcttgttttattccacatgagagcctattcaaataatattttctaacccttcagtgaagagaacttaaaagtgaattaactcatttgtaatcttgggagaatatgaacattgtcatgttaaatagagacatacgagaatcagaggatagatgagagtatgtgctgaagttaaacaagtttcacattctgattctatccctttttagccaggtggcagtattagtggcagttaacattaaaaaatatattttatcatgtttcaggtacaattttatgtgtattacatgtattcactactttagttctcacagaaattgtataaaccattattagccctatattataaatgaggaatccgaggcacagagaggtcaagaaactccaaagtcacacagctagtaaatgcaaagataagacaagagctcatgctcttagcctctctaaacctctatgtacttaataaaagaggttaatagatgcacactgttaacagtgcattgttcattattacaaatttcttaggaggcagcatgtcacagtggctcaatttgtttaatataaaaaagcttaatagcaatgcctgttagagtcttatataaatgagatgatacttataatgtgtttacagtagtgtttgaaacacagtacacaataaacaattatttttctatccacattgctcaaatatagttttaaaaaataaaatcatactatacattttctttgtagccttcttttatgccctatgataatccatgttaattaaaatgtatccatcaatttcatcggcagcatataattctaatgcatgattatactataattaaaccaatccctatttgtagggatgcaggttgtttacattttttctagtgtaaataatactacatatgaacatccttatgcataaatctcttcatagtttacctttggataaatccctgagagtagaacttctggatgagaagataataatctaattttgataacagaaggaaaccctgtagagtaaatgatctactcaaaatcttacagaaccagagttaatgccgggactagaaagaatggtctttaaaacacagttatataactatgtatatttttttcaacacaaagtgtcaaaagagattaaggcctgtcagctagtaaaaatctaggcttaagctgaacccagatttcctgaatcccaaaactagaatctttgacgtataaaagatgatttgtgtaaggcatcttctttgcataacaataaaatcagaataactggcttaggtgctttgccacataaatgaagagttttaataggcataggtgttacattatttgtgacctggtaaaatactactcctttagtccattataattctaagaaataagaaccatggtacataaaatgacaatcttgctggaaaatcttcactgtactgtttgctcataacagaggaaaagtgacttctttaataatgatgacatatatttctaagcctcatacatcatttaaacacccattactctttgcccttcatcaatattttaggaacactataaaacttggattgttcttggaaataattctttcatttttgcagtaatttgtttcactaccagtaaaattagataaatacccttaactggtacaaactatttctcttaggtttgagtcaagagaagccaaaatgagtcctcagatggtgacgtgaaggctctgtctaatataccttttctgagttggatttcttctttcctttattccatcttactcttgttcagatataattcaataaaatcatattatttctaatcaattaattttcttattcctctaatatatattctgagggcctaccaaggcctaaaaataaaactttaagacaatatgtttccttcctgcaagaaattcttaatccaacagatgatttgtccttaaattatttttgaaatataatcccttacaaatttaaactaggcttaagtagatagccatatattataatggaaaagtagaacacatgcaaaaggaacagtaggaacatatgttaaccaaagacaggcattagaaaaaaatatatttttaattgatgccatgaaaaatttaaaatttacaattatttggagcttcagtataataggtaggaagacttagtttaaaggaaactacattatgaccattcaacctactaaaaaatataataaactgaaatgttgttccataattgccataaagagaagcaattatttatctcagggagaagcaagatattggcacttaagggacaaaaatagcaaacattagtttgctgttaaaatgtatcctccttttctcattcctttactagtatcttagaactttatttcccttgtttcttaaatatgtatatttcataaaaactcagactcttaagaaatgttttgcttacattcttctcgtcatattatttcatggtcatgctgtgcagaatgacagtgattttaaataggccttcattacactccttagcaacctgaaaacaatatggaaatctattattttaatttcttttaatcttgagaaccccaaaatctttaagttgtttcctttacccatgagtcgttagccatcattatactgttttgccttatctaaaaaggcaaacgagtgagtgactttctgaggctcatgagaggtgtcagtatgtatggagctgcagtaatcccccacgttttagggataagactgtttaatccttgagagttgcatcagcgaaacaggcagtgaatgagattagccatctttatgtagaagaaaatatacttcccaaatcagataagaagagctggccctgtagataattccttcacagaatatggaatctagtttcagaaagatataactaaaacataagttttacaaaaaaagaaaaaaagaaagaaaaaaatggtatacactgtgctaatcccattattggtatgaagaaatgcctgggttttggagtcagaatttctgggctcaaaatccagctcttcttcttactgtgagactgaaatatttatctagtctctttggcccatcagtattcgttttttgtttgtttgtttgcttgtttggtttttgtttcttgggggttttctttttttttttttttttgagatggggtctcactctgctgctcaggctggagtgcaatcgcatgatctcacctcccgggttcaagcgattctcctgtctcagcctcctgagtagctgggactacaggcatacgccactatgcctggttgatttttgtatttttagtagagacgggatttcacgatgttggccaggctgatctggaactccttacctcaggtggtctgcccacctcggcctcccaaagtgctgggattacaggtgtgagccactgtgcctggcccagtaatctcatttataaataaggataataataactccctctagaattgagactcaaaagagataatataggaaaatacatagaacaaggcctaggatactgttagcgctcaatgaacagtacctgctattattaatattttgtctatcatatggatgtttactattcctgtggtttctagttgtctttttttatttggtattttattccttaacagattattttcaaacaccatatcatgtttatcttgccctattttttgctttatccctgattatctttcaactctgcatcattagatctcttctgctgagtcttcttttacccagaggcctcttgcccagagttctatcagaggccatctgaggtaaatgttgctatttcctctcttgtcttgcttggccttatcacctgtaaaatgagaaaatagtagtacttatctcacagaacactgaagagaattatatgaggtaattcatgtgaagggccatacgtagtatcacacatataattacccagtggatggtagtcaacatcatttttacccacaatgtcttcagaagtggcttctactaaaaagccttctctcatttttctccaaactatccctaaacctcagtccacccttccaactctggctttgtttctagctctgtgccctctgctcccaaaacacccaataagtcaaatatagcattttctgcattctatcaaaattgcttatgtttctctttcccccatgaaactgcaacaactttgagagccagtaaaatgtcgtactgcaacttccttgcctcagtgtgtagtaacatgaatgctccacccaaatgcattgaattgtttttacaaaactcaggatcagacagggacttcaacaaactcatctaggtctgtcctcaaagttttatgtgcatattcagcagtccctttctccgatatctttacttcagcaaacttttctattacattgcattaaattatctatttttctttacctttatttataaaagatatctatttccagcatacttctaatattttctctttaagctgagcaacaaaatatagataaatacatttctgcaggtaatgcaagctatctattctcctgaaaagagaattgcaacaaaacaaaacaaaacaagaatcttctttttaaaaagctaaataagcaaaaaagaataaatgcataggtaacccagataagaattctttaaagcagctgcttgccaagcaaacattggttctttatttctataatatagcctcatggaagtaatctttcaccaagaatgtcttggtattctcataacttgttagtgtcaaaggatccaggcaaaacaactagttagaaatccatgatcaaaaatgttgcaggtgcaggacttaaaaagggcctatagtatgagaacatttttgaaaacattgattatgtcagttaataataataaaaccttgagcaagctccttaactttgtattgcctcatctgtaaaagggtggtaacacgatctcccacagaactgttgagaggttacacaagatcattaatgagaaagtactttgtaaatgttgaagaataaatctaatataatgcctaagcatggtaaaaccctgaattttggtagttccaaacaacagcacactgcttcatattatttgggcccatgtctttctatttttccccaaagatgaagtcctttgagagcccaaatattatcttattcctagtttgcttcccaaagtttatgacttagtaagtgaaaataataggtgttttaagactgctgaatgtctgaataaatgaagatgaatggaatgaatgaacaatgggtaacaaaaaattaaatgagtaaattccttctctgatttggggaaaatatttgccaaaatattttagtggaggagaaaaatgttgactatggttgtcaaatagagaactgttcaaacattaggccagagaatatataataaacttatagagacaaaagcattcaatgtaaaactcactcaattctttggactcatataacctggaaacaaatggtcattattcattaaggaatacataaagaacgacatctgcatgtgatgattaaattacaattaaactgcctgggcacggtggctcacacctgtaatcccagcactttgggaggccgaggcgggctcatcacctgaggtcaggagttcaagaccagcctggccaacctagtgaaaccccgtctctacaaaaatacaaaaattaggcaggcatgatggcgggtgcctgtaatcccagctacttgggaggctaaggcagaagaatcccttgagcccgggagatggggttgcagtgagcctggatcatgccattgcactccagcctgtgcaacagagccagactccgcctcaaaaaaaaaaaaaaaaaaaattaaaccctgcttacattagtctctgtaagcagaaagaaacttaatgctggacaaatgaggaagctgaaactactttttgcactgtcgttctgatacaattaatagcataaaaaaccacacattaagtaagaagaggacctgagctcctccaaacactcttaattgaaataaggtatcgttacgagtttatccaaaaacctttttaaatctgtaggaagagggtggatggaggggaggaaaagcagttaggtacttttgaattgcaaaatgaagaaaataatattaccttcagaattatgtaaatcatctgaaagaggtagaagggtttccaggtcaacaagacctgaatgccgcctaattgagttcattaatggatctaaggaaagaatatacctatgcaatggagagttcgttggccagtgaggcaaccaactcttgccagaggcaaggagtctctgagacagtgtctggcagtgcatgtcatagctctattccctctattctattggccttaccaatagatctttatgagagtataggcatctggcaattacattctttatgttgctagagggacagcaggagtcagaccatgaggtcattagacttcagaccaagtatggtcaccaggtatattcaccaatatccacttcctctctactgtggggtacaagagatggttgcacctcacctccttaaacttaggtatagcaatttaggtatagcaagtaaatagatatttactttagccaatgaatgtgagtttaagcaacatatgtcacttcttggtggatgattgtaaaagctagtgtaagatccttcattattcctttccccttgctgaaacaatttcatgaagtacaccctctatcatcttgagctcctaagtgaagatgtcttagagccagatactcaccactcactgtggacacaacgtttgagagataaatccatcttagaatttaaggatactgagattttgtggttatctgaactggattaagctagcctactcagacacaggtaagctgagggttatcatttggctccctttataatttctgtactaagggataatgaactggttagagtatatggacatttagtcagcttagaaacttttttgcattaaaattaataaactctagtaagtatctattcatctccagcagtatcttgtaagctttactattatgaagcaatatccccaatttcgactggctctgggatgttggcaaattaagagtttttgaacttgcaaaataaaaagcttgatcctggagcttgataagttcaaaaaggaaactctcccatttgaataatctttcaagtcacgtggctctttctgaccacatctaacccatgtccacatctgtttattagaagagttaacagtagtcactgatgttttaaatttgaataacctactggggtcttaatattctatgcattttaaatggcaaactgagtctctaacactttattgtacatctactatacaccagaccacaaatgcttttatacaaatacaacttcataattttcataaaagccatgtaaggtaaatttaatccatcctcaatttagagatgatacacctgtggcttgcttaagtaattgattgcacagctaacatggagccagaatttcaattcaggtattctaggtccagaggtctttacacagtaaagaatttaattggatgttcctaaatcagctaaaagagcctcctgtatgcaatgatttggtaaaaatgtccctatttaccccttctctatggtacttagtttgatatactttgaatatataatatttctatttttgattttattcattagcaataacaaacaatacccaataatgagactaaataacataattcctacagagccaaagtgagtcatgtgtaacaatttataagaaacccccaaataactctaaaggatgataattgaataagcatttgacacaaatttactgaactcattccaaaatggttttccctgactctgtggtcattgaactaatcaatataatcttgcttaaataagtagtcaatatgtatggctctcagaagacaggtctataatatttctgctttaagacagatatggcactacagaagagacaggatcaaagcaattgtgaatatagattccacatcatttgcctgtgtttttcggtgccatctggttcctccaaacttgataaaggttttgtgagaagtaaatacatcaacagcagaaacagcagaccatatgaaggtcctactgtagtgtaggcatataattgggtactcattaaatgttaattctcttcctgtttcttttattattttgtgttaatctggttaggttaggtttgttgtaagaatgcagtaaacctgaaatctcagtagcttaataatacaaaggctagttctcactcattgcaggttagggcactctgatctatatagtcattcaaggatctagactaacacaccacattttgtagctataccatctaaaacatgaggtctccttgatcccggtgtcaggaaagagaatggtagagggaaggcaacctgacatttctgtgcttcgatctgggagagacacatatgcctttttccacaatctattggtcagaactaattatatacccctgtcacctataaggggacctagtaatgtggagtggcagatggggatagcctcattgtctttgtcatgccttccctatctctataaatgaggtagatctcaataaagggttgagtgacaaaagtattatctgtgagtaggccctctaagagacctttagcaaggctcaagcaccttaaatttttgaagattatgatccataagttcatctgtcccaaacagatttaacacagagtgggttaggttttggttagacttggttggaataaatcatcatttttctcctctgattaaattatccaaagttggagccctctttgagctgaccacctaggccaaatgaagttactgattctgctttttctttaggttcttcctagtagtacaagtttaagtcccaaagttgcagggtgatgtgaaccacatattaattatttacatgtttatgcgagtgacaagatgatttccttctattggaaataggtgtgaaaatctgcctcaaatgacactttttactctcagaaacagaaaagaaggtgaaaagtctttcgagcaaatgcaggaaaaagtcctatgaatgttcttggagtaatgtatgtatcagccactaataaatttcctcatcattggcttaaaaaatcagctaccccaagacaagggagtgaaatatctttctaattatacatgcattcaatagctcaatagttatttgatactcctgtatcaaacattgaacatataaagatattcaagaccctggctctgagtatgttgctagcaaaaaaatgtgcctcttgataaattgaagatataatgcatgtataagacattctagaaggaggatatagattcttcttactctgacctgagaaggccaacaaaaataatggtaagacatctactacccaaaattggaagtgagtgtaataggaaaacttacatagaaactttgttttcaggagaaatgtctagcggtcatagttaacttattttacctagttgcttaggcaaccaaaaaccaaaagaaaaactatgggaaaaggtacagaatgattaatcaacaattattagtctttttttcagagtctgtgtttatctgaaagttataatttgtttacttggttctaaatatatgagtaccgatgacaaactcatcttgtaattcaagataaaccataaactcagtgtttataaaattatcattaatgtaaaaatacttaacacagtgcctagcttaaataaaatgcttgataaaatttagccactataaatattgtttcataagaattaatatttattggcataaaaatctcaaaaagaatagagtaacagaaaaatctctctgggtatatagctgatggtcatcaaggggaaagagtcagatgtatttttgttgccaaagttctaaaataatataaagtttactcacttcagaatgtcctaataacttaggtattttatgaaaactttttaattcaatcctttctaaataaaggtattgtgaaagatactgtaagttctgtaagatacagtaacatactactccagcctttaggatgctcaaaagctagtaagaatgttaagagaaatacagagataactatactgaggttcagccagaagataattaagaaaaaccatggggattgtgtaaaggacacagctgggaaaaatgaggaaggcttcaccaaggaagtaccactaaaatggcattgaaaaacaggaggatttcaacaggtgaagaaaaaggtgaagaaccagttggggcgaaagtgggagtacattccatgtgaacaaatacggaaggaaaaagcacctaatgtatttcaggaagataatcccattttattggagacaaagtattcatggatcagaggtagaattggatcaaattagagatgaatttgaatgacagagtaaaaaataattgtaaagctcaagacatactatctttaatctttgtgttctctttctctcactttactgaaagaaacttccagcattgcccctcagaatcctgctttaggtgttgataacaaccaaaggaaactcaaattgggagaaagaggcagtttagtttttagaattagaaaacaacctgttgaaagtcaaagagaagatcagagaaaaaagagttgtatcataccaatagacgtggaaagacaatagagaaacaggaggccccaagtgcccagtgacttcactggaaaggaatcctgggaggtggtaggagaataaagttcgggtaaggatggtaagatgacctccagatcttgttggaattggggaaggccttagttgatggccatggtcaaagtcatcttgctgcatgggagctttgccaactgagccaagttagcctctttgctgttgggtataggttttccaagctgtgactcatccaacagaaggatccccttccttagccctgagatttgtatgtattcctatttaaactgctctcttatgtgtgaccagcaccctgcattttccatagttaaggacacttgcaagacagcttactctgcttccccatcaccacctcactgcttctgagccagaaaatgggctagaatccaaaggagtggtggctatgtaaaagatgcctttcacaccaagtaagcttaaagggactagattcctatacgaggtgaagaaagatgactgcagattttcaaaagacctggtaaaactaataaatactgtagtttatctgtaacttttaaaggtctgtgactgtacacctaaataaatgttaaatatttgtagaattgatccaataaactaaatgtcacctggggcataaagatgtgctgcctctcttcaagagtattcaggtaaggtatattcactggaatattcaaagatgagatctaactcaccacaactgctcaagtgttcataatagtatcagtgcttaaggctcagaaatactgaataatttcacataatattgtaaacctaatagataatagagaggactcaaattagttgttctgtctctcttttttttctttctataatacagattcatcccctgcatggctttatgtttgggacttaagggataaagtcacttcaaagtttatgatagtataaaacaaacggcactgcagtatttttccttttattaggtattatctgtctttagtctcagcactgattatttatgttccgaaggataatggtggttcatctttcttctacattttagtataggcaactttatttgtacactaactgctttttgaccattatcacttatttttcttcctaaaccatctactattcctatttaaaaatgtgtttctgaaatatatcccactaaacactccattccctgcttccagtgaaaggaacacacagtcccttaggactcaaaaatatcctatagctctccatagtctacaaagtaaaggttatacccttcccattgatataccatgttctcctcaacctgtccccattttattatacaaacctagctcctaataatttatgtcagttggccttcatttcaaccaaagcaaaacgctggctccaggatctcacattatatgcctttatgatgcttgtattcgtattattccttctttctagattgatttacatggacttttccatgcatccaaatgcaacatgacctttaatgttcacctcaaaatttaattcctccatgaaacccttcctaatcatccatattcaaagtatcttttctatgtaaaatttcatatattctatcatgtcttggaattatttttgccggaggactataagaaagaagatgatatggtagaggagaaatagggaagaaaaaggagaaaaaagaggcagaaaaagttaaaaagagaggaagaggaggaagaggaagtaccaaaagaaaaatagaaaaaaagaagatattttcagaagtgtttgaatgaatgctattaagaatgattatttaaaaggtaatcattaacaaatatcgagaaatcaggacattcagtggttagcaagaacacaagctcattcccagctctatgatttaacagatctttgatgctgggaaaggaaagttccttagccctcagctttctcatctgtaaaatggaaataatagcagctatcttacagcactgttgtgaggattaagtaagattgtattactaaagtgcctaagacatctggttaatagtttcaagttccacaaatggaaatgctttaatacagttggaggtatgcttttacaagttcctttaaaccagaaaggttttagcttggattcagtagaaaagatgaaattcccagcttctaaattccattattgtaaaagtaccaaggtctggacagctggcagggctgattgaacaatatccttatgtgaaaagctcaggaaaactgagccctggtttaataacttactggcctctgtttaatcataggtcttgatgactctcagcggagatttaatttttggtccctggaaataggctattgatgtcttgacagaaacaagcagaataacaactagctgttggtcaacaggaatacacacacacacatatatgagcaaaaaaaaaaaaaaaaaacccgacagatttaataattagatctaaatgtgttttggtaaaagcaatgagaattgcctgagaaggataagaaacatatgaacctatgagtacatcaaaacccaatggaaccaaatggtgcccagttttcttgttttgacatcctctattttctagagttctggagagtaggaataatgacaactaaaaaatcccattctaacagatctgaatggttgcgtgtgtgtgtgtgtgtgtgtgtgcatatgtgtgttaccatatttaattctcactagctctccagtgcattatcttcatatgggatattgtgaaattgaggataaagaggttaagacatttacctaggtcatctcagagttagtggtagagctagagtatgaaatcaagaaggatgccagaaccactccccaacataaaatctaaataataggaagaggtagaatgtcagagcacattgccaaagtcaggggaaatcggaagccaggtatggtgatatggtttggctgtgtccccacccaaatttcatcttgaattcccacgtattgtgggacggacctggtgggagataagtgaatcaggggcaggtctttctcgtgctgttctcttgacagtgagtaagtctcataagatctgatggttattataagggggagttttcctgcacaaactctatttgcctgccgccatccacgtaagatgtgacttgctcctccttgccttctgccatgattgtggggcctcgccagccaggtagaactgtaagtcaaattaaacctcttccttctgtaaattgcccagtcttgggtatgtctttatcagcaacgtgcaaacagactaatacatacagttaccaagatggacgcattttctaggacagagaaggaagataattgtatgaccacatccttgtttgttctaactgggtttctaatatggtgaacacagctgccattaagaaaccaattttaagaagtattctatagaccattttagatggtcaaagcaagtggcagttctgctcatagctgatagtgcctacctcaaagttctaaacacatttccaacttccacttgcagtcaagttccatggtttttaaaaattacagaaatcttttttcttgctacattcctctctaaaatgctcacactgtgaatgttaaacatgtgttttacctaatacactttccctggtggtgtggcccggtcattgattaagctcctttcccaagatccacattcacatttcaatcttttgactttatctcctataaaaggaaagtgtgttactttcccattgcattgtagagattgttgctaaaaataacaaggattgttacattctagaggcttttaaaaagacattttaagtaaacatgaggtaaaaaattatgaccgaacagaatttataaaatagagtgttgatttaattttatacatgagagatataaatttaagacttttcaggctgaaatatgttacacttaagaagagaggcaccaactgttctagtatgaataaaagggtttttaaaattattttaccccatagaatctatgttctgaagaatttttctgccaagctaactgcatataatcagtgatgatttgatttgtttaactacattcaagtatatgtggaataatcaagacaagcttctaatcagtccaagcaaatcattgtcagtagagtgggtgatataactccagctttctttctttagaatgcacaggcttttgtagagccaatgttctactggattaggctttctgatatatttaaagtagcacaattaaggactgaggctttgtagcaggtaaattagagtttgaatactgattctatcatctaatgtctgtgagaccttacacaatatatttagcttctctaaacctcaggttcctcagctgtataataaagaaaataatcacatataactcacagaagtaatgtgaagagtagaataatgaatgtaaaatgcgtagtgcaacacctagcatatttagtaagtgttagttgctgtttttgtcatcctcatcatcatcctaaccacaatcaccatcattattattatgtcatctttatgattactggattcaagaagtgtagcaggcttggaaactttaggttgagaagtactgttttaaatggagtgtcttgtgattttgcacttaagttccaatagacagttttaaccatcagaccaaaggaattatatataattcccaggggataccaactttttaaaggcatgcttatataataatatcatatttctaatggtcaggttcctgatgttttgataaaaggaacagtttttctatgatcttaaaatgaaatggccattgggtatgggaaagaagagtgtagaataatggtggacaatatgagataagatgggatgacaagacatgatttacagtcacgtttccttttctacctgaagtgtccatcagcttggggacatggtgtatgtccatcagcttggggacatggtgtgatggtggatttatcaggtcagattcaaatatcatccagctgattactactgactcattgggtagttttacttttggcagaggctcagattcttgataaattttaccacctgcttgaaaataatttgccatcaccaagcagtgaaattagttttgctaagcagaacaaagacaatgatcagtctctgcttatctaaatataagtagtggtgggttttgtaattggtgtgtttggcaactctcctcctagtcacccataaactctctccacccattccacccccttcccatcctctccaaccagcccctgcctgaatcataataatagctcctattttgggagcatttttatgcatcacacattgctcaggtccttggatactgtagtagtcagaaaaatgacccctcaaggtgttcatctctacataaacagtgagcaggcactggagtcactcaaacttgattcaaatcccaactccaccactcacatagctctgagatggcctggtgagcaagattacacaggctcatttaggatgtgatggggctttcaactgtaaaatgaggataataatctctacttttataggtccctgataatgtatacaaagtgcttagaacaatggctggcatataataggcactcaaaaaaaggatgttaaaaaaactagtgatacttcacatctcttcaataattttatcaggaacatgccatctgaaaggttcatttttgctgaggtaagtatcttggccccaggtagaattaatgaggaatttttaagagctttgtcatagtgtaacatagatagatccatgaatggattcagttgatgtaagtgaggtggtttaaaagcagacagggtaggcagtagggacaagtgtcatggcacataaaagacagagaagacttatatgctcaaaattatctgcctcttatatgtttcaatacccatcattaaagactgacaacttatctgtatattctcccttcaatctctttgcaggatccctttacaaaaggcaaacatttcttgtgtgtggtcaagaaaaagcaaagataatacatgtgcttcttagctcttaatcggaaagaatatgctgcccatgcctttggcttgaaccactgtgcacctgctgactgggggaagagaaagaaaggaggtgaaaagtgctctcaacatgagggtgaaaacaaatactacttttgtctaggacatactttttacctgaaagtagaatgttaaaatctaagactttcttcccctgagagtagctgcttagagactggccagagacccagggccttgggccactcccagcagagaggagcatgttcatgaaaactgacccaggcagatggagaagatagagtcaggactatgtcaggtagtgggctgtagcctgggctggtgatctgtgtgagcaaaattccaaggggtccggaagtagtaatgactgatagataaacatggtttcaggaaagaggaccagaggaaagcatttattatagccaggggtgagcttcagctgtactaggcagtgagtagcagaccctaaagcatgactagaagaagcaagagctatgcaaagccacaggatctaagtgttggatgaggtgtacagaggaatccctgaaaatacctgggagccaagttgacttgctgcaacatcttccaaaaggagcctccctgccccaattttaccaattttcagtttctcgttttaaaacccatcagtgactttgcattgtcccaagaatcattctcaaattatttagcttttcacatttttctcttatcactttcctgtgcttcaaacaccatgggaaatgacatagagacagaagcatacacacatgctcacacctacacacaagctcacccacatacacacacccatttaaacataaaccagttgtgtcgctcatttgctcaaaatttctaacatttttcatttgaattaccatcgtacttatataatctgtccctaaaaccatctgtgacctcatttcctactacttgctctcatcttggtcattcttgctatttctctgacacaggaactactactgcctcaaagtccttgtgctttggggttcctgtgcctagatatttgattaacctgctctctcattttcctcaagtctcagctcaacatatcacctaagagttagggaagcacgatctgactgctctgacataaatgtgtcatactattcagagcacaagtataaaccatcatttcccctttttttgccttattttccttcaagacattcaaaactaccttcaaatttataacattttacatgtatgtctcctcttcataagaaaaaggactgggtcttattcattttatcaccaggtcattagttacctgaacagccactgctatgccttcaataaatatttgttgaataaacaaaagaataaatgatgtcacctcagttatcatctattttgggaaaactctggttgccctcaaactgtatatcattctcttctctgtgcttccataataacttatgcttatccctgcattaacactaaccatatgaacactgggcagaaatgacctctaattatgtggcctccctactattctccaagctctgtgaagtcatggattcagctttgctcactgaagcaaatgtggtacacaataggtgatccacgtatgtttgaagaataaatgaagggcggtaaacgggcacaatgtcagaggaacatgttgattccactgaaccacagaatgaatgcttctcaatttctccccacttgtggtggctttcaggtccagagcagggctgagtttccacgtgggactcaggtaaaagatgggaccaagaaggtcattatatcctgtcttcttgagtaccaccaggcatctaagctggagtgagctaagctgaactgagcagctgtgtgtaggtggagagaatattctggttcatcataggcaataagttcactaaaagttcctgggtggatgaaggcatcaaagttcagaatgtaccaccatcgtgaacctcaaagttaattatcttttcatccagtttcatgtttacttaattgccaggaaagaaacctgctttgaatgaggttcagaactcgctgatgaacaatgactactgcattctgagaaatgtgttatcatatagcttggggtgagctctgtgtgttttcagagagacaaagcatctgagttagagtgcttagttcccaaccactgctactggttgttatattttgtgcctgctacatgaatggactacagatagatggctttaaccttagaaatcaatgatcataacttttatggtgtgcatatgtcatgccaggcactgtactaaattccttagaatctgattaatggaggcaagattgttgaactgattgttgctttttccaacaagaacatttttattcagcaactgcattattgtaatataaggagaaagtaaaagactttttattgaaaaatgtccaaagcccatccaggggaaaacttttatatatataaaaaataatccttaaaatttatttagtattacatgatttccaaagcatttttatttatgttatcttattttgtttcctcacggttcacggttcactggaataaaaaggaagccccatgtgaaatgtgactttaattagcctcatactgtattttaaattttcagagcagtatctggacatggtaaaaaactgacaatttttgaatgaaggaatatacttcattctatttacttaatatgaagtaggaagtgaaatatgccataatcaggaaattacagagaataataggttaagaggtagccaggaatttaggtttgccttttcccttcattatctgaccaattctctggtctcgcataagaacttaaactctgactcccactggcctcactaattaaacaaatagataatggcgtttaactctgtcatgtagattaacaaacatggaaaatgtttagcacaaggtttgcacatataagatgttcaattaatattagtgtcccttcctccctcttcccataggagagatacaaataaattgttatgggatttcagaggaatttagatattcaattttattatatgaaatctgaggttgttaagacattaaataatttgcctgaagtcacttagctaagtaagtaggagagctggagcttgttctgagctctcccaatattagattattgctactacaactgtaccctatggaccctatagtcccagagttgggactctacttgaagcatcctaaatgtgagtatatatcccactatccaatcagaaagacaatcttttttctaagagagataggggatgaggattagagattcataaggccattagactctcctgggaacatactgttacctccaaaggagatccctgcggaaacctctgaaatattaattcaagcaaaattataagcttatttgtcctctgcatggctcacataatacaaattagaattctcatgtcatgagtttgggaaccatggaattcatataaaacatgtttattattttgcataatgaagtatgtcaacctccatggaaattaaaataactaatcatctcttatcaatgacattcacatgccgttatacctccactgaatgtcagttcttttcatgcctggcacagatccgcattaccttgatctgacagtaggcagccacataggtttcaaggaaggagacattaaaaggtatccactgattgagctatggcttgtaaccaactggcaatcaagatacacgatacactagaggacagaacccaggcactcatggtaagaaagcaaatgactaccaagtacacatgaaagggcaataattttctacatgacagctttccacagattgtttccaaagggagacttgctcattggagtggaaactgggatagtcaccgcctatctatccatgtagtgtgttttctggcacaaaaacgaaaagagataactagtgataggcaacaatgagtagtttataaagtattttggcatgatagtcaacatttcctaggtttgggctaaattctcagaaatgcctacattgtgtttctattttaatccatgatgagtaagaaactgagatgcaaagacactatgtaataagtacttacttattcagtcaatccaatgacagggagctgactggatgccaggcgaagcatgtgggttcaggggaagcagatgaataagtcacaatcaccgtcctaatggaacccatcttctaactgagatgtcaccaccacccccaccaccaacaacaaaattcttaccacattctaaggttctcttaagaaaacagccacagatacaaatatcatcaattataatcacctaaataatatgctaaaactacaactcaaaaccaaaaaataaaaacaaaacaaaaacactgggtgtaaatagaagttttggctgaaacagcaaagcagtaatcttgtgccaaaagaaaccctactttaaaaaaatgatatctatgaagtgctgaggcagccattgcctacaaatcttacttcctagcattcttagagcattacagagttttcaaaacactctcttatatattatctttcttaatccccacatgtcaggtattattttctttacaatatcaaaaaacttatttgtaacaaaatcaattacaaataaactgatttgtacaaggtaacagagaaagtaaatactgagactggggttggatgcaggtatgtgaggtgtgagggccaggtacagtgcttttgtccaatacactgaaggatgagttgcttagacacatagggtcaaagctgcacctagaacctacagtttatgcttcttagccccaggctgctggattcttacctattgtttaattcttagtaacttgtttaaacataaaggatgttcttttgcaataattttaacatcttccaaacataattaagtggttaagagctgaagtagggaatatcaaatctgatgtgaaattccagctctgagacactacctagataatttacttaaactttttgaaactcacttttctcctctataaaactgaattgtaatgtctgcttcatagggctgttacaaggattagatgagatattaagtgcctaacataatccctgataatggcagatttcagattgaagagctatttaataaacaacatggtagtaacaatttagtagctcaaatttgcacaggactcagaaacttcacactttttacaaccctatcccatgacctttactctaaagaggtgctaacacataagtattgtgctatatatattacaagtgggaagctctgcataatctacagattcataacaatgccaaaactgctatactaaactaaaagatacttgccatcttaatggatatcttggatgaaaatgctttactggctcaaatataatgcaaagattaacagtttttactttacttaaaagtcttagcttgacactaaatataaatatttgccaggttagcagatcaaagcagatacttacatttttttcactgttctctctttctgtctctctctgtttctctctctatatattccttcctctctctctctctctctcacatgcacacacatgcatatatgctcacacatagattaagcacttaattttaaattatatctgcttgtctggcataggaggtaagattgtagacactagagtcaggttacttccgtctaaatccattctatgcccctgagaagttgtctgatcatgggcaagattatccattcactcattcatttatctattcatttatttaaaataattactgatgatctacatgtcaagaattgtattatttttctggagatacggagatgaaaaaaatagacaagatccatgctctcaaggagaatacattcaggaaggaaagacacaagtaaaaataaacaaacaaagcaatatcaggttgtgataaagaaaataaaataaacatggtcgtatgatagagcgagttggaaaggtaccattagacagggtggttataaaaaacatgttggaggaagaacattctcctgtgagctcaattctctcctgattagatagctggaagggataaatgacagttgtcacccaggcatgctacagactctatttacacacagatgatgtctcagccaaggttatttggttgcaagaaaaaaaaaaaaaaagcaaacaacaaatggctttgactaaattaaggaaaaaataaatctactgctggagaatttgatagcttaaagaatcaatgaaaacattataaaactaggttcaaccacaggcaagtaaatcacctggggtcttgatagaagaaactgcctaacatctatctattcagagcattttctcatccttgcattctctataatctggctaggaagtgtaatctagctttcgtcacctaaattcactttgcctaaggcaggataggacaccagcatttcagagctccagagcatctaggaagtgtccctgttttgaattggagacaaaaaagtagaagatatgtgaaggcatcaatgccctcaaatctcaaggtccaaggtacactgggatcagaaaccagatagataatttaaaaagtaatggatcccaacacagtgtagtataaatattgagatcatgtctcatgctaaccaatttttctatgcagagagaaactcaccctaaaacagttcaaaaattcttatttccttatccaggtgatattttatatggcaattcacaaatatattgtcaaggaccctacaataattctcacttatatgaaaaaaagttgattatatgttgaatttggctcacctgactttaaacaatatggtttttgacaagtgcacataccccatcccctgaactcagtttcctttgttgtttgactcataataggttgtcaaacagaaggtagtaatagaaggatgtggatttttctactcttatacttcttcccacccaactactccaatatggggaatataagcttccaaatataaaacttatattttaagcttttaattatgaagaacttcaaattatacaaacggtcacttatttcctaagtagattctgaaatgtttacataagaaatagtaggccaggctcagtggctcatgcctgtaatcccagcactttgggaggccaaggcaggtggatcacctgaggtcagtagttcgagaccagcctggccaacatggcgaaaacccgtcttgactaaaaatacaaatattagccaggcatagtggtgcatgcctgtagtcctagatactccagaggctgaggcaggaaaattgcttgaacccgggaagatggacggtggagtgagctgagatcgtgctaatgcactccagcctgggtgacagagccgagactccgtctaaaaaaaagaagaaaaaatttattacccattatggaattagaatacaaatactttgcttacatcgttgagattttgtgagaaacagtcaggtatatgcagcttactgtaaactttccagtacaatgcaaatataaagtagattattctctataatgaaaaaaaatggattaatgttctctaaattacattttagttccaaaattatcttcaatggtatgatataattatctgatcaagccaccaaaagagtaatttgttaaaggaaaataaatgatatagtagaaaaaccatgtgaataagggtagaggatttttttttaagctttaaatatactgatgcccagaagacttctagtttcacatcctgctttttcccccaagcaatgctgtgaaccttgggctgtacaccccactttgcagtttcatctgtaaaatgaggacatacaattactccatttcagattccttttctttgcctttcttttcttttctttttttcttttctttttccttccttccttccttcctttctttctcactctctctgtctttctctctttctctctttctcctttctttccttccttccttcctttctctctctctctctttctctctctttctctctctctctctccttccttccttccttccttccttccttccttccttccttccttccttccttccttccttccttccttccttccttccttctttctttctttctttctttctttctttctttctttctttctttctttctttctttctttctttctttctttctttctttctttctttctttctttctttctttctttctttctttctttctttctttctttctatacagagtctcatgctgtcacccaggctaagtgcagtgtctcaatctcggctcactgcagcctccatctcccaggtacaagcgattctcgttattcagcttcccaagtagctgggactacagggtcccgccaccatacctggctaattttttgtattttttagtagagatggtgtttcaccatgttgaccaggctaatttcgaactcctggcctgacatgatccacctgcctcagcctcccaaagtgctggcattacaggagaaccatttcacgacagcccaggttattttcttaaaattctctgaacactttctagtgagtgtttacttatttcactatgtaggtctacagattatccagccctttaaggatcttactttttaaaatggaaggcatagaagtaggcaaatatgcaaggggagaaaaagaaaacaaaaatcaaaactaataaaaatctggacaataaagtaaatgcatcatcactcatatttccagaggaaatgctacatggagaagaaggtcagggataagtgcctaattagaatagacagaaaggaaaagaaaaatagagaactaacaaaaactgactatgctaagtgggactgaagagattctcttgtaatacattctaaaaatcttcctggaagtggtgtttctaataatgatttgaaggatagcagtaaatgttagtggtatagaacagaggtgtaatctgttggaaaagtgagagcaagaggtaatacaatttcttatggaataaacctttgcattggtctcttttggtagactaagaaaacgctcgaagataagaaaactgctttattcatgtctgaatacccaatactatttcatagggttgtctgggggtcaaattagttactatgtgtgaaagacctaatagtgagcttggcagagtagacacataataaatgtccctagattacattttggggaaaggttgatgcataaagatcagaacaaatgagtgaagatgatttgaagcaggtgaattcaatgtcaaaattaaactgtttctaacacagcctgctaaccaggacccctcagtcctccagtggaagggtagtctgctgcatgtttcttaggaccaagcttcttggctttccatagagtgtgccacagacattttcataggaacaggtgagttgagagacctctgtggccaagctaccctcatttccaacaaggcaatctgttcttgccacatgttccagctccagggctagattgcctggtaagttaaaatgatagatggtccttaagaaaagtctgagtcagcaagttcaacagtatatgcatttgtcttagaattttaataaaaacccagacctactcaaaaactagacctcagtgaagaaagtgaaatattaccctgtaagcatcactgcatcattcttaacttcataacagatttgaatgacgactttacattttgtggcttctcaatgtttattccttcttagcttcacaagcactgtgtacagagatttctatgttcttttccctacactgcactctgatgaattggagtgtgactttgaaaatctgtcatgtccatcactgaaatacggatgtagatatttttcccaacacagctttaatattattgttgaaaataataacaaaaatagctgttaccatttgctgagcaattactatagaccaaactgtacatgtgttatctcatttaggaactatgaagaagtaatattactctaattttacacctaagaaaactaaagctcagagatgtacaccaaagcccaagttttaaactcattttttttgacatttaagcccctgtctttctactatcctcttctacaaaggggtgaaatgtttcaacaacttacttaaacattaacttccatcagataaatcacatacatgattatttgtattaataatgccaaatcctacctaactactaagtgtttggcttattagaacccattctgggtattactaattctcaattattaatggcatcccttttattatcaaacgctgttaccactagatattttagttcagcatgtaaaaccttattacttatttatcaaagatacaatttaagccctacttcaaagataaaacctgagattgtgctgacctaattgccaacattctttttcatcttcagagttttttccctaaaacctaaagttgattaataagtaaagtaagaaattgtgtaatttttttttctaggcatttaaactaaccttcttaaaaagccatttttaacattgaaaccttcatgtggcaccagtgcttgttagaaatacaagtaatgacccagaggattatatatagacaatggaagctgacagtttgacctttagctgataaaaagtcaatgtgttgactccatgttttagcagcaacatctataattgactctaaaacttgatggctctttgactgaatcatctatttgcaaataagttcaaatatacccttcccccaacagaaacttgcatacaactatatataacacaaatatttgctcgtattgctatgtaatattatgaatagtgtgttttccattcactcttttatattcttttacgtcaaattagttcaaattgccaatggataggagcactggacttggattcatgagaactagcttcgttggtgcctttctaaatgatacttaatctttctatacctcagttatgaccctggtgatatagtagtattaaaatgtatcctatttatttcaaacaatcagtagttctgtagcaatgcaacaatggtaggcgacccttcccacaaatttggtataaggtatcataatataataagtgaaatgtaaattttagcttttaaattaaaagtagcattctatgagcgtatactgtatactagctattgcatcaagtacttacatatattatatgtaacatctcatttgtcttcacaagaatcctaagagataagtgctttctccatttttgtagttaggcaatctgagacttaacaaggttaagtaatatatttgggactacagacctagtaaaaatcactgcaagtattgaatgagagacacttaattttaattccagttctataatttactagttaaatggctttgagcaagtgtttaaatgtctctcaacaacatcaggttcctaatttgcaaaataaggatgccaacatctgccttatagaattattgaaggaattaaatgtgataagatgtttctaggctagaattaatatgttcagcaataaaaatggtaatcattattaccattatttaatagtagcaatagtaaaaagaaatgtgacatcttcatacaccttagaatacagcttgcatttatcaaggacatatggggaacaagaaatctcttgggtatattttcaagattagaatgaaaaacaaaaaaatgtaagatgtattttatagttcaatctcatacatcttagcttaactttctgggttgtagtaggccgaagaaagttcccctaaaaatgtccacattcctgaaggttataaattcctgaaacctgtaactgtgttaccttatatgacagaagtggctttgcagatgtgattaaattaaggaccttgagatggcgagtttacgctgggttacacagtttgctctaatgttatgacagaggctcagttcttttttttttttttgagacggagtctagctctgtcgcccaggctggagtgcagtggcgggatctcggctcactgcaagctccgcctcccgggttcaagccattctcctgcctcagcctcccaagtagctgggactacaggcgcccgccactgcgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctcagttcttaaaagagtcagtaaaagatatgtgaggacggaagcacagtcggagagaaatttaaggatgctatgcttcggagagaaatttaaagatgctatgcttctggttttaaagatggacaaagaggccataagccaaggaacattctagaaacttcatctaaaagctggaaaaggcaaggaaactgattcttccctcaaggcttcagaacatagcccttcagataccttgattttagtccagtaagggccattttggactctgacatcccaaactgtaagataataaatttgtgttgctttataccatgaagcttgtggtaactttttaaagtaacaatacaaaaccaataaaggagtggtgggtattatagagcgaataatatttatatgtgtagtatctgaaaaaaagaagaggaaaatgtaagaatttgttggaacctcaagaactgcccagaagagatgataagtcagcagactactggcaatgactctgcttcctcagccagtctatcttcagtggggacagacaaccatggggcaaccatggcttaaaggtattagttggctaaggtcattctacttcccttgctctaattttctgctcattgtataatccttttattatagcttagtttccaaagtagacatttctactgaaaagataaatttgccaataaaattttcttccagcttagcacctctatttctcactgcagattaattagttggcatcaagtttctatatactcattcactcatatcgtcaatgaatattcatagagcactgtcaggtacagtgctattacagatacagaaataaatcaaatataattcctaccttcaaggagttcacagtttaagggagaaacagttaaaagagtcataaattagcagtcacagttcagcatggtaaatgctaaaatataaataaataatgtgtgaccaaagtgccaggagagtagctaactaatatttgtgggaatctgggaaggctttgaagagaagtgatgagatttactgagatttaaaaacttattaaacagtttaacatgaagtgctactttaaacatgatgacttctggatatacagataaaattgagcccttacttttgtaaaactgagtactagatgctgataaataaaaactgggcatccttgtcttgttccaattcacaaggggaatgctttcagcttttgcccattcagtatgatgttggctgcaggtttatcatatatgaaccttattattttgagttatattcctttgatgcctagtccgttgagagtttttcatcacgaagggatgctggattttattcaaagttttttctatgtctattgagatgatcataagctttttgcatttaattccgtttatgtggtgaatacatttattgacttgcatatgttgaaccagccttgaatcccaggaataaagcctgctttatcacggtgtattaactttttgatgtgctgctggattcagtttgctagtttgttgaggattgttgcatcctttaaaataatctcagatctaaaaatgtgaaactttattaagtgattctttttctgctctagtttatgcttagcaaacaaggtgacaatatttgatttctttgatagagacacagtgtactttttatatagcagtcaaaataatccttttcaaaatataaatcacatcattttcctcccctgatcaaagttttccactgggttctcatctcattctgaatgaaaccaccagttcttactttgtcttatgatacacacatgtgctgcctgctctacctattttaacttccacagtacctttataacctcacttcctactactttgtcttcttcatatgccacactgatcttttttgctgtttcttgaacataataagcatagtttggcctcaaggcgtttttattacctgttgtctttcattggtatattctctctccaatatattgtgcatgattaacacatttttaagcctttgctcaaatgctatcttttctttctttacctttttttttttttttctcttttttagacagagtctcgctgttgccaggctggagtgcagtggcgcaatctcagctcactgcaacctccgtctcccgggttcaagccattctcctgcctcagcctcccaagtagctgggactacaggtgccccccaccatgcctggctaatttttgtattagtagagacagggtttcaccgtgttggccaggctggtctcggactcctgacctcaggtgatccactcgcctcggcctcccaaagtgctgggattacaagcatgagacaccgtgcctggccattatattgcttttttatttatttacttatttaatagcacttaccatcatctgacatttatattatttctttatttgtttattgtctgtctactctcacttgaatgtaaactttgttaagacaggaaattgttctgttttattcatcattgtaccttcagtacctttgtgaagtagatgctcagtaaatggttattgttgactgaacacaggaatatggactatatggacttctataaatgactgaccgtcttactaccaatgtataaaaattaggcacaaaatgtggaaataaatattttaaatacatagctgagcgcaaacacaagaattggaaatctctgggtgaaagaaatgtagcagacacctgaaggcagatcaatcaacttataagctagtgctaatatatatgaactaaataaaccgtaataactcaaaactggagttttaatgctcacctgaggataagagatatatcatacatttgaaactgtgaccttgcataaagtctgaattctggaaaatgtctcctttagataaagggaattagaaaacctgtgaccttgtcctaagaagcaacaaataagatggcctctactttaaatttaaaaagtctttcaaggaaattacaatcctcaagcaaatttctcctgtgaatatgtattccaaacttactgttcccatttagtatgagatctcttatattgataaattaatgtaaaaaactacttttctggacaagtgaaacctttggaatgttcagctgaagcaattatgcaattattccctagtgatatttctccaacccatggcaagtgaaattaccactgataaaacagtttctatcaaagttgaactcacaataagaagtcataaactacatgataaagtgctccaccaggaggaagagtcagcccacccaacaaatagaaagactaaattacaaagaatttgaaaataaaaatggaataatttgacactaagtacaaaatctatatgtttaaaatgacaaaatagtgggtgaattgagaagcaatttttttcacatctgaaagagaattggtaaattaaaaattgtgcagaatacaaaatacaaacaaaatgtgatctaatatatgaaaaatattgtgatttccaagacagaataagaagcccaatttatatctaatcagaaggagataattgagaaagggaaagagatattattaaaaacttcaatggttgaaaaatttaaaaattaagaaaataaattaaaccttatatatgaagaagcacaccaaattcaaagcaacaaaaacaaaaataaattcactcctaggtgccttttagcaaaactgcagacagccaaaaataaaaatgaaatcttaaaaacaatcagaaagtagtaagagttcacttattattattattattattattattattatgttaatcagaaaataattaaaaacagtaaattagaataaggtaaagttgccattctggaagtcaaaagaagtattagttattatattatcaaaattggaaaggaaaatataacatttgatgagtaactatgtgccagttactgagctagatgattttaaatttttattcctaacatatgtcatttattacccaagaattctcaagatcatattcaccacattttatacaagtaaaagtgagtttagaaacaataatcttgcccaatcatgctatcaataaatgaaagcgccagaaattcctaagggtttggctccaaattacactaaatagatataagaactcaaaacaagacagaacagaacaacatagttgtactactaaccttgtatgattttaaataagtaatatagtttatttttttcatttgtaaaatgagaataacaatagtactaacctcatagaattgttgtgaggaatagtatccaaatgtatgtaatatataatacaacttggaacatatttagtattttttaaatgctaattggttgtgttatttacaattaattatgatatttaacagtcattcgttgaaggaagacaatgttttattcatcttttattctctatggccttacataatgggaattgtattgagtaaattattattaagttaccaggataactgttttttgtttgtttgtttgtttgtttgtttgttttaggagtggaggagcagagagtttaataggctcaaatgaagggagaagggagaaggaagaaactcccccatacagggacagagggaggagggctccaaagccgaaagaggagacccctaccaggataacttcttacatggaacatatccttccctaatgtttggaattttagggataaggaaatatcaactagactccagaaggagaaaatatatctgttcctgagaaggtttcctctggatgagaaaaatagataataataatatataaaatgagtttgatgagagtgctgggaaaatgataatgcataaagagaggattatagtgctcagcttacatcaagtttcttgacaccaagtgtggaatttttttttctaattttgtctttcataatattttattcttaaggtacagtaaaatgttattctattcttacttcaatttaatataggactaatcaaatatgaatgcatgtatgaataataaaaatgaacacaatatttgataaccccacttactcttaattcagttgaaatggcaacttttctttggaccacaaattgaatgaatatcttcttcaggcactactgaaaattaatgataatatttatacttcaggttatatcagagttcatatatattttgactcttctacagcatctgaaataatgcctatacttaggttccacaaaaatttccattaagtgattcaacttaatatattaataaccacttaagtgctgagtactatactaattgtcaacaatattagggcctaaataatccactgcttatttgaatgctaacatcaaaaacaatcttaaatgataaagtaaccactgaggagtctaatggtgctcctgagtgctggataactggctggttctttatatactctgcctcagtgctttcaagacttgcttgatgataaaactcatttggcatatatgttaaaatgctggttctcagggccctgcttggagcttctgattcaatacaactaaaagggccttagaatgtagatttaaaacaatatatctgatttggtaaaatttggtacaaactgtattaatcctcacaacaaccctttgaggtagggtgaatttgttgagactaagaacaattaggtaacacgctcgaggtcacatacctagcaaacaacagagctgggacttaaacttagttttgaattcctcaaaggctacaagtctactaccctattttgtttttgctcagccaaggcgagcaaagtttaggattatttctcctcctttttacatataagcaacagaccacatggcatttccaaaagcaataggcatttctcagtaaagccatgaaaatataacaacttgtcccctcccaataaggacacctgagcaccttttgtggcatgctgagctttcttcagcttttctgcatgcaagtctctgcctgtccacagatttctgagtaaacaatgtaaatatttaccaagaacttctaggaacatagagagcacttcaggcaaaatagaactgacagtacctttaaaaaaatcagatttgaaagaatctgaggaaattaaaggctactataactctgtcctgtgtgtttccactttcttatcttacttatttgtatttattctgcaactgacttgaagctccttttgaacaagagttgtttctcaaccatctttggatttctaggactttgaaaaattcaaatgactaccacaagatatattataatcaaactataaaacataaaaaagacaggatcctgaaagcaaaagagaaaatacacaaataacatataaaggagtttcaatacagctaccagcagacttcttagtagaaactttataggccaagagaaaatcagataatatagcaaagtgctgagtaaaaaaaaaagacaaccaagaataatgggtaaagaaaatgtggcacgtatacaccatggaatactacacagccataaaaaagaatgagatcacgtcctttgcagggacatggataaagctggaagccatcattctcagcaaactgacacaggaacagaaaaccaaacacctcatgttcctactcataagtgggagttgaatgatgagaacacatggacacagggaggggaacaatacacactggggcctgttggggttgggggactaggggagggagaggattaggacaaatacctaactcatgcggggcttaaaacctagattacaggttaacaggtgcagcaaatcaccatggcacatgtatacctgcacaaacctgcacattctgcacatgtatcccagaacttaaagtaaaataataataaaataaataaattaaaagaaattgaagaggacacaaaaaatgaaaaatattccatgtgtatggattagaagaaccaatattgttaaaatgtccatactacccaaagcaatctacaaattcagtgaaattcctataaaaataccaatgacattcttcacagaaatagaaaaaagacaatcctaaaatttaaacagaatcacaaaagacccagaatagccaaaactatcctgagtataaagaaaaataactggaggaatcacattacccgacttcaaattatactacagggctattgtaaccaaaaaagcatggtattggcataaaaacagagaaatagaccaatggaacagtacagagaacccagaaacaaatccacacatatacagtaaactcatttttgacaaaggtgccaagaacatacattgaggaaaaggatttcttcaataaaggtgttgggaaaactggatatccatatgcagaagaatgaaacttgacccatctcttgcttcatacaaaaatcaaatgaaaatgaactaaagacttaaatctaagacctgatactatgaaagcatcacaagaaaacattgaaaaaaaccatccaggacattggtccaggccccccaaaaaaaaaaatcttgaataatacccctcaagcacaagcaaccaaagcaaaaatgcacaaatgggaatcacatctagttaaaaagcaacacagcaaaggaaacaatcaaaaaagtgaagagataaaccacaaaatgggagaaatcatttgccagttacctgtctgacaagggattatagccataatatatagggagctcaaacaactctatagaaaaaaaatctaataatcttatttaaaaattggcaaaatatacgaatagacatttctcaaaagaagccatgcacatgacaaacaggcctatggaaacgtgctcaacatcaccgatcatcagagaaatgcaagtcaaaactacaaagagatattatctcactcaagttaaaatggcttttatccaaaagtcaggtaataacgaatgctggtggggatgtggagaaaaggaaactgttgtaaactgctgttgggaatgtaaattagtacaaccactatggagagcagtttggaagttcctttaaaaactaaaaatacagctaccacacgatctagcaatcccactcctgggtatatacctaaaagaaaggaaatcagtatatcaaaggaacatctgcactcccatattgttgcagcactgtttacaatagctaagatttggaagcaacctaagtgtccatcaacacatggatggataaagaaaatgtagtacttatatacaatagaggtcattctggaactggaggtcattatgttaactgaaatctcaagccaggcacagaaagataaacatcacatgttctcacttattttgggatctaaaaatcataacaattgaactcatggatttagggagtaggagaatgattaccaaagcctgagaaaggtagttggggcaggggtgggggtgaggaggagaggtggggatgtttaaagtatgccaaagttgtatagttagagtgaataagaatactgtttgacagcacatcaggggtactagaattaacgatcatttaattgtacatttctaaataacaaaaagagcttaactgtttgtaacacaaaggataaatccttgaagggatgaatactgaattttccatgatgtgattattacacattgcatgcctgtaccaaaatatttcatgtaccttataaatatatacacctactgtgtacccagaaaaactaaaaataaaaaaattaattaaagatctgttataactgtaacattttaaaataagtctcatggtaattagaaagcaaaaacatgatagacacacaaaaaaattaaaaaataaggaatcaaaacataccactagcagaaatcacttagccacaaagcaagacaacgagagaggaagaaaggaaccaaatacctacaaaacaacaagaaaataattcatacaatggcagtgaggagtccttatctaccagttattacttaaatataaatagattaaattatccaaccaaattacgtagattggctgaatgaacttaaatacacacacacacacacacacacacacacacacacacacaccccaaatatatgcagcctacgaaaccccactttaagtaattgtaagaacacacatagactaaaagtgaaggaatggaaaaagatattttatgcatatgaaaatcaaaagaaaggaagaattacacatatatcagataaaatagactttaagtaaaaaaatcataaaaagagataaaggttattatataatgataaggggttcaattcagcaagaacatacaacaattataaatacatattcatctgacatccaagcacctaaacatataacataaatatggatagatctgaatggagagccagactaaaattaataatagtaggagactttatcaccccacttttaacaatggagagattattcagacagaaaatcagcacgggaacattgaactcaaactatactctagatcaaatggacctaaaagacatatacagaatattttctctaacagctgcaggatatacatcttttttaagtgcacatagagcattttccaaaatagatcatgtgtgagggtacagaacaaatcataaaagattttaaaagactaaaatcatatcaagtgtcttttccaacaacaatggaatgaaactagaaatcaataatgggagaaactttggaaaattcacaaataaacatgaaaattaaacaaacgtgttcttgaacaatgagttaattaaaaaattaaaataaaaattaaaatatctgttgagacaaatgaaaatgagagcacaatatacaaaaaccgacagaatactgcaaaattggttttaagaggcaagtttatagcaataaatgtctacatcaaaaaaaaagatctcaaataaataacctaatacacctcaatgaacaagaaaagaagaaaaaactaagcccaaagttaataaaaggacggaaatagaaagattagagtagaaataaataaaatagagtctagagaaacactggaaatgagcagtaaaactaagttgttttttgaaaaaaatatataaaattgacaaacttttagctagactaagtataataaaaacacagaagactcagataaagtcaaacatgaaaaagaagatattataactgatataaatacaaaggatcataggagactattatgaactattatatatggacaaattggataacctagaaggaatggataaattcttacctacatacaacctaccaagactaaaccatgaagaaagagaaaacctgaatagatcaaaaacaaggagattgaatcagtataaagtcttccattaaagaaagcccagaatctgatgcctttagtgtctaattctattatatatttattgaagaattaatgccaattcttctcaaacacttccaaaaaattgaagaggagataatacttccaaattcatttcatgaggacagcatcaccctgataccaaagccaaacaagaacatgatatataaaaaaaagaaaaaaagaaactacagaacaatattcctgatgaacgtagatgcaataatcctcaacataatattagcaatgtaaattcagcagtacattaaaaagtttatttgctatgatcaactggtcttgatcatgtacttattactgtgatcatgacttaaaactatgaaactactagaagaaaacctaggggaaaagattcgcatgtaccctaaaacttaaagtataaaaaaaaaaaggataaaagtaaaaaaataaaaaataaataaataaataaataaataaatattctatcctaaaaaaaaaaaaaaagattcgcaacattggtttgagcaataatttggggatatggccctaaaagcacaggaaaaaaaagcaaaaatagaaaaatgggactgcatcaaactaaaaagcttcagcacagcaaaggaaataatcaaggaagaggcaacctacatgaatgagagaaaatattttcaaactatatatctgttaaggaattaatattcaaaatatataagaaactcaaataactcaacggaaagaaaaccaccaaattaaaaaatgggcagaggatctgaacagacatttctgaagagaagacatacaaatggccaagaagaatatgaaaatattttcaatatcactaatcatcagggaaatgcaagtaaaaaaacaatgagatatcatctcacacttattagaatggctatcatcaaaaagacaaagataataaacgctggcaaggatgtggaaaaaagggagcacttacacactgttgatgggaatataaattaatgcaaccattatgaaaaagagtatatagagcttcttcaaaaaactgaaaatagaactatatcatataattcagtaattcaactattgggtatatagccagagtaaataaagtcagtatgttgaagatatagctgcactcccatgtatgttgcagccttattcaaaatagccaaaatatggaatcaacctaaatgttcatcaatggatgaacggataaagaaaatgtggtatatgtacataacgaaatgctatttagccacaaagaaaaaggaaatactgtcatttgccacaacatggatgaacctgaaagacatttggttaagtgaaataagccagtcacagaaagacaaatatagcatgatcttactcctatgtgaaatctaaaaatttgatctcatagaagtagagagtagaaaggtgtttaccaggagttggggtggttggtgggaggaggagttgtggagatgttgtcaaaggatacaaaattttactcagaataaataatttcaagagacatcatcactcacgagggttgaaaatacaaaaattcaataacatgtctaacttcagttagacttcagctgagcaaaactattagtggccaacgtaacaactggtcccagtcttttaaggaaaggtttcagaacctacaaagagtttaataggctactacagatatcacacactgatctttttgcaatgaagaatgatttttgagttttaccaaatttttaacaacgtgcaagacagagctgggattgacagagaaactaaaaaagagaagagggaagaagaaaatacatagaaaataatttagctaatgagtgttcatagacagttaatataaagaaaatgccgaatgatatacctagacacaaaatatatttacatccaaaatgttctcttcaatataaacatttcccagggccccaatatattcaccttaagaaaacaaaaagcaaacaaacttcctcatcaattcctctaacagatctcacaactgaagtatgatgcgtgcctcggaagctctcaaaactgtcagcatctgctttgctgaggcccatttcatttgatcatttatttgacagaggaatagctccagttttgcagttttccttaaattgctgagatttttccccccaattaaatcacccagtgacagcagcaattttattaggctactttttaaacttggtcagaaggcagaaagataacaagctaaggcgtgcaacaatataaatcatgttaagaaccatcactcagtagctctggatccaaatcaaagctatgaaatacagaatgacattggatgctgaagtgaaaaataccaaccacatttctctgaggttcagacattaatactcagacacattttatataacagtctgctcagtagattagtaaaacagagaccataaagcctggaaatcctcctacccacattaagctaattgagttggagacatccaattcatcatatttgcaggctgatttataagcaactcaccctgccctggagcagaaagtgaaatgttatgagttagctactcttaaaatttcaaacccagcaattctgaacctgtcaataccttaacggtacagagacaagaagaagaattcagttcaggtgcatttctgtgaccctgatgaaaaaataaatacccagtgcacattttatgactgatatttctatgaagagtctagccacatattggaaactccctgtgatagaattctatggaaagtgtatcatcattttagcaagttgatggggcaatttgaaatcagttctttgctagaatgcaacttccatcaagcataaagaaaacagccttatgacagttaaaacccaaattcaaagagacaagatattattgctcttggcttgaatagatggtgaaagcttatggcactaactaataaacagaaaactgccttgtaagaatacatcaaaaatactgaggagaatggaatcagaagcagttctgcatttagagaaccctcctgaagcaaatgtaccctaaaatccttctcatctaggggaacctgttgatctttcctgctgagggctgctgtggaattgggcaggcctcacagacacaatagattgggaggcctcctcctattttttccaaaatttacaaaagatttattctcaaggacaagcattccttaaccagccagtaactgtgggacagaaaaataggaatcatagtttctcagaaatgaaagaaaacttgaaattcattccatccagaaattcctaaccttaagtctatgttccataggaagtccatagatgcccttcaagtaattcatatcatttctgaagttttatgcaatatttttgtgggtatagttttgtgggtatagtttttatctagggaaaggggtcatagtttttcaaatcaatttctcaaagtaatttatgtgtggaaaaaggttgaaaatactattcaacattctctttcctgaatcatctctacaatatctcattgaagattttctaccttttgcttgaatacctccaatgacaggaagctcactaccttatgaggcaggtcattctctctttggaccaagttatttaaaacaaaaattttttaacttacataaactctgtttttctttcattgtttactctaaaggtcttgatgtctacaaaaattgtatggacaagttctttgttttaaacaatttaaagatgaactaccatgtcattgtgagctgagtctattctccaaggaccacatcactcatagcctttgatgttcccatttgacatggttttaatagccttgccagcctatttacccctctctggaagcaccccaatctgctgccattctctctgaaatatggtcctcagatcctaatgatacattctagcatagtgtagaattgtcatctctttgttcttggcatgcaactccattaatgtagcctaaaattacattggttgtttggaagtcccacatactgacaactccttgaactaaatgtgtgctgacattcccctctgcgcccccacccaccacccaaccctcactgcccagctcctttttctttatcatgtgtttctcttacttttccattgaccattctagaaagtgggaatgagaaaaagagggtggaatggaaaatagggactagggaaatagaagttgaggtggaggtagccacacaggaatttgagtgtggaagaaggggttctttaagcgtagatggtaaaattcaagccaacaaaggataacctccttaatcttaattacttcccacaatgtgcttctattatcatcagtatataaatgtggaaattaggtttaggagcattcagtgaattctcaaatggcacatttctgatgccatgcctagctcttatcccacacactgccctgcagctctgggaaagcatcccatagagaaataatagcattgctacgatgtacattagtctttgagatgtaaatcatttacattttctttttacaaaactatctcatcagaatttacacaagtacacaaatggacagaagagttaaataatgatgagacttatttttactgaatcaatctgatgcacacagtttagttggagagatttgggatgaagagagaggttggtctagcgtcaacaacctagatttggccctttactaaagctgaaaattggcataaacaaataataactcagtgataacaattttcaataacatcccctagaaattgaaataagtgaacctctgtgatctgctgagttgagaacacctgttgtttacttttcttgggaaacagagacataaactcaggtctaggaatccaagacccggattcctgtctcagctatagtgttagctaggtggctgccttgggaaagtctcataacagctgtgattcttagttgctttatttgtaaaattaagtaattacaatatgttattcctaatgcctctgctgagatgtaagtctagtgattctatgaggcttcctattggatattgcgttatctgattatttaaggaatttattgctgaacttaaaagcctcttgcctgggtctgtgcagcgcattatctaaactaaagcaaggtatcatcttgtatgagaaggggctccattttctaattcatataaatatgttgaatgagtagcggcagctcagctttaattgtttataagagaagtaaaacctacttttggaaatgatatttcaaatagttttaaattgcttgtttataattaaaagcaggtaatatgtcttatagtccactgagaaaataaactaccatcagaaacaagtttttaaattaaatttctttgggctgggcatggtggctcaagcctgcaatcccagcactttgggaggccaaggtgggcagatcacctgaggtcaggagttcaagaccagcctggccaacatgatgaaaccccgtctctagtctctactaaaaatacaaaaatgagttgggcgtggtggcacatgcctgtagtcccagctacttgggaagctgaagcaggcgaatcacttgaatccaggaggcagagactgcagtgagcagagatcatgccactgcactccagcctgggcgacagagcgagactctgtctcaaaaacgaacaaacaaaaaaaaaaaaagaaaagaaaagaaaaaatttattcacatgtaatatgaagcagtgaaactagaaaatctctaaagcaccagtcctgaaaccagaaaatctctggaacaccagtctagagtaacttcaattactgtaatttcaagttaactttgtctcattacttctgtatgtgccctattgcttaatgggccttaaggtcaaggtgggaggtggggagttgttctgttctatgtaaaggaacttcagtaactgtctcttgaatgcattttaaatgaacttacctgtgacccaaaattggccacaaactctaacatactcagtgttctgccaattcagaaggaacaaatcatctgccttcagagtgactttggtgagtcagctggactggaagaatgtatcctgggagctgcattaggattaaatctgattgctagacactggcaattcctctctgagttggagaaaatcaattcaaccttctctaccatgttttcttgtacaacattctgtcttatataagattacataagtttcctttgtatataccaatagacgcatttaaaaattgccttctggactatttttatacttattaaacaagatgaaataagtgttttgctgtatagcttctgtccactaaatgatccttgcacatcctgattatctttaaaggttatgcatatgttccaatatcttccatcactagcctcaaaagaaagccatttctttatgctttagtaaattcttgtttggaccactcaaaatgtccccaactcatttgctacaatttgagctaaccaacatgacattcacttttgcagaagagataataatttgaataacacacccttacttagctgagataggaatgttctacagtgtaaaactattctctgaaggacatcaaggatgaggatttaacaatttccaatcattactgagagctcaaagagttaactaatcttaaatttagatttgttcttagatacatacacactttctatttttttaatgtgaaataattaccatttactgagcaactactaggcgccaagtactacagactttccacgtattatctcaagtaatctttacagcatggaatgtgaattccatactattatttccaagaggttagaagttaatagatttactaatagacacagctagaaagcaactaagctacattgtaaacacaagtaagtctgattctaaagcccatctgctttccactatatgctattacttttctggattagctgggaaagagttaaaaattcaacagcactaacagtctcagaattaatttttgcagagtttggaaaaatttccgattatctttgctaagaaaaaagaattgaaaacatgctcaccaaaaggttacaattccagactgtttagaaatatgggagggatgtagaagttacgtatcattttagggtaccactaacaatatcatctttaaccacagtaacaataagtgccttatattgatgagcagcctctgtgagtgttagtacattatttctaattgttacagaaagttttggcaatagtgaaatcttagttttgagaaaaatttctgtgtaactgggttaactctagaaatatctgcagctacatataatcactattaacacttatctagaattttctataaacacttatttttaaaacttattatgattttaataacctaatatttcttagaaaaaattcatcatcattattgttattaatactatgtacataaaagaagtagaaaatttgaatttcatcacacaaactcatctttcaaaacccatagagagaaccccttccatgggtgtccagtcttttggcttccttgggccacattggaagaagaagaattgtcttgggccacacataaaatacactaactctaatgatagctgaggagcttaaaaaaaaactgcaaaaaatatcataatgctttaagaaagtttacgaatctgtgctgggtccattcaaagctgtcctgagtcacaggtggcccatcactgcaggttagacaagcttgccttaacccttgatgactttggttctaaaaagaattcttatattttgagatgctggttcagtcctatgcctaacattcctttcttcccgcttttcaatatctggcctaaatagccagaattattgggggtatgctgtttgtaccctttccagttaaagataattgaggaaaggaatgctttatttgcatggaatttcgatcaggagattttgtgcctacattcagaatgcgtctgtcaaggccatatttcaaccatttcctctcaccagggactagtcctggaacacaatgtgctgtgcacaagtcacaaatctctgccaaacctttatgtttttattaactaagagcttctaatttagcttcacaaatctgtttcttcctcaagactagatgcttccaggatgatcatctcagctacttccaccatctagtggcaagagatagaaatgaaaggattttacacttttaaagattattgcctaaaatatcaagaatcagaatagttttctaatcagtggtattattaaaaacattatgtctagaaaggaaaaataaacacattattttcagttgctggtcagggcctcatgactgttggggtcaaatgtaactcatagggtatttcttttttttttttttttaaattaatcaaatacgtattttaaaacatctgctatttggtcaacaccatcttaggcattgtagaggaactacaaatttctgtatttaaaagacatgactcccttttagtagaagttcataacttagttatgaaaatagaagctccaagctactaagggctaaatgttgtggtaaatttctcactgcttcatgttatcctcggtaggtacctctctctccccaaagcccatatatggtggtggtggacctgtgtttcagtcctctgtgttcttctcccctctcctgagcaatcccatccattttcacaactccaactacactgaaaacgtcaaagtttccattttctagatcagatctttatttcaaactgactgttaaacacttctacctgggtataacataaatacttcaaaatcagttactccaacataaactcagaaattatcccactccctcccctgccattctaaaatctgctcttcctctggcattcttggtttcatttcatgatacatcctctactctggggtcaaattttaaaaattgtaaattatcttctatttctctctcttttctaccttctatatgtaatatgtctcaatgtcctgatgatatctctttttaaataagccttctaatctatccttcccttcaaccccaatacctctgctttacatcaaagcttatctatcttttacatttcacctgatgctcttgaatctgatgtcatacctttccaattattccttccactgtaccacatgacatgaataacggtctaatttgcatatcaggtcatgtcattctcctttttaaaaattctgtagtcacccctcattacctacaaggtgaagtccagtctctacataaggtccttcattacctgttcatgcccatctctcttgctttatgggatgtttgggcccactctatgcccctttccttaattcttacattatgcgtcagtatcctagccaactacttggcaattctcagaacttttccatactgttacacaactgctagagtatagggcaaccttgacttttctcccttatttcatacttccttcaagtaaaaaatgatctcgtgtataattttttttctctgacaacacccatcctaacctctccagctccaaaaaattaaacagtttttctacgtcttgagagacctcttctttcacactttctttattgtacgctccaaaagtatatgtgcccaaccaaaatataattttatattaaagaaataattctatgacaaaatatgtctgggaaatactttgtactaatcatatttccatcttagatgtttatatttcatattattatagtaaaggctctgagaaatccttcaataagttaatggatttaactcctcaaatgtgtttaagcactcattcatacctttattttaataatgctgacaaaattccaccaaacatactttgggagatgctagtctagtttcattttagattccaataagggagtaaaatgaaaagcaaaacaaaacaaaaataagatgcagtccaggtcttgggagcttacacatttactaagagcaagaaaaacagcaaacctagaggaaagaacattatatagcagtccttcctgatcttaggttgcacttttcatgcagtttcagctaccagaggtcaactatgacctgaaaacaggtgagtacactacaagatattttgagagacagagagagagcacattcacataacttttattaaagtatattgttataattatattttattagttattgtggttaatcccttactgagcctaatttataaatttaattatgtgataacatacttatgaaaacataagaaaaaacatagtataaataggatttggtactatctgcagtttcatgcatccactgggggtgtttttttttttttttttttttgagacggagtcttgctctgtcgcccaggctggagtgcagtggcgcaatctcggctcactgcaagctccgcctcccgggttcacgccattctcctgcctcagcctcccgagtagctgggactacaggcatccgccaccacgcccggctaattttttgtatttttagtagagacggggtttcaccgttttagccgggatgatctcgatctcctgacctcatgatccacccgcctcggcctcccaaagtgctgggattacaggcgtgagccaccgctcccggccccactgggggtcttaaaatgcatcccccacagataagtggggactactgtatagttcaacaaataatttttagaacaatagaataaggcatattttaaaatgatgactatgtgggatgcactaactccttgtgccataggatcttatgaccagtcggggttggccaagagttaacaggaaaggctttatgtaggaagagggtttttattgtacttttggctaaaacatactttcctatgattgtgctctggcaactctagtaagaaaatagtataaaaatacacattgttatcctttgtctatagtttttttattggcttcttcatgcttcagctctcctcctataatttctcaaatgtgcattgcctacagattctcaaatgtcttctatatatactcaacaagtgcccagttgtctcagggtattgaagtttacccaaacctcacatactcctaatttccagcaaagcttcccagaactgtttattccagtccctgtgaaaattcgaagacacacaataatatttatctgattaaagtaattcacaccaatttataaaaggaggctttaatcttccttgtaattagttactgaacctaagaatctaagccggttttgactgcaagacacatttcttttttaatacaccctaggaaatactgccaattttaactgcaagatgccattgatcttaagacacatccagatttcagatatgttaatatgtgataaaatatgaagtttagaatttatgaaattttgtataagtgatgattaggtaaggaagaagaggacagcagttaactccctccctttctctctctctctctctctctctctctctctctctctctctcgctaataaatactcctacagggcactctggtaggtgcttgggccccatagttttaagtttgaggagttcaaatttcagtttcggaataataataagtaacaaataattaattatgaatcaagagaataatctaggtactgaaaatcatttcactgctctttgtttccccattacttagtgctatagtaggcactcagttaatatttattgaactgacctaaagtgagaagacctaaactgaaaagaaaattcttgtggtttattataggccaatttcttttatgaaagattctaggtagcatctgaagagaatgcatccccaccttgaggaaaggaaaacaaattcccttgaattcaccactaaattgcatttctctttccaatcccacacttcacactggccaaagcactctaatgaaaacaggctaagaaagcccatcctatcacttaggcagctggtgtgcaccaaagacagatgaatcttagaaccaaggcttcaagtaatacacgacgatggagaaaatgatactcaaacctgtgacagtgagattattcagctaatgattcagagcccactcaatgtgacatttaaactgttatccagcaatctcacactctgtttaggcatgccatatgtaaattctccattaatactagagtcacattgttttctcagtaggattctgggggaagcatctgattatgtgttttgcctccttttcttccttttagtgtttgacccaagaataccagacagataaaagaaggcaaagaagttgaaaatatgacagttctaatggagaccttgtacctttttagcagttccctgattctaacaggcttcctttatgagaaaataacccattagattttaatcattgcaagtttttcaacagttgaactgtgataataacaacttgattaggaaatgtatcctattgctataaaaatgctagtgcttgaatctgatatcacagtactgtgctggagctcactcgtactagctcatgagagcctcatgtgcctccatttccacatatttaaaaagtagctttaggttggtagcctgaaatcagccaggctgggaatatttacatcacaaaattggccaaccttaaaacggactttttttttcccctagaaaaatggtacacatttattcctattactattggtgttgaaggagagatacacagagtgtctttactaagacaatctaaaagcatatcttgagctataaaatcccagatcatactgaatggacaaaagttggaagcattccccttgaaaaccagaacaagacaaggatgccctctatcaccattccttttcaacacagtcctggaaatcctagacaaagcaatcaggcaagagaaagaggtaaaaggcatccaaataggaagagaagggatcaaactattcctgcttgcagatgatatgatgctatacctagaaaaccccttagtctctacccaaaagctccatgatctgataaacaacttcagcaaagtttcaggatacaaaaccagtgtccaaaagcagaagtattcctatctaccaacaacatccaagctgagagcaaaatcgagaactcaatctcatttacaatagccacaaaaagaataaaatacctatgaatacagctaaccatggaggtaaaagatctctacaacacggatgacaaaaaaattgctcaaggaaatccaagatgattcaaacaaattgaaaacattctgtgctcatggataggaagaatcaacattgttaaaatggccatactccctaaagcaatttacacagtcagtgctattcctatcaaactgccaatgacattcttcaaagaattagagaagaacaattaaaattcacatagaaccaaaacagagcccaaagagccaaggcaatcctaagcaaaaatatcaaagctgtgagtatcacattcttggacttcaaactgtactacagggctatagtaaccaaaacagcctaatactggtagaaaaacagacacaaagaccaagggaacagaacagagagcccagcaataatgctgcacaccgacgattatctgatcttcaataaagtggaaaaaaaccggcaatggggaaaggactccctagtcaataaatggtgctgggacaactggctagtcacatacagaagattgaaactgaaccccttccttataccacgtacaaaaaaatcaactcaagatggattaaagacttaaatacaaaacctaaaactataaacacccagaaagataacttaggaaatactattctggaaagaacctggtaaagatttcatgatgaagatgtcaaacacaattctgacaaaaacaaaatttgacaaacgggacctaattaaacttaagagcttctacacaacaaaagaaactatcaacagagtaaatagacaacctacagaattggagaaaatttttgcaaactatgcatccaataagggtctaatattcagaatccattaacaagccaaaaaacaatcctttaaaaaaagtgggaaaaggacatgagcagacacttttcaaaagaagatatatatgcagccaagaagcatatgaaaaaatgttcaacatcactaatcatttgagtaatgcaaatcaaaaccacaaagagataccgtcttacaccagttagaatggcttttataaaacgtcaaaaaataacagatgttggtgaggttgcagtgaaaagggaatgcttatacagtgctggtaggaataccattatttcagctattgtggaaagcagtttgacaatttctcaaataacttaaaacagaactgtcattcgaccaagcaatctcattattggacatatactcaaaggaatataaattgttctgccgttaagacacacgcaaaggtatgttccttgcagcactattcacaatagcaaaggcaaggaatcaacctaaatgcccatcaacagtagctgggttcaggaaaatgtggtacatatacactacaaaatactgcacagccataaaaacttcgggaggccaaggcgggaggatcacgaggtcaggagatctgtagtcccagctactcaggaggctgaggcaggagaatcacttgaacctgggaggtagaggttgcagggagccaagattgtgccactgcactccagcctgggtgacagagggaaacttcgtttcaaaaaagaaaagaaaaaaaagaaagtaaaggataaagaatgagatcatattctttgcagtaacatagatggagccgaaggccattatcctaagcatactaacacaggaacagaaaaccaaatactgcatattctcacttacaggtgggacctaaacaatgagtacatatggatacaaacaagggaacaacagacactgagacctacttgaaaatgatgggtggaaggagggtgaggattgaaaaactacctatttgatactatgcttattacctagtgatgaaataatctgcacaccaaacctccatgatatgcagtttacctatataacaaacctgcacatgtaccactgtacctataatacaagtttaagataaataaataaataaataaaaactcaaacacatcttgtttagcataaacaacacctcgagaaggtcatgatgaaaaaaatcctggtcccaaaatagctacctcacagccccagtgtagaaatccttgatgagcttccctttccctcctcttcacaataccttggggccataccacagaactggtggttccaaaaaggagaaaaatctattaggaccatggtgttttatcccaggggcctgctattcatagttggctgttcttaaaactgacatgaggtgccctcaataaaaggctaggaaattagttagaagtgacataaatataacagaaaatctaggctaagagaaacccattgaagttgaatacagttaattttaagattcctggaaggcaaaggataaaggaaaaataggaaaaattcctttgtttatatgagatctgagctttagaaaaagcatactttcccctcaactctgatatacattttccaaatgagacagtgagtagcataataaatgatggtgcaatcaccaaaacagcagatgttcagataattatattatcatgtatatgctgaagacttaatatacaaaacaaagctcccatggtgctttcattgttctgttcattttttttttttttttttttttttactgtaaccgggctagcatccctcataattataatagcactaattataaaatttggactctccctattccatttttgaatcccagaagtaacacaaggaatctcactactttcaggcatgatcctactcataagacaaaagatgcacttatttcaaatatttcatctatcattattagttgacttaaatataatactaataatcaccatattatcaattctagtagaaggatataaaatgctagccttgattatcctacctacttagcctaaagttctttgggaggtatgctctagaggtgattaaggaggaaaggttgggaagggagaaaggtggcgaattttgtgtatctgtgtgttgggggttgtggcatggacagggtctcactttgttgcccaggctgtagtgcagtggcgtgatcatggcttactccagcctcaacttcctgggctcaaatgatcctctcacctcagactcctccatacctgcaactacacttgcatgccacctcgcttggctaatttgttaaattttttgcagagacaaggtcttgccttgttacccaggctggtcttgaagtcctgggatcagcggtcctcccacctcagcttcccaaaatgctgagactacaggtgcgggccactgtgcttgatctatggaggttcttatagggagtttttcaaccagtttgaaagaataaaactgaaatgtaagtaccttcaatgcagttcagtctctcggccctgccctttctcaattttcagtggtttgtaaacagagtaaggatcagcaattgttagaaaatattaaagagtactgtctaactctaggaatcagcaagattctatactgaacacagaattctgattcctaaacaggaccttaaagacaattttgtttacccttctgcggaagaaggagtcttttctacaaaacctctgacgagtcattatccattgctgaaagatttctagggatagggaacttctgtctcatgaagtagtctataatttttctgagtagctataaatgtcaggagctgtggtgttaaaatgttcccaaatataatatacattcctgtcagttatgcacagtggatctgcttctgccttccgcatgacatcgatgtcgtgtttttcagatgacagctctggaggtaaaaaaggtttagtcccatgtcccccaattcttaatcttttcttctccaggttaaacatactcatttccaccagtcatccaaatacttgcaaagaaattgcggagatttgcacaatgaatcccagaagcataatattaatatttacatatttttagttactatataatatttactggaatttgataattggtctaatatttttatgtattggtagtagctatagctaatttatttgctaatacatttttagcataccaatatgtttgaaatgttccaaaatttgaaacgtaaggttaagcataagttaacctctcttagatgtttttgcaggtataataagatccagagaacacgggagacacttttatgtctttattttttattgtagcacagctgtgtagaagtgctggcaaaatgaatgttctcggtgatgaaagaaatttttgtttagcaataattactaaggagttaattggtaggtgcttttattttttccatttcaattctgttatttcagccatattctgattttttctttttaaactttaatcaacctttataagctttttatcccaaacacaaaatccagtagcgccagttcagccaaaaaaaaaaaaaaaaaaaaaaaaaaaaaaaatcagagtaatttgcacagccaaggggcatagaaaagtatttttctcatttaattataccttcttcttgtcgaaatataatttatcaagcaattgtttaaaattaaattttaaaaagtagaaagtgttgggaaaagtatgacaatgaattgaaataaatctagtaaacaattttctctaggataaaatagaggaattgattagacaattcacacattttcctttatagtttagacagtaaagcaatcattagatgtgatcatgttatatttgttccctttgttggaccacgagtactgacaaacagagagcatctgagcaaaaccttgatgtacttggggtttaaaaatatgtggttagcttattttccctttcagtgtttcactcttggcgctttctttactccattctcagcaactaaaatgatttttccagatattcaaacaattgcaataaaaatatgtcccaaaaatacaaggtgggcctccaatgcacaagaaagaccctttggcaacccgtgtcctctatcatgttttaaaagagcctcatttaatcgggccagcaaacatctccattagcaattaagaccaactactgtcaccaactataaagtcggaagagcaatataactgaccttcagaggagaaatatgagactgcaagacatatccatggacattttctatttgagagaggttcttttctgatacatgcacgagttctgggcctcttacttcgtgggttagtcgaggtaaggaatgatcatgtggagcgtcctcatcttgatatcgatacttctaggagaaaagaaaagaaaggacaagtatgtatatatcagtgtttgtaaaggatatagactgaacttcatattctaacttcatcaataggacacagtgtgcacctactgttgacttcaccaaatgggctttgctgcagactcttctggcggtcaccatagaccaggtcaaatgcaagcagaactgagttaaccacgaatattgaccaatgtccagacttgtttctgcctgataatatactctctttgtttatgagctacagaaaggtgataacaaatgagacagaacatttactttattcaagtaagtgaggaggtaaccctcctgaccagagtagctaagtatgtgttaaaaattctaggttatggatggagaagaaaaaaagtactgagcaagaagaaaacagaattccaatatatcccatttagaaaacttaattttccttcagaatttgtgagtgatttaagttccttttgaaatgaggaaaaaattttgtcacccacattatttgtattagactcaaagagaagacaagcttatctttctttacttcacccgctaggagaaggagtattgatttgggttagtcagattccaggacaaaagatcacaatttttagaagcagagctagctcttttaaagaactttaaaaatcaaggcaagttatctgcctatattgtatggctccctgaggggacagaggtaaatacttcttctctcttgttcccttttcctcttttcttaaccatcttgcttacacatgactgtaccagtaaagattattgtttgagtcttccaaacagatataaggaagttggcagagaaaaaaaaaggttcagggttaggaatgctctgagggaactcagccctcttcttggggtctatctccatttttggcctcagcctgggtctccatcctatttctgtgtctttttctagtttgtaccccttttcccttggatctgtccctttagagttccattgttcaaggctgttgtcctacctgggaaagaagaaagggaaccctctacatctgacctcttaatcagataataaagtgttagtttgctttactttgcctatgttccttgtgcataacacagggatattgggaacagggatctaaacattgtcataacaccatcacaggcttaattgtgatgtctaacttcttcccagtgtcccattattgttatcatcaatggttaattttttcatatacatatatatataaaacttctaggacatcagctctcagactgactcatagtggaaaagtaacaagaaccactccagggatggtaattcaatctgttgttcactcttcctcagaagcagattatcaatacttacacttatactttctggggcaaggtaggctttcttcaatgtcccaagtaatatctctctcaacaaaaataacaatgccataactgcagtttccaaagaactctcacaaacttgttccattgcaatcattcttggccattttacctatgagaaaactaacactccaagaagttaaggtacttgtcaagagtcaccttaactgacgggcataagcgccaagaccctatccagatcattgcagtctgaatcctctttcagttatcatcagcctctcctctaccccataaagagatgaagtccaagtctgaaaactgaattggctgcttagtagaaaaaaaaaaatcactgagaatacacgacacaatgaggttagaacatttctgtgaactgcaaataccatgcttttgtttatctaaccttatgaataatttgggaatgtaatctgcctcagaaacatggatcaaatttaacattcacttttgatcagttacgcccattatgagtggaatagtgtcacacttgcgcccattttagtttctctggctttcaacccattaactcccacgtctgctccacatttttgattctctcataaaggcactaccatctatgttgtcatctgagccagaaaagtaggagtcaatcagactccatcctgtcttttgcctgctgccatctgccaatttaataagttgatgagtctgcttgatttatatcctaaataatacttgagtccacactctccttattcttcccatacccccaccaacactgtccatgttcaggatcccataagttctcagctgggctatagaaacagcctctgagctggctagcctgtctgtggggttgcccgtttcccataaattctctacactgatccaggggactttgtgaatcacatgctgataaagtcctccttgaaaacttccaatggctcacactgcccacaggacagaatacaagctttcttacactgccataaccctactactatatatgctgaacccccattacttctgaattacttttttttttatgagacggactccagctcttgtcaccccaggctggagtgcagtggcacgatctcagctcactgcaacctctgcttcccgagttcgagcaattctcctgcctcagcctcccgagtagctgggactacaggcgggcaccaccacgcctggctattttttttatttttagtagagccggggtttcaccatcttagccaggctggtctcgaactcttaccgcaggtgatccgtccacctcagcctcccaaagtgctaggattacaggcgtgagccaccgcacccagccctgaattacttttgttctcaacattctcactccaataattataaaataaatataaacaaactattgagtctcatttttaagcttcttttaaaatttgtggtaaaatacacataaaattttgaccattttaaccatttttaagtatacggttcagtagtgttacttatattcactttgttgtgcaacagatctccagaacttcttcatgtgcatgttcccataactccctagagtctccaattacaactcttgtcatgctatatggttgtgtattttctgtgtttttccacggaactgtaaaatcttgtaaggactgggaccacattggtattgtttattctcacatctccagtctttagtcatatgcacaacacatatgctcaataagtgtttgttgaatatagccatgagctaccattacacaaatggatgaaatagatatcacttgcttaagccacaatactattttggctactggatgaaaactttttcactataaaatgctgtgaactcaggttcaagtaaaaaggacaatcacatcatttgcttgacacaatctaaaaggacatcaggctattaagtactacatatctttctcctcatcattcatttcagtatatgctaagaatatgaactgaaaagaacaacccttgacttcaagaagaccataaattactgagttatacttgtgcacagataagctaccatacctcgtgataaactcagttctgtgggagcagaaatgggcaagcatttgtggctggctggctgcagcttctcagtttgaaacagggtctggaataccataaagaggtaaaagatattccagccaaaggcacaacatgtgaagagacatgtggtaagaggggatgatgtttgagggaacagtgaggtcttaaagtggattgtagcagatgctattgtgtccccatccaaattcatggaaatcttttttacccattgaaggctcatatctgcatacttttcaggaacattacccttaggtgattgaagcctcctctcttggatgtccacaggagtcatatttgaaccccaactctcatacctcacggtgagacaaatcccgtgatgtgaattacactacaaagtatccagcgagattagcttaaatttagactgtacctgaacctatatttctgcacagttcctttgtgcttcccttactccctatgttttttttttttcttggaactgccctccataaatcatgcacacatgaaatctcatcttaggtctgcttctagtgagctgatgtaagacttggatgaagcttgggatgtaaggtacagtgtggcaggaggagactggaaggcagattggtgtccactgtagacaatagggagtcatccaagagaccgtggacctaaataatactctgcccagtgccaaccagacattcccgtgtttttttttctttgagtcttcagcctatgactaagcaagaaatgacaagaactgatgagaaagtcacatctttaactcaaactcaagcttccaaaggaatcaccctgatatgatatagcagaatttctctgcttgtattcaaatctttatttcctttggctgaacaaaggtactgatttataacactaggattaatattaacaccaacattaatgctaatcctaacactaatgcaatattacaaccaataataataccagctacagttaatgtacctggagccatattaaatgctttatatccatcatcaccatatgagacataggtgttattctctttatcttagactcagataattaggtatttttctaagcttacatacctggaaagtggcaaaccaggtttcaaatacatgttaatttcactctagagaaagagcacttagtcttctaagttagttaggactcaaaggtctttagaggacaactttatcttcaggaaataaaatttttaggaaatattcttacaccctgactaagaatcaaccctaacattctgggtaattctgagtcaaacttttcattccaaggcttgtctggtaggtactaatgtcattctgggcacctttgaggatttctctattgcctacaaaatgagggccattggcagaaggcctctgtattgcagtctgtgctttcttctttttctctcctcagcttggtctgttgaaggggacttgagtaaaagaaactttgtaattctgtgaggaaagtcatcggtagcttgatggggatggcactgaatctataaattaccttgggcagtatggccattttcacgatattgattcttcctaaccatgagcatggaaggtacgttaaagttcatttggaaccaaagaggagcccacattgccaagacaatcctaagccaaaagaacaaagctggaggcatcatgctacctaacttcaaactatactacaaggctacagtaaccaaaacagcatggtaggtatagaccaatggaacagaacagagccctcagaaataataccacacatctacaaccatctgatctttgacaaatctgacaaaaacaagaaatggggaaaggatgccctatttaataaatggtgctgggaaaactggctagccatatatagaaagctgaaacgggaatccttccttacatcttataccaaaattaattcaagatggattaaagacttaaatgttagacctaaaaccataaaaaccctagaagaaaacttaggcaataccactcaggacataggcatgggcaagaacttcatgtctaaaacaccataagcaatggcaacaaaagccaaaattgacaaatgggatctaattaaactaaacagctcctgcacagcaaaagaaactaccatcagagtgaacaggcaacctacagaatgggagaaaatttttacaatctacccatctgacaaagggctaatatccagaatccacaaagaacttaaacaaatttacaagaaaaaaaaaaaaaaaccccatcaaaaagtgggcaaaggatatgaacagacacttctcaaaagaagacatttatgcagccaacagacacatgaaaaaatgctcatcatcactggccatcagagaaatgcaaatcagaaccacaatgagataccatctcactcagttagaatggcgatcattaaaagtcaggaaacaacaggtgctggagacgatgtggagaaataggaacacttttacactgttggtgggaccgtaaactacttccaccattgtggaagtcagtgtggcgattcctcaaggatctagaactagaaataccatttgacccagccatcccattactgggtacatacccaaaggattataaatcatgctgctataaagacacatgcacacgtatgtttattgaggcactattcacaataccaaagacttggaaccaacccaaacatccatcaatgatagactggattaagaaaatgtggcacatatacaccatggaatactatgcagccataaaaaaggatgagttcatgtactttgtagggacatggatgaagctggaaaccatcattctgagcaaactatcacaaggacagaaaaccaaacactgcatgttctcactcataggtgggaattgaacaatgagaacacttggacacagggtggggaacatcacacaccgggacctgtcatgtggtggagggagaggggagggatagcattaggagatatacctaatgtaaatgacgagttaatgggtgtagcacaccaacatggcacatgtatacatatgtaacaaacctgcatgttgtgcacatgtaccctagaacttgaagtattataataataataataataataataataaagaaactttgtaaacagattatatttcctgtttcagctctaaggggagtagaggcaggataggtgctcaagacagggatgcctggtatactacttatgtctccctatcttagttcattttgcccctgacttctggaattctatccccgtccccgttctgaagcttaaccctgcccccaaccccagattccttcatcaagcaaacttttttaggtccttgattatcagatttagtgttgcctcctcagaagcattctctgacttcaaaggttggaaatctgtatctcttttatgctcccatagtgttctgcacaggattttgtcaatgaataagaactttatactgtaatgacctctccatgtgcctatctcccctagtagcccacaaatgcctcaagagcagaggtagagtcatgttcatctctgaatctccaatgcccaaccgacaaatgacacataaaaagagatcagtaaatgtaagtttaactgaattaaactgtaattatctgagcaataacatgatccgcataatcagaaagccctcccagctgagcttgcacgcagttatactcatactcattttctaccacagtcccccctacacagacagaaaaaggctaaggaagtctgaccaggctctgctcagtacattctgctgatgcttgtgtgagtcagaacaaaccatcctgagtttcccagaatttaaaaacggaatcttacatgtgcctgatctgtcactggaggttctctggtgcaatttggaagatggcattttgctggcacagtgcatgataactgatccagaaattggaaatatttcaaggtttcataaacaaaaatctgagtttacctctgttgcttcataaaaagtgctctacttcccccttgtagcaggagttggcacagtactgatgagagagagagagagagagagagaaagagagagagggggaaggaacaaatcaaaagctggagagctagaacatgtttgtgtgcacatgaataggtggcatattatcatacctaatagtgaatactatccatgaacgctttgctaagaatgtcacagaaattatcccacttaaggctgatagtagcattatgaagcaggtataaaattaagtaataattacagttccttacacaaagcctgacattaaaaaacttgttagtttcactgtctctgttaactatactgacaaaccatgttctctgtgtcaagttttatctgtccctctgtaatccaagttctttgagggtaagaaccctgacatgtatctttgtatcctgcagagtggtcaggctagaatgctacatacatagtgtgtgtccaataggcctgtgttgactgattgagtgctgcttctggaagaaagcctcttaatttaaaaaatgtgcttgggctgaaaggaagcacatattctagaagcaagaagttggtaaaaacaaaataataataataacagaatttcaaagggatccctaaggaagaggtaagtgaatctcagaaaaaaacagaaaaccaaaaggacaaagaaaacgagctcaatgatgaaccacgtgaaaacaaaaaatttccatttcatctcaaggctgtagaaatttaagttccataattgagtattcccatctaggccctgccagccaccttcttattttgagaacaatgatttgtttaaacactttgacatttacttttagggatttctgcagtctgtacccagcaaatccttttctccagcttcttcctttttccatgatgcctcagcctatctatgacctgtgtctcatcacttttatatacctactgcatcctcactcctactcactgccttcctctctggagggaaaacatgggtaaaaaagaaaacaagagaagataaaggaatgttcagtgcaatgatcagatcaatatttatattcatttctttaatttgaaatgaattctctgaatgatatcctgactggagcacagttttatttctgttattccaatccattctttcagaatggttacatataggttgcaaatctgggggtggaggtaggtagtttcagataggagaaaaatgggaggaggaaaggcaagagagactacataattttccccttcacttcctcaaggtgacctcctgacttcccagattaggaagttctctccctgcctctgcacaccgcacactgctccctgcttcataggctttcagggcaccctgtccttattcttcataaaccttggcacatttttattttacatttatttctgtgatgattcgctggatgtttgtctcctccactgaactaaccgtccccgcccctctccccatggggtcaagggccccacctgcttggtttactgctgacctctagtgcctgccacataggagttacttgataaatgtttgttgaataagtaagtactttgcagccagatctatcttcaaaataatcaccctttaaaaaaacaatgacccacaattagcaatatggcttgcccaaagaacccttgaaagaggaatttttccagtttggagaagaatgtaagtaacagcactgatgggagaaataaaaagctctcccaggtgctccatttgaattttttttaaacaaaactcaaaagtgaaaggaaatactttcctgctttttttccacaaagaacaggacaagccaggatgttaattaaattacaaatcagctgtctgcttgcagctgacagagctttgtgtgcttccaagcaacgtcagatattttaaactctatgtaattacctactatggactagctgccaggaaggatgcttcatgaatatttaatgaattctaagatcctttttaaggaactgatgatttaaataactatgggagaacttactctagctcagtgccaccctccatctgttaactgaagatattggaaatgtagcctggtagaaatgccatttctcccctaaaatgagctaggctcaggatctagggaaggctagactcacacaggagaggtaactgtaattctaaagttaactgtttaattctaaacagacctcaagctctctaagtcagaatggaaccacagacctatgaactgggaaaataacgagtatggaattgcaaaatgaaattttgtaagatgccacacattgaggatgctctttataatttacaaagcactttcagcaacactgtcttgagtaattctctcaagaattggatagattaaacaggtatcatcattctcatttccaaatgagaaaacagagggtcagagagtttctaaagtgctaaataaatagtaaagctgtgtttcaaaccaaaatagtcctctgattccaagaggcagcctcacatagtggaaagtgcatgaattctggcattagacacatgatctcaaatcttggttatactacttgctatctgggagacatctatcacattgctggatacaactgagctttggttgactgaagttatgaaccaggaattacaatatatatctcatagaaatacaaagattgaatgagatgctgtactcctggcatacagtggctgcttggcaaatgtaatgctccctttggcttggagtctcaagaacttggtactctgcagatttgtcgtaacaacaacagccacaaccaaaaaaagtggtcgctaaaagtgaatttttcacacagcaaaaagtctttggtggaatgctcttcacttccacagaacagaaacaataataacctgttatacaattagtcacaaatacagtccttgaattttttgtccatacacatgagtattgtctaaaacatgttttctttgtagcagctaggtgctgccaccactgtgcatggctgagttcacaaatctgttgtaacctgtagcttccctgtcacttctctctctcacgctaagctttgtttctttgcagtaattagaatttttgccactgccatggctaatgctgctactggaaccacgagagcctccttggtttcatggtttggcaaaggattgtccttcatcaccagaggggctggagcttctgcctcctaaggtttctctcctcatgggtccaaaatttgaagactgattgttgtagctgccaaaatcactgtagcttccttcacctctaaaactgcttccatcatttacaaatccattatagccatcccactgccaccatatccacaaccaccacggctgccaccaaagctactacgaccactgaagattcctccacaatcatagttcataccaaaaccacctccacaaccaccaccaaagcatccagaactactttggcttctttggctcaatgaagcactagccttctcttgctttgacagggatgaatttactgaacactctttgaagtttcctaacttcacagttgtggccattcacaatatggtacttcaatcttattcatagagtcatggtccttaagagttacaaaggcaaaatccctttgcttgccactgcctcggtcattcatgatttcagtcacttcaattttcccacattcttcaaagtaatgtcttaggtgatgttcttttttttttttttttttttttgagaaggagtcttgctctgtagcccaggctggagtgaagtggtgcaatctctgctcactgcaacctctgcctcctgagtttaagtgattcttccacctcagccccctaagtagctgggattacaggtgcccactaccaagcccatataattttcttatttttagtagagatggggtttcgccatgttggccaggctggtcttgaacttctgatctcaagtgatccatccgcctcggcctcccgaagtgctgggattgtgagagtgacccaccatgcctggctcttaggtgatgttcttcagtgtcttctttagtgccactcatatggtttggatctgtgttcccacccaaatctcaagttgaaatgtagtccctactgctggaggtggggcctggtgggaggtgattggatcataggggtggtttctaatggtttagcatcatctccctggtgctgtctcatgacagagttctcacgagatctgattgtttggaagtgtgaagcatctcccctgccctctctcttcctcctgctctggccatgtcagtctgcttcctgtttgccttctgccatgattgaaagtttcctgaggcctccccggaagcccaacagaggccagcatcatgcttctggcacagactgaaagaaccatgagccaattaaacctcttttcctcttttccttataaattacccagtcttgggtatttcttgatagcagtgcaaccatgagctgatacagccatcaacaaatatctttttcacagttaagtaggcaactagtctttgagaatctcctcttgagacaactgtctttggttccacgactctctcatacctcatgtagcatggcatttagggctgcatccacctcctccacagtggcatatgtgacaaacccaaaggccctggagcaattggtgtttggatatctcattaccacacagtccatgagtgctcccaattgctcacaatggctcttcagactctcatgggttgtttcaaacctcaaccctccaatgaagaccttccagttattcgggctctttcagagactccgacttagacatgatggcagtaggaagatagactttagtgatgattcctctgtggcatcccagggccaaaaggagtaaggtgacaaatgtatctcagtagaataagtttctagaacctcagtttcagaacagcgcctaaaagcgcagattctggagagacggcctgcatcaattcctactttgataaccacatgaccttgggcaacttattaaaccctctgagacatggtaatcttatctgcaaaactggaatagcaactacctcacaagattttttagaaagccaagtgagatgatgcatggaaggcacttagaagagtgagtgtctgtgatctagtaagtagtcacttagtagaagttatgattgttttactggaacattagatatgttatttgattataaaaaattggaagaatagaaaaaactaaaggaaaaatttttgccttttactgttttgaatttttcaaattctctaactgcaacttctcccactactccataacacatagacagtttatcaaatctcacagccctcctagtctcacaaagtacactttagcctttctttacgccatcttaaatgcttgaaaaccttctctttgcacttttgtatgcaaaaagaatttactgagcaccacttctatgccagatattgtaccatgtgctagagatgtaatagtgaataaagaagatacagctcatccttgccctttgctcttgatgtcttctctacctctcataactttcccaactctttttcacatactgctcaaccttcaaaacttagttgataaatgatatctttccagatgctttccctagacatccaaatttggctaagcattcttattctgtgctcccatgtctgactccctgagaatccctcttttttctcaaagcatgtatgtctctgccattctcactggaatgggaagagttcacaattcattattgtaccaggggcaaatattctgcttgggacccagtaggtgcttaataaatgctactaaatggaactacccctggtagagatgtaagctccttagactcctgtgtactccaccatgactagcacatcctagaagtagtgcatagtcaagaagcctgtcactattctacagtagagctggttattgaacagtagtaccctgtaagattttcaacaataaaatcaaaaattggtttatgttgtgtagcacaggtaataaagtgagttcctttgaaagttttcatttagcagggagaattgttccagctttgggtatgacatccctgacaaagtgtattagctggtggcttcctggagtaaaagagttgacagaaagaaaaacagtaacatgcagagaagaactgagttcccttcttccttctccactgccagcactgagtcagagcagctacggaagcataacacacaaatgagacaacgctaagtattcttttttttttaatttttatttttattatactttaagttttagggtacatgtgcacaacgtgcaggtttgttacatatatgcatgtgccatgttggtgtgctgcacccagtaactcatcatttaacgttaggtatatctcccaatgctatccatccccacccgccccccaccccacaacaggccccggtgtgtgatgttccccttcctgtgtccatgtgttctcattgatcaattcccacctatgagtaagaacatgcggtgtttggttttttgtccttgcgatagtttgctgagaatgatggtttccagcttcatccatgtccctacaaaggacatgaactcaacatttttatggctgcatagtattccatggtgtatatgtgccacattttcttaatcccgtctatcattattggacatttgggttggttccaagtctttgctattgtgaatagtgccacaataaacatacggagaccacactaagtattcttacacgagcccatctaaaccccaggtcagcagcttgactcacatttgagtgtaccaacctcaaataagcccaataaaatagattaaagtgtatgcaaggcagggaagaggtctggaagaatatactaatatgttgaccatggttatttctggatgactattactttcattttttggagctacatatatttctttgaggaataaaaagaattagaatatgtaaaacatgatcaagtatttgctttgttgtactggagaaggttcagtgtggtataagttttgtgataaggaaaaattctctagtcctggaaagggtttatccatgttcagttgagttaattttgagaactggctgaaggatgcaaaggaaggggtttccagctgacaaatgaaagagggatgtgccgggaataaatttgctggagaggaccaggctttaagtcaaattgctttggtaccaagaaatcaaagcaatgatttgggagcaaactcaacagtagttcatccatttgaagcaaaacttcaaacatggtctgagtaattttccagggataactgccactggattctattgagcactgtacgatcttgtgggcagtccctgtctgactaatccaccagctgtgcaactgctacagcatctgtgagtgagaatcattcactactaaaagctagaaacatgttttgctcagtgcacctggtgcccagaaaagaggaaatgttcatttcagcaaaatgcttcctcaagcgatgcaaattccctgcagctcagttcctgggtttaaatcctgttcctgcaccaaccagcagtgcgactttagggaagtatgaaggctctctgaaactcagactcctcattttaaaattggactaataatgtatgacagtgtcactataggaaattgatgagataatatgcccaaactctttgggccaggacccgcctcctaacaggtgcttaggaaatataagattcttcctatttctctttttttgtttgtttgtttttgagatggagtctcgctctgtcacctaggctggagtgcagtggcgcaatctcagctcactgcaacctccgcctcctgggctcacgagattctcccacctcagactcctaagtagctgagattacaggcttgcaccaccacgcctggataattttttgtatttttaagtagagacagtgtttctccatgtaggccaggctggcctcgaactcctggcctcaagtgatctgtctgcttcaaattcccaaagtgctgggattacaggcatgagtcaccacacccagcattcctatttctctaccagtgtcatgcagtcatctttccaagtattgtaaaacgagcctatacacacacacacacacacacacacacacacacacatacacacacatgcatgtatatgctcaattcagccttatcaccattacagggaacaggcttccaccatgctattaccagtattgtagagtattgtagcatccctacagaacagcacaaactttctgaaggtggtaaaatgagctgctaaggccttgctgccacttctcttgatccagtgccttttctgtatgtgaggccatcttacccaaattctactcacacctctagctaggtcaacactcctactcttggtatcttccacttatgatgatcatctctgtccagcaggcagagaaaaaaaaagtctcagacacaggtgctgaaattgccttcactgctcattcaagctactcttcctaaccatgtgagtttttggacttcagaacctacctgtgaaattggcacttgcctagccttcccattatatttgacttccaaggatgagatcagttacccacctgaacctagaatatctcctggatgatctccagcagactttgttcctggtcctgggacttcctgggtggtcgattggcatatatatcctctgtgacactataaagactaaagttccttcctagtgggaagcaccattattcattcatccaacagaatgtttatctagcgtgttatatgctaatcactaaattttaagtgctagaaatacagtagtttaaaaaaagcaaaaatctgtgactctgtcgaaattaaattctagttgcgttaggtaatccagctctttgagctccctttttcctcaacatacttcctgtaccaagaagcagttatgaacagctgtcctttctatgggaagacactcaggggtccaggtaggcaaccactgtgaattgtctctggtggtggtgcaaatgggcttgatctatccagctgcctttgttttagagcacctcataatgagctggtgtcaatggcattggaacatgggaaagttgaaaaataaggcagaaagtgtggccctattactagtgtgttccaatcaaagaggtttatttcacaatcagacactttaataaaaatattaatgtttcctcaaataaggttgctttataatccatgcttgcttatggtggtttaaatattctccaaatacaatagtgtctaataaaatgccttttggaaataataaaagcatatttatacttgatctagatgcttaatatgcaacttaatgtgcaattgtagaatgttattttgtgcttactatactcttaagatgtaagccccaaatcaagaaaacccagaaagttttctaattttcttgtcctgctgccctgctgggaactgacagtgtcatctttcagattactgcctgtgacatgacgtgcatatgtattaatgctttacaagccttaatttatttaatccttaaacaaacttatggagtagttactgttttatttccctcatttaacagatgagaaaatacagggagaaagaaattaaataagtaacttgttcacacaactagtggatagaatgagatttatacctcattatccttgtaattccacctttaattcacacactatattgtctctcaagtattatgcatttcttactctctgactcagatgtttcttctgagtatggtagatactttggtcctttggtttaaaagctaaggtctgtaagcttccctttatccttgctgggccatagaatgcaattgggagaaagtataaatagaaataacctagttaatgacactgccatttctctggtcacccaaatacaaaattacacagatgaagatgatccctcagcatctttcctctctcatgtcttccagagtggggtccatctaactaaattgccagaacatgactcctaatatcagagtgaaggccaagatggtttacattagactgagagctccctgatgaaagcagtgatactacagctgtagctatctcagtaaccccctggcacatagaagaggtttagtacattttaccaagtgaatggatctaatacaagtttaatggactctaaatcagcagatatatttgtttttgtttatctccattgtccactcccccatcacacccttgtttcttctccctagaatattccacttgccttcaatttctctttccaaacatatctcttgcttctttctaccccaacacaccaactttcctttctctgcttcttcatcttttcccaccacattccccaaaatctagaatttcaccaatctgaattatttgcaactcagagtaagaggaatggatcacctccaatgttttgcacttgttaccttccacatgccttttgccatgtctttaacgtcaaagttcagttaagatgacaatctttccaggagcctccataatttattcactgcctccatcagtcatctacacctcacccccagactgcggtcagaactcatagttacctgtgcactcacaggacatttacttaatctatcatttttgtctgtttatttaattgtttactttttatacactataagatctttgaatgcaaggattgagtcttgtttatggctgtaggacctgtgccaggtattcagtgggtcctaataaatgtttgttaagtgaatattagccacctagtaactggtttccttatctatatactctccatcaaccaattcttttaactaatcaccctcagatacatcttccttaaacacaagtttggctatatcactcacccctttaaaacccttcagtagtttcctcctgctccagaataaaacgcacgcactttgatgtgaaattcacaacattctcaatctcttgctaaagtactatctcttactgatttttttcactcatttgcattcctttcaaactagctcagcagctctttcctggagccattttatctttctaatcttttctcaccttcctgtctcatgcttttccttctgtcttgaaatgatgcttcccaaatcacaggtgagaaataccttgctctttttaagattcttttcatgtcaccttttccacagtctctcctaatctatcttattccccccaaaatgtggtttacctttgtcactttgtattgttcttacaataaaattgtccttgagtttgtaatctttttattcatccctcatttcactgagcacttaaaatgagtcactgatgcactgtaatagaccctggtaatatttagagaaaacgcaatgaccagtgagctctgttttcagttgataagactgataaatgttatcaacctaaaatgtcatagttaagatgcatgctgatttcagagatacaaatatttaaaaagtgcatgttagaatcaatacaatatcaaataaaatatcatattcacatgctcccccagaggtcatttaacctagctttggccgtataaaggagcagtttcttggagaataagatatcacagtctactcttaaagaacggaaaggtatgaatccaagagacagcaacaatactgtcaaaggaacagcagactagaactcacggaggaggaaccataaaggttaacttcctctcttgagatttaagatgcttaaaggcagtttcttacaattctttccttgagaaggttggtacagtcttaaacggttgtgttagattaaaattaaaatgtattgtggaccattcacatgttacaatatagataagtttgataatttcttcttaaaattggcaacatgaaactaaggtgtcaggaaaccttgaagaatgagtgcttggggggaatattcaattaaaatttgaaagataaatgataaagtatcatccatgaggatatgatttgaatgactgcactgccataaagtttagactttcacttctagagacttggccaggctgataaagaagagttagtgcacattctctattcatcacagaaagtccaattctaaattgaattcaattcaaattctctaaaacccatgagcaacttctagtctctgcttgggcatatcttcgtccattcagttcatggcttcatttgtagttctgtgtgttttattttcttcttcatccttgtatcaattcatccttttatctaaactattaagttttacctggatatgcaaaattaacaatcacagtgaagcttcccaaatggggcagtttttaaccctaaaaatcattactctttccttaatgtggataggacttgctcaatcttgagggcagaacgactaccagttttattaggtgcactagctgcagggattcaacagtgtacaagcaagataggcagtattatttctcttgtggagctttccttctagtggtggtgactaacataatttaaaaataaagaaaatgggccgggtgcggtagctcatgcctgtaatcccagcactttgggaggccgaggtgggcagatcacctgaggtcgggagttcaagaccagcctgaccaacatggagaaatcccgtctcttctaaatatacaaaattagccgggcatggtggcgcatgcctgtaatctcagccactcgggaagctgaggcaggagaatcacttgaacacaggatggggaggttgcggtgagctgagactgagtcactgcactccagcctgggcaacgagagtgaaactctgtctcaataataataataataatgaaggaaataaagtcaaggaaataagatgctccaagagagcacaagaaggaaccatattcattagagaatgtcaaggatgctttctgaaacaatgacatattaactgaagtcagaggaatgagaatatctcccatgtgaagaggtgggtaagctgcctttcaaatgaaaggaagaacaaccatgagaatctttgtgttggaaaagagtgtggtaggttcaaggaattgacacggctttctgaagaggggtgagtgaagcaaacatgaggaaggagaggtaacctggaataagattacatacggccttgttagccttgggaaggatttgggtccccatcctaagaaaaatgggaagtcaacaaagaatttcagcaggagagtgatatgacctgatatatattttcaaaagctcactcttgaactcttagtgagcctgtaagaggatgtaactgcaataaaaagcagtatggaggttcttcaaaaatatgaaaatagaactacaatattatctagcaaacccacttctgggtatatatcccaaagaattgaaagcaaggtcttgaaaagatatttacacacccatgttcatagtagtactattcatgatagctaagaggtagaagcaacccaaatgtttgttgatgaataaataaacaaaatgtggttagaaatatccatatatacacacacacacacaataaaatgttattcagctttaaaaaagaaaggacattttgtcacaagctacaatatggacatatcttaaggacattatgctaagtgaaataggttggtaataaaaagacaaatggtgtatgattccatttatatgaagtgcctacagtggtgatattcacagaaacagaaagtaaaatggtagttatcagggactagagagaggaagaaatagggagctgtttaaaggatataaagtttcagatttacaagaggaagaagttcgggggatctgttgtacaacaaagtgaacataattaacactactgaactgtacagtttaaaatggttaacatagactaaaattttatgaattttttactacaattttttaaaagcttactctagctgccaaaggagaatggattcaaagggagagggcaaaagttggggagaccagttgggaggcatttagagaacctgtgctggtgcctgagacaggcaagtggcagagcctgcaggccaatgagctcagcccctgcccatctgcatttcctacagtaggaagcatctaggggccacaaactccaagttttcttttgcccacccacacaacattccaaatgtccatgtcttttattctttcaaccctccaacatcttttctcagaggagataagaagtaacaaaaaaaatgaattttgtaacacttggtgactaagttcactcccatctgggcccatcttttgcctgataggagacaggacatggtcaggtagcaggtggactttaagcaaccatatccagctttgagattggggcctagtggacagtgggtataaagatactctgtgttagcctctcatcaaaaatgcacccccagttattttttgtaaacttgagcatctgacctaacatgtgtttagtctttcttcctgactcgtatttctgttttggctcatagcaacaaccctaaatggttagagcaagagtatccagtctccgatcttttggcttccctaggccacaatgggagaagaattgtcttgggccacacataaaacacactgatagctgatgagctaaaaataaataaataaattgcaaaacagtcccacgatgttattcaaatgtttttgcatttgtgttggcccacattcgaagctgtcctgggccacatgtgacccacaggccgcaggttggacaagctgggttagagggtgaagagcctctgttccccagattacacatgtagtactcccacactcttaccaaacaattattttgtattgtgattaaaaattatatttcaaactcattatggaatcattcatgtgttcttatcatttagctcccacttataattgagaacatgtagtattgcgttttctgttcctatgttagtttgctaaggataatggccctacataacaaagtaatttacatcagctatacaatctataaggaataatgtaacaaacttcctcataactgccatccatctttaaaaagtattaccagcagaatggaggcccctgggtatccatcccgggtcatatctgtctgcctctcccctgaggtaattgtggaattttatctgtataattccctgttttccccaatagtcttactacatagacaggtaattgtaatggttagttttatgtgtcaacttggctaaattatagtattcaattacttaatttaggtgttgctatgaaggaattttgtagttgtggttaacatctacaatcagttgactttaagtaaaggaaattatcattgatattctgggtgggcctcatctgaccatttgaaaggtcttagaagcaaaactagggtttccatgagaaagaatagatttcatctgtggatttcttgcttagtgcctattgaagagtttccagcctgctgccctgccctattgattttagctcccacaatgacaaaagcaaattccttaaaataaatttgtttatatacacatattaatatatatacacatactggttccatttctctgatatgatctttactgatacagtattccttaaaaatgcttagtttatatctattttggaactttatgtaagcagtatcatattgtggctatttttctacaacatttcattgagaaatttatttatgttgatgtgtgcaaaactagatcatttctttttaattttttacagtatgttattattagtatatcacaatgtaccatttttttttttctgagagagatatttgggctttttctattattttcctttccggaataacaaaactaacaatactgctaaaaatccttgcatgtgttttttggtgcacatatgtaaaactcttgttagaacatatatacctaggagagtagaggagttctgggtcttagactatatgcatcttcaatttttctagatatctgttccgtgctttctccaatgatcttactacaaagtagttgtatttttgtcagaaatataccaatttacaaactatcagcaacatatgagaactatgatttttccatactctcagtaaaacctggaattatcaagaaaaacacttataacgtgactatatatcagatttggaaaatctcatcgacaggatttatagatacattatatgtaaggggtgagaaagataaaggagtcaaggatcattcaaagatttttaactctagtattcattaatatttattctaagtgttattattcttattattatctctaacgcttgtgatgaacttgaacaaataaaaaaacttcactaagtggtttggagttggtttatttcccagattacatcccttgtgtgcagcattcactgtcagccacaaggtggcaagctaagcatccttaaatctaaagctcaactctggtctgggtgaacttgactattcttagaaagtttataaagcaagaacttattccccagtagtgaattcttatgggtatagcacacatgcttctttcctaaaaattgtggcatctttgcaatgtatgtctccttgtataaggaaacaagcagaaacctttttttcttaaataaaactctaaaccaatcagggctctgctagcatccttttggctccctttaatcacagcacacattctagactcctaatcctgccatccaagaccctctacaaactgccttaaatcttcgcttctaacttcaccttcctttactttctttatacttcaaatacctaccgctccccagctccctatacacacaccactttttattcctctgcctaaacattccagctctcagggcatagtccacctacgccaaattccgttcagatgtgtataactcatagttcacatttccatgacttggtgaaggctattgattccttatcttctttatttttttgcatctattcaattgaaatgcaaatttgagtctcagcttcaagagtactcttccaaagacttcagggtctcctccagcagttagctatgattctcctaagcccctcaaaacattttttataccatcattagagctgtcacattttattataacatttttatcttttttctccccaaaagcttgttaccaacagagagtcatgacagatttttctttgactctgtcagtgaccattccacgcctggcagctcaatggatgttgagtagcttgctgaataaatgaatgaataaatagatattgtatgaaggcaaatatttaattttgagtgatgtatgtttcctatcagtatgtagagtacccaacaaagtgcttatattgcctgaacttttatctattattactgttgtcattataacaaaaatcatttaaaagtaaacaaacactgagttggttgttaaccagacacagaagatacagcttctgccatgaagaggtaagccaaggggacctagggagatggcataacttagggaacaattagagacacagacaatgtgtgcatatgtaaattagtataatatactgatataataaagtaattcacttaatgtaattaaataaatcattaggtttcactgttggcacgagaagtttccataattcagttgacacataaaatatttttttcagcaaacatattattgattttccacaaaggttataatataataagcatataatattgatttcttttaaaagctctccatccagagctacgagaatctcagaggaattgtaatcccttctaattaaaagcttcaacatgcaaatatgtgctattaggcattaggcaccatatgctgcactataatctgaacttgctaactgtgtctcttcggtcctctgaatataactatttcctgatcaatacattttttgcattttatcttcttgggtttagatctaaaaggtttcctaagttagtttatgctagatcttaattctattttaattttaaattgattaaatcaatagttactgagtgactatgagatacaagaaaatgggctatgctctaacatatggcacatgacatgttatcccatttgtttttagctattattttgatgaagacctactctgtgccagatattcctctaggaggaagaatctaaggctcaaaaatgtatataggtatgctggagtatcttgtgtacttgttgggaaatcacaggaataaattcagcctaacaggttttgcataatctttttagattcttttatataatactagctacaggactgtatatagtctggataccaaatttgggaatctgatcttccctttaagtcaaatttagtaggaaagccacattgtattgattttagccaatgttctcaaatgaagcaacttaagtcagcttaaaaattgctgttgactattattgaatacctacagtgtgctaggcactatcaattcagctgaaactcattaattcaagtgaataactcagtccccattaggagggctcacattttacaaatgaccaagcaagagaaaaacacccagctgaaaggcaacagaactggcaggcacttttatcatctgctgttaattggaagtagaagaacttaattttattcagaataatgcttcatcatggctttggaaagtaatgaattctcaggggatctgaatgtgcgcctctaataaactttctataagacatggcagatttgttgagagaggagaggggtcttcttataaaatattctgggctgtggaaaggtaaaataaaacaaatgtacattttgggttaaaatcaacagaaaatcataaaattattttatctggccatccatagactactatgagcttttaagttaatttatgtatgagcataatggagagttgaggcaagaaaatgaggggtatgctgaagatggagtaggtattacttcaagaggtctgagtgccaccctttgccatgaaggaaaactaataaattgatattttggagttagagtactcacgcttttacaatgtgacttgatactgcatttttaaataactccttcaacacagatttattgggcatctgtcatcagctaggcactttggtagatactaggaatacaataatcaatgaaataatttcattcccttttctcatggtgtttggtctggtatggggaggcaaatgttaaatgcataagtgactactgactacttaattatagccataatattagctgtgaaacagtatattgggcatttggagtatgtgcagtgagtaggacatatagttcaataggtttaggtgataatgcaaatgatagatgtgctttactgagcatctatattcttctggtcattatgctaactcttttgcattatttccaatttttataattatcctacaaaaataaaatacacttctgtcacagatgagaactcctgatcctatagatttcatgatggcagatgccatcaagccatagcctgttacacccttttgccatctcatcttctaagactcagattaaatgttacctctcttttaagactcatattaaatgttacctttctgtgaaacctcccttctagcagccaatgttctctcttctgtgctttccaaagctcttgctttaaactctaatatttagaagtgtaattaatctacttataagtctgacttgcccaccagacagtcatcttcttaaggaggagactatgttttaattgtatttcatttactttcatacctcctgcacccagcaagctcagtgcttgacatttataattcctcaataaatatttattaaatcattgttgagtgaaagaaatttgttcttataatctatagcaagaatgcaacacaaatgggaaaataaggatagcatttcatttgaaatgctaagaaaatatttgaaaggcaaattgttagttaataagtatctagaatagaccatgaaccttgtacacaatacatattaatttgaagatttaaaattgacttctttttttaacttcctaagtactgatgaacactatatatgtcaaacgaaattgcaactgggtttcaaccaaacagaattcacctagataatttagccttgcactgctttctcaatcttgatttatacttatcaaaatgtgacaaaatttcatgtaatccataaatacataccccttatgtaaccataagaatttttaaaagttaaaaaaaaagtaatgtgacagaatatacttttataaagttacatgtttacaatatcaagcaatgtataatagaatcaatgacccttgatctagaaggaactccaagatatcctttggttcagtcccctgtctatgagaaacactattcagaactgatggctgtcatagactaaataatgactaccatttaagttactaactcccaggataaaggcagcattttctatgactgcctatgtctctacccaatactagcttctaagataatataaaatgtaaaatttttttaaaaagaaaaaaaattgggagcactcatttccttctttgcatgtggattcaaaggaggagtccaattcaaatttccagcccctacatgaaggcttctgggtttgcctcatctgcaagtgctctctcccttgacattttatctctaaatgcttataatagttagcttgaaaattataccctgtattttggaattgtttgtgtcatttgtttaaataacagtctatgagatctatgagtcccttcttaaaactaaatttttaacagcagtttcgtcttatattttctgattcctccaagcaactgctatagtagatgtgtcttgtgttacagtaacaatgcaaaaaatctttaaaatatatttcttagaataaataaatatccaactctttacctctttttctttctttctttctttttttttttttcttttgagacaggttcttgctctgtcgcccaggctggagtgcagtggtacgaacatggctccctgctgcagcctcaaccaactgtgctcaagtgaccctcctgcatcaacctccaaaatagttgggactacaggcatatgccactgtacctggctaattttttatttttcatagacatggggtcttggcatgttgttcaggctgttctcaaactgctgggctcaagtgatcctctcgcctcagcctcccaaaatgctgtgattaccaacttttataaaaccacatttcaactccatttacgtaagtttatcttgagtaacgtttctactaaaatccattcatattgggctgcattccttgtgcctagcactgtcgctagcatataataggctataaatacatatatgttgaatataaaaatgaaggaagaatccagttggcacctgcggacttttcaaccacgtctgatattgagctatctcaaaacatgatggtgagtaaatgaatgagtgatgctacacccacaacacatccacatttgcaaggaacactatgcatagtactattgtgatttatgttgtttatgtttaccataaatgttgatatttctttttttcaaaaaccctggcatttttgaggcctccttctaacataattagtgagaagtaatgactgagtgaccttttgacaacaatccccagggctggaaggaatcatgctttttttcagaacctggcattttggctgcaagcagcagcactgggagctcactgaaagagccaaaatgtgtcagagcacagggcaaaatggcacagctgccaggtgaggttcagatgctgtctgtgttttaggttgaagcagtgaaaaggcagactctaaaatcggtcttgttcttacactcatgcgtagctggctttgagttcaagaaagtttaagtaaagcagttaaatgtacaccagaatcattacaataacactcagatcttggtcctggctctgtgaggctctgaagtagctgtgtgacatcttagcagctatgtgacatcttattagttatgtgacctcctctggtagacaaatttctcatctgaaacatgtttagagaactaggctagaaaagtggctctcttttgtgctgtggagacacactgaaaggtcatgttcatcgtgaaaaacatttcagatactgatattaattatatagtgattggaaatcatttactcaaaaaaataaaggataaaagatttaaaaggagacaactccagtctcactcgcttatattctgtgtgtttgctttagaggaaaagaaagaagtcagatgtcagttaatgcaacttcaataaagcacagcctattttatccagggtaagcctattgcaagtgaccctaactgaagctgtgacaataacaggtggttgcaaaggctcgtctatgcagtattattgggggtttttataaaagcttgggtatgcttataggcatgagttgcctcttatgcctgttacagaggaaaaaatactgagaagagtgagcaagaagctgtctaaagtccctgtcagcactgaactgtggagatttggatcagagtcaacctcagggaactgactttacagtatccttggagacactacacatatccctgaagcaaggctttaaacccttgaaagatcccatccgagaatgtactattcccttattgggtgagactgcaaggcaggggggttgcttgggaaagaataagaaagataactcttgaataagcataaaatatcgcttgtttttaaatactgcccaaaatagcacctccatttcttttttattctgcacataatgtcgtctaactaatatttatatatggtttttctttaacaaaaagctattcttacagaactatgctgaatcatggctctgggtctcaagttgccataactgtaaaatggtttgggttaaatattacctaaggtgtctcctaagagtatgattcagtgattttctcaaaaagatgtgagtgcctggctgctgccacctggtgtcagctacctgaactacagttaccaaagaagttaattctttcctgtgtttgcacattctgtccaatttagtaataatatgacagtgcaacatgatgactttataaggtgaaatggtctcaacagataatctagtctatatgactgtgtgatacataaaaattacattctacttttaaagacacctacaggtagattctctaaattcttttgtcaccatttctgtgtatcactacattttaaattcttcctgatattactccttcctgatatattcatcattatactataaagcattcccttcaaactcaaaaataaaaataaaatattttcatttatattttagtggaattaaaagaacatgtaagtgaccagcttgtccatatacacaggtgtaaatagaggcttctgacaaagaaaataggtctcagtcagtactgcgcactcaaattacctgtaaaatgtctctattagctggaagcatgggatgtcaaaagtagtagaatagggcatcatgactatagggatttgggtctaaatatgtcagttatttgctgtataatactgtaaagattacttaattttactgagtcagtttccatttgcacataggtacaacaatttccacctcatggaactttcaaagttaaagtaactagaacataatagtgtctaataaatgttagaaaactctgtgagtcatacagagcactatagatgcccctgaatgaaggtttccaacccttagaaaaacagcacaatacctagaacatagtatgtgctcaatacataattgttgataaatgattgattattactcatgttcaaatgtcagattataaggcttccaggacaggctttgatgctctacctcaaatttatattggagatgggtctgataacaaaattggtgcttatgagaataggacccagatcatgtaacacattgctatggattatatttagttgtattcacgtgagcttcccctacaagcctattaaatccttgaaggcaggagctatattttaaatatctctatatctctagtgatttgatgatcactagaatgatcatcaaatgtgacatatgcaataaatatatcattcgataaagtattattgacaccaacataactactatttccacgttaaatttcatatgatgaagttttttttttttttttgagacagagtcttgctctgttgcccaggctgtagtgcagtggcattatctctgctcactgcaacctccgcctcctgggttaaagaaattctcctgcctcagcctctggagtagctgggactaaagcagcactcaaccacgcccagctaatttttttttgtatttttactagagatggggtttcaccatgttggccaggctggttttgaactcctgacctcaattgatccaccctcctcggcatcccaaagtgctgagattacaggcatgagacaccgtgtctggtctgaagtaattatttttatcttatgtcttagaaaaatgaaactctagtcaagtagagtcagaagctctttcccagatacatactattggttttaacttttagtaaaatcaaatagcagaaactcattcacaagtatctacataaatcagggtaaaaaaagtttgcatttccttagaagagtggataatgcccagtgaatacaaatgtccctctctctcatctgtctacctggtgacttgcaacacagctttgtttgtctaactgtatgggcaggacctataggtaaaaagttgaatatatagaagatttaagcactaaggttaaaaggctccctgacttcccaagatttgagttactgtaaaaaatatcagaggaaatcctctgtcacaatgtgactaactgaattgataactgattatataagagaagtgtgtttaaactggactgtgtggtttcagaaaagcacagctgtttgtagtcaagaggaaggccatcatacagctacagttcctctaaccttgttccactttgaagtggattgcaggataaattttttaaaaactgtactataaaaaaccctgatgcagtcctttctcgagtctgcagaatgaagagggtcagctttccttaagtgattggcttcctgtttttcttaattatacaaaatgaggacaatgcaaaacacagctggtggaaactcagatgttgctcaaagcttgaaacacataacgactttgtgatgaaaaacatagaaaatacttgctggtgaggggagagcagcagtgacacatttccagtggtatgcttactacagctgaaaaaccaacttcacctcgaaaaataaacagggtgaaagtcttgctatggggtataaatgctagcctttaacttagccacacaagcgttattgaaagaatagaaaggaagaatggaaaaaatgcataaaaggaaggtattgaatgtctggtttatggatggttattattataatgcctaaagggtgacaaaggatttcttctgtatatctgaaaattcaaattactgtaggcagtaagaaagcaagctgaaaagtatgctactggatgacgaatcaattgtgtctagggaagaagaagttatattgcttaaccagaatttggaacaaatattaagttctgtgtgacaataaagaaattactcacatatttgatgatcccttgatggatcctcaatcatcgtttcaggctgagttcaagtataacatcctctttaataccttttccaacaattaggctgaaataacacatcttcttttcacttcctcagctttgaatagcacttgacaaactattaaaattagttgtatgcatatctgccatactgttaaagtacaaactctttgaaagtagcggctgttacttaatcactttttaattccccaacaattggtatcacacaggtccttaggaaaaggtcaataattatgtcagaaagatgccagaataggaagttttaggctctattcctccttacggaaagttcaacaagcaactatccacagacaagaacatccttttgaaaaccccaatacatgaaaacaagcctgaaacacctgtgtggctctacacaactgaatgaaaatctaaaaagggtaagaagactggccttaatctaactgtgctgctcctcccactcccccaagtcagcacaaattcagagtgagaatatcttcctgggcccagtttccacatgggcaaatgagaactggaggcagtcatatagcatccctagcattccaagatgcttctcaggaaggccactttggttttacctcacaggaaacactagaggaaatggcatggctagaccacctggagtcaggtagaaacaaagaaaggaaccatacgtgataagtaaccagtgcatggatcttggtggtacttctgtgttcctgtgacaccagatcagaaacgccaaccaacctctggctgagtacgttggctcacgcctgtaatcccagcattttgggaggccaaggcggatggatcacttgaggacaggagttcgagactatcctgtgctaggtggcgaaaccccgtctctactaaaaatacaaaaattagccagacatagaggcgtgcctgtaatcccagctacttgggaggctgaggcatgagaactacttgaaccctggaggtggaggttgcagtgagccaagatcgtgccactgcactgtagcctgggagacagagcaagacaccatctcaaaataaataaataaataataagaggcagccaacctgtaaagctgagctggtcaccttcagaagcatgttgggaggctcaacctaacttctgtactagccatctagatggctagtatctatgcccagccttagatcctaccccaacaaacctgcccaggcaaagagactcccatagttgtgcattccagagaagcaaaggtgctagattggcttaacctgggaagtcactcagccaacaaccttacccaggcagggagatttccatttctatgcaattcaaagaagagaagagctagacaagcttggcccagaaggtcaaatagctactcaactcagccaaaagcctacctcgtggctccacctgactgggaggcaatctttaattgtaaaattctaaggagcataacgtatttcacctatcttgaacggtatctccccctaactttatagcctagcctgcagccctgctcaactgcaaatcacaaagagcaaaattgcccagccagagaacacatcctattaccagcctgaccagaagtaatagcagtacccagtcatcagctttgtagtgcccagccagtggtctcactgaacaacagagttcagccagcagccctaccagtgtcagagcaaaggcagccacccagtcaacaggaaaactcacaataaactctaactgtctggggtaatcaccagctggtccttccagaatcacaagctagactaaatagtgaagatctagccctgccaaagaacccctggaaaggccatagcaggggctgtatcctcaaatgcacggacaacatacaagaacaaaaggattaggaaaaatcagggaatcatgacacctcaaaaagaaactaatacagttccaggatcagaaccaaaataaatggagatatataaatgactgacaaagaattcagattaatactcaaagttcagtgaacaataagattatatggatagaaaatttaataaaatttggaaaacaatacataaaaagtgagaagtttgaaaaaaaataaaataataaaaaagaaccagatagaaatcctagagatgaagaatataatgactaaactgaaaaattcattataaagtctcaacagcagacttgatcaagaggaagaaaaggtcagtgtacaatatagaatgatggttctgagaagagaggttatattgctcagttagtatttaaaacaaatcttaagtgttgttactcacgtgtcctttacccaatttctttttgtcctaccatactcacttaagattgaggccaattatgggagaacaaaaagaaaggagaagactgggtcattaacactgtgaagcattttagcccttgactggacacctgggctttgctgtgagagataaatgaacatccactttacttaagctacctctattttgatttcctgacagttagtagcaatgcctaattctaactaattacctgtgttgacatttgtgttctcagttatgggtgaggtggggtggtgaatagctgggtgcaattctgaatgttggaaaggatgaagtttcaaataactaataaccaaaaaaataactagggacctgttaatctatatttgtagaacaaagatggattctatgatttggcatataggccttccagaactagtccctacataactctcagtctctaaatatattcagttactcataagaccctcccctatcaacttgcagtttcacatttccttgccattgattgtgttgtcctctgcccaattctttatctggcttattcttgttcaagaatcagttcaggtgtaatctcctacaggaaggtcctcctgtcttcctttcacaggttaggtatctcactcttgttcacctacggcactcagtgcacacttttgacttatatctgatctcacttaattataattttttgttatggtatgtgtctctcctctctaaattgtgagctgcctgaaagataggatagtgtgcattcatcagctattattttcaatgcctggcacatagtaggtgttgcatagtaagtaccatctggtatagagtccatagcacataagaacgacatacttggaatcatgtaccatcactgattttgccttccactttatgaaagacctaaaatccaccccttgtcaacttctagagcctagatctgccctgaagcccatcacagaagacagttccttgatttccattactcttttctctaaggacatcttcctttctcccttcccttcatcatctcagtttagaaaatatattttggtgcctacttggctacatagatgctggactaaaactgtgtcttaaaattaatttgtcaaaaaaatttcctctgcattttattctattcatttctgccaatttcttcagagagcgaagttatctttgtgactcaaagcttgaggcctaggaaagggggttggaggaaaatctgtcttttgacatttaaaagtatttgctaaaattagagaacagttagcacttctgtttaatagtgagatgagtctacacacatttatgaacatccaaaataccctagctctgtgttcctactgaccacacatacctatactataaaagggagtaaataaaaagaaaggaggtaccctgttttttcataaatacagagtttaagctaagaggtatgctgtttcttattttgaacagttgttttctgcctctcactcccctacctccttttcttcctcttttctttctcttcttttttcccatctcctctttttccttttcttgtttttcttcctcttcatttccatctctttctccatccctatctcctttcacttctctttcttttctttctccttccacatctttgcctcttcttcctcctcctcctcctttatcttttccttctcttgtattcagaagacacctaagtacattcatttcacagtgcagcatcccaacagaactcttaaaatgaactgctatttatgaagagactaatgccatgcttggtctctactatgtcttcttcttggtgttttgacatggcaccctcccctcctcctgctcaccagatatcaaatgccaatgtgtacagtctcctttctgtacattcttagtgccttttccctatgaacaagcagcacactttttttctacacagtttcaagagtggtgacatgtagatgtaaaaagttgccaaattctagttatagttaatagtatagatctggaacaacagagtgagtggtgtggatatgagatggatggaaagtttgattttcaaacatgctcataactttagggaacagatagaaaacaagcatgaaagacatggcaaaccacagctgagtttttaaaatgagaacatttggggtttaataataaccagtttcacttactgcatactgtttatgtatcaggcacaactctggatacttcttttgcttcttgtcagtttgattaggtacttataacaactctttgaggtaaatacttccattctcattttacatggagagaactgaggctctgagtccttaagtggattctagattttttttttttatttttgtaaattttattattattatactttaagttttagggtacatgtgcacaaagtgcaggtttgttacatatgtatacatgtgccatgttggtctgctgcacccattaacttgtcatttagcattaggtacatctagatttaaatccacatattttaaaatctgatgttgtagattacaaaaatgattacaattctttatagtactttctattaagaggtggtgtctattatctatctcttgaaaatggcctggctaatgacttgctttggccaatggaatgcagcaaaagtgatgttgtagtagcttcagcctacacttcaagaagccttgcttcttctctccttcttgggacagagacatgtaaagaagtctgggctagactcctgaagaacaagagaatatgtggagcagagatgagctatcttactgagatactttaggcccacaggctttaaactgagatcaaccaagcctggcctaggtaagcagaacccacccagttaagcctgacctaaatcctgccttttagaacacagggagaggcaaattcactaggggccctaaaagattctgcatgttcttctggaatatgcaaacaaggtgacaccctgaccatactttgcctgagccgtttctcaaggttatatttgtagtaagcaaccttgaggaatgaggtaatattattcccctccaggacaagaaaaaaaaaacaggcttgctttgtaaaaataaattccccaatctcagtgttccatcactgtcatgcaaaactactacatgtgcagcatccatctgggttcctctgtgtttcctccatgggatttgggaaccaagagaaacctacaccaacatactaatgttcatgctgctttccatgtcataattaatgaagttctttgtttctgacccaggagtcttgtgtctcctgccaaaaatctaagaaatagtacaagctaactctttagcttacaaatacaataaaatctacttgacatatatttgtgagtaaacaaatggttgttgttaataagccactggatttttagtgggtagcaatagacaactgataaaaatgcctgcagtctaacctctctgctagtggtattcaacatgtggtaagtgatttacaaatgtgtgagataattttagtagctaagtaaatttttttcatttaatttttactattactaaaatgttaactatttttagttatctattaagtagcaagtgatatcaattttccatttataacacttacaaaattaaactaaaaagtgaattaatctaaaggaaagcattaatgataattcaaagtattatttttataatgcaaagactatgatgacaaaacataaatgaccgattattaggaatcactgtatacatcaatattgcttcttattgaaataaataggataccaaaaaggatgcaaggttaacattaaggtaggctgacagatcctgaatgatgctatacttcagatactgctgagaaaaaaaagttatcctaccttaaaccacatacatttatgatagtctttctcaaataccaccattcaggtaaagaactaaatgctattggaaatacaagcattctcttggaataggaaaaatatgtttaaaatagaagcaaatattcagtttctattaaatcagaggaaaaccagatgtcatggggaggaaaagctgtccatgactctaggtgttattatgacactgcccatttctcctagcatttcttcatagtaaaaatgttagtccataacaatcattcatcttcatgctccagactggcaaactctgagtcatgcacaaaacttatgaataactgagaagaactatgaagacttcttaaagacagatgtgttgagagattcatagaatatgttagcctgaaaggtacttaactattcaaccaactcctttatttcacagaaaggaagtaaggactagggaggggcaaaacttgttcagaatcacacagcaaatcagtagtgacagaactgagactccagatgtcctatctttccattcagctttcttccatgactcagtgttcccactcctctgggtggttcactgggtgaaacagagtatctgacagagacacaaactgggattcacgaaaaggcagatatcattcccaaaactgcttttcctcagcaaagagaagagaaaggtctctatactcttactgttacagagtttatatcttgaaaataagatattacaggatgttatatacaagatgttacagggcacgtattattcccctaaactaatatttctcttaaacagaaaaaaaaaaaaacctcttaaacagtaatgctaaaccaacacattaatgtcaatgtttacctgtttactctcttcctttttggacaaggctttagctatacatgttctaaatttcactatttgggatcttgatatcaattagagttttacattttgtagaaaattaaagaaccaagctaaagctccttaaaatctttgcctgtgctttgaatgttgtctataatgatcttagacacatgttaacactcataaatccatccagaagaaaattcaggttagcacatactttactatgcctgctatcacagtgaaagtttcagaggtccatagcattccacattttctgaccattgatcatcatctccgtgtgctcttggcacctcaattatagaatatcctaccattctttcttaaaaggtgctcttgctcctttgttgcctatctcagtgactggaaccaccatctccacacttgcccaagccagagacctgggcattatctgacttttcccattgcttgtttttctgccattaaccagcatctacccagccaactgggtagatgcaagtttatccaactacaccctgtcaatatgtctttgagatcatccctcctcacaatgactctgtctataaaacttccctggctagaagcatcgtcagctctctgctaatgtactgatatactcctatgattggctgccgtgctctaagctggattcctttaaaatccattttatctcactgccactaaaattagctaattgagctaaccagatcttatcaccggctttgtaaacaccttcagtgtcccatacattcaggataaaaatctgagctcctaagcagtccttacaaacctctctgagatcttacctctccacatttctagcttaatcttctgtaactctccattttcctaatattaaattacttatagttcctcctgattgtgcatgcctcccccacaccccccatggagcattcacacattctccacccctccctcaactgttcttttcttagttacctcctatttatcaaacttagttccaacatggatccttctaggcagcttggtattatccttccatttccaggctgggtaaagtggaatgagtcctctcatttgattctgtacaaagttcccttgtagcacttttcatgttaaatgtatcttttaagaaaattttgtgtgtacatagtatatatatttatggggtacatgtgatatttttgatacaggcatgcaatgcataataatcacatcatagtaagtggggtatctaacatctcaagtatgtatcctttgtgttacaaacaatccacttatactcttttcattattttaaaatgtataattattattattgactattgtcactttgttgtcctatcaaatactatatactcatcagtgtttatgtgcctctttctcacaaactgtaggcttcttcagacttgagattatttctgtcaatccacatctggtatagtatttctcaactctagctaaagagtggaatcactgggaaattaaaaaactacatcccagtgctcaagcttcactctaatctaactagaatctcagaggtagagcaagacatgttccttgcctaagactttgaacctggctgtttcctcttcctgaaaatctcttttctatatggctcactcgcctttctttaagtctttgtttgagatgtcgctttttcaaaaaggtctactctagtcactctatttaaacttattagcacttttcctgcaagctttccaatcctttaattaacatcatatatcattctgccatataatacaattcactttttcaatatggttatcgtttactgtttgcctccctacatgcagaaataatctattttgtttgctaatatagcattaatgcctgccacataatatgtgtttatctacctttctacctatctgtatctatttatcaatctttctctataaagaatgaatgaattatatttataatctgtttttagcagaaacagatgtttaggaagtcctgaaagcctgcagaagtgaagctgattaattatgcttctaggaatcagaaaatgcttcactgaggagatgatgatcaagctgagccttgaaggattttctagacagagaaagagggtaagtttttgaaataaagtgtctaggtaagcaccaagctcagagtacaacatattgcagtcacttaataaggtcctgttaacaccaaaagacaattcaggcagaggcaacagcaagtgcacaaaaatgagagaaggcataaactctttgggatgggtgaggtgtgcaagtaatgaggataaagtttgaattgataatttttggctaaattagataatttatttattaggtagtttatttctgcaaatgacacaaagaatctatgtggatttttagtatcttaattcttgtagatttccctacaatattaaaaactgttatagctgcttactatcactgatatacttatggcccatattttcttattagttttcatatatactttgtgatatggtttggctgtgtctccatccaaatcttaacttgaattttatctcccagaattcccgtgtgttgtgggagggactcggggaggtaattgaatcatggggccagtctttcccatgctattctgtgatagtgagtaaagtctcaagaaatctgacgggtttatcaggggttttggcttttgcttctttctcatttttctcttgctgctgacatgtaagaaatgccttttgcctcccgccatgattctgaggacttcccagccatgtggaatggtacgtccaattaaacctctttttgttcccagtttggggtatgtctttatcaaaagtgtgaaaatgaactaatatggtaaattggtaacagaagtgggatgttgctgaaaagatacccaaaaatgtgtaagccactttggagctggctaacaggcagaggttggaacagtttggagggctcagaagaagacaggaaaatgtgggaaagtttggaacttcctggagacttgttgactggctttgcccaaaatgctgatagatatatggacaataaggtccaggctgaggtggtcccaatggagatgaggaacctgtttggaactggagtaaaggtaactgttgctatgttttagcagagactggcagcattttgctcctgccctagagatttgtggaactttgaacttgagagagatgatttagggtatctgacggaaaaaaattttaagcagcaaagcattcaaaagttgatttgggtgctgttaaaagcattccatgtgaaacggagcataaaagttcagaaaatttgcagcctgatgatacagtagaaaagaaaaatccattttttgaggaaaaattcaagctggctgcagaaatttgcataactatgcaggaccctaatgttaatccccaagaccacaaggaaagtgtctcctggccatgtcagagaccttcatggcaccccctcccatcacaggcccagaggcccaggaggaaaaagtggtttgggggccaggcccagggtccctgtgctgtgtgcagcctagggatttggtgccctgtgtcccttccactccagctgtggttgaaagggaccaatgtagtacacaggctgtggcttcagagggtggcagccccaagtcttggaaatttccatgtggtgttgagcctgtgggtgcacagatgtcaagaattgaagtttcagaacctcaacctagatttcagaagatgtatggaaatgactggatgcctgggcaaaattttgctgcatggacggggccctcatagagaaccactgctagggtggtatgaaagggaaatgtgggatcagaccccccaccccatacaaagtccctactggggcactgcctagtggagctgtgcaaagagggccactgtgctccagaccccagaatggtagatccaccgacagcttgcactgtgtacctgaaaaagcctcagacactcaatgccagccatgaaagcagccaggatggaggttgtaccctgcaaagccacagaggcagagctgcccaagagcatgggaacccatctcttgcattagtgtgacctggatgtgagacctggagtcaaaggagatcattttggagttttaaaatttgactgccccactggattttggatttgcatgggccctgtaacccctttgttttggccaatttatcccatttggaatggctgtatttacccaatacctgcactgccattgtgtctaggaactaactagcttgcttttgactttacaggctcataggcagaagggacttgccttgtctcagatgagactttggaccgtggacttttgggttaacactgaaataaattaagactttgggggactgctgggaagccatgactggttttggaatgcgaagacatgagattttgaggggccaggggtagaatgatatggcttggctgtgaccctaccgaaatctcaacttgaattttatctcccagaattcccacatgttgtgggaggcacccagggggaggtaattgaatcatggtggccggtctttcccaaggtattcttgtgatagtgaataagtctcatgaaatctgatgggtttataagggatttccacttttacttctttcccatttttctcttgccactgccatttaagaagtgccttttgcctcccgccatgattctgaggcctcctcagccatgtggaactataagtccaattaaacctctttttgttcaaagttttgggtatatctttatcagcagcatgaaaaatgaactaatacaccttgcattattcacgtgtgtgtgtgtgtgtgtgtgtgtgtgtgtgtgtctttcttttctacacaactaatcctaacctttggtagtacaaaaagggttcatgatttttcttttgtaaaaatatagtttttcaataagaccttagccaattgcacttttatttaaaactcaataatacacagtgccaaaagtttatggtttcctgtgagaagcagtaaaaaaactactgtggtttttgctgaagaggaaagaaaaactttcaatagttccattgctaaactataatgaaagattagtagtaattaatcatgcagtgaaaagaggagagggagaacatttcaagaacagaatatatgtgcaaggacccagaagcatgagaaagaatgacccgtgtgaggatgttaagtatatgttgctataatatggtaagaatatggggaggttggcaaggtgaatctgtgggatatggatatgatgcttaacttgcttaagtaatgaaggttatgatatgctgaggagtttagagtacatcataaagtattggacagccataaactagggaagtatgcaggaagtaggtagaagaacagaccagttaagtggattcctataagaataatttaggcaggaatgataaagggctaaattaaagcaatgttaatgcagagagagaataacagatggaggcatacttgacagtacttggtggctggtggaatgtgggggctgatggagaatgagatgtctgggataactcccaaacttctggttggagcagctgagtgcctggaaggtgccactcaccatgaaagtgagtataagggaaggagagaaaagatgatgagcaagttttgtgcatgtgaagtttgagatcctgtagaatatgtcttgttggcagacttctagaaatcagggggaggaactgggctactgatttaaatgaggaaatagtatgagcactttcaatcctcagtaatcgattaaagtgtgtattacctaatggaatataccaagggtttgcagtaatatgctgtgggtttcatcaagcctcagacattttcctggatcataaataatgattaagatatggagaaaatgtatattaaaacaaatataaataatctaaggcctggcctgtaaaatttgcatggatttttaagataaaaccagtctccaaacaaattgctaactctttgacttgtacttacagtcttagtctcaaactacattacctcttacacacactacattaactcttgagacgtgtgtttgccctcctctgtctttggtcctctggtggaaacatttaaacaagactgcactaaagcagttcacaggctctgtgtgatttgggtcccagtgagcagcccattcaagaggtcaacctataagaattcaacacacctcctagctgcgagtaaaaggcagcaagcagctgctgtactctaattcagctctgtctcctcgtattttgaaagactgaaagaatccccattgaaacactaaaacgtggaaaggaacagcaagctatttggacattatagttcctttggcatgaatatagtattttggtttcaatttcatccttaccctacgcaagataaatcattcacttcaattcactttaggagttgcctgctaaggggtcagacgcttcttttatattcagttgttacctgctgcctggaaaatacacacgataaagtataaaaaattccttttaccatcaggtagtctaaatgtaaagaatactcagaatactgtgttcaactaatagagtttcagtagtagagagggtattttcagaagtgctaacaccagttaatgaaagatcttctgttgagagaagcacgaaaaagccattctgtctttacacaaaatgactccagtatttgtggttaaacagctgctctccctttttttatggtggaactcattattttatttccttttacaaatatttgacgaattgaagaaccacataggcaaacaataattatgagaagttcagtagtcttttttcagttaggaattttcctttattgacctatgatataaattatgacatgaacacaaaagacattccatctttggaagtctagtggagtcggtttttctgtctctcattttcctcattccagccaggcctttcttagtaaaggaaaatcttatcactatatactatatttatttcctctataaaacattcttgtgattattcctccagcattacgactatatatacagatgttcattttccctaaaggaacatggaaagaggataagagtcattttaaagaaattgttgggcacaaactatgggacaactctgctaagctatttctcaaatttaatttaattttaaacatatgatagacattactattccaactttataatgtctctcatgcaaaatctatgctgaatttcaagaaaaatctgagtattaattatttttaaaagttaatttaacacctgtaattccagcactttgggaggccgaggtgggcggatcacaagatcaagagatcaagaccatcctggccaacatggtgaaaacccatctgtactaaaaatacaaaaattagccgggcatggtggcatgtgcctgtactcccagctacttgggaggctgaagcaggagaatcgcttgaacccgggaggcggaggttgcagtcagccgagattgcctcattgcactctagcctggcgacacagtgagacttggtctcaaaaaccaaaaaaaaaaaaaaaaaaagaaaggaaagaaaaaagggaaaactgttttaaaaatatcaacattgatttagtgttcatattcacaaataaagaaattagagctctcagttaaagtaactggaacctactagaaagcggcaggactatgatttaaactcaggcctgtcagataagaaagaaaggctagcaagataaagttaggtgagacgaactatagctttcaattctatctgacaagctgaatttgaatgaataaatacttgaaaaccaggataagttcttgagtagaaaggcaaggtaataaaaattatactttagaaagattcattaagtttatcagggacttgaattgcagggatcaaaattatacaaatcttgaaggtggcgaatatatatatatattttaacttaaaatatatatgtattttactactaaaaagtcctaactactacagcattaggactatatatatatttagggaaaactcttttaagttaaaatacatatatattaagttaaaatacatatatattatgtatatgcgtatatatacatataaatacatatataataaacatacatacatatatataaaatacatatatacatgtattttaagttaaaagagtcaatgttttccaaaataataataataatactataattaaggaagtataaccataattacatgttgacaataaattatgggacagttatagacataaaattgtgtatatttgtatatattaacatctatagctctatctatatgtctatcaatgaatcacagcagcaaaaaactgaggagtgactttacaatcttcctactatagaaaagactatttcataaattatgagactagatgtcctgttcaaataaggtcaagatgaacaaaaagagtcttgaatgagaatggcagaaagtgggatttagactggacacaatcttatccttgcaggttagtacaggtgttgcagtaagtagttcagctaagggtcaggtgtcttcctgattctatttaatctttcctaaaggagcttcctaatatcagatgctgtcaagagtaagaaatgtcaatttcatggttttgcttatgctgacccaataaaagaaagtaataagaacttcaagcttccttttgaggtctattctaacctgatgattttgtcatttttatgcttcatttcatcattgaaatactcacaatggtggcagatcctatcaatgacagttcagtggtcccagatctttcaattccagctaagataagattgttcttaagtgtatctgaaagtagcatggccgatctaattcacatggcagcatatgaatataagcattttcttctaattccacccaccactgctccctctccctgttgcttttaaaagcatctgctgtcacagatgcagaagatatgtcactatgaacaactgctttgtttgaaagagctgcatttcatgtctgtcatctctttaaagtaaaactcaagtccactttcaggtaactccagtgaaatgaagagaggaattcttacaaggtccatttttgttttaagggttaagcctgaaagaaaaacttgctatcttaacaaaccctaatgttatgttttttgactatatgtttgatgtatgcaaaagaatacatgtaatgtaagggaaagtcttgaagcacagtaatgaaattaacatcaactttaaaacctgaatgataaatattcttgtatgggttctgcttcattcttgtatctctgtatctcttatgatttaacaactctcctaaattttttagcactccttttttcattgtatggttttagtgtatatatacaaatctaccccaaaatattaatatattgtttaaatgtgcttctttttgaccttcataaaagtgttatcataccatatatcattttccttgacttgctcaacatcatgattccatttgattttatgtttcaaagattcattcatgtttatttttaatgctatatattattctattatgtgaatattccataaattatatttttattctcctgttgatataaatttgtattgtgctcacatcatgttttactttttccttttagaaacaaagctactatgggcaatggacatttacaataatttctctatggtatatatatctaagagtaaaattgctaagtcataatgttcagctttataaaataatgtcagtttgttttctaaaatggttatacccaccagtagtatagaagaaacaacctcaataacatttcacagtatcaggcttcctaattttatacctatataattgagtataaaatggtatcgggcttaatttggattcctttcttatacgtgaggtctggcattttgttatactatataagtattcactatttgtttaccttttcttttgaaatgttttgatgatgtctattgaacatttttctgttgtattatttatatttatttttatttttattgacctgcaagagttcttcatatattcatagctcaatataatctcagatatcttggatcaagtgatcctccagcctcaggctcccaagtaactgggactacaggtgggtgtcaccatgcctggctatttttttttaatattattattattttatagagatgggttcctgctatgttgctatgttgtccaggttagtctcaaactcctggcctcaagcaatcttcctgcctcagcctcccaaagtgctgggattataagcctgagctgctgtacctggcccagcattccttttttttttttttttttttttttttttttttgagacggagtctcgctctgtcgcccaggctggagtgcagtggcgggatctgggctcactgcaagctctgcctcccgggttcacgccattctcctgcctcagcctcccaagtagctgggactacaggcgcccgccactacacccggctaattttttgtatttttagtagagacggggtttcaccgttttagtcgggatggtctcgatctcctgacctcgtgatccgcccgcctcggcctcccaaagtgctgggattacaggcgtgagccaccgcgcccggccccagcattcctttaatgtagttgagttcaacatctttcaattattggttcatgatttttttaagatacgcttcctaatgacaaagtcataataatattatgctatattttttctaaaatgtttaatattttgccttttttatgtatttaatcaaaagtttgttcatttttatgtatgtgagataggaattaatttaatttttcgtattatatataattgtcccagcactatttaattaactcattaagtcctcatatatgaggtaggtactattaggattacttttttaataataaggaaattgaggcatgaataggttagtaaattggctctagaactggtgaacttaccttctgtttcaaggtccttttgtttgtttagccgatatgcttatctaatcctgaaaccacactgtcatcagaattgttttagtataactgatgtctgttaggccatgtaccctcacctgactcttcttcttgggattatcataggtattccttaccctttgctctcctcatgtacatttccatcaggttgtccagctcctcaaaaagtcctgttaagatttttgcaggaattgcattgaatctacagatcaatttggaaggaatatctttattatactgaatatttatatccatgaccatagcaggccattgtatttaagtcttctttggtaaatttcaataaatgtttatacatccttttttgcatatatttagtttgattaactcctatgtaacttattttgttgctgttgttttatttgtattttacatggagatggtcctccatactactagaaatagcagtgccttgtttaaatcttctgtaactttagtaattttttaactcttgacattaaaacgtatcttatagcgttaacgctgtgggcttacacctgtaatcctaacactttgggaggctgaggtgggtgaatcacttgaggccaagagtttgagaccagccgggcaacatggtgaaaccctgtctctactaaaaatacaaaaactagccgggcatgatggtgcatgcctgtaatcccagctacttgggtggctgaggcaggagaatcgcttgaacctgggaggtggaggttgcagtgagccaagatcgtgccactgcactgcagccggggtgacagagtgagattctgactcaaaaaaaaaaaaaaagggtttgtaattaattgttcattgtgatggtggatttattactttctctatgtgttctgtttctgtttatatacactaaggatattttattaaatatgcataaatttacaatgtatatttatgaaataagcatgttatgattatatcatgatcttctttaactctaatagtctattttgtcttgaagttgattttgcctgacatttataaagtacctcaactttattttatttagcatttgcctagtacatatttgttccatttgttaactttcaaatttttgagtctttatattttaggctcatgtatcatcatttctcagcctgttggctaagatcaagtgtaggcttctgtctcatcaaatggcatattaggtggactttaaaaatcatttaaatgtcaatttttgtcttttaactggcaagtttaatctatttatatttgtatgaatattgttatatttgaaactatttttctatattattttttgtttttgtcatacacttttgctttatatttgttattgacttttttgattgattagaattttttatatattacattttattcctctactaatttgacatttatacactatttctaatcttttaatggttacttcttaaattttgtcatacattcatatcttaataaaatgtaaagtttattactatcttaaccaatgctttgccatccccatcctccaaaaaagtacaaagacttgaaatctgattacttctgtgataatacagtaatcttatattgggtttcccaccttgatgggttttcaaagctcatcagtaaagtcagaaaactcaatcacttttttgcagacacttgaatcattttcttaaagggaactttaacctcctaatatcttattgttcactgctccctagtctagttcaggtcactggttttatgggagagtgtgagaagtacatatccaggtgacaactttttgtctgtgcaatttgagaggaaaaatccctttcagctattgtgattagaaagtagcagaaggaacttgagttacagagccagaaaatcccaaatttattttctttggcttatgtgtctggctttaactgagaaaggatctgagtctttttgccactgattatgttcatttctctccctcataggtattttgtgggagaacttctgatgaaaagaaggtacccaagactgctctcattccatcattatatctgacatctctgttacacattcccatgacccctgagccaaaatttatttattatcattttttactattaaaacagtaaatcaagcttcatgatgtatgtagcctactatataaatgtttttctgtcatgactttaatttttttctcatgaacgtttattttcacaaatgaaataatatatttattcttgacaatatttagatgtgtttttctggtttttaaaaaggcggttctggcatttaaaagtccccagtgcatctgatggcagacttgctccaagctcctaacatcacttagtgggcaggtttattccttggtcagattcactcctgcagtgatcggcaaaatactcctagaatttagctttcactcctatgaatctaaagaactccatgaaaaccttgctcattatattatgcagtccatgctatttagctctattcttactggttttaaaaaaataatcaattgcatttttgtaaagaaattggtattatttttctcaggagccccactacttcatgcctccttacagctcacctgaaccatggtgatcataactggatttggctttcaatcactcctcttttcagtgcacttcctattacgatagcatcactcctctgcttaacaagcccaaacattttaggatgacctacatagctgtgtgctttgtgaatgccatggccccagcatcattcctcttcattcctgccacacacactgttctaggctcaccaaatttattgacattccctaaatatgcctcactattctgcctctccattcaactaacatttgctgagctcctactatgtgccaaacactggagatacagagaataagaagatgcagtttgactccgcaatccatgctgtctcccaggtttagaataaccctctagcaactcctactaatcttccaaaaactactcacacatcatcttcttttcagccccacccccaaacacctcatttgcacaatgaatcatcattcttttgtattcttagtgtttctatgatggtggcaagataattagaatttgggtttgcattactaaattttttcttactccccaattccaaacagatagctatgatttatcccttgtctctggattctgacaaggctcaggacacactcaacctaagtttacggactctgaagcccttttgtcagaggcatttgaaccagagcagctccattttgaatacaggctggctaaaatgaggctaagacctgctgcgctgcattcccagtaagttaaagcattctaagtcacaggataagataggaggttggcacaagatacaggtcataaagaccttgctgataagacaggttgcaataaagaagccggccaaaacccatcaaaaccaagatggtaaactttttctagcatatgtgaaaaaaaaaaaaaaacaaaatatgggcaagcagcagcctttggggctgctttgtctatgaagcagccattcttttattcctctactttcttaataaacttgcttttactttactctatggactcgccctgaattctttcttgcctgagatcaaagaaccctctcttggggtctggattgggacccctttctggtaacatctttctggtgaccacagaagggacaatagtgaggaaacccctgacccaaagactaactccaggtaagtggtggggtctggtaacactttcaaagtactattctaggtatcctgactttggagagggagtggagaggttgtggctgaagggttgaaggtaaagaagaaagagagaatgtctttgagatgctggaaagtgagtaggggaggctgcaggagcttgagatgaaaataaatgtctgtgagtctggagagatagcaaatctggagaaatatttgagagttgcctgtggagaagtcaacacctagagaatgggattctcagctttgctaatgatttctacaccctaagtgtatcagaaaagcaagaaggcatgagaccatagagttttaagcaatgcacttctgtctccatgaaaatcagtgtaaggtattgatcagtcagtcactctagaagctcaatcctgtgaaaagtcattaatgtgaaaaatgctcacaacttttcacagtactaggggtgggaggaggagaacaaatcccttataactagaagtctagaattctcctagagaatattgagggttaaacattaaaaaaaagaaattttaaaaaatgttatacttaatgcaaacctaatcttttgtcttgagtcttatcaattacacattcttctattataacatgcatcaatatgttctataattatatatttacctgtccctctgtttgccagaagttttgaggacaggggtcatgtcttaatcatctctgtcacctccggctatggcacaagatttttcatactgaaagaactcaatgtttatgagacaattgtcccaaatcaccaaatatacatggaaataaactaccaagacggaatttattttaaaactcatttcttacaatacatttcccttgaagtgtttcctcatacttccatacacatgtgcaaggcaaatactgcagtcttttctaactggagtgtaccacctatgtttaatatttgtatagagtcaaagttctactaagcatggatatgcactttggaaatgttcatctttaaatattatctgagaaaacgggaaataacatgacatgtcaacttgtataatcaatgtcctaccctgttggaagggcaatagtaagcatctaggtttgcatttacacttgctgtcacacataacaatcactgtagggcaaatagtaattagtgtgtaatgaacagtgtccaaatgggatcagctcctgaattaccatttaaatgtggtaatggcagaaaacttgccacaattattgctgctcagcaagccccaagagatcccattcttctccaaagtcttaggatatttagcacatttctttcttagtgttcttaaactgttggctatgcttggcacgttttttctcccaagtaaataagctctgagattaggagacataactttagcttttaaaattcctgacagcgccttcatgctttgtaataggcaggcactcaataaacacacaattgttaattaatctgacagtatctagagtaacaaaactgtaaattacatcttgtaaatatttactttctatcttctaggggtgagagataatggctcgtaggggaaaatagaaaataaagatctaattccaaacactatgatttaagtcaatggtaaagtgctatagtctaacatatgaaggtgttccttaccttcatattgctgttgcatttactcaatagatgctgcatctctccctacccaacagatgctctggactatatagctgtgaataatgcagaagttcacctctcatagagcacgcaaacttttgaaggaggatattgatatactgattaaccaaataataacagaaatttaaagcctacgatgggtgatggggcacatctatgagatctgggcctgttcctaagaggtgcaaattgggaagaaaatgatgggacaaatcaaaaatgcaaactggattatgcagctctctgattcaaagactgctatacttccttatttctctcacaatagagtccaccttacttagtgccacacaaaagtttctagtatgaaggtcctgctccaatgttatctttcatcctctgctccctcctattagtagctctgatgtattgctgcaattaccttaacgaccatactgtcatactccatgctgttgtcatgttcatactcctgcccccaccctaaagttttgttataaacactgctatatatgtgtctctctgtgtgtgtgtgtgtgtgtgtgtgtgtgtgtgtgcgcgtctttctccactacataatattgatcagggaaaatacaaaagaccatgccttgtttttttttttttgttttgtttgtttgtttgtttgtttccctcagcacttagaagaaagaaagaactaacagtcaggtgcagtggctcatgcctgtaatcccaggactttgggaggcagaggtgagaggatcacttggggtcaggagtttgagaccaacctggtcaacatgagaaaaccctgtttctactaaaaatacaaaaatttgctgatggcaaatgcctgtaatctcagctactggggaggttgaggaaggataatcacttgaacccgggaggtggaggttgcagtgagttaagatcatgccactgcactccagcctaggcaacagagcaagactccatctcaaaaaaattaaaaaaataaaaataataataaaaaagaaagaactaacagcttgaggtactgggtgatgattcccaactttgctacacttagaattacctgggaagcatttacaactcctgatacccagtttgcatccgcaatcaaatcagaatctctgtgggggtaggacccaaggagcagggattttattatttttaaaatttatttttttggagacagtcttgctctgtcacccaggctagagtgcagtggcatgatcttggctaattgcaacctctgcttcctgggtttaagccatcctctcacctcagcctcctgagtagctgggaccataggcatgagccatcacgccaggctgatttttgtattttttgtagagatgggttcttgccatgttgcccaggctggtcttgaactcctgagctcaaacaatctgcccctacctctgcctcccaaagtgctgagattacaggagtgaaccacggcacccagccaagtcggcaggaattttagagctcaccggttggttgctaagtgtaatcaagactgagatccattaatttaagggttcaattacttatggggacatttgtgagtattgttgaaagtatatgatgtgggcaataagccagaactcactgaattaaagtatgagcaatgagaaagcaaaaagaaacaagtgttagaccagtagtatgctagtctcttgagagtctaggtaataccatttaggacacaggcatgggcaaagacttcatgactaaaacaccaaaagcaatggcaacaaaaaccgaaattgacaaatgggatctaattaaaccaaagagcttctacacagcaaaagaaactatcatcagagtgaacaggcaaactacagaatgggagaaattttttgcaatctatccatctgacaaagggctaatatccagaatctacaaggaacttaaacaaatttacaagaaaaaaagaaataaccccatcagaaagtgggcaaagtatatgaacagacacttcttgaaagaagacatttatgtggccgacaaacatgaaaaaaagctcatcatcactggtcatgagagaaaggcaaatcaaaaccccaatgagataccatctcatgccagttagaatagtgatcattaaaaagtcaggaaacaggccagtaacaggattacaggcctgtaatcccagcactttgggaggccaaggcgagtggatcacaaggtcaggagagcaagaccattctggctaacacggtgaaaccctgtctctactaaaaaaaaaaaaaaaaaaaaaaaaaaaaaaaaaaaaaaagttgggcatggtggtgggcacctgtagtcccagctcctcgggagggtgaggcaggagaatcacttgaacccaggagatggaggttgcagtgagccaagatcgtgccactgcactccagcctgggcaacagagcgagactccatctccaaaaaaaaaaaaaagtcaggaaacaacagatgctggagaggatgtggagaaatagggacacttttacactgttggtggcagtgtaaattagttcaaacattgtggaagatagagtggtgattcttcaaggatctagaaccagaaataccatttgaccgccaatcccattactggatatatacccaaaggattataaatcattctactatgaagacacaggcacacgtatgtatattgcagcactgttcacaacagcaaagacttgggaccaacccaaatgcccatcaatgatagactagaaaaagaaaatgtgcacatatacaccatggaatactatgcagccataaaaaaggatgagtttatgtcctttgtgtgcagggacatggatgaaactggaaaccatcattctcagcaaactaacacaggactagaaaaccaaacaccacatgttctcattcataagtgggagctgaacaatgagaacacatggacacagggaggggaacatcacacatcagggcctgtcaggggttgggaggctagggaagtgatagcattagcagaaatacctaatgtagacgacgggttgatggctgcagcaaaccaccatggcacgagtatatctatgtaataaacgtgcaggttctgcacatgtatcccagaacttaaagtattataatttaaaaaaagaaaaagaaaaaagagattctctctatagccaattatgttaggaaacatgccccatctttgatagcattagcatattgaagactgagcaattattcaacaaagaaacctgtttaacattacctaattgaatattttctaaatttatttgtcttcagaacactacttttcccatctaacacctattaattttcccaagaaatgccaatacattttttttaatttcaagaaattacatgagaatggcagtgcaaataatgatgtatcttagaggaaggaaagaatggttgagagaagactttatatccttagaataggaaataattggtcacatttgtagaatgaaaagaatgaaacataggggagggaggaattgaagatgctgtaacaagcaatgatctgatttctttagccctggtaagaaatgcacagttaaactgtgggtggattttcttttctcaagcctctcttctccattgatgacctcacagagtccagaagacaagggaacatggactggcattctaatgtaacattcattcatgcctcaacatttattgagcatcttctatgtgtctcgtctagacaatagaggtgactattccatttggaatgccaacaaaagcctcacccaaaaaatgaaacttaaattggtttttcaaaagtgagtggataattcactaggaagaaaaagaagaatatgaaagacagaagaaagcatgagaaaacaacaatgaaagaacaaagtagcagtccaaaaaattgtgactgaaatacggatgggactggtagaacatgaggctggaaaattagactaggccacacatatacaaaaactttaaatggcatgcaaaacaaacagtttgggatttatgaggtataaaataggaaaagacatgctatatttgtcttacagaaaaatcactttgacagcagtgtgagtgataaactggagacctgccacagagggactagtttagagcctactgcaattatggaactgttgcaggtttccatggatacaactgggtataaagtattatttagtaacagagcctgaaacatcatgtgatcattactggtttaaagcaaacctcctacctcaggatttgggcacctttccaaaatataaactcagcatttatatcaactgctgctatgaaagttatttgggatcatgtagatgacctttcatgcaaaaagtagatcacaaaatgtaggtcgttgaaaaaattacagcagcactttgtaaaatggagatttgagaagatactcattttatatttattttgggggtctcatacctatcttgaatatatagttatggtagaaaaagttctatttctgaagcacagtggtgtgatctctgttcattgtaacctccacctcccaggctcaagcgatcctcctacctttgcctccagactaactgggactaaaggtgcgtgccaccatgctgggctaatttttgtattattttgagatttggagagatagggttttgctatgttgcccaggattgtctcaaactcttgggctcaagtgatccacccacctctgcctcccaaagtgctgagattacaggcatgagccactgcacctggcctggcaatagtaccttaatgaaagacttagtcattgtcagagctacctcataaaaaggtaaatttcctttttctaaaaaaaaaaaaaagcttatttgttgcatattgaaataagcattcaagcaactgaaccttgtatgagatccagtgggagagtctacagacaccaggaacttcctggctctgcacagacagattttgcggagaaaacacaatcttgctctcaaggtagtgaagctttcataggttattactgtttcatttcttccggaagttgtttcaagctttatttaagattggctgaaaaaagcttactatgattcctttaaccataaataaagcataaaagaagaaatatcacaaaatcatccaaatactgcagatgctttcttggttttaaagtcacagattgaaaactggttttaaagcaggaggtataagcatttgatgctctgattattttttactttaaagaaataattggagttttagaagacttgaactctacagcatagagaaaccaacaaaaccaacctaataaaaatattgcatcttaaaggtaagagctaaaggaatattaatgtggaaaaaataggagccactctgaagaatctgacttaaatcacataggagaaaaaatattttttccacattaacacctagcattagctaattttaaggaaaaaagaaaacatttattaggcaacttacaaacttctctcatcagctgaaagaattatcagacttactctgttgaaatttctttccttcttttctctgtctctctctctctctctctctctctctctttctcttgacggagctttgctcttatcacccaggttggagtgcagtggtgcaatcttggctcactgcaacctctgcctcccaggtacaagcaattctcctgcctcagcctcctaagtagttgggattacaggtgtgtgtcaccatgcccagataattttcttttttttttttttttttttagtagtagagacggggtttcgacacgttggccaggctcctctcgaacttctgacctcaggtgatctgctcacctcggtctcccaaagtgctgggattataggcttgagctattgcacccagcctactctgttgaaatttctagaggaagaatggaatttcagtggcaaataccagctcaaggtaatgaaggcatttctaacaattagcactatctctagatggactatgcagcatttgagagggtgtatgtagtcatttgtgggtggtactctggcagaagctaagagaccatcatgcgtttgccacaggaagcatatgggtgaactagatgacctctaaattacttttgattttggaattacatattatcaatgaaaacgaaactgaggttgaactgttaacttaattgtacgaaatatatcactttccaaatccttatatcaaaatactatttctaaaagacttactatgttatgcatcaggcactatgctaggcataggggattcagcaatgataatgacagaatgaatctactgtggccagactcagtgactcacacctgtaatcccagcaatttgggaagctaaggcgggcggatcacctgaggtcaggagttcaagactagcctggccaaaatggggaaaccccatctctactaaaaatacaaaattagtcaggtgtggtttctcatgcctgtaatcctagctacttgggaggctgaggcaggagaattgcttgaacctaggaggcagaggttgcagtaagccgagattgcgccactgcactccagcctggatgacagatcgagactctgtctcaaaaaaagaaaaaagaaaaaaaaatgaatgaatctcttacgcttatggagctttagagtctaactgcgaagacagcaaagtaagcattaattacaaggagggataatgatagaggaagtacttgtatttctcctccttatgaccactattattattagacagactattttttttccaaaaagttgatactgttctcaaaagcactctgtttctacaaatgctagaatccaaaaattatgtcaaaatgtctttttaacatgagaacaatgatgtcaatgatgggtgaaatgataatgagtagaggaagatgaaagcatacatatattcttccagtctctggttttcatattatttgtaaggcatggatgcttttcaagagaaaggctaagatgatatggcagtggcaaccatgaaccattaaagcagcagttagagttactagatgtaaataaagaaaaatctatctccaaaagcttgctttgaactttataatgggtggattgcactgatatcatctgaatccattgatcaattacagcatcagtaaaagtaggacaagaaggcatcatttgccttcagtaggaagtatggagcaccatctatgaagtattcttgccatttgaaaccataacaacaacaaaatccatttaatgtaatcaggcctgtactcctaattagcaaattacaggaacaaggacaggtgaaaagagaacaaattaaatgataccatgagaatagtgcttaatcaatctatgtttttcttttcatattattaaaactccaataaggtaactattactgtgcattttcacaaataatgagaccaaagctcagaaggctttattaagatatccaaagttgcagagtaacaagctaagataaggtttggggagtactgtacctaaattcacaggatgtgttttgcactgggcctcactgccccaagagagattatttcatccactctcattttactgcagcacagaaggactaagccctttgctcagaaaccaccaactagtacttgcaggatctaggtgtagattacaggttccttaattccaaattcagtgctcctctgtccctacaaattataaatttgggcaacccttgatgcccaagctgcaatatggatcagttaaatcagattctttgagggttggattaagaaaccactattttctaaagtacccaaggtggctccactttgcagctaaggttgaaacactggtgttatgatgcttatttccctaatccaactcagctattttacattttatctaatcctattcatcactaaattctgagaatttcttcccaggtaccacgcttatctaaactatattgaaaatatcagtgtatgaaaggaattccacctcctctgataatattttagttactatgtttgttaaaatcatataacaggccaggcacagtgactcatgcctgtaatcccagcactctaggaggccagggcagaaggattgcttgagcccagtaagtttgataccagcctggaaaacacagggagacccatctatgaaaaaagaaaaacattaaaaaaaaaaaaatttagccgggcatggtgtcacatacatgtggtcccaactacctgggaggctgaaggggaaggattgcttgggctttggaggccctggaggctgcattaagccacgatcacatcactgcacttcagcctgggtggcagagtgagaccctgcctctaaaaataaaacaaatcttggccaggcacagtgtcacatgcctgtaattgcagcactttgggaggcaaaggtgggtagatcacctgaggtcaggagttcgagaccagcctggacaacatggtgaaaccccatctctactaaaaatacaaaatttagccgggcatgatggtgcatgcctgtaattccagctactcaggaggctgaggcaggagaatcattcgagcccgggaggcagaggttgcagtgagccaagatcatgccattgcacagcagctggggtgacaaagcaagactccatctcaaatgataataataataatatgataaatcagatctcaggacattaactgagccttgttttacgagggactatgaaaactgtgtcatatgtcagcatccataagcggtgctccctcttctacttctgctttcacagtacagacccatctaggcagaatcagctttctccaggcatgttgggtcattctcttctttcttgctttagtgccttgtttttgtgaagagctgagcagaaactgcccctctgggtagactcatctaggacttactctttctattttaaatgctttgtgtctaaatttgaatggtgtattcatacatcttagttcatgaagaaggaaataggatgcctattttacacctacaggcttaagccatatggatttctcagcttttaccagagctgtgttttgggagcatttagtattcaggtataaagtggtactctgaggccaatttagcttctatgccttatgtatacattccgtaattagaaattccaagggaagccagcagtggggctcacatctgtaatcccaacactttaggaggcagaggcaggcagatcgcttgagcccaggagttcaagatcagccagggtaacatggcaaaaccccatctctacaaatggtacaaaaattagccaggtatagtggtgcacacttgtagtcccagctacttgggaggctgaggtaggaagatcacctgagccctgcgaggctgaggctgcagtgaatcctgatggctgaggtaggaagatcacctgagccctgcgaggctgaggctgcagtgaatcctgatggagccactgcattccagcctgggccacagagtgacaccttgaaaaaaaaaaagtaagaaggaaggaaggaaggaaagaaagagaaagaaagaaagaaggaaagaaagaaagaaggaaagaaagaaagaaagaaagaaagaaagaaagaaagaaagaaagaaagaaagaaagaaagaaagagaaagaaagacagaaaagcaagcaagcaagcaggcaggcaggcggcaggccggacacagggaggagtatgaatgtcagggcaaaaatagggcatttctgagtccctagccatcataccatcaatgaagaaaataaatttcaacctaaaccctaaacatttattattattaacttgtattggtagttttttaatcacttacatgacagattccacccttcccctattctctccacaatactgtggggacagcagaaatattcgacagattattaaatccaggattattgaggctaagtaacttgttctgtaacacaagctggttatgaggatatgactagaatctatctgccttcaaatataatgctcttttaacataccttgtttattttttcaaattcattcttcaggaatttaaaaagggaatttatcatgtataaatataactgcagtatttagtgtcaagacctcactgcttaacaaaaccagaactttattcctcttataggatagcatttttgggtatttcttggataacaacagtaaactttgtataccaaagaaatctgcgaaatgaaactatgaattatcactattaattaaaaaatgagaaaaagaaggaaataattgccttttacaacttatccctcaaaactggtacatggtaggtgtccaaggaatgtttagataattgctatagaagttcaaatgctcaaaggataaatggcttaacacaaggtaaaaataaaagcttacagtagagaataattatatttgactaattaaaatatgaactttgctcacttcattgtgtttggattatatgtataaaggtagtgatctagctatgctgaagctatctctactctgttatttttatgtagaagattgtacacaggtaacccgcatatattatcaagcaagaataaggagaaattatatttggtgttgacaggttattctggaagctgtagtgatacatttgccactgaaagaattgttttgaaacacacacacacacacgcactcatgcacatacagagaatattgctcttcattattgacacattttttccaataataaagataggcatcaacatgtaattaagaagcattaggaaaaatacccgtggaaactacaattgtgagaaaaattagtacattttctggaaagaaatgcagtgcttccatgtatcatctaagagctttaatccaacaatcatttcatctccagtaatttattctaagtaatcaaaagacaagacaggcaattttgcataaatatgttgaagagagcatgacttatgacagtgagaaactggaaattacctaaatatccaacaatacaaaatgacaggatttggtatctcggtagaattgaatcttaatcacctactaaaatgtttttaaagaatatatagtgacaaaataattacacgtgatgatgttaaatgaaagatccaaagaaaatatgcctacattttgacaatgtttatgtaagtaaatttaaaaaatatatttcagtttttacacaattgtagtttacaaattttcttgaataatcatgactatagatagaatattgggagaacatattatttattaatattgctaaaggtctgtggtagaaaatagactgaattcgtggttagaaaacctgagccccaaatgaatacacttgagggttcatctttgtgatcacaagccaattatttaacatttggggtctcagtttacccttttgttaaaagagtagcataaattccagaggtctagaattcaaatattttcagaggtccatcagataatataaaagcatcaggaaactcagattcagacattcattcaatgaagaaatattgactgcttattagatgtcaggctctgtgctggacactgggaatacagtagtgggagaaatagaggtggctagctgcttatattgtgatcaaatcttaatattttcctagagatggagaagtagggtaggacacagtaaaatagctgcaataaaatcaatactttgcatgcagtgtctcagtttattctctaaacaactctaagaaatacctattattttctccatttctccattctactggtgaaaaaaaaaatagggaatttaactgacttgcccaatttcataaaggtattaagtaacagaaagacataaagtaattatattaaataatgaaaactttgtgatattaaacaattcactcaatctttctatcagtttctaaataagaaagagacaaaagcttgagtagatttccattaagctttcctttcaattcataaacactatgattctattttcaatctaaatttagctctgtaaaccatataccagtgatcccatctacatatattaaaacaacctattttcctattatcaccaaaaagcaagtgtaatttgattttgcttttatgtccctttaaggatgcagtgggagaaatagagtgatcaccttggggctctggaatattctcatttggagtctacttttgattttgcaaaaagtcagcttcctcaatatgttatcagctctgcagaagatcttaaaagtctgctgacaattgtcacctcaaacattaattcattcagtgtttcttcacaacagagaattactgttgctgagttaaattaaatgaaaaaaagaaaaagtgtaaaacaatttaaaagaaactaaaactcaaactaaatgatagacatgaattagataatgttcttctctgattgcattggtgaaattagaaaattctaatttagaatcaaagtccagcttatctttgaaggaaatagaatagaataaaatactgaaaaatgaatagctagcataaaagcctaggtcaaatgtaacatcaatcgagcatcttcttttagtcttctactgagaattaattgctctgttcatggttctcctagaggacattataaatgctttagaaggcttattagtctgtcctgaactcgtttatgtaactgtctctaccaataaatattgagctattaaagggctgtggccaggttatttatatctctatgcacccggatcatgatggtctgaacatagcagacattccatatatatttctaaatgaaaaaatgaataattcaaataaaattacatttttctattgaaatgtgacttttcctctacttgaatatgacctagagcaagccatttacctctagatctcaatttgctcatctgtagaagcaggtatgcatctgcatcacctctaacataaagttttagatgtgaaaggatgcaatcaatctaagagccatttaggataactgtggaagaaaaaagataaaagacaattcttaggggtcaacaataggttcaaaactagtcactcatcctcttaatggcttcattttcctagttctcaatctctgaacctgagtcatctttgactctcactctttctcattcttctttgttaccaagatctatcttcttagttctcacaatatatcttatctcatgtattggtttatgacaagattatccaattcagtcattttataaacatttattgaacacctactatctgccagacactgtgctaggtattgtgggtactctgatgaactcagtggcttcagcctctgctcccatggagcttatattctagtaggatctaaaaacaaacaaatattcaataatacacaatgattagtttttgacatggaaaaatggcacctatcacatgctggaataaggaaattttcttaaagaaatgatatcactaccaccacaatgactacacaagggatcatcatcatcatcatcctaatatgtaataagctgctactaatttatccttaaattgttataagataggtactattagtcctactttacaaataaggatagtgtatctaagcaaaaataacttgactaagattgcataactaatttaacatttaactcctgagtctgtgaccttgagcagtaacactgcttaagatattctgataccagaggaatcaacaggaataagaaaaagaagagctcagttaattttccagaagtaagaataacatgtacaaaactcaggagatgagagagaagaatatattaagataattgaagaaagttcagcgtgtacaaatcctggggcagtggggagtagggtagggaaagtaatgataagataatgaagctagagatgttagcagaaattaaattatgtagggctttataagtcaaattaaggtatttaaactttatgttaaaggcaactactgcaataggtatcctactggcattcatttcatcttcctgatttatgtgaggctactgtcattcaggcagtgttctaagtgctagagatggcatggaacaaaataagcaaggtccttaatctcaggaagataatttaaaaaataaaccagaaagtaaaatgtattgctaagtgctacaatggactgaaaataggatgtgacgggaaatgacaaggtcaacaccagatgatattaaaaggtctctcagaggacactgattttcatctttgtctttgtagtcatgatggtttacactcaaagctgtagccaaaataatgtttgtgataatctcttctaaatagtttttcaaaatatattttaacaaataatatgttcctttaagaaaggtcgatagatttaaagtaaaagggaacttttaaaaaatttctactcccaagtgataattatttttaactatttggtatatattcttcttgatagtttttacctaaattaataatataaatatttgttttcacataaatgagatagaagttactgtttggtatttgttttggtttgttttttaacatatgataaatattattcaaggctagtacataaaaatataattcatcattttggaaaaccataattataagcattttgttcaaggttaatgccataaattatttaaaatattccaattaatgggcatttcctttgatgccaatgtaacagtactaggcaatatactactacagattgttatgtatgatcattcttgagtatttctcaattgttaccttagcatgcatttttagaagaattgccaaatacaagggtatgcacatattaaatactgaagtattctgtcatattatttcccaggaagtctataccaagttatagtctcataattatgcacaatttacatcaatgataatagttacttttctatatcttcgtcagtactaattattattaatcttttaaaatacttattaatctaataggtgaaaatgccacattactttaattcacattccattgctaacactattcaacatctttgcatataagcatccatttatgagggacaatctgtaatgctacgtaatcctctgcaaaaaaaaaaaaaaaatcctagaactcttcactgtcaattgcacccatttataaggaaaaatctgtaataccatgtaatcctctgcaaaaaatcccagaactcctgtctattagaaaggtgtttggacttcttaatttgacattcatgactctctgcctaaaatttacctttctaggcctctggtctgaaatttccttacatggctcctaagttctcttcaaataggtttgctcactgatctttcattatacttttctttcccacatctgcacctgtgatcatgctgtggaatttacaaccccatcattcaagccttagatcaaattctgcttctctccaggaaaccattcctattattctagtcataactgacctcttttttgaatgtcttcagtgcatttctttttctcctcttaaggcactgatcacattctacttttctttgttttcctagtagattgttagctatacaaaagccacctttagcatggtagctggaagacagtagctactcaaatacttctaaaagaaataattgattttacaaaaaattaattctatgtattccacacctcagagtgcattaaaaaaatgaaaacatttaacattttcaacaggattttaattttaacagtggaaagtatacataatttaaatgcacaatattagggaagtggataaaccgcagcatattcatggaattttatgcgtacatgataacaatttgtaaacagagagtacagaaatgtatataatgtgtgtcactgttatgcaaaataaacaacacacacacacatggaaatactccaaaatataaattataattgtctttgtatggtggacctcttctaaatattttttctataaactttcctatgctttctaaattttctatattaagcatgcatggtattactttaaatagctttatttccatctttctttaaaataagtacaattgcaaaactgcaagataaaatttttaaaaattaattgatggattaaatggcaattgtgacacataagtgaaactgtctaaattccttttggacagctgacaagaagataaatgcctctgtttctatattcaagtaaaaacaagtgcactcgcattatgaaaggggagtgggaaggaaaaggaaaatgatctttatgttcttgctacagaaacaagaaaataaaaaggggaagaaaaaggtcataggagacattgatgcgttaagctcctctttctacctggtggtgtagtatcaattctgccccaagaccagttcaatcccttcccccctggaaaatcttccctggaccctcgcatgtaccagtctctactttctctgaattgtgttttatttactacaagtgtcatatttgaaagcattttatatgtttctaaatcatttctactttttaattctttctccatatccaggatccaaggtcatcaagagcagggggccatagagcttaattttttttagtgttattcaagcatctaaaacagccagacacactacatgcttagtaagtatcttcagatgagcccttttcaatgagatagtgagtcactggaatgtcttactgtaaaagagaaagggatctaaaatttattgagccacaactataattcaagtgatttacgataactattatatattttatgctaactcttaaacaaggtattctctccacttgagagtcagaagcaagtatacagatagaacttatttccacgaggctccaaagtcctttcttctaccctgtaaagttgagaaagccacataaaaccttccacttcttgatgcatagccttgcttgagctaaactagagcaggctataatgatgtcctcataaggaaagatgtaagatttttgggggggcagggagagcagaccagtaaatgtcatttctgcaggaaagtgaagtcagtggacttttaaaatttcatactctgtctcctgaacttattaaataaagagtcaggtaaagatttctaatattctaaattcagtttactcctttttttaatgaatataattcctacagtgggaagtgcatggactctagagcaagacagacctaagttcaaattctgggctttacctcctcctatctctgactttaatcaggttattctcatttatctagtaagtattgatccccatatctaatgaaagagacaatcaccccacagagttgattcaaggttgaagtaaggtaacctaatctctaatatggtacctggcctctggtaagcactctaaaaatgttagtggtctcccctcatcccaacatcctttgtcctctgagataagaatagttctttactgcagacataacacatgactctaacaaccagtctctctgaacagcttttctttggtttggtgacctaaggagaaggtcttgtgtcagataacaattcctgtgtcaagataggcttgagaaaagcaacctctaaccacaaattgaagacaattccttataagcatctctctagaggcagtgagcaacaggagactgtgcgacttttgactttaaaggcagcaccaggatccaattcctctcatacacagagcacctagcaaaggccctggcactggccagtgagcagtattagacatgtggcccaactcattcaaggcaaaattccttcttgaacattttataacacaaaagacaaaaataaacacaatcatatctgatcctatttcttctttgtttgtgtgtttgtttttaccacagtccctagagatacagacttgacctagggtagaaacaagctgcaccacctccagcaatggttctgaaaaggcactcttcacacacttatctgctgaagcagtgactcatgaaattcacaacgtgctaagattcggtgagaaacacttcatatcaaattaacataagcaaaaggttacttgagggaacactgcactacttttttaggtgacccagttatggctaaatttggaaagttggcaaggctgattcttcccttgaaaacagatctcacagaaatataagatactatgaagcctcagggcccagttttttgccgtggcatccatagtgagtagggccacttgacaaagtcagacactgtggatgtgtctggtcacttcaggttgccactgagataaccgttttctagagtatgctttgtgagacagaaatcagaggacaaatcaaactacaaacaattaaacaaaaacttaaatactgataagtatatgccaagcactgtttcaagtgctatgtaaatgtttattcccataataatcttatgaggcacttactattatctgctccactttttaaataagtaaattcaaatagaaagagggtcacacatctagtaagtggcacagggccatagatttagtaagtggcagaacctgaattgaaacagaggcagtttggctccagaatctctgttcttgatccctacgctgcctcttaatgctacgtgatgttactacatatagtaagacaacacctaccatttggtttctggcacaaagtgtctctgggaggcaatgcattggagtggtttagaatgctgactcaagagcaaactgcttggcttcaatcctgcattctgatctcgagagctaagtgttcatgggtaagttagttaacctctctgtgcttcggttttcttatctatatattgggtgcaataatagaccctatctcagtggctttggaggactaaatgagttaatacctataaagtactaaaaacattacttgagaagtagtaataatagtcaatagttgttaagtgttattgtttgttaaaaagagagatactatcttgtctcagagttacaaaagaagcaccgtaattctcgcagtttttggtgagaagacatagtagttggaaaaatataaactgtgctatctgatgaactccagttaaggtcaacccaagccaatggaaaccttgggaaaggcacttaattacactaggcctcagtttctccaactgccgatgattaacacacctctgccatagatgggatgaaaattatgagttaatatgtataaaaattggaaaatgaaacctttgattactgataatttggtaatcaaataggattatcagattccctgccttcccttttttatgattggatatactagtagaggatgttgagtgaattagccaaactccagcatcttttgccaacataaaatgacacatggactggcagcatttaatggttaggcccaaagcaatctcagtatttaagaatattttaaattatctataagaatataatttggaaacaatctaaatgtccagtaatagggggtatgataattaaatatatgttggggaataggttattctatgaaatcctttatgcttttttgcctttaacccaacaattccacatttataaatttatcttatggcatactactacttgtatgctaagatacatatgtagggataataattgtagcaatattaataatagcaaacagctggaagtaatccaatatttatcagtggggcactgatgaaatacataaaatgagatatgtggatgatactgaaggaaaaagcttttcatgatgccacctctgaatattgccagtaatatttgttttattccttatatttttgtattttataacttttctataataaacatattaatatcataaaattaatactaattattattctgtagtgagcatatattacttttgcaaccaggtaacaaatattttttaaaaattttttgcaagattttttttgcccttaatacttcctatgagttccttaaataaagaaaaattttttaaaaaacatgacaacttcatcaatatagtcatatcaccaggtcataaaaggttccagatagtgacctaaaccagaattatcttggaagagaagtcaggtggattggtaggtcctatccactgaaagacacaaaatctactccactactgatgaataaagggaacaaggggtaagccaatggtggaagcctgaaccaccaggtcaatggcaagcccctcccctggcctggcctccaggacctgttgacagtgtccttgccctcctcacttttccttccctggccttgccaatcctgactttatagcttcagcctattcatcttttctgggagaggtgacccaacccaagggtaacagcttgagggtgtagcacaggccattcattcccagaccagcatcccagtcatacatagccacagattactgttccaccttttctccctctggaattcatacacgctgtttcctctgcctgaaatattctcctccctctcctgccaagtttcttcacctggatctttcttctttatttatcaactcagatgcctcttactctagaaagtctaccttaacacattagtctgggatatgtgtaccactgtctgttagatgacatacacacacacacacacacacacacacacacacacacacacactatatgtttcccaatggtttatgcctctaactgagctaaacactccctattcaaatctactatttacttaccggcttctcaaataatactgtcaaatttttgaggccaaggaccatgtgttattaatagttttgtccttagtaccaatcaaagttttggcatatagtttgaggtcagcaaacatttattttattgtatgaataaataaatgatgagtgttaaaggcaacagacaaaggtccatatgccagtttctacattgacagtagagaaaacgccatttactaagaagaaaaggaagtgctgagtagtgactgtgtgaccagtgttgtcaactattgaacaatatggttaacagtatatacagatgaacagagacagttcatgaggtccctggaagcctgatggggtcagatgcttgaagaagcttaaaattctatcattattagtctcctgcctgagactcttgactttaccactctaattgtcacccaagtgcctctatgctactatttttatcagtggcccaagtggtgatgccaggaaaccagtaattaaaatcatttttttaaatagctggtaagtcagctatacacataactccacctcttaagaaacttaaatgaggagtgactacaaagatttttctgtgccattcttgcccaaagaaagatactttcaccattagtagactccaaagagaaatcaaagactatacaatacctttatgccaaagatgttcactgcaatgttgtttatgctagcaaaatatctgaagcatctaaacatacagcaatgggaagagttgtaaaaataatgatgcaatggaaccattatagtgagatttcttttcaaaaagatacatcattttttacaactattttgaagtataattgactaacaacaacctatttaaagtgtacaatttagaagttttgagccatgccaacatctatgaaaccattagtttaatcaagataatgaacatatccattgctctcaaaagtttcctttgtactctttccctttacaacttttctcatcctcaagcaagctttctgtcactacagattgagttttctagaatttcatatagagggaagtatagggtatgtactcttttttagcctggcttttttcatttgatatacctattttgagattgatttctatgttgcatgtgtcaatagtttatttctttctgttgctgaatagtatttcaatgtatggaagtgtcacaattttttttttcagtagaacctgttgatatatatttgggtatttccaccatttttctattacaaataaaatactatgaacatttagggagaagtcgtcattgacttatgtagacatacgcattcatttctcttcagtaaatacctaggagtggaatgactaagttgtttagtagataacgttcatgatggctagcaatgtggaaagtgcttatggttaacactaagtattatataaatgtaagatttaaacatagccatatgaaaatgaaaataagaaaatacattaaagctagagtggtagtttaatttgtgtggtaagactaaaggtaatgttttttcttttcttagttcataaatattttataatatggttatattatttttaacttttttaaattaaaaagaagtaataatatttgttaagcaactactatgtatatacacatacacacattcctttttgtctttacagcttcataagataatttttattggttcaattttcacagatgactcaatctggactcagaatgattacgtcatttgtccaatacaccagagctagtaagtggtgtggctgtgatttgagtccaggtccacctcacaaaaaagattttgttcattccaatatgtaaattcttaatcatggatagcagctcatatgtctttataaaatggggtacacagttggaacctcacgaatttctaaatgcaaatataaatgatcaagcttctgttgaacaactctgtcctgcattgctccgtgaggcagttgggctgatcgagaacactgcaagacgctggggactggcttgatctaatttggaatcctcctagcaacactatcaggacaacggctctctcttgaggaactaagacttcacagaatgttcaggaaaaccaaatcaggaaggaaatatcggtattttatattaaataataccatgagatagtttaaaaacaccagataacagtttatcataactatattaggaaaagagtctctgtgatctaagtcatcaaggagacactccattaatggcaagttcccacaaaaatttcagactaggttagcagatacagccagttcccttcagaggagagaattgctgactcttctatgccctacctactcagcttggacaaggtattggaacctctctgagatttggtttcttcaactgtaaggtgaagaaaatagtatctattaaaataatttattttgctggttaattgacaaaacacaggtaacagttatcatggtgccctgcacatagtgaccactcactaattatcaactactcttgttattgccatagttgttttgttgcttttactaaataccacagatacaatgcctaattgtcaagacaaaaggatgagatgagaaggatacaaattaaaagttttttatccttctttagaatgcttcaatctctttcagaacctactactctaaaacttgctatctcaagtcattaaaccttacaatggagattccttgcctaagagcagctaatgatcacacttagagaactcacatcagaaagtacattcttaggttgaagtgacatcatatggtcaccaagttggaggcagtcactgataatacttttatagatcctctctttcatatttgtaaagtgggaccttgcctatggatcttatgttatttctgtaatcagatggaaaaagagatatgaacacatttgaccaatagtaaacaactgtgaatatgtaacaacagtttcagtgaagtaagataactagcactgtgtattattcaatcatttattaattttttcaacaaatatcttttgattgcatagtatgtgccttgaaccctgccaggtgataggaaaataaatggacagtaagtccagtaagtagaagcaaactataaaccaataagtgctgtgttgatataaaataatagaggctgggaagattgggaaaatgagtatctttagggagaggtggagaatgtcagtggcagctttatgaaagaggtaacgtctgagctgacactgcagcataagccaacagaagaaaccgtgtgggcaaaagaagacatgtaaaagcctgacacacttgtggaaggggcaattaaagtcaaggtcagacagacaaggagaagctagaccatgacttgcctataggcaaatattatagtgtctgaattttaactaataccaacagagagaaataggttttacataatagagaaagcagattaaatctgcatttagaacaatctttctgtcagtaaagtgaactgtagtcagggagaccagttgtcttggagtcagacaagtaggtgctaaatagtgaatgacaaatatatatacattttttacctgtttgttgatctttaaaatatttccctgtctatttaacaaagctgttatgataaacaaagtcatcttgagattatgggagtggaagagttttataagatgaagaatgctatataacacaagatgtgtcatgattaccgttattttgtcttgccattttgaccatctggacaatcaattcagctatagctactaaagcagttacatcaattgtgctataatctacatctgctgttacaggactttcaaagtagctatatgagccctgccatggttcttcatttttcatgaattaatccagtaagaaagaaataaacataactgatagaactcttaagtgaaagccacacttaattcctcagccaagcattcaagcaggcacccaattcataaggatgatacaaattcaatggaatattacccccttgatttattctgtcactacaaatggttgtgtatgacagttatgtgaaaatcatgaaaagtattatgtgtcataattgtaattctggggtagaggaaccaatgaaaaataaatgtagctttatttttattggatgagtctaatagccacattaaacatgacataaatttgatttgcaaaagtaacattgatcaatacctaacacaagcatcgcacacatagtataccctcaataaatacagacatggacgcaaacagagttaccagaaccatctaacactaactactaattactgctcttggtcacctgaaatgttaaaggtatggaaatgtttgctggaaaaggtttttatttctccaggtagctaataattcttcttaattttaggtacacaatacagcctttcattaaggcattatttgttaaccaaatttgtcattcagaatagtaagttaacaatgattggacacagtccttagctatataagtgttgtatccaggctggctgtcattacagcatatactcttctagtatcattttttttaggggtcataaagggacagagttgccctctgtttccatctaaaatattgctatctatcaaaataccacaaaatagaggctggtgacctgattaaaaagggccctatgatattttgtctccaaattatctgaaattattaaatttttaaaatccctactcagagaaaatttcaggacaaaaacggtaaaaaaaaaaaaaaaaaaaaaacttcattccagtaccccatgtaatatttccattcagtcatttatcattcaacaatatccattcaacatatgtcagacttcaattctgggtataaatggtaaagaaaaatatatatagtgacgaggttcatgttcttatggaatttaccattcagtgatcaagacagacattagtaagcaaaggaatatcttattacaaatgacaaaaaagtactatgaaaagtaaaaacaggattgatctatttcagactggaatggcaaaggggggtcagagaaggctaatctaagaaggttacatgggttgagataagaagcacaagaaagaatcagcaaggtaaaaaggtggggcagttgtaggaaggaagagcttgtgtttcagttttcagttgacaaaatctggtctttgtagttacagataacctaatgggtttgagcatttactttccaatttaataaactataaagtttgtgggactgaattttgatatttgttttatgtacaatgaaatattatttcagtaaacaaagtacttgaaatgaaataattgaataggcaggggaactgtctgaagtattgttaggatgatgattttaaaataatgatgagggtacattttagcactaatagttgcatgaccgtacagtttggtggctttctataattcacaaagcactgtccagtagaataatttaattgaagcctctcataaaatctcacagtgatgatgtgataaaatgaaaagagtcctaaattttaaatcagaaaacccacaatatagtttactactacttgttggctgtacagtctttggtaaaccacttaggctcagaattagcacctcatctaatgaaaaatgaattgatgataataacaccaaaattgcctacccttgcactgtcattatgaagacaaatgaaatcacttttgagaaggtgcttaacaaatcttaaaatgtaatataaatttaaggtatctgaagttttattattgttagtctcattttaaagtggacagataacatttccctcatttttccaatgggtaaactaaagcacaggaaaggtaaataatttttgcaaagaagcattgctagaaatgtgaatcagatatcatcatccagttcttcctcctctcttccctttctttttttttttttaattatactttaagttctggggtacaagtgcagaatgtgcaggtttgttacataggtatacacgtgccatggtggtttgatgcacccatcaacccgtcaaccagattaggtatttctcctaatgccattcctcccttagccccccacccctcaacaggccctggtatgtgatgttcccctccctgtgtccatgtgttcttattgttcaactccaacttatgagtgaggacatgcagtatttggttttctgttcctgtgttagtttgctgagaatgatggtttccagcttcatccatgtccctgcaaaagacatgaactcatccttttatatggccacatagtattccacggtgaatatgtaccacattttctttatccagtctatcactgatgggcatttgggttggttccaagtctttgctattataaacagtgccagaataaacatatgtttgcatgtgtctttatagtagattgatttataatcccttgagtacatacccagtaatgggattgctggttcaaatggtatttctggttctaaatccttgaggaatggccacactgtcttccacaatggttgaactaatttacacgcccaccaaaaatgtaaacgcactccaatttctccacatcctctccagcatctgttgcttcccttttttttatgttttcattcattcaacaaacattagactattaggatggccatataattcatcattaacaatgggcacttttgaaaataaaagtgagcactactaatgggtacactacgaagaagggaggtaaacaccaggactcttctggaaacctaattcatatggtcaccctaagtaatatgcactggaaatcaaggaataaacaaaagcagcctttgccctaagagtctgatttaaaaaataggtaaaaacagtcaaagaaagtaatgcagtgttgtaaagggtaaaacaggtatgtgtaggtagttatgggaatttgaaagaagggcacttaaaccagtcttgggggcttaaagaacacttaaaaaaggaagtgatctgtgcactgaaacttaaacgctgaagtatcctggtaggtaaatagtaaaaagcatctgaagcagcagaaagagtctttaaaaagtgtgtcatattcagggaattgtaactatttggggaggagcatataggttcatatgagtaagtagaaggaaaggagcttggagaagtccaaagaggttgaacctggggtcttgatgcttttactaaagggattgtacttaatcctgggggctaaaggaggattttgaagcagggaagcaacatgatcaaaatctatattaaaaagttcccacttccgtcattacagcacacaaggccctcactctggtgagccgtcctgctataatacgtcaatggttttaatacattctaaccatcatccttttaatgaatctcagccatgtaagaatatgagaaaaataagcaagaccaaaccaaatgacacacaaaatcctatcaactaaaaccagaaaagtgggctgtagcaaaatgaaagccagcatgcccagaggaaaaatagttctttcaggtctgagatcagaaaatttgagaatctaaagttaagcaagactctcaaaagggaccaaagtggctcaaactcagaagagtcttttggctccaatcaaaaaccaagtctaatcttctctggaagaaaacgtctccatattgaccctgaaaattcccactatttaagtccagcaaaaatatgagaccaccatcaaggagataggatgaaacagactactatgagtgacaaagtgtagaaacaacagatgtagacttacaaggactttagatattaagattatcagacacataatttaaaatagccatgagtaatatttaaataaataatgaagaaaatatttaaaaatatcaacaaatccactacccaagaaggcgattgtaaacagacctctttgactcattgatagatgatgtaggtacaaatttagtaaaggtatagaaaatttgaaaaatgtaaacaattaataaacttacctaatgaatataattataaacttgcatccaataattacagaacacacatttttcttaggcaaacaaaaaacattgacaaaatattcaccacattctagattaaaatgaatttcagagaatagttaccataaaaagttttctagatattattaaatcagaaattaataacacaagaaagaattcttagggaaatttaaaaaaattttaaataacctggctcaaacaaataaatatttgtaaataggtgggttggaatgttaatttaaaatactgcatatcatatattatataataccaaagcacctaaaatatattgaaataaatgtataaatgtattgtaatttaaattgttaattaaaagaaaatggcagaagtcaatgttacatccctctgaaacatttatgttaaagcaggttaaagccccaaaagtagagttaataataataccagaataataaaattaaaacaaaaatagtaagaataaaagaagaaagaaaaaaagagaaaatgacaacactagggatacaaagttgcttgaactagcacaccccaatcaatataatcacattaacacaataggggagaaaaatcatgatcatctcaacaaatatagaaggaaaaaagatactattcattatcaacaataacaacaacaaaaatgaagagaactgataaaaaaattctcgaaagtttttcaaaattaatgctttttttaaatgtaaaatatttaaggaagaaattataaaattgtattgaaagacattaaagatctaaataaatgcaaaaatagtctatatttataaatagaaaaattcagtatcataagaaatcaatcttcccaaattaacttataggttcaaagaaattccaaaaataaccccaataagaattttcacaagtttccaagttcatctaaaatgcacatgaaagaataaaacctaaacaaagacacacctgaagaaaaataaaatggaagaatttgatctagtagacccattttaataataatttaaatttttagttaatgtagtaatttattataaagaatttttaattaatatagtattgatttggcacagagataaacaagatgaccatgaaacagaatacagaacatagaaacaggctcacatagtatagaaatatgatataggacaaagtgagcattgcagataagtaaggggagaagaaagaagtgttattcaacacatgttgctatgagaaatatttagttatttggaaaataagaatacaaaataatcaacaccagactcattaaatacttaaatataaaaattttacagttttatatctttatgatcttgggataggaaaatattgcttaaataagacagaaaatgtgtcaactataaagaaagaataattttgatcatattaaaatgaataacttaatctacaaagtgggagaagacatctatgatgaatagtggatagtatccagaagatataaagaactcttaaaaatcaataagaaaaagataatacaatataggtgtaagcacacagcaataaaccattattttacagaagcagacacatgaatgctgaataaagatatttttaaaacctcaatagtattcctcattctgaaaatataaagaaagaactcaacgatatttttgtacttcataagtctgataaaattttgtgttgatgatgtgaacaatgcaaactcttaaacgcttctagtaggcagatgaatcggcacaactactttagaaaacaatttgacatgatcttgtcaagttgaataggtgaaaaccatatgacttagtaatttcaatcctaaggaaacttgtgtactgataccaataaaattgtgcaaaaataaatgttgctgcattgtttgcagtagcaaaaattggacagaatcaaagtatctgttagcaagagcatggaaaaatgaataaatattatcccagaaatattgcacagagtagaaacgaacaatatactactacatgcaacaatggggatgacttttaaaagcattaataaatgagaaaagcaaattgcagaaggtgaaagcacataaatagaattagggaatgggaaaaggtaccctcaaaggtaacagcattattctaattcttaacttggaggaggggcttatggtgttggttttattattatactatatcatttccactcatatattttagttattaaatataacagagtaaaaactatggaagtttctttataaaaaaattcaatgtagaaaaattactctggctactgtgagaagaatgaactggagtagaggaagtctggaagctgggggttaattaggagattattttcatgctgaagattatggtgtttttaaaaagataagcactagctgtgagtatggagaaggaatagatggatttcctcaatgagtgggatcaccatattatagattcatgttttggcctgaaaaataaatgagcctcccatgtacgcctcatttgttcactcgctaattgaataaaatatttataggaagtcagaattaatttaggcacatagagaaacttgctaagaggtcaccaataagattttggagagaaataaatgtacaagctatttggaagagaactaaaagcaggggctgctggctgactcactaattggttggtcagttcctactaatgggtatttgcaattacctgggcaaagcatccaagtgggctgctggggattttaagatcagcatcagtagtaactgtgtcataggaatagcgcaagggtaagagtgtgtggctgtaagatgcttgggggaagggtggcaggagggatttatttgctcagaacaccgccaagctgaaaattgtcagcacattgggctggaaaacaattctacctacccaggacaaagcacaggtaacctataaatagaaagttgcttgttgaaattgtacattagtagtacaacattttgaagctgttactggactccttaagggtcagtaagtaagtaaaaagttgcggaccgcactttcccactttacacatcaaagggggcattgtttgatataattttgacttaatagtttgtccacagagaatgggctgctttgtatttagattttgctacaaaagcaatctttgggaaacctagcatgattaagggaatagaaagtgtcttcctttgtgtcagagaaaaaaatatttatattttggaagtacctttatcctgaataacttttttcctcataactatcagagataaattggtatacttccagttcaccaccagaaagagtctttcttgataggagcatatgactgtatagaatgctatacaacatgctctgacagcagcagagatttactgatattgggtattacgagtgtaatcagaccaactacaaacattcttggatatgaaatccaaaagtcagattccttcataagagtctgatcccacagtggactgaaaacttcatacatcagtcctgcttactgaatagtatcaactttagcacacactgattttgagaatcaatgggaccagcaacacgtgttaggtgtttcacagaagtggaggggagaacattgccagggagacttcatagcaaaggtgactatttagcttgtgattgaaggatgagagcattctatgtgggttggaactaatattccatgcagaagaaatggcataaagaaaacattagacatggtcaaagaatgaggaaaaatttactatggctatagcttagaattgaaggatcaaaatggtagatcaagacctaaacatggaaagctttgaatgccatgtatgttctagctctgttttgccggagatggaggatatcgaccactgtgatacttcctcaaagctctttcaaatctatgctggagatttgagagataaaccaatctctggaaattttatcattgtgctatcccttacatcaacttcctcctttttagtttcatagcctccaatctagtgcaggcccttattaactctagcctcttaactttgcattcagtctctctgctttccagtggatcctatcagttgtttgaagagtactatcccaaacaccacccttttgattatgctgctcttctgtttatcattacatgactccctactgatgactggatatatcccaactattaataacttcatcctgagttttcctacctacatgtatttacttatgccattccctccaccatgtggaggataatcaacgtaatgaccccaccttttttcaagagggaaacggcagaccttctgatctccccgacacaaacttgctccctccctatcaaaattctactcattaaactccactcaaggaaaattctttccatgaaaccttcccagacctttccagctatgtaaaataataatcagtgcttatgtagcactttctagcttgtataacactttatagcttatggatcacttatatcattgaaagtatggcagagaaatattattataatattatcacagttttacagatgaaggaatgattagagaggttcagtgacttagtgttaattatggatcttcttactccagatctcatggtctaaactctgtacatcattcttctgcatttgaatttttgagaaatattaactacacacattttaatagttactacctcaattacttgtttttaatacaatgcatacacatagtatttaataaacaaatgcaatgttaatgtacccaattcaaatgattccaatctaaaatagacactggcttcttccctaccaccatagtatacatacgtccttcccaccacaatgagaatattttttctcttcatgtgttacacaattacctcagtattgcaacaactattatactgtaattcatttattatcctaatattcttctctgctaggtcctaaagtagtccagtgattgcagtacatttatttttgtatcttcaatgccttactaagtgctcacacataatatgtactcagggattatttactgagatgcttactagaataatgaaccataacagaaaatctttgaataatgtaggatatggtcagacatccatgtgttggattcttcaacttgagtaaagatagggggaagaaatcgggaggtgacatctaggttctaaaaactttcctgttttgttttgtttttgttttttcaaagaacttgagaaacttcagcagtgtattttcctgtttttcttttataccatgcctatttctacagaggatctgaggcattagtaccatcataatacctaatgttattactcccacgatcactaacgccaccactatatttacaagtaattctaaaatgggataataacactttatttcaataactaaattgatacatataaaactttaacacactaaaaccttgtaaacatcttacaattgattgctgtcatgattatttatattatttttattatcactattagaacaatggtcagaatgactactgtagttataactcctactaggagttctcatacattaagcatttattgctcaggtactgtatgaggtctatcaaatcattattattaaccttaataaaatcctccaagagcttcactatcattcccatttaatagagacagaaactagggactaaagatttactcatcaagctcttccccatgacattcctccttttattggtcctcagcattttcagtgaacatcacaggtcaaatagtgcaagcactccccactttaacccacaccactccctcatcttaagactagcatgataaaattatcaaataatacagttgactctcttctgagagttacctctcagaagagagtcaaccttttttttttttttttttgagacggagtctcgctctgtcgcccaggctggagtgcagtggcgggatctcagctcactgcaagctccgcctcccgggttcacgccattctcctgcctcagcctcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccgagagtcaaccttttattcaagtcaaaagtccttaaaaatttgaagaatgaaacatctaaaatttcacattactccccctgaagccaatgcatgttcctaggacactattcatcacagatgactctttaccacagactacctgttactggcaactgcactagaaactggaaaccataattgggctggattaccaagtggccgctccatttctcctgaacaagctgcttccgcattacttatgactagttcccatcaagactgggataattatgttatttctctactcaaggttactctatatgtgtcacctagaaatcaaatcaagtctgaagtttcttctgggagcatctgcttgtaacttccaggtactctgagaacacaatcttatgatccatgaaatagattccctaactaaaagccagacctcatttctgttggaggaaaatgataaaaatattgaaacttcagatggaaacaaagttggcctgcattacccttattcaagatccaagtgacagacacttccctaaaaatatcggtatgatgaaaatttgaagtctgaggttatctgaaattttgactatttttttgattcatgaaccttgtatctttctcatgatgggccagactatagtttaacatgtgaaagaaaatcatgttatttggaaacactagtcatttagattataagagaataaccacaagtgcagtcttctaatcatatcaatattttctcttttctcttaaattttaaatgtgaaatttagtgggatccttaggtcaggaattaacaattaggtgccaagcatagaatgtatttttctttgtctttgtcaccattgtctttatcatttttatcataataattatgatagtaactgctattgcttattgaggaccgactcttttgagactagttcgggtgattcagatctattatcttttattatgaaaacaatatgaggcaggcgtgttgcccctgcattaaataatatggtcctctttcaacagtactaggagatcttaaaagaacatatgtataacttatcagtggtttctaaatttacattaggtggagtaagaagcacaccattttctgtgaggagcccttatctctggtacccctggcaacaaggtcctgagcatgattcctctttacttcaagacacaacactcctaactcttgaaagctggggtgggagggaagccatgggtagcttgcacaggaagtgggaaggtctatgtatctggaatcctcctccacatcattgattcatctagcaaatgtgcacattgggaagcatgtgggacttagggaggaaagttggtggagccagtcactgcccatgactcagaggtctgaaggtggcagagcttcttgatatgtgaggctaaaatatattttggcctgaaactcagagggaaaaaaagaaagaaaagatccagtccttattaattaaaatgaaaaaggcactgcttataaaatcagcaacaaggctgaaggtagggaaacacaaagttagctctgcactagcagggaagagctatgcaagaggaacatgtacaggagcagcaagacccaactacggcccaaggttttctaagcagtgctctagaagcattttctcctccacacctgctatatttatatgctctttttggaagccaagtggctcatcaattacatattttattttattttattttattttattttattttatttttgagatggagtctcactctgtcacccaggctggagtgcagaggcacaatctcagctcactgcaacctctgcctcccaggttcaagtgattctcctgccccagtctccctagtagctgggattacagatgcccgccaccacgcccgctaattttcgtatttttggtagagacagggttttgccatgttggccaggctggtcttgaagtcctgacatcaggtcatctgcctgcctcagcctcctaaagtgctgggattacagcataagccaccactcccggcccaattacacattcaaaatatccgaacacagtatattagcaacctaacattggcaatgtcagagacattcactttaaacacaagcctatgcacaatcacttattcaacattctcagttgttatttatatattttgtatcctatatcatttgctgttagtaaattgaacgtaaggtttcttgaacccacaaaatacagaaaaatctctaatttccaattccatttctgaactcttacagaatttacacatatactacaaaaattaaattagtacctaattgtaaaaccccatattattctgttactataaacgaacaaattttgtagcattctcccccagagtactgcagcggaaatttcagcaaaggcttgtacccaaaagtagaagcacaggctgtggagaaagataaacctgagtttgaatcttgtctctcaacagacattagctatgtaactgtattaggctattcttgcattgccataaatacctgagactgggtaatttataaagaaaagaagtttaattggcttaaagttcttcaggctgcaaaagccagcatttgctcagcttctggggagtcctcagggagcttttactcatggcagaatgtgaaacaggagcaggtacttcacatggtgaaaataacagcaagagaaagcggtgggaggaggtgccacagactcaaacaaccagatctcatgagaactcactcactatctcaagggcagcaccaagccatgagaatgcaacaccatgacccaaccacctcccacaggccccacctccaacataggggattacaattcaacatgagttttgtcagggacatatatgatccaaactctatcagtgacaatggtaaattactagacctcccaaaagttcaaatgtctcttctgaaaaatgactatatatatatgtacacacatatatacacacatatatatatatatatacacacatatagatatatatatacccccgaggaggttattgtgactattaattagcatagcacctgtaaaacacttaacacagcacctggcacagattaggagcccaatattccttctttctctctatcctcctcctttaaaatctattattcaacattgccaaggaactattctctggttagtccaagctctacatttgttgagcacctactatatgtcaagcactacactgcatactggcaatgcaaaaatcaaaaggtttacaatctctgcccttgagatatttgatgtttgtgtaaattgattgtatgttccttaatcaaatagctatattccaaattatcctagaatatttcttgttctttacataccaatcttgactctaccacgcacttttattataagaactacatagtttcctgaatttgatgcatttttgcttatcttcacatctttgcacatgttacgtcttctgctcagaaatgacctccacctggatatacttcaagtctttctcagaagctttcttgaaacttgcatgaattttgaagagcctctctactttcatgacaatctatgtgattttttgtctcagaagtcacttggtgggttggagacaaagatgtcagttttatgtttaacttctttataaaacagaaaccaacctgagggcaaggatttttaaattattcatctttgtgtttctatgcttagcaaagtgttcaatgaatagttggtgatcaataattgtaaaatgcataattgagtgaaatgatgaatagtctggctgtgaccgagattgaaaaagagaacagatgaccagtattctccagcacactaagcaggttttgtcagttcatttgtctagaacagcccccatagctttctgcacacggccaggtctctctgacaagaacatttggtttccaaattacatattgcacagcatgaatccttcctttcctgcaactgcctgttaattatagtgccacttttgctctgtctttgtctcaatctcctaatctctgagatataatagctgatttacttaggattttctgagctttataaacaaattctgcaacccctccccacatacatcttcttgtaaaaacaacaaagaaaacaagaaacgtctgttcagagttcaaaagtaaagggaaatataagatcaatacaaaattatttgagactgaaaaaatactcccctttgttcctttttttgttgtttttattcacatgtaattgtaaaaaccaacctgctttagagagtagctgtggaaatgctggggagctgtcactggagattagcagcatctccaagctcttgaagctgacagctcctagaagccaactgagagattcagctgaagagttcatttgatcacaccggcagaaatgcctaggaaatgtttctgctcttcatgtgaaaactttgaagagttcaagttcttccttaggttataatatttagcaagtattctaacaatccctctgtcattctctattttttcagaagagatacctggcccatcttattcatttgtgtccccagtacctaacagaacttgacaaattaagtgttcacatacatactcaaaagctcaggcaaggggatatgactgagaaagggaagaaggaaaaggcagacgaacggagagagggagagaaagttacagagatagctgtgaaaggggagaaaaggaaaagtggaggaaaagagggaggaaagaagaacaagagaaagggaaaatggagaataagttcctctacttttttctcataatttttacaagagacagcatcttaaaataaatataaaacacctccaaaatattcatagttactgtgagagcaaagcccctctccaggcagttgttgactcttagagccactgaggtacaatagagacacattccagatgtatcatgtttgctttacctgcctcttgccttggtctacctaagaaggatttcaggctcaagtaatgagtgatattcttcaaccctttcccttactgacccatcaagaaatccttaacgccacccaagaccatcatctatttagcctcagcagatccagtggtttcctaatagcctctagggtaggggaaagactgcaggagcctatgtctgagtaaataactcagaaggggcaacagaatcttgtagaaaccatttgggacatttctccacccctgttttcatcctgaggttaggtttggggtagctcttttttgctactatgactcctcctttgatctaattttcaatccaactctcttttgctttagaatttgctgtgctcttaactgcaagtccttcattttctcaacatttttaaacatcatgagaatttaaatgtaatttgttatgtgacaaaaacagtaactcttgattgtaggaacttaactataaaaaatttaaaaataaatgcatgatcttatctattaaatagagccactgatagtatgttagtctttaatgtgcattgacacatatatttgttgtcttaagaataagatgatactgtacatagtttctaatctgctttttctatctgaataacacattataacaattttctttcattaaaaattcacctcaatattattctgatggcataactctttatgttccagcaattccttgtaaggaaacagggagtgaagaaagctctggaactctagcagtcagcctcactgttcacttcagcctgcactcactgttcctgtttttcctagcatagcatagcagccagtcagaagtatcacctgagcatttgtttggtttgtctgtttcaggaaatatgacgccaattctatgaacttggtctgggtgattcttaaatgcatttctctctctctctctctctctctctctctctctctctctcacacacacacacacacacacacacacacacacacacacagaaaccacgttttgtttctactgtgagccatccccacagagtatcagtgtagaaaaatgctgttgaatggtaaacaaggctaccaaaagtaatggcagggagtacattgcaaataattcactagattatgtgtgctccttatggagcagagactctatcttttccatttttatttctctcaggcttagaccagtaattagcccataaaaaaaaatctaatccattaagaaatgtttatctaatgaatgaatgaataactgagagaatggacataaaccataattaagaagactggtcataagataataaaattttctgaccctatcacattattttgggaaaaatgaactgtgctatagagaaaatgatttaagatttagacaagaaaattcatcttaaaacacacaatagcaatacaatgtcactaaatcctctgttttctgtcaaattgtcacaacaataaagtgtccttatagagatgttgcagtgatcaaatgagatgacagtgtagggaaccagggaaacttggaacttcaaaatgtcctaggatctcagcaccaagacgatattacaataggccatacttcactaccactcccctgcccaatacatacacataaaaagacaacagtaacaatacaacaaaataaatatcttcactgaaaagaaagttttaaaatgggtggcaaggaatacgggtaccagctggtgctatttcaggtaacatgaaatagtagaaaaaatgatggatttaggagacagacctaggcacaaattttggttctgcctcttcttagctgtataactttggacaagttgtttaacttctctggcatagttttttctttggtaaaatttttataacaactgatgcttcctgggattattatgagaactaaataaaaggatgagaagtccctaacataatatatattcaataaatgtcatttcacttgcttttcctcactgccacaccccaggctttgcctgaaccagtgagaggaagatgttatttatactaaacagttttgcctaaggccttgcccaccatcagacctgaataccaaactgccaaatggaagtttgctgtgttgaaatacttataccagacttcaaacatagaactcagaggttattctatcaaaagcttagcacttgtcaacaagaacagcagagactccagaactcttttcagtcttgctttttttttttccaagacagaagcagacaaatcctcattgatcattctaccgaggtagctccaaccctccaaaataatatatttaaaatcacaggttattttatcatgtttgaagaaaaaaaaattactggaaataagaatctttattgactcttttagttttaaggtcagttgacccagaaaaagaagagtgctccgtttgagagtagagtgaaactctgactgaaaaggaagaggcacactgcaacatgtaaatttgatcccattttacaaatggagctaaaaggagcatttaccatagtaagctgacagcctttagtaaagtcaggtttaagtttgaagagttccaacttccactaagtgaatcatgtctagcagtggagacagatgattcaagcaaatttcagaccattcttctaatacgcttaagccatccctgaaggtaaatgttaaaactatttaatacctgaagcttcagaatttgtggcttgggctttgcccttagactttttggttgctactggaaataagattatattttaaagtttcttctatcagaaaaagcaacactccagaatttttacatcctttagttttactgcacgcaagctcctgtctttgggtaataagggtctttcctattcacaataaaaggacacattaaatgtataccttcttcataagtcagtagctatgaatgactttgagcaattccatagcttttctttcttgagtaaactcctcagcatcaaataggactctgctcctgagatgaaaagaagaaagactggctacccagaataattcaaataaaatgatgtttatgatccatgtatattaatgtagccatttagagaaagtcagggctatttataatcattctggactttctccaatcaattatttccctgtttgaaactctttggttgctcttatttttagaacaaagttcagacttctcagcatattatacaaagcttttcttgatctggtcctttcctacctttcccaacaaaatctgaaactctcactttttttcctggacatttcatttcagccacacttaactaccagccattaccatgacttctctgtgcttttttctaacctgtttcctcttactgtgatatgcctcctcttctcacccaccccctacctactgcaacacaggtttctggggcctaaatatatcctactcattcattgagaatcaactcgtgcaccacttactccaagaaacatttcttgactgcctcctcttcccctatccctggatgataggaatctgtcctctggtctcccacaacattgtttatttttatcacagcatttctcaccgtgtattatgactatttaaaaaaaaaaaaagttccttgaaggtaggctctgtgtctcattcttcattatatattgatacagagcctgtcacacggtagttgctcaatacactgtcattgttattgatgaatgcagactatgggccaggcttgtttcctagaaacatacaagttcagggccatccttatgatgcagggactgaaccaatcacacacactggcctgctctcgttgttgggttcttagtaaaatttggactgagtgaaataacaaaggcagctgtaacaagaaaatcattataataataagaataagcaagtaatcacgggcaacttcctgcctcactgcaataactggaacaggataatggggagaccagaattattggcacatttagccatattctttaaagaaaaaaagcatacatacatacatacatactaccaaaaatgctctgtacagctgctctatttgcacttgaggcatctgcagcttgggcattaaaacatatgtgaagagtatgtcaggcgatttgggttgagaaatctggatttgagatctttgtttctaaccatctgtattgtcttcaatcagccccttcatctccctgattctcagtcttttcctcttacgtgatctttgatctcctttttagttcaaaagtctcattcattttgacattctgagttggtagagcccctgacacacataaagtattcaaaaatacataacaaatagtaaaattaagtttagcctaaactgtctacttatttaagttcatgctaaagatttcttcatttatagtggactgtaacttaactggatgtgtaaacagactacaacctactctttatcaaccagtttcagccagtcacaggcggacaactattcaaactgtgttcaaataaggcaaatgccaagctgtaaacaatccagctgtttctgcaccttactttcattttctgtatgtcaccttcatttttctgtccataaatctctaactatagagctacccagagtctctctgaacctattctggttcgagggactgtttgatttatgaattgttctttgctcaattaaactttgttaaatttaatttatccaaagttatccttctgactaaatgaatgaataaatgtcactctccttccctgtctgcttttggggttttgcagaatgagccacagtaacaaacttgaaggaggctgtgtcctacaagcattaagagcttcagcagctcccactttcctctcaatctgcttcaacaagccttttaaaaaagtagcactggagcacaaagtgggaaataccggacatcctcaaggtcaacaaggaaatggagaggcaatagatgaagactacagggtcaatccagaagttcctcagaaaagcacaataattcaatccgctggaggagaggatgacaacaggggcctctgcaaagagcaagtgatcctttgaagaaaacaaagcttcagtttcctcaagaagttcttcagagaaaagcaaaacaataacaacaaactttcctttagctcttcccaggcagcgggaatttcagacagaagatcagcatatttgccctcaaaagccacagcttgggtgtgcccatgtgaccagctccactgggcatctgttggcaggaagtccaatgctgcctttctgataaaggcttgatggacagcccttctatattccttacccacccttccttggggccaatactgatgcccattaccactcttggcttttaacctaaaagcccaatgtctactgtggtcttaatttattgcccagtagatgctttaaaaggaacgtgaaaaatatacaggcgtgcacggaaagctaaagcatttagaactttgagcatcttccttgtaataaatacctaatacatatgtgttaaatagtttatttgaactataaaaatacaagtataattattattatttaatacttgtatatatattttctttccattcagctatgcatttctctcattattttgtttaggaccttaactatgaagatagtaacaaatacaaaaaacaaagcacctatatttctaggcactatactaagccttcatacacattatttcacttaattccctcaaggactctgtcatcttcctcattttacagatgaggaaagtaaagctgagagaagttaagaaacctcctcccaccaagatcacatactaagaaagtggtatggccaggatttgaagtccacctctaacatctgtgctcttagccacaacaccatactgccaaattcttcttcatacattcttcacacaaaaatgtgtaccatgacatttaacaataaacagtttaatcgttaattaaaggataaatgagaaacagtgaaaagccaaggacaaaatgtagaacttggtagtttaccatggtttgagaaaaccaatgagacattgtttgggaggaaccatgttggtgtttctgactaagttagggtgcatgtataaatttccctttcttccctttgctaatctggacaatgcagattaagtttttcttttgcttacagaatatgagtgaaacaaatgtatagtcacagaagtatgtatatgcacatgtgtgtgtgtaaaaatcaaagtttgaaatatatcttctgagccttcagagattcatttggccgagaaatagccacagtcctccctaaaattctaatgcctaggatttatatgctatttacacagattaagaagtattgaaaagtagtataactgtgacattgaagttaaggagactaggattcaaattttgattctgctacctaccagctgtgcctccttggccaagttattcaactactagtggtctgggtttccatttctgtgagttgtggagagtaaaatctaccttgcaggattattatgatgtttggagatagtttttgtaaaattcttactgtcattttgggtacaaaacagacacataaaaatgacggtttttattatgctaggcagaggaaacatcattttcctattctggaatgcacacctgacaaacttctactcattatgtaagtcttaattcaaatgttatatttatttattctattaacatttcttaagaaactaatataatgctctttgctattataaggtacttggagaaaaaagttataaacttaagatctctgatctcaagggatgcacatttttttttttttttagagggcgttttgctcttgtcatccagactggagtgcagtggcacgattttggcacaccacaacctcccactccaaggttcaagcaattctcctgcttcaacctcctgagtagctgggattacaggtgcccaccaccacacctgctaatttttttttttttccgttttagtagagacgggtcttcgccatgttggccaggctggtcttgaactcctgacctcagatgatctgcccatgtcggcctcccagagtgctgggattataggtgtgagccactgtgcccggctgggatgtcctctttaatggacaggttaacagaccattatgtgaagtgtggtaagtgtccaaagaaagcgatgtccagtgggctttgcaggccagaggacaggctacaaggagagtcagataaggccacctcgagaagtttacaaagagtttcccttacaaagattatagcaatgattatgaaaagtttcccaacagccccaggctgtgatcactcttttctgtgaacccaccacacgatgtgtatctctatcacagcattgtttatattgaactgaatgtttaattacctagctctgctgctagacagtgaacaacttgaaagcagtggtcatgactttgactaagatgaattttcagcatcccccataggttctaacctagagaagcagcctgataaatgcctgaaagaactgaattgaattgtcatggacctctgaaaaggcaggtggttaagtagcaggacaaactataacccaaaactgcagctgcttgggatctaagggagacaagagagggagaaagattacttcatttgttcttgtctggggaagttcagattcagagcaaagcaatgccaaaggcaaaagtgccaggcactactctctagacatcgcagctcattttgttttgtggtctgtgattgaactctggtttagatctgatgtctatggcctgagatggctcttagtgtggagcttttggtttacagtgcgatgcagtctcttcaaaacatgacaccctggccaagtaagaggtaaaatctgattcttacaagattttctagcagaactcttaagtttttgtgaggcttaaaaaaagttaaacatttacaacatgccaatatgaagctcatttagcctctgctaatgacttcagtggctttcttaactatgttactttctgtctggtttctctaccttatgtttgccttagagagctggaatgaaaacgtgtttgcttgtttggctgatttcatctttgatttagcagttccaacctctactttcattttgatccaatattagatgtgttgttcaattcattgtcttgaaatcttgccagattgcaaataagcaatttcaacaagagtaataaaaatggacagaatataaggaagaacatcaattgtaatccttgcttaacctcctgcatggtccaaatgtgtccttggcaccaaatggaaggtgaagaggaaatataaatagataatttaactttcattaaaattcagtaataataccacagacaagatgggaaagagaaatgatatcagcatttagtgtgggtttactatgtgccaagcactgtcctatgttatctcatttacatcccatggcaacctaacaaaataggtgacagtcccatttttggaagggaagaagttaagaccaaaagaagttaagatgaataatcatttaagattaaaagcaacaaaatgatgaagctataatgtgaacttctttgtctgtctggctttaatgtacatactttatccattataaggttaaatgagtgttattttttgaaattgctcaactagccatactttttgtttcattataaatttaataatagaaccatagtatgaagtagaaggaacagaggaaatcaaatattccagagactccataactcaccatgggacttaacacagaactctgtattatcttcagaaattattagtttgatttcatatttgtgtgtgtgtgtatgtgtgtgtgttcagcaaattagagtgttggtcaacatgccgttgatactgcattcatagaattccagtgtaacaattcataccttcattagcttgttggctatcatcaccagcatatttacattgaaacactgaatataattcaagaacctctattggcacttctgggatacccaatctgaggaccactgataaaatctgagagcactcagtgtaatttcacatcacgtctgcatgaaaatactcaacttaggtctttagctctctttaacttttaaatttagttattttatcaagtatgttatgagttccttctcatttatttaagtttcctcattcagtaaaccaatattatgataataggatcccagactctagcatttggaaagagttgcttatttttgacattttggtctaatataatctgagtgttattttttgaaattgttcaactagccatactttttattttattggatgttttatactgaacatatttttcatgttctgaaatggcaatacaactgcagcatattgcagatatctgtgtttttttttttttttttgtctgaaagtgaccttttgattattttctttttgtaaaaccaaagaatcattaaggcttctacaaataaagcataaacaaataatagctgttgccatcttataacattgacagttctaatacttattataaaggtttgcttgacctcaagccttgtaaattgtatgaaggaacactagaccatttacttccagggcattggtgaggtcataaggctaattactaagactaaaacccaatgctcctcaacttctcaacttacatctgcctgctacttggtactacctctggagtcctaatttcaaacattattagtggctcttcccaaatgagcaaagacaatcacacatgggccctgggttgctcaatgccaatgctccctcccagggtcatatctgctttctcagttccctctcttcttgatatatccaattccttcctatgctcagtgtacctcccactctcaggctgctcagcacacctgtctgagtaggcttcctcatccctccagactgacaatagaatttcctcatcatccccattctattaatttcctgaagataataagcctatgaactatttcaattctaaaatttttgcttcactctttgccacatctatggcaagaatgaagactattctcagcaatcagactgtcggcactccagaaaatgtcaacgttactctgaagggacacacagttattgtgaagggccccagaggaaccctgtgaagggacttctgtcatatcaatgtagaactcagtctccttggaaagaaaaagaggctccggttgacaaatggagaaacagaaaagacctggctactgtctgtactctttgtagtcatgcacagaacatgatcaagggtgttaacagtgggcttccattacaagacgaggtctgcacatgctcacttccctatcaatgtcgttatctaggagaatgggtctcttgttgacatccgaaatttcttggatgaaaaataaatcctcagggtttggataaggccaaatgttgcttgtttggtatctcaagcccagaacgatgaattaatctttgaaggaaacaacattgagcttatttcaaattcagctgctttgattcagcaagccacaacagttaaaaacaaagatatcagaaaacttttggatggtatctatgtgtctgaaaaaggaacagttctgcaggatgatgaataaggtctaagagttgcccagctacagaaacaagatgctggatgattcctaagacctatttgtgatatataaacaatacaataaaagacctattgatggccaggcatggtagctcacacctggaatcaaagcactttgggaggccaaggcgtgacgatcatgaggtcaggagttcaagaccagcctgaccaacgtggtgaaaccccatctctactaaaaatgcaaaaattagccaagcgtggtggtgcacgcatgtaattccagctactcaggaggctgaggcaggagaattgcttgaacccaggaggtggaggttgcagtgagctgcgatcaggccactgcactccagcctgggtgacagagtaagactctgtctcaaaacaaacaaacaaaaaaaaaaaacaaaaaaaaaacaactattgatttggaaaatttttttacatttaaaaaataaacaaaatttttacttctgatcacttttccctctggggaaactgatctggggaaccaggtgttagagtcacacacagtccatggtctcttttccttaacactgttaacagtacagtagttaagagaacagaccttgaatccatgctttctgaattttaatcccagcttctgccacacagctgcatatccttcagcaaattattcaaactctctctgtctcagcttcactatatataaagtgaagataacaataatacctcttttaaaagggttatgttgaagatgacataagttaattcacataaagtctttaggaaattgcctaacccatagtaagcgctcaataaatgttagctattattagctactattgacttccttcagagatgtccttctcagttgcccttcactttgatttccggagatgggcttctcaaagattccccttccttctgaatccatccttaaaacaagctcaaagcctaatgatgagaaaaactgcatgtttccgggagagtcagcaactctggggtgctccaaacctggtgtttttctgtatagtagcctggatttgacctatctctccctatatgcttcgcttcagtgaggcagcgtagtttaagtggctccaaggccagactacccagttaaaaactctggctcaattctactttcaagcttggattaccttgggcaagagcttaatcttgctgtgcataataacagtacctaactcatcagattatgaagattatatattagttcaatatttgtaaaatgcttagaacattacctgcatacaataaattctatacgagtttgttgaataaatgccagttcctattagaggaagtaaaaatgtccatttttgtcaaagaatgaaactgtacatgtgtggatatgttatatatacacacacacacatacacacatccatacgtatatatgtatatatatgtatgcatgtgtgtatgtgtgtgtggatatgttttatatatatatatacacacacacacacatgcatacgtatatatgtatatatacgcacgcgtgtgtgtgtgtgtgtgtatatgtagagtgtgtgtgtgtgtgtatatgtagagtgtgtgtgtgtgtgtgtgtgtgtgtattaaaaaaagacaggttgatttctttataagtttctacaggagcttgaattaccaaaccttactcctaaattaccactaaaatttcctcaatgactttcaaacttagagtaaccaattcatccaagtaacacagcaaagtcctgaaaaataatacttatagtaaactaaagccaactcctgcagctttgtatatacaaagcttttcctacctaaattgcataggaataaatttgtatggagtataaatcaaatccagatacatattttgctataatgagaaattttaaagtgacggaaagagatacactttaaatttctgcaatcactcatagatcaaagaaattttaaatcaaatagctcctatgtaccaagcaccatatgaagttctgggtatataatgggaaacaataagagtgcctgccttcctgttgcttacaatcaaggtgacaaggagataggaattaagtaagatagaatccaccataaatgaagcagaagagaagacatgtacctgcctgctgtgctacctgtaaaccacagctagaggttccccactctacatggacagttttacctcctagctggaatgaagtagagagggagactaagtgctttcctttttcaatataatgtgcattgaacagtcaaggtgcccaattttgtagtagccctgagaaatgacacaaagaaaagacaaagtcttttatttttctatcaagaaaccccagagagcacctgcaaattgatttagctattttaaaagaatcaagaaaaattacctgcataaaaaagagtccttaaaataatgctacagtaattttttccttaccagtattttttttcttctctagtctaagctggtgattaaagagatatctttcattctaaacttaattctactctattcaagctctggccacagttaaatcaatttattttccatcactatgtagacacctgttaatacattttaaggtagatgctctgtgtgtctctgggtatacagtaggcacttttgaggctgtgctagttacttgggttggggggcaggatgcgaggtgattagactgccaaatcagtctgtccaggaaggcctactcaggaattgggcccttttagtgaatttgatgaagatgtaactttctaaaggaaatctctgtggaccagaaacaagtaatgcagtttttgtaacttctttccttagaaacagagagagcagttataaccattacataagcagcttcagagcatgggatgtagaatctgatgacccagctctttatttcccaggtgttaccccagtttcctcacctgcaatactaagggaccacatagatttcctttgcagaaaaatcataatgcaggttagtaaaatcatcctgtacactgtaaaatgttctatataattattattccctcaaatctggaaggatggttctcttaaaataggggaatcttatctcttacaaagcagagatttcacccataacttgagaacaatttagaccactaattgctttgggttttctgtttgttttttaaggccaagacttctctacagaagaataggtgtatagggcttttaacttttctttcactagttggcagaacagcaaaaatgcccctgcagccaatgggcatacaagcctgcttcttataaagcaatgtctgatgtttttgaaatatgacaaggaaaataaccatagaagcaagcaggtgttaaagccctaccatgtgttgaatcattgtgccaggtagtttatatatgttacctctgatccttataatcacccacttaagtatttctatgtcattctcattttactgatgagtaaagaagttcaaacagtcagtatcttgcccagagatacagagctggtaagtggtagatggggaatttaaacccaaacctgcctgtttctaaatgtttattttttgcttccccaatacgtggccgtctatacatgaagatgcagtatattaagaatccagaaatcattcctgagttttcccgggggctgagatgggtcttttcaaaggtccatctatgtattctaagcctatcccactgcttcacatggaatgatcctcaacccaattcagaagaatgagaggctcatatctgtctgagcatctcctagtgtgaaaaatatttcttcacttcctccagcaataagagattatcttatttcgccacctggtaaagtttcctttcaaaagagcatctggaaattatagtgtgcaaggcactatacatacatgtaagatgtcttattggaggccgggcgcggtggctcacacctgtaatcccagcactttaggggacagaggcgggcgagtcactaggtcaggagatcgagaccatcctggctaacacagtgaaaccccgtctctactaaaaatacaaaaaattagccgggcgtggtggcgggcacctgtaatcccagctgcttgggaggctgaggtaggagaatggcatgaactctggaggcgcagcttgcagtgagctgagatcgtgccactgcactccagcctgggcaacagaacgagactccatttcaaaaaaaaaaaaaaaagatgtcttatgggaatgaagtaattttttaagcagaccaagaaaagaaaatggggagtgtgggaaactaataattcctgtatgtagaaaataatgagggttctgtgggtgcctgagcgctgtgtggctgacataggataagtcaaaggcctctccctcatcctctgccattgtttcaagacacacaaattctcttgaatttggaacctgcagtgctaaagaaacacatatctctcatttatagaaaattcatactgcagcacattctcgattatctgtacccctgcagagttgcattaagaaagttaacagcttagcatggaaaatttaccgaagagtttcaaaaccatgaccttaccctacaggcactcctactttcaaaattggataaagaggaagcagtcagggataagagagagggaactggttatgaagggagacaggctttgttcacacccttcatattccaactactagctatgtgctcttgggcaaactattgaacgtctctgaacctcaaattattatcagtaaaatgggcgttataataggtaccttttctaagggttaaataaaatatgtcaagtaactatcaatatctgatatataaaggggcctaaaataaggttagttatttttacccaaagcctgaggagcagattgtagatcacttgtcctgaaagtttgggaaaggttctcatcgaacacaaggataagctattaagtgaccatccataattatctttatttatttatttattttttgagacagagtctcgctctgtcacccaggccagagtgcagtcgcacgatctcggctcactgcaagctccgcctcctgggttcacgccattttcctgcctcagcctcctgagtagctgggactacaggcgcccaccaccatgcccggctaattttttgtatttttagtagagatggggtttcactgtgttagccaggatggtctcgatctcctgacctcgtgatccgccagcctcagcctctcaaagtgctgggattacaggcgtgagccaccgcgccaggcccatagttatatttaataatgtttttgcatagagtggctagcaccacaggtgaatatttcccgtgcttgattttattaattgcacgcactccagtagaacatatttccagtggggcatctccacaactggatggacataggaaacctggttcacaacattcaggctaactcagtgaaaagaactacacaataatttgtcacatttcttccacaatgatgatggtgtgagatatcttcccgaaaacttctgagaagggggccagctctgaaatatctaaagctttgttttggaattttctgtttgtctgtttttagttttccataaaaagcaaagctgtgggctcttaaaaattttcaaggtgggggtgcggctgtattctctagcactggtttgcagtggttaataagtaactatgtggcttcaagtaatctatgcacacagtagatggaagaaaataatccctttcccataaaaaacaggttatttaaattcaaatgaatcagtatggagtacttgacaccacagggtttgaccacctccgtggctgtaaatgaaaagaaggacttttcgaagaatttgaatcaggtacaaaataaaagatgccagttgtttatagaagctggcaattaagaaaatgtatgagggtaaacagaagaaagtaacttcttgacaacttccttggactttaattctttggcatttactttatctttgtcagagccaggcagggggccagcataacttctgcagacttctcatcacccagaagacaggcgcagtatgaattacttggatgtttcagtctgacagaaataaccagaatccaaagcttcataatgtaaaaagaaaaaaaaaactctattctagaaaccaatggcctggaaggtcaactttggttcaaaaaataacaacctcagagcacaagattttacacttaaaaaaaaaaaaggaaaaaaagcaaatattaatataaaggttatagtcagttcctgctgaattatactgtgggtttcacttcattagaatcatcaaacctttactgcatgcacatatgataagcgctgtgctggaccctgaaatgaaaaatgttatccagcggatgtctaatgatgggacatcctctcttcacacattagtagtacaagttataacccaggcatattctctgtcatcaaagggcttaaagtgtatgtctttatatgtgacttgtgtgtgtaggtattgagagagtaagacaggtaaatatgaaacaaacataatacaaatttataaatgctagaagcatttataacatatataatacataatatattatctaaatctattggggataacatatataataaatatttcaggtactaatggcataataagagctatgaaagcacaaagaatgaattaagaaaaacttcatataggaggtacattttaactgcacttagaaaggtacgtacaattatgccagttgaagaaacagtgggagagaaggttttgctcagacatctttgtgtacatatatataaataaaggatgataatgatgccttctctagacctatcgttacaatcatcaccaaattaatatttcttataaaacaactgataattaatattgggccataatgtattcaatgaaatataaacaacaaaggcaagcatgcatcaaatcctaggcacatcagactacgattatctaggtatttcaatagatcagtgcggtagaaatgttttcaaaattaagtttgatgatcaaaattttgtcctgtgtaaattttccaagattaattccattagcctattcactcatttctgcgtttatttaaaacatctttattaaacacctatagatagtcaggtagccattagatcataaattccttgaggatgcattatgtactcattaaatgttcgtagatgacttgcagatgagagctcacatctagtctgtgacacagttggttcagtaacctctgtcatagagatgtgaacagtatttgggggctaaagcggatcctactaggctttctagcatttattacccaaattggtgtgaatgtacagtgaaatgatttccatatgcagaaaatactacatgcacctctttagttgtatgagtattcattaatattaattacatctaccatttactgggcacttaccatgtgatagttatggtgcttagtacttagcatacttcaattcattctcacaataatgccataaagtaggaattattagccccttttacagatgaagaaaatgaggcctagaaaccttaggtaacttacccaaggtaacatagctagtaaaaacaggaactagattatgaacaagatcttactgcctacaaaacctatgctcttatacccaagtcatcttatttggcacttttgattataagcacttgagaatagaggtcatttagaatgctaatgcgtattaatactaaaaaggaacttggagatgcatagaagaagaaacccccttcatagaagaagaaacaggctggttctgataccttgattaccaaaggctgattttaccactagtgcaaagggcacctgcattctagggtgtttgtatcatagttaaatggattcagaatgaatgctagtgcttcccagtctaatacagagatgcaagtagataaaatttgtgcgagaaattgaaatctaaggggaagactgtagcttcttgactttcattttatttcatttttctctattgtatccgttatagtttggatgtttgtctcctccgcatctcatgttgaaatttgatacccaatgttggaggtgggggctggtgggaagtgtttggagcattaggttggatcgctcatgcactgctgggtgccttccttttggtaattagtgagttctcattcttagttcttgctagaactggttattgaaaagagcttggcatacctccctcaacccccgccctgtctcgctcactctggctttctctctctctccttctctctctctctatatatacatgtgtgtgtatatatatatatatctcacacacacagacacacaatgtcaagccctcaccagaagcagatgctcctgtcatgcttcttgtacagcctgcagaaccatgagccaaataaaaatttttttctttataaatcattcagcctcaagtattcccttataacaacacaaagacagtgccacagtgcctcatttctgagtaattatgatttattattttttttctaaagcaacaaaatgaataaaatgtgaatttttacaaatgacatatagggttttcctcgatttctcctccaatgattcaggtataaagcttccaagtacttaagctatataagctttgaattggggccatttttctttgcaggtttgttctttgttttcttcctggatcttgagtactgccatgcactcagaagttccacaaaccttagagctcttgaatatgaccattaaggattctctgatgaaaggaacatacgactaattccctagtaacagtttctttatagagtgtcaccatgtacaaatatcccattttcaaaaaggtggtaatagaccattaaaatgaactatgatactcagcagaaaatatttgtttttatataatgggaccaactcagcatcctacagaataaagccccatgaggtagatattattagtgaaggagaaaggctgtgtaatgaataggatggagagaaactcatgaattaaacaaagaaacccaaaggtttgatttcagtgtgttgatgaattaggtgttaatgcataaagctactcatagtggctatgatttgtgtgttttgtaacatgtttttaaacaggaaaatcaaggtactgcattttcaaaggggaagttatgcaaaaatgtattttctgtaactctttatttgataggtttgctgtctactggaactggcctgcagcaaaatagtgaggtggtcagatcttgtctttggcccattttgtgctttgattcctctgagactgcctgtggcatggccctgaaggcatgctttatgcctgcaatcctggttctaaggaaggattccagggaaaatcacagagccacactaattctacccttccatcaacacatctccaaactcagacctgctcttaaagctgctcagaaatcctagagatgactctaggaagttcccttgtctcatgttccttcagaaactattccaaattccaccaccttctttgagtccataatataatctctctctttcagagagtaaatacaaggtaccaagaaagaaccctttcagcttccagttgatgtgtactctagtagcctctattccaaaactaatgtaccccatgagctgaaaattacatctattcattccatctcctcagaaatatacctctttcctctattttaactttttcctctgaagctgctccaaaagtctgcctacatttgtttaatccattctttacctttcattctttctttctcccactacaattgaactctcctccctcattactccactgaaaccacccatgtggaagtcaccaatgacttcctaattaccaaatgaaaagaaccttctctctctttcgttgtaggtattagagatgtgggagttttggcctgagactagacattttcattactgacttgagactattatggagaaattggacatcttaattactgaattgagatcattatttacagttaaaaggctcaaaaaacttgagccaactggagtagtcatacaaagccaagaatagtgagaaggtaggagaatcttgtttattttgtttacactgatgaagtgacagacacagagggattaagaaatttcccaatatcctatatcaggtaagtagcagatcttgactttgaagtcagagagctatgctccttcttgcttaacctctcattaaattgctattcatagtctcttatgatgttactttttcaataatatgcttcagaggctctcccaataagtatatactgatcacagtatttaagagatgaactatattttattgtgttaatatgctgtaatggattttaccataacagaaaagttataataaactttcctgtatgtgtgtgtgtgtgtgtgtgtgtgtatatatatatatatatatatatatataaaatttttgtgcatttgttgaagtaccgtttgcatggtaaaatttctggaaatggaattgctaagtctcaaggatctgtgctttttaaaaagtgatggatactttcaaaatgccctccagagatgctgtacctttttttttctgaaagcaaacattatcttacttgacctttctgagctatttgactttgttgactccttcattcatcaatctattcattttcatgataccgttaccttccagttgatatctaactctgcctgatctttctccatcttctttagagcatcctctcccttcatctcccctttaaacactgggttttctcaggctcactccttttcttttcatctataagttcttcccaagtgatttcatcatacttattgttccaactataagagttaaactgcactccatatcgtcttagaaaatcttagccttttcctgttgttatgtagtatttttgtacttttggaccaattaattatgttaatgggggagaactcagtgatactcttcatactaagatgttcagatccagatccagaaaacttttcagagttcacaggaagatgctatgtgtcttgagacaaataaaaatagaagctttcaaagccataaagagagcaaaggtcactcctcttctgtctccgggtgaatttcacactgcttgagatggtcacaggttgttggaatccaaaatcaggtgaagccattggtattggaaaacagactatggcttttgaattattatgttgatatgatggcatttgtaactaatgaggcattgggaaatgtgttaatgggaaaagggatttttgtgacttgtataatctatgggaaaatgtaaccttggagactggactagagacatctataactttgcttccataacaccagtaggcaccatgaaaggtgaaaactctgtgatccagttcagcatcaaactttttcatatattctaagaccccaaagagtcatgagtaccaatatacagattttaatgccagtaataatgaagtggtcagaattattggaaggcggaggaggtacattgggagatgaagaatatcactgtaaatatatgaggaaagactagataatatagcaggagagttttagagggaagagaggaaaaaaataggcttgtctggaagaatgatagccagatgattatgaaagaagctataaaacctaagcaagaagcatgaaatatttgaatacatgaagaatgttctgtgttcctggaagagtaaatattgtaaacgtgtcacttctttccaaagtttgtcataactttgatgcaaaactaagttagacatttgtgtgtgtgcctgtttgtgtgtgtgtgtttctttttctcgagttttgtaatagtctaatgagaaataatagtagaggaatggaagatatacaagagttatttaagagatagatttatatcaatgattggttattgattaggtgtatgggctatgggaggaaatttagggtaacgcacacccttctgtcttgagagattggttggatcattgtggcattcactgtcacagaccaaacaggagcaggatcatgtttaaagaagaaggcaatgaaatcagcttttgacatttgaaatcaaactgtttatggaatgtgtaaggaaagatttttttcaatagctttgggataagatctaaagtcaagaagataggtctgggctaagtttattgatttggacattagcatataaaaatagacatgccaagaaaaataaaattaattatcatgtttaatacttactgaataccagggaccaggctcaactgctataggtattatttcatttaaaccttttaactattattgttagacccatcttacagatgagaaaattaaaccttaagttattaagtgacttacccaatgcacagagttagcaagaggaagaacctggatataaatctaggcactccaaatctaaagtcagtgtgtttcacaagatagtgcaggacaatggtgaggtacaatagaatccaatattggaggttttttttttttttttttagatggagtctggctctgttgcccaggctagagtgcagtggcgtgatctcaactcactgcaacctctacctcccgggtccaagtgattcctgcctcagcctcctgagtagctgggattacaggcatgcgtcatcacgcccggataatttttgtatttttagtagagacaggatttcaccatgttggccagactggtctcccactcctgacctcaagtgatcttcctgcctgggcctcccaaagggctggaattacaagcgtgagccactgcaccttgcccaatattagatttttaataattaaagtagatgtgattccagacttgacagatgtagaaagaaattcagagcagtttcaattctaactgaaggctctttcaaaaagatctaacttacattaaactgaaatgattttcctggtaacttccacccaatgcctaccttgaaatccctgcaatcaacagagcaagaccaaagtctccttacatagtcagttatttgaaaccagtaagtaatgagtttccatattcctgcctccagtaatgactcccctgttacctcagcatcgtctatcctttatttaaacatcctcacttcttcagatagtctcttacatggtcaccttgaactgccctcacatgtgccagctcctgtttgagtatttatcttgcactatcatgacagaagcagacacattatgcatcaagagtgatgatcctgctccctaagtgataattccaccagtatatgttcaagtcctcctaacttatgggatattacagcaaatatttccacctgggtctcaggaaaatgtctcctgctcctctcagtgtcaggcattctcttggctctttcatgcaataacaggatggggcatagtgaggaagaggacagaggaattagtagcttattgtctcttctagcctttcttgggagaggcatttggcatctccatcactccagaattctaaggcattcctgcagaaaagatctttagccttaggtacctcatgcaaattcagtgttggttataactcagcttttctgtttgtagatgaccaagtgtataagactgaatgctttcttaatagaatatgaagtggtgtcttataacattaatattacattatatagtactcacaagccacaccatgaacctgaggaccctcttttctgaagatccaaaagctttcttctccattgccaccacaagcaattcacccatggaacttctttgtaacccccatatcctccttgaagtgaagatttttgtgacactcacctcatcccatctctcactgaatcttgaagattatcagatttgtctaatttcttctcacttattataaactctgtgagggcaggggctatggataacttacctttaaatgccctacatcatctaaagcattcataaatgttttcttaaagaattgcagtctaccattgatcactttcctggggggagggactatttttcacctgctaactatgccagtctttgatccctactttcttatctgtaattgggaataaaatagtagcttcttcacaggatcattagtaggatataatcaaataatgaatggtacataataaatcttgcctatagtcaccatttagtaagtcctgtcatttataccatttttccaactgtattaaaggacgtgctgttctgaattgtaatatttattcacttctctctctagctggctggtatgttcaatatcggggcctggatcttacttacttttgaacatggcacaaatgtttgttggatgcaaagctacctcacaccaagcctttgcttcatcacattcattcccttactttagtagtgtgtgctggcatgaagttcagaggcaagagtttgctgacactcctctgctgggaccccgatgtagctctggtttcagcagacttcttaccactctcttcctctccatcttttgtcctcagcagaccacctgtctcattaaagaccagagctttgggaaactcacttttttctatcctgatttatttaaacagaagcctccttgagacaaaaacgtatctaaatgttttatagcatttctgaatttctgtttctcttaattgaagttccatgtgtaatgtgtagataaacattttttccctagaaaaatgaaaatgctgaccagctgtgaatctttgatatatgaaaggctctgatctgccctgtgtattgtacccatcatcaataggtttgcagggcaatttaaccattctatttcctcccgtcccattccaatctcctttcatttcatatttcacaaaaactggaaacataagcagaacattgacctataatccagctactcaatttctacagagcggcaaaagcctcaagagaatgcaaacatactttgactccatatgctttaatgttgagcagcctgcttggggttgtccaatggcacaaataatccttaatctccttcgagccaagagttaaatgtttctcttatcctgagtgatttactagagaacagagcagaaaataaacgtaatgggctacaccatctatttcttaagcaaaaaaaatactaagtcacagagaaaagaaatattcagaagaaagggcccagatctggagagatggagctcaccagaagaaagaacatcaggaatgaaagccagaagatctgggtgtgactcttggctttgtcttgtcattctgtgaccatgagcaattcaaaatctctctaaacctctttatcctcatctgtaaaatgatgaccaaactgtactttgtttttttttgtttgttttttttttttttcatggagtggttgtgagaattaaacatatgtgcaagtgcttgtaaatagcaggaaactatgcaaatgttactcttaatttctatcagggggccttttcatccacccatgcaaatgtttcattagcctgtgctcaagtattctgaatggcattctgccagttcatttccattcactaaaacaatcaacattccagtagaatattgatctgggcctcagagtagaaagcaagactaatttattcatgacttagtaacagagacaaagaaaagatgtgttaccttaggtcaattttcattatgtacaagaaagacaaaggaaccgtacagacaccattaacaacaaacctcacagcacaaaacctctgcatggaaagaaacccagtcctgctagagagaggactgttgtttcacatggcatgcatcgacaggttggaatcatgatgcattcagttccaatttatcatcagtagcaaataaactcttccatgtgtataaccagtccaatctttctgaagtattcagaaatatatccaacatctgttcacttctctgaaaagacatccattcgattcacttgagccatggaaacaaaaatcaccatataaaacataggtctgcttgctaaaaaggctactcagtatattaaaaatgtgaatcagcaaaacaatataatacactgaaattttagaaaaactttatcatacgaagagtatagccaaatgtagtggaagagaaatataagttaaatatagtagcagggaggaaagaaaaatactctgggctagatgtcataaatctaatattctgcaactatgtttgggatcatgaaaagtctcttgactctactctgtcccatttccttaattgtgaaagagtatagttgaatttaaacaatctggaccataatggaaacagagagatcacagttcaaatctccatcctagcactcactaacgaagtcaccttaggaaaaaatctctaaataattagaaccctggtatcttcatctgttaaagggacataagattatctctctcaaaaaattgtaatagggagtggaaaaaaatgcatttaaaatacctggagcacagtaggtatttgaactattttaattctctaccccccaacaagtttatatttctgtttattgtgttaggatcagttcaaactaatagttttgtttgtaataattgctatttattgagcaccaactctgtgccaggtgttatctttatccttaaccttaacaacgattctttaagtagtcattattgtccccatttaccatatgacaaaactgaaggccagaaggattaagaatctttcctaggatcacacagctagtaaagcctaaagcagatattaaaacctgatatgactgttttaatgtgctaatccatctcccaacagacctgtaataacaatgataatcatagtaataataaaaataaacctattttaatctaatggccaaaaagttcacaacagtgatcctttagagcactgcagcttactgaactcaactaaaaatgtgtgagataatcaagcaatggcaaacaggggctttgatggaatgactacagacagaaatgctgtaaggagccatagaaaagagcaaagagccatagccatgggactggcaagcctgcctccctgcccctagaacattctttttatgagaccagctctatggcctacacattggaccagaagtcctcaacccttttgacaccaggaaacagttttgtggaagacatatttttttcacgaatgagaagggtggggagacagattcaggatgaaactgttccacctcagatcatcaggcattagattctcataagaagtacacaacctagatccctcacatgcacagttcacaataggtttcctgctcctatgagaatctaatgccgttgttaatctgacaggaagtagagctcaggcagtaatactcagtcacctgctgctctcctcctgctgtgtgtcttaattcttaacaggctacaggccagtaccattaggccacactcaactgcaggatctgcttccaatactgctcgcagtcaaaatttaatatagttgtttattgtctagcattgcagcaaaggctgctaattaacctccaataaacggtcattcctttttccttagaggactgccccacaccctcctctcgacctttttagttgggcatataaccatatataataaagatgacatttctctgccttcttggaagctttggtatagcaatctgacttatttctggacaatgtaatttaagtaaacatgtgctgtgtaggaacaattccaaaatggggaatacagtgggtggcttatttactgctgcttctttctcccttcttccttccttcttactttctataggataaaatgtatacacgatgatttaattttgaaatgccatcttggatgggagatgaactatttatgttgagggtaatttgagtgaccagatagaaggatcgtgggtccctgattatcatggaactaccaaccttgatcagaatccttctttctaggttcatttaagtgagtgatatagatgaaatgtttgtatccctgccaaatttcatatgttgaaatctaacccctagtgtgatggcgttagaaggtggggcgtttgagcagtgattaggtcatgaggctggaattctcgtgaatgggatttatgcccttataaaagaaactgtagagggctcctgatatggtttgaatgcttgtcccctctaaatctcatgttgaaatgtgatccccaatgctaaaggtagggtctggtgggaggtgttacagtcatggaggcagattcctcatgaatgatttggtgatctccccatggtaatgagttagttctcactctattagttcatacaagagttggttgtttaaaagagtcggcacttcctcacctctctcttgctctctctctggccatgtgacacacccactcctcttttgccttccaccacgattaaaagctttctaagccctcaccataggccagcacatgctggtgccatgtttgtacagcctgctgaactataagccaagtaaccctcttttatttataaattatccagcctcagatattcctttatagcaatgcacactggactaacacagctccctaacctcttccagcatgtgagattacatcaagaagatggccatctatgaatcaggaactgagccctcactaaacatcaaatctgttggcgccttgatcttggaattccaagctcccataactgtgagaaataaatttctgtggtttataagccacttagtctatagtattctgttatcacagcctgaataagctaagacaatgagaaaggaacttctttctttttacttcaagtattctgtcactcacagacaaatttaattctaactgacaaaaatatcaagtccaacttgtaggtagcctcaatctaattgtgtatcttctgggtggagctttgtattttttttcaacactttttaaaatttgaagtcctgtctgtccctggaccctctctctaaagtgtgggctctctattctgcccctcaattcccactaggtctgctataatgccttttcaagactcctttcagtttgctctaggtctagactggaatgtcatcctcttaatatatctcttgactaccaataaacttctggatccaaaatctcttgatgttttccagatatctagagatgctagaagctctactatctctttggggcatgacagtgcttttatgattatctggagcaagaaacaaaacttacatgcagatatcacagatcctaagaataaaaagggtgaaatcaagtaagttactgaatgactatccttcactctttttccaaatttctcaccctgggaattatcatttggatgttgattttcaataatgtctctataagatgctaaaccaactatgaggtatatgagggcccacagttcatataagaccaccctcctttctgatatcaattgcaagtttgggggattcccaaggttaccttcaacttttatcattcactagaaagactcacagaactcagtgaaagctgttatattcacgactacagtttattaaaggaaaaaaatagacattaaaatcagccaaagaaaggtgtccattgggcaaggtccagaagaggtgccaaacatggggcttctgtcttctactcatggagtcatgagcacattactctcctggcattgatgtctgacaacatgcacaaaatattaccaaccaggaaagctcacttgagccttagtgctcagagtttttactggggctccatcacatactgttcataaggctgaaatttagtctccagtccatctggagacagaattgataccacatgatccaaaacccccattaaaaatcacagtgttagacgatccaatggcaaaaaccccaggcaaacaaaggcattcctaccaggcatcatattctaagaatccaaagattacctcccaggaactgagtgtaaaggtcagacttctgttaggataatgttaaattcttcattacacagcattcctcttaactcccaggatcctggatttgacattgacaattccgatatttcactgggtaccctgacacttcatttgctctggcaaaacatgtgctgtactatggtttgtgctatttttggtatctgcatcaccataatggtgtgtcttatctctataaccttctgaggactggtctgatacctcttttaaggaagtaaatatgatgggcagaccaacctgacccagagtagaaatgctagaatctgaggcagggcagtagagagatgcttttgtccaggcctaaagaaaataaccctcagtttgaactagactatgatggaacatgctgtaaaagaaggaaaatctacatcccacaccagcctttgatttacgcattttcatatgaaagccatttcatcagcagtgttgaatatgaagagatatataaatatacacattgacccaagcaataggaagtacactgcaaatgcagatctcactccttctgacaaaggcaaggtgactaagtgggcctatttctttctgtgacttcctgaatctatgatttaaatgaaattgatgccacaaaatgtttcatcgcatgttataaataaactctctggcctgaaggactcaacttcaagttgtacatttttataaagaatacattacagtttaatgtgggagtgggaggatctaattcaattcaagcagtgatgattaattaaagttagtgtgcaaaatttgtttatgatctacagatataaaataaaattttatgactttgttaccatatacgccccctctctccaggtaaagtcacctgcaatttcttcatacagaaaaaaatgccaaggcataatgcttatttgtaatcatgcctttgcaggtagttttgttttgttttgttttgttttaactgcatggtctagagatgttgtgagatggtttcttggcttaagggcacttgaataaaaatgaaggctgaaagcatcagaagtatttgccttgtagaatggattacaaagtctcaaatgtagcaatataatgtagctgagaaccaggttatctatctgggttctatctctgtatatcatcgtggggacccattttatcctctgaacaacagcttcctcaattataaagttgaaatagacctaatgctcacatcttcagggattataaatatgatatgtttgtaaagtgcatcttaaaactatagagtgacatgagaatgttaattgctattatgtgtacttttcagtgaaaatttatcatcacttaataattcactatggaccaagagctgaagtacaagccagggatataagagcaactaagacatgatctgtctctttgagttcctcacaattcagtatatttgtgtctgtaagtcaggtgggggaaatggtgttgagggagggagattcagagattcagagagactgagagagatgtccctcattcactttccagaatatagaaataacttggcaggacttagcaaagtccttgatcattaaagatgttcaatataaatgtttatatattgaccacgtaatgcagatccagagacaactcatctcaagtttccttaaagaagcacaagacatactgaattaacggtaacaagacagggagtaaaatctcacctggacaaaatgcatctgcccctcccccatgcatgttttagctttaatttttttctctgtaatttctctagtttagaaagggtcagcttgtactagggaaccacaaatggaaacacatgtgacatgataatatggaagtagagggccagctcctctcacatcatcctggtttccataaccattcattcagatgtcagtatcagatcatcagtacttagagtcagtttctttgtaaatcttttttttttttttttttttgagatggagtttcactcttgttgcccaggctggagtgcaatggtacaatctctgcctcccaggttcaaatgattctcctgcctcagcctcccaagtagctgggattataggcacatgccaccatgcccagctaatgttgtatttttactagagatggatttctccatgttggtcaggctggtctcgaactcccgacctcaggtgatcggcccacctcagcctcctaaagtcctgggattacagtcatgaaccactgtgcctggccataaatctctttttaaaagcagtcatggcccagacatggtggctcatgcctataatcccagaactttgggaggccaaggagggcagatccccacctgaggttgggagttcgagaccagtccagccaacatggtgaaactctgtctctactaaaaatagaaaaatcagtcaggcatggtggcatgcacctgtaatcccagctactagggaggctgagacaggagaatcgcttgaacctgggaggcggaggttgtggtgaactgagattaagccactgcactccagcctggtcaatagagcaagactctgtcacaaaaaaaaaaaaaaaaaaaaaggcagtcacttctgagtttgaaggtcctgattagatccttccagtcagggattaaaccggagaactgagaaaaggtggagctataagtctagttttattgttaacaaattggggcattttctgagccagcctactcagttataattaagccctgagaggaaaagccctaccaggttacagggtaacatcaccctcttccaatttcctagccaacaagaccactttaagacataaatactttcctctgtttattaccggaaaatacattttccttagtatgtccttctcccattctttaccttcttcaccattttgaagatcacctcagatattaactattcaacttattctgtattacattttctccatacagaaaaacataccaagatataatgcttatttgtaattatgcctttacaggttatatatatatatatatatatttttttttcatatattctgcatggtctagcaatgttgtgagatagactcttggcttgagggcactcaccaccatctctttctccctcccttccctgacccaaggctggatcaaagattgctgtcctgggctccaagagtgaactctggtggttatctcaaacaaattagaatctattctaacagtctattgacaggatatcctaaaaggcaggtaccttttcttatgaatctgtgcgtctccagagtagacacagagcacagcaaatatttgttgaaaaatgcatgaatgaatagggcaggaacacaggatatttatttactgtatctcttattctttctatccctagagtgactctagtttctttaggactgtcttaatttatgactatttacttggcacacttatatattacctttcactttcaaaaaataaatgggtttggatgacaaattatatagtccaacactattcatacctgaacctgtttgtaggccccttatatctggaccctgaggttctgtcatccttatatccaagttcccatatctaattcttaatcatgggctgacactggacgacgatcttttacttcagccaattccactcctgctattttccctctcttcccctactcaattcaaagggccttgcaaatgtcttgtctccagatctggtgcccaggcaggcaagccatgactaaaggacacctgttttgaaatcctaggcctctttggactagaattcctgacaaccaaaattcagctttttaatctcaaagtaaagttacaggcagaacaacaacgactattttataccttaagaggcttccttctgaatgaagcaaagtggcaggcacatttccatgaaatatagtcttaacatttttcaaatgatcttttttgctctatggataaactaatgaaaaataatcataattcaatgttaaatattagctgtgaatgacatttgtgtacatatcgttccctttttaaaaagtttcaaattctaagcctcctccttggctctcaaaaaacaaaacaaaacaaaacaaaacaaaaagcctgaaataatttgtccactaaaattacaaattatatttcaaatgacttaattacaaagtcatggaatataatgaaaatgacaactgactctaagttagtaactacacttataattaacagaagactttgacaaatgtttatagtgctttgaaacaggaggtcaggacatcaattacagaggtaacataaactcatttttcctatttataattcaaatccaaattaccacatattgtaacatgtggcaaaagccccagcttttcaaacttatgcctggaggtcaggtaattgtctcatagaaggaaaaagcagaaaaccaagcaggacagatgggaagtagggcactgtgggccaaaaagcttcaaatatattcaaaaaattgtattgattttcagagatgctctggctgtgtgttcccctagccagctttattttctatcatacttctctcctttccttaccagcaccctgtacaaaataatatgaagatgctgatatctgatgattgtggtagattgtatttctgtttatgattgttaacacccctccattgtcctttcccttaggaaattatacattcctgcctcattgatttggagtttggccacggtatatgctttggtcagtggaatatgagtaggtatgacatattttttttttcgtgaaagtaggagaagtaccatgagtttctgccactaatcttgcttttatgtgctgccatgagaatcttagctggagattcttctatagaatgggaaggcaaggaagcagagctggcccttacctagagacaagctatagtggtaacacaaacctgtaagtaacatgagcaaaaaaataaagatttgtaagtgctgaaattttaagtatgtttgttatcacagctgaccaacacattgataatgatgatatataatagtattgatggagctttacaatgtgtcacacactgtcttaagtgctatatatgtgttaaattatttaatcccattttacagatgagggaatggaagcaaagaaagtcaaataatttgcacaatattacatagtcagcagccaagccagatttggaacttagactctggcttcagaggctaagatcttacgctataccacctatctatctatcagtagtatttccaaatattcatatattcaaatctctttcatatctccatgcctttccacatgctaatccttctggaattccccttcagtcctttctcacttagaaaactcctattcatcctccatgacccatctcagagagtcaatttctgtgagtctaattgcttctcattcaccccaccccacttcttgaagacggttgcttctttcttctataagggcataacattttatagttttgttgtaacagtgttattactttctgttgtgcttgtcttcctttctagatgttgaactcttccagggtgaggaaaatatttcacttatttttaaatttctagagtcaatgtgcttgatacctagtcaatgatcagaaaaagtgtgatgagtgactattagagttctagtgacccattcaatttgttccttaaacccaagtaaaagaagatgtgggaataggtaagcattctcttagtctacagttttattttgtaactgagttcacattataaactataaaatagggagttagcacattacatcgccttcacctgtagaacaatttctctagcatgtgttgccctcccctcccctataggcatcactaggaattcggctaacacataggtctccaaatccatttcttccctttcacatttatttgctgctcagccagatttttggtcaagcattatcctgggtgtttctgtaagggtgtttggggatgagattaacattgaaattaaatcagtagactgagtaaagcagattgccctccacaatatgggtgactctcatccaatcagttaaagacctgaatagaacaaacaactgactcttctcaaagtaaaagagaattctcctatctaatagccttcgaactggaacatcagctcttgttactactacagcagcttctggtctttggactggaactgagacattgattctgtagattttagacttgacagcctctctttaatcatgaattccaattcattataataaatctctttatgtatatatctatatatgtatatgtctatatatgtatatgtatatacacaccccatattggttctgtttctctggagaagtctgacacttacaggaatcaagtatttagggaccctctcctcatcagcaaaacaatttgatatcaaaaaagtactcaccaaacaactagctccatatgcaattggatgtgtgtatacacatatatttgtacatataagtatatatgtgtataattacataaacacatttttacaaatatatatttatatttaaataaaatcacacactcagaaatttttttgaggtaattataattatccctatttcatggctgaagaaataaagcttagaaaggtttacctaaggacagataaccaagaaacacaaaactggaatcaaaatgggatccaaatccaaatttacatgacacccaagatctaagctgctaaccactaaaatgcactactgaatatcagcttcatttcatggtagagaaaatttatgtgttgtcctatctacatatccctcttttttaacccagttttgcctgaattttgttttatatattagtctatcttgtatgacttatttattgatgagaatgccacaatttaaaatatccgttatgtgagtgttagttattattattcttaatactgaatacttcatgttcttatttccaatttatgagacgacttaaacagaatatacaaatgtatttctaaattctaacaccattcgcaccgggcaggtaagtaagcaacttaatagaaacattagaccatcaagatatttccacacagtgaagaaagctaatgcatgtcttgtgagagacaaaataccattattatggatatacaaacatggctaatattcaaatatagataatataatcacaaatattaaaaatacactaaaggtaaaatatgaattcatgtatcattcttagacaaagtctttaaaataaaaaaattgagaggaaatatgagaggatagaacattgattcaagtttttttttgtttttgttttttgttttttgttttttttttttttttgagtcatagtcctgctctgtagcccaggctggagtacagtggtgcgacctcagctcactgcaacctccgcctcctgggttcaagcaattctcctgcctctgcttcctgagtagctggaaatacaggcacccaccaccacgcctagctaatttttttgtatttttagtagagatgggttttcaccatgttggccaggctggttttgaactcctgacctcgagtgatccgcccacctcattcccccaaagtgctgggattacaagtgtaagccaccacacctggccagattaaagagatttttagtaactaggttccattgcaaaaatttatccttgtgtccccacccaaaaagttaactctggtggacagagcacagactaaaaaatcaaaatacttgagtcattattctggatatattatttaataattgagcaacttttgagggtaatctttagatctcaaaaggcagactagaaataataaggactctgagtgagacagatctcagtgtgagcccagctctgtgacacacctgctatatgagagtataaaagttaaccactttgagtatgaagtgccagataaagatagtaacgcccatttcgaatgaagtgctttctagagtgcccaacagagggtacccttgataaatatttgtgcccctatctccagaccctattttcctcacccaaagttcctttctgagtctatacttctataatgccatgatctgtaccctacattctagggtgactctactaaaaaagttgctgaatggattcttctgactatttctatcccatagtgtgtttgtagcttttgtttcttctttaagcaattgagtttaaagataggttttgtcaaatgttctctgcattccaaatgtatctttgaattatcaaatagaaggtaaccagcttcccaaataccatttctgtgaagagaattgctgtgatcagaatgcctcgttcactgaatgccctttctgataaaactaaattgaaacggtttaagtactcattatgggtttactgagctctgcagttgattccttcaagctacatctattgaacgcttggatggcataaaaatcagcattctaagaaaaaacacaaacactttcaaaacattccttcatccctcgtggtttctagcgtgtctttctagagcaataatattttatcgctgactctgagtcaagtcaccatttccccttagtaataatttttatcctcttctttccttctgcatttccacatccaattgttgaaaaatttgaaaatatttttacattcaatttttaaattaatgtgtcattttcatgcgaagaagacacaaaacactgtgcaaaaacaaaccattatcatttatccaaaaaatatttgagcatccacaatgtgccaggcactgttctaggtaccagcaacagaaaaaaataagcaaacaaaatagacaatattccttgttctaacaggtgtatcttcaaattgggggagtatatagtatatctggtcttgagaaatgtgatggggaaaaataacacaggatatgggacaggaagttagggtggccagggaagggctcatagagaagatgacactagaggtaagacctaagtgaggcaaagggcaagcatgtgcttggtggttggggggaataaaaggggagttggggtctggcacttcaaaccagggaaacaagggtaaagatcctcatgtagaaccatcagtatgcttggtgtatttgagaaatggcaaggaagctgaaacaagggggagtatggctagagacaaggatggaagtgtccagatactaaggaaaacatttaccagtcacaaagactaacttcatatgccaaagtaggacaatggcaagcattggctgtgctctccaaataccagactgtctatattttgttaacttaaattgatttccaaagtgaacgcactactatcacctctggtgttctactcatcatatatttacttatttactaatgcattcataaactccttcacttcttttgacaaagtgttagcatctatggtgtaagatattagataggtacggaagaacaatatgctttcaaataacacagtaaagattcaccaaacccctttttccccctactaaacacacactttgaccacatttcacagcctatcctgtagtcatttagggtcacctgacaatattttgatcaaatggccacctgacaatattttgatcaaatggactgtcagaagaagtgatacacttcatttttaggcttggactcctaagtacctccttggagatcctccatgacctctcctttcctttgcatgctggcagagaattggtggaggattctgaaaccctgggaactcgaagaaagagtagcattgaactgacaaagaaaggtaagacaagagccttccttgaagagagaccagcacatacaaaggcactgaggtgcaactaaacaggacctgttgtagaaagaaccagaagaagttctttggactggagaataaggcgaatgggcatgatggcaaaatgtatacataaggactggatttcagaggtcctgcacgccatccaaagaaatgaagacttcctcttgaatgagatataaagagaaataacatggctcaggtcaattccaaccttcctcttgatcgcatttacaccattctgagccttccctgtcttcttcaccactcactgtatttctcattaacaaaatgtccatattctcagagaggtttgtgaactctcagagggcaggctctctctctctccttcaaatttgtttttcagaacatgaagtgggcattcaaactattttttcatatttaaagcaacaaagcactctagttatacatgattttgatgtaaatcatgaggaaaaagagtaacttcagtgatatgttgcctctgcccagggctgcgggagatcaaagagcagggcgcttatgatgggatgctagtgtgtccaccagaggctacagaacacacaagtggtgtcgatttcacaacaggctcaccacaatgttcaattctgtgtctattgcctctggtggcataatataataattcaaacaacaatacaaaccactattgattgaacatgtgttgttttacataaattgtcactaatcacaatacatctccatttacagatgaggaaacagcttccaagagtttaatgtcacacaatgactgagtgggtagagccaagatttgaacttagtcctgtctgattcaaagcccctgttctttccatcatatcgctcccacccctaatattgctgtggactcatagtccaaagcaccatttgttttgacacttgtattttatcttaaaaattcctatgaacaaagtattcttattaacatcagagtagatacctttttgtacttattagtttcatgttttgaattaattaccataagaaaaaaaattacaaatttacaacctcttgcagcagcaagtatttaaaaacatagtgcataccctgtggggtaagaagacaagggttacatccggcagccttgtcaccctctttccacacttctgggatttaccgagtacaataattttttttttttttttgagacaaagtctcactctgtcacccagattggagtgcagtggtgagatcacagctcactgcagcctgccttgacctcccttgctcaatcaatcctcctatctcagccttctgagtagctgtgactataggtacatgccaccatgcccggcttatttttttaaattttttttgtagagacagggtctcactgtgttgcctaaaccagtcttgaactcctgggctcaggcagtcatctcatctaggcctaccaaagtgctggaattacaagtgtgagccattgtacctggccttacagtactactcttgaccccagagcagcagttcctctgaagactttacaactctataaatgtcctacagctggaagagcaagatgacagtagggggaggagattagttgtacagccttctgctctgggaacctgctgtaaaataaacactgctgaaaattcctgttcctgttaaacagaatgacttccgtgttggctattgcccatgtgcatgtgctctcagcagagaaaaagagacaaaataaaaagtgacttgtgcagaaaattctggaataattagaaattcttttgcaggaagtctggcaagtttcgccacttttaatgactggtatggacttctcttggtttaatcttggcttctgaaaattcgtctgagtcagtcactactcagaacagactgaaaagtgattatgggaactaagtaaaggacagctggctcccagtaaatttgtgaaacgagattttttggttttgaggtttttgttttgttttgtcttcctcttgtatttgcatttctgtgttccctggatggaaggcaagcttcagaggcagagacttaagactatataagtatctagctctgtgagcttggacaagtctatcagttatccagaacctcatttgaacagtcctcatttttaagcaaacatttattgtgcactaattgtattctagacctggctccaaatgttggtgatataatggaacaaatcatagttccaaccttaagtaaactcatggaaacataactaatagtgtaaaaaatgctttagtaagactaaacggaggatgctagtcacccaaagtgggtgtctagtctatttctgtccttcagaagaacagaaagcttcttcaagagagatccaactctgcctaaacctaaatgatgagttggaatgagtcacatgacatatctatgtattgagaaggtagggtacgtagaagcatatctcaggcaaagagaacatcaaatgacacaggtacagagacagagagagcgatctggtagataaatttaaaataaagcatatacagaaagtctagaaacctaacatatttttaatagagaagttgtcttaagcaagcctcagccttacaataagtttaagtctaatattcactcatttccatccatccattcattgtactagaaactattccagctgctagcattataaacatgaagaagtcataaaataggtaagtgaaaattgatagacaggacttctagaaaagcgccttaaaatggagacagacacctgaggcactccttttgcctttccctctcattcttccctgttaccaggaatacagctctgatagttaaagttttagcagctctcttgggccatgacgtgatcctggtgtattagtctgttcttgcactactatgaagaaatacctaagacttggtaatttataaacaaaaaaaaggcttaattggctcagggttccacaggctatgcaggaagcatggcagcatcagcatctgggaaggcctcagggagcttttactcatggcagaaagcaaagcaggaacagttatgttacatggaaagagcaggacacggtgtgttggggggtaggtgccatacactttcaaataaccagacttaacgagaactcactcactgtcataaaaatagcaccaagggggaaattgacccccatgacccactcacctcccaccaggccccacctccaacattaggattacaatttgacatgacatttgggcagggacacagatccaaaccgtatcacctggacatggaatgcacaagctaggataatagacagggaggaagaaggagcctgacaatcatggagctgccttcctctaaatgtattttacataagagagaaataaatattgctaggctgctattatttgaggtttaaattatatgcaacagaatccactttccaaccaatttagagcggtagcatggtgtagattaagaaagattatagactttggatacagacctgaatttgaatcctggctttgtcaaaaataagctgtttcctcctaccaaaatgagactgatatacagagggtgggtaaggggcttataaatattataaataagtgcctaccatatagcatatgtgtgatattattatctggattatttggattaggtggaaagttaaaaacaagtctacaaacaaaacatccaaaagccctagaatctaaaaaaaaaaaaaaaattaaaataaataaataaataaatcactaatgtagtgaagactgtgacaaaaataagaattttccatggaagaattagaagaaaatttgaaccaagatgataaaaaattaatgaattaggtacatttcaaattaaatgtatctccttaacatcagagtctgcaagatatttaaaaggataacttatagggacttcctcatctattatcctatacctgtcaactactcaaagtcatgctacctgcaacttacaacaactcagcacttcagcacagggacagcaaacaaatgcaaatgctggcttgctgtcttctgaataggagtaacagctttcatatgctttcagacttaattaactttggccttaggcccagaccctgaatcatcagtttataagaggtgcagaataatggcacaaaactcacataatgtaggggtaactcttagaaaaacttttctagaactgaaagacaaaaatagaattgggcacagtagtgaaagcaacatagtgatgagtgtccttctaaatttgtccatctttctgaattatttttcatgaagacaactatgcattcatgttgctactgtattcaacagtaaattctactaagaaaatatgtgtgactccaggttgatgtttaattggtaatagctcctcacacagtctacttgattaaaaatctcaaatccaatatgtcaccaagagaagactttttacttccttgagtagtcatcatcattgtgatactacatgaatgagcagagtataattaattaaataagtatttattgagccttactaagtaacaggcactgtggtagtttatcctggcttctaaattagtgatcctctatcctgctaactggagactcatatacttcttcaatctcccattcaaaccttagctccttattaacttatagaactgaatatctctggacaatattttacacaaaacaaaactgaacttcaatcatcatggcctctattgaccactgtgacatgttctgtcactttagttgagtatacaagattattaggaataatacaaatttatttataacctctcattgacctccttttagtttttgactataggtacaatagtcaggagttaagcagcatgaccataatatgtgatgtatgtgtccataaatatgtacttactacttttgcgtgtgttcacacgcatatatgtctgttcatgtcttcaccttccttacatgggctcatctttaatctctaaaatctattacttcagcctccatctcaccaagtcttcccatttgttaatgactttttcccacaagacagttgaaattaattttcctgtcaccgactttgtattgtgggaaaatcctggatttatggagtttccctaacagagaacttttcattgactcctattccataaacctagtatacagcatctgcctctctttctttatttgcatcaagttgcaactgcaggcctgaaataaacctggcaagccaggtagggaatctgccatccagtccaaccctgcggccccctctatccagagtgttgattctgctgtcttgattttcagcacctgtttggattcttgttcttaacagaacatctatgggttccactgctttaacaaaactcatcatggaaatagcctcttcagataaaaacctaaaataaattaggaaagagaaatcataaatacagcagtggctctaagaagcagagccgcttctctcctgggaagttgccattactgttagggaataatgtcagaggctctgggaaggctctccatgcaaaaacctttctcagggattcgaagatatttttaacaaataagatgaagtataaaatttcacaagtggaattcagccttaaaactccagagaaactgagattgcttgttacagctcataaaccctagtggctcctgggctatgttttgtttgctctagtttacctccacccagtgaatgcattttctggttcacatagcactcgttgcctgacacatgttcacaatgcttatttctagcaactgcctacaccctagttgaaattcactagataactgacattagacgggacggtattttagccttcctttttggtagctatgcaatcctagcccattgtctcacttctcatcccttttacaccgaggaggactgaattactaggttctggatgatggccatttgtccaggtttcccaactgagagtaattaattgccaaaggatttatgcacagggactctggcctctttctcctcccttgtccacttaaatcagtaggaggtagtttcctggatatgtgtgcctcctctgggtacccatactggcccttgagtgggttttttctctatccagatagagtaatagctacatagcagaaaggcagtagatctacttgaatctcatataagagctacatattccagtctagtctgacctttactagtaacaagggtggtactatcattctcctgctgacttgcttctcaactgatacagtttccagaataaatatgagagctatttattaagcataacaaataatatatatatgagctttaccaaggagaataatttgatgatgggttggctgtttgtgtataagaaaagaagaccatcctggatgtggagaatacttcagatagaaagtctggaaaccggaaggaaaacattaacattataattagtcagttctttctttttcccctttactttggcttttaagagaacctatgtttccaatgattttaaaaataaaagttcttaagaaatgtctgtatgggtaagaaaattgaaacccagaaaggttagatgtctttccaaagatcatatggcacagctatgattgggatctgaggtcctttatcacacaccctttaatcaacatctactaataaagggaaagtaagaaaaacaccaatggtaacaacatttaaagtggtttatacatatagagcagttctgccagacattcttctaggtgccttgaaatattaactaattcataaaatactttatgtgaagcaacgtgtacctgattctgtactacctgtggcaaatacaggcataaacaacagaagtggctcttgtctttacattctagtagaggtgacagccatcaatataatatattgattagcaaatcattacttaattatactgtaatatgtgctcaaagaaatatagactttcatgacagattgtaataaaaggcctgatacttgaagtgtaggagtaaattaggatgggggaaaagcaggaaaagatgttccaggcagatggaacaagtgagaaaagcctgcagcagaaaagggccttttcaaaagcgtggggcatcattggtgactggagataacaatggagaggtgggactgggacagatcatgaagggccctagaggtcataaaaagaatttggggttttatcccaagagtaacagacatccattgaaagagatatgtgaataatttgacaatacaaagaagaaaaatgtaggtgcgtgactaaattttcggggatggaaatcaacaatcttggttacggcattcattaaagtagattgtatgaaggtgggacaatgaatctgcctaacttccttttgattcgtatcagtcattccgggcatccccaagataagtgcatttcaggatattccagtagcttcacttatacctgtttatgagagaagtttaaacttcatagtctggaaacttcctgctgattataaaggattttgagagttattacctaaatcctgtggctgcttgtaaatcagtgaagacatcattataagaaatagtaggaaaaaaaccatatttctctagtgaccatactggaacaaaaatctcttattacctagaaatgagaactacttacaaatccttccttataagaatagccctgcacagaatcattctaacttgacacagatcatatttttacaaaacactatatcagttcaaccactaaaaatgttgctgagtatagtggcttatgcctggaatcctagcagtttgggaggttgagctgggaagatcacttgaggccaagagctagagaccagcttgatcagcatagctgacctctgcaaaaaaagaaataataataataataaaaattagctgggtgcagtagcatgcactcatagttctagctattcagtaggcttaggcaggaggatttagtgcaggagttttccattgcagtgaactatgacagccctactgcactccaacttgggagaaagagtgagactctgtctcaaaaataatagtattgtctactaactcaaaatgcatgagtaaattgcatatagaacaatattaatctaatattcatacaaagcaaaattcttcagagactgaaggaagtccaagtctgcagaatgccattaagtatcaaggcaattaatgagtttcaaaagctcacttgtaaaaaattgcgtccctgaagattcattaaaagactctatggaaaagcagcttctctcacccaatcacttcttcctccacctacaaccagatggtgagagctaacctaggcctccatagctgcttttctcttcctttctctcagactatggacaatgccatctgttcccaaggttttgtgaatcatatgtaaactaatgacacacacttcttttctgtttagccttaacttttttcactggatgttttgcttatcatcaaaagcaacagcagtccatctgttttcagtctaatacacccttgagttaacacagggttagcacaccagggagacaacatacggatctcattccgccattaaggaagtagtatatggaggtgaataagagcatggaatttggggtcaaacagatctgaatttacagtcaagtcctgccacttaactgtaatgtaagttttgacaaattctttcattctaggagcttcattgtctatactgatgaatgaggctaggaacaatctcacataactatatgaagcttaactaagatcactcacttgaaaagatgcctggcacataatgatcactgaaaagtttgtagcttctatcaacatcatcgctcaacagctagccagcttctcatttgtaaatatatatttataccctgattaaatatattgtatgtgtggtagaagaaggtagtatagtggaatgtcttttgaactagaaatgaacagaaattgagtctagttccttttcctgtcctcatagccatgtgacttaggtaatttatttaaatttctaaatctcagatttttaatttgtgatatagcagtaatacttattgcataagtttggagtgttaaacaagataatgtatggctatgtaaattatgattctacataaaaaagttcctagttgagtcagcatttaggataagtaacatttattctcatagaaattttgttacaaatggctgttaagttcaagtgacaacccacagcaatgtattcaccttaagcatagcttaaacacaatgtatttgaaataaaaaataatacaaaataacagcaatgactccaataatagttgctaaataaaagacaaaaaaaacaatgtggctgtacaaaaaatattttgtctcaggtgctgatgctggagaaaatataataatagatatctgcagaatataatgattgatgtctgcaaagaaaatataatgaaatatttcacgtttcaatggaaacatgaaagttcgatgtcaatatatagagattttcaggaatgtttgcaaatgatgacagattccagttgaggttttacaaaaatgtttggacagttgctttttctttctcaaagttttttagggttcaaaatgaaagggagagctacattaagattttcctgagataatgaatgaaaataaaataaaccaagaaagaaataagagggcaagaaagaatatggattttcatgtgaaggagggttacttcaggaagaatctcaagagttatgatcagggatacaggattaggagataaagaagaaagaaaaaataagttgcctataatagttaccatttattgagagtttactatatgtcaaagtctgttctaaacgcttcgtatatattaaagtcatttagtcttcacacttcgtctatgaactagtgcgattgtgagccttattttatagattaagaaactgagatgcagttataaatatagtaagttgtagaaccaggattggaattcaggcagtctggatccagaccccagactcttatgaaaaagaataaatattgggtttgggacaatttattcatgtaacagtatttaatatcagagagtatatacagatgactattacagccacactttctgtattattggagcttacaatttagctctcgtactgagccaacaggtagtgctcttcatgagcatagtttggtcatccagtaatactaggttatcaggtttccaaataagcaatgttagagccatttccaactcttcacttctttatacatgatagtgacatctttcagtgtcccttagtctctctctcttccagcatatggtctttgcctctgttcaaaccatagtcaacctccttcctcctcctcaacagacttcttctaggcagaacactccaatcatcttcaaagctgtttcttgaagctgttttcaccagttatgtctatcccttttaccctgtcacaattctgcttcttgctgaacaaaaatctaggctacaaaaagagtatgacaatttgcctattgcaccagtatcagtatgaagataagggccatccctcttaagggcaattattgccccttggactaaccaacaccctgcctcctcacttcctcataattccaaggtgaatctacctatccttacatgctggtcctctcagaaaggatactattctattattcaaactaatcttgaaatccaggaaatcatttctactggggtgtgagagcttggcatttcttcacttaaaacctttcccaaatatttgtctaaaaatttagctaatctgatgggcttgaaataaacttttgctttgcagccagacatatttagattcaaatttttgctcttctgcttcctagctgagtgtctttggacaaaggtagcctctccatagagcagaagcaaataccatagcttgtactgctggtttgagaataaaaggaaatgttaacactgtctttgcatgtattgttgtcttttcaggtcagttgtcttctagcagttttatacataattcttagttactaactttttaaatgctagaacccaagttgagtacacagagaaaagtagattctttcaccttctaatcaatgctttggatatataacagtatttccctcattaatttactcaacaaacatttatcaagcatcaactatgtgccaggcattagtcaggacactgggatgcagtggccaacaagatccataaatatctattagaacagcactgcatatcaaattatatgacttcattgaaatgagttcttttctatttatttcacacagttgctaaacctctattttctttaaatgtaaaagtcaatttgagaaatgtattcaataatcatataggaaagcagtgacttactgtcctgaggaccacttcaaactaatcatttctcttcacaatccttccttcccctgatatgggggtataagtgttaccaaagaatatgtgcccatctctgtgctaagtgatttatcttatttcatttttatttctctgtaaagtagacaatttaaagatggacaacctgaagttcaaaaagcttaggtacttgaagaaggccacaaatctactaacccagatcaatctagctggttgaggcactgttggtttgtaatttcaaatgtgtaatatacattaggaagtggggggtaccggtttcagtatttgaacatgcagctttatgctcacaatgtgtggttccaaggtctcttaatggcagaataaaacttcagaacacagagaagagaacatgctggctcttccaaccatcagttttacatgctttcaattaatgcttgatctctgcaggtgggaatctgcagatgagacaatccatctgcagtcagtaatcactccatttcactgtcttgaactcctggctagtaagggcaattaaagtcacgcccctgctgagattcagactcagtgattgttgctgctcacttgccagaaaaagcaagaaccaatgtggaaaaattgaaccttattgaaaaaaaaaaaacaaaccctcttttctttgctgacttttaggcctgactttgatgcagaacatttaagaaatattgctattatagtatctgcttctagtgagggcttcaggctgcttgtactcatagcagaagatgaaggggagctggcatatacagagatcacatggtgatagaggaagcaagatagaagggagggaggtgccaggctctttttaacaaccagttcttatgggaagtaacaaagtgagaatctacttatccggctacccaccccagggaagacatatgtttattcaggagtgatctacctccattacccaaacacctcgcattaagccccacctccaacactggtaatcaaatttcaacatgagatttgaaggagtcaaacaaaccaaattatagcacagtcccaacatagtcactgtctggctatgtgatactgagtaactcagtgaccctctttgaaagctgtaagaacaatgaggataatggtacctgatctacagacttcagagaactgttgtgagggttaaatgaaattatcatggaaaagagctttgaaacactaccacacaaaatgcaaaggcaaggaatattttggttctctctcaacacaggctttgtgtggtagctggcaagggaagggtcctaaagaggtgccatggagagtggggagcctggtgctcctccacggctttcctcctgtggttagtactaacaatcagatgtggttgctgaatagagctgaaggctaacagctctgggtgaagatctttcaaagttctgccactggaggaaaaagccaacctccttgacccacaggtctctcagtccccatgactagggccttgagatgaggccccaaagactcagccccagctcagttttaggattaatctaatctcacacagaggactctaggaagcctttactcagtgacttggtggcacagatgtcaaaccaccagctgctctattgcctctattgctctgatctcacacccttcttcttgtaggtcagaggagtagtgagaagagggtatgggcttcagaatcctatgaacatggattccaatactggatctatcactggtttggttttaaataaacaggccaaatttctcagcctcagttttctctttatcacaatgcagatataaatagctactgaagaccaaattagtttacagaatttgtggtggggtctctgagtatatttgagcaatgtttataatgacttaaatatactggtctgaatgatgagtgtaagttatccaagaaaagggaaaggaagggcatttctggaagaaggaagattttgtgagcacaggaagcagaaatgagtccttatggtatagtgactgaaaagaaagacatgttaaataatcaagtttaatatgtgttgtgaccaactaagagaattcaaatgaattttaggttctccttggttttcttagcactatctccattctccagacttactctcctatgcctgtgggttgatgtttcttaaacagagattccctgccaggtattgcaggtaatcttgcctgtatgtacctgtaaattcttcactgctttagaaataagcattgggagaaaagcttaacaatcatagtccaaatatttgacttcaacctaagaactgcaaaaccaagtactataagttttcagaagaaacaactgcccttgccataatagttgctgaaaataccagcctccaagaaacagggattaacgaaaagcctcctacacaaagttcatcagcctccaaatgacacaaccactgaaggattttgagactcgcagatgagcacatgcagctggtaggaaatgggctgaagtcgcagcaccatgccattatctgcaggtgcactgaaagcaccaattaagcctggagacagggtgtttaggtggaaggatgggttttgagaagcaatttcattgtgaaacaaagttccacaatgtcctattgctgaatccagaaaaaaggaagaggcccttaatgcaaataagaaagctcttgactttgttttccacagtgcaaaacatcccagttataaatgttgacttatttttagagtcaggtttcagaaaacatctataccaacaaaatcaggaacaaagcatcttgaatttacaaatttcaaatagaaaacatctgatttagcttgcatgaatgtagtttttcaatcccctaagcaatttgtttcatgttgagattgcctcatgaataaaaaatgtcctggaaaagttggttttgttacatctcagatatttaatcaggcatcaggcacaggatagatgcaatgtgtatttattttctactttggctacaatatcaaggactgaaaaaatgtattgaaagatctgaaatgacaagctgagtagtaggagataattcccctgtggcatttagaaggtatatttttccttttgtctttccttgagtgctaattttattcttggtatcatctgcacccagcttgctccccttgcaccatcatctctgtggcccatgtcttgacttcctttatacaactttctttttcttgttcacactccagaaattgagtttctaagcctctccactccattcactaatacacagggtgtccagggcctgttaaacagtacgtcacagaacatatttgttgatgggctacctatgaaagcagcatcaactctatgggtacccttctctagagttcagtttgtatgtggtgcactgaaggtaacctgaacatgtgggtcagatctggtttcaaatcccaactgagtcacttacaaagccatgtgacctctgaccagatccttgaagtaccttctctgagcctactttctcctctgtaaagtgggaataacaatacccacctctcagaactgttgtaaaatttccatgaaaccaaataaataaatcactatatgcaaggcctggcatataatcgtattttctgtttaatgtgaattattactgcaatctaataactcatggttacttttcttgcttccacttaacgtaattataatgtgttcccagatacagaattaagtggaatacagtgtttgactttgagaatttcagtgaatgattctagaggaagaacatataagattttgacattattaaggtgagtagcgctcttttattatttgcaatttatctctttttgattcttacttagacagtatctgtttgcattctcacaacaacctcttaagggaattacaagcatccaggcattcctatttaagagacacagaaactaagttccagagaaaagaagtgagttgtccaaggttacagagctggtttgaagcagagccagggctataattccagttttctgacaacctatccaccataccatccaacttcagttttaggagctccaatatcctgtgagttcctagaaagctggcctttccatatttgtgtcctcaatgcctagccaagttcctggcacacaggaaatagtcaacaaatctttgatgagtgaataagtgttctgcctggaagcattaataagaaccacagtcagtcctaaatacagaatctagacatgatcccaggattattgggcaagaagttccactgccacttcagtagtttcacagagcaagagcaagctgaatcaggtacagcctatctcccagatccaataggtaatcaattccttctagtcttctcatacatatattacccattcttttcctgcagctcactcctgttctaatgagcttgagctagagatttatttatctgccagaggactattccaaatatacgagtcacagcatgagaacatcagaaacatagcagaatttccaaaaatgaaaatatatttcaaagtaatattttgctctgtattttctgtatcctttttttttttgagacggagtctcgctctgtcgcccaggctggagtgcagtggcgcgatctcggctcactgcaagctccgccccctgggttcacgtcattctcctgcctcagcctcccgagcagctgggaccacagactaattttttgtattttttagtagagacgaggtttcaccgtattagccaagatggtctcgatctcttgacctcgtgatccgcctgcctcggccttccaaagtcctgggattacaggcgtgagccaccgcgcccggcctattttctgtattctttaggccagcagcagttctgatgcttcaagcctcttcactcatttacaagatctaaagcactgaacagagatcttcctttaagagcagtacctagtgagtcaatcgttttcatgaacaggacatttggctcgagccagacagcatatggataggcactcagtcaacctcctgactgtagctctgcctgcttgcctaaggtcagacatgaaatgctgcctgagagtgcagttctccataagaggctgtcaaatccatgtctcctgaggtaaaggactttgtccaaagacccagcatggttctttctgaatcattttttaatacgcaacttccttgttaacatcaatttatggcatgcagaaggcaacctttctacaatgcttcgtgtctggagatctaaaataacaaattacccagaatccaaacaacaacctggatttggttttgtttctcatatttcaggacttctaaactaatctgttcttatattaaacactactcaatgacatctcatggttctctccaatccctaaagttacatggtattaaaatcctgaaaaactaagtgattaggcaattgaactatattttatttcaccttgtaaccaaattctttcaactggccttgaggttttttttttttttttttttttatgctatacaccatgtaacatataatagcctaaaaacattcatccataagaattctaacagtcgatagtgactgcctaacactcataaagaaatcacactccttacttgcttgcattcaagaaagagacttgtggttggggggtggcgcagaaaaaaagaagaaagccaaggcatttttctccatgtttctgcttcctgtgataattccaacagcagtggcacctcctccttggctcctactctgctgaacaggcctgcagtggttccagcttcctgtggttgattctggccctaagttccttcctttagtccttcagtttaggagtgggcatgttttcctgctgtggttaatctgtagattgccttgccatcttctgtttgtttctaggctctttcatggattatgcaacttactgttttatgatgtgccttttatttcaaatacttagaaggacttctgttttcctagttggaccctgttacatgctctatttcatttttctttgccttccacaaaacactgtgtgaaatattaaataagaatcagacatacttggtccaaattctaactacatctgctggaataagtaacactgcctgggactcagtcttcagtttcctcacctgtaaaacataacgacataactgattttacagggttgttgtggagattagatgagaatatgaatgagtatgaatccttagtgcataatgcccaaaaaatcctggttattatttctccaaactcagttctttacagccttgatagaataccttaactgtagtcacctagctttcaacatattttcccatgtaaaattttctaattcctccatgggtacctcaattagtatcatttactcttattaaaaacacctgtctttcctccagtctatgctatgaatttatttaaacctacctgccttcttaaataaactctatttcactcttatgactcatttgcacaatagcctccaggtattcaaaatgtacaaggtcaccctgcacttctgaaatatttttgaatgactaacatcaccttctttcctacctatcaggtttcatttgagtaaatttcttgaagatcataactatagttaccattaattttcttcaagtcatacatatacacattaaatgtcaaaaaaaatgaaaaaaatgatgctagttattgagtgaaacaaatatctaatcaggaaaatagtgtttgctgcacttttcttccactaattgaaaactaaggatggagggatttcagatgcaaataaaataccaggtgggttccacagtactgcatttaagtactgaacttcatagaagtagcatttgtccctgtcaggtgcaactgaacaccatgccttcagatgtactgtgtatatatgtgatagcagaggaagagcagaaaaactcagatgtggtcctcagttttcagatgacttagctaaatagagacatcactgagcagtaggaaacagcatgagaacatgaaacattataaagcatagaaaaaatttgtgttgcaaaacctatttagcaccataaacatgagaagagcctaatataaaggcctcttgacatagcagaaaatagctattggtagtctcttgaacttcaccatacagcagtgttaggtctcaccactgcccacaactcttacagccaaagtatatataaaataaatcactgtattaaaattaggaaaaagaaagtagatctcaataaatgtattttcttgtaaagagtggttagcttttagaaggcttggcatcaaaggtatgtgattcagttatgaaaaaaatacacttacatgtaaaaatttcattcctttcattcactgatttacataggtattgagcccttgctcccttccaagtactgctttaggcattggagatatgaagataaataaaacacagttcttgcccttaagaagagaagcactgagctaaagtagcaaatgttaaataaatattgtggggaagtgtcaaggtgtatactatacacttaaaatttaataagcataaatctggctctctctgcctataatgtgcatcctactccatttcacttggaaaaaggccctcagacaagatcagctcaaatatgacccttccaatctccactgtctgtgtctgtacatctctacagtgtactcactgcacacttctaggagtctctctcacctctaccctgttcctggtggaggactatgaaatcctcaaaagcaaaagtgacagtttattttctctgaacaacttctgcatatacttagttagctacacagaaatcaactgatcctgaatttgaattacccagcctttagaatgtgggagaggccttccttcacagtgctgttaagcagactggagactatctacgtaaaacgctagcacagttgctgacatgtagcagtcgctcagccaaatggaagcttttattattacctgttttttcaacattcaaaaacgtaaataactatgaaatgagaaattggctatacagttttatctcaagaaaatctgtatattgttcttaacttcctaatatgtataaaatcatcattttgtgacatttactagtatttctggaggtaaaatgcctaatgtcttgtttttttaaccattctacttaagtgggaccaacattcagaatggaatgtaataaagcaagactctatttggatactttgaatgtattaatgaatgtttctattgagaaacaattaagtttcaaaaaaaaaatagcacataagatgtactgtacaatcatccctcctcctcaatagaatatttaactttagcagctagtgagccagggataatgaggtgatgactcactttactggtgtgaaagataagaatgaataaatttataagtatttattatgcatttaaatagttaactacttcagtttgagcactattgacatcatctttcttgtaattaattctgttttacccattgtcctacttttactatagaagttaaaaagaggtttgacaattctccaggtacaatcagttatacgtcattttgctcatcattaaagccaaaagagtataaagcagggaactaggtgtccaaaattttggtactaccatattggtcaataggaaatagcagaaataaatagctaagttaacgcacacacacagacacacacacacacaaacatgcatgcagaccatgcacataattaagataaagagaagaaaaagagacaaaaaagttcaaatttgaatagagccatgtgaataattaatagtcaaaaaatattttgtggattaagtgtatgtaaaaatgctacaacatgggtgaacctggaggacattatgctaagtaaaataacccaggcagagaaaagcaagtactgtatgatctcacttatatgtgggatctaaaaaagttgacacaacagagaatagaaaggtagttaccagaggctgaggtggtcgggatggggttgggggtagggggaaaaagagatgggaaaaggagagatattgatcaaagggtacaaagttttggttagactggagtaatcagttttagatatttattgcactacatggtagtcataattaacaatactacatatatatatttcaaaattgcaaaaataacattcttaccacaaaaaagataagctggtgagatgatggatggatatgttatttaacatataacatggaacttaattctacaatgtatacgtagatcaaaatatcacattgtacttcacaaatatacacaattatttgtcaatcggaataaattgtatttaaaaatacttagattggaaaaaaaaaagaaaaagaaaagtcactatggccatccctccatcccttatcccttctctcattgaaaacaatgtagagcgtgggaaagaaattaaaaaattttaattccttttaaagaaaagaattttccccaagatatatgtatcacttaatggcagctatttattgagtaattattacgtgtcagccacagtggtaacagatacttaatattcatcatctcatttaatccttatactaattatgtgagttaggtgttatcatcacaacaatattcatttaaggaagctgtgtttcagagagtttacatgatttactccaaatcacatacttaataacaggcagaagtggtaattccaacctaggtttatctgattccaaagactttgcatttaaccactgtactcagtggcaatcaaaataaatggaattgataagtgccagtgtaattgtggcatatatgatattttgattctttgcctccatataagaattcttataacattgacataaagaaatggctctctactgtaagacaaaatgttattaatggtccacagaacagtttatcatatctatgttctttttaacataaggttttgccctttcatctttaacattttttcaagtgtataaattttagtcatctcatttgggtccagctcaaatgccacttccttttttaaggtctccatgatattctccagttgaaagtaatttctgcaaattttgaacttccatgcttttataatacaacttactatctttaattatttttagtaggaacatatcatctcctccactaggcttcaagcttccggaggtagtgatctatacctaaattatgtctgtgtcttctctgtgttgagaaaacatttgtacgtgtttagaacaggcaacgacttagacaagatatacattattttactggctaaaattctacgttaaactacctatgaaaatatgaatatgttaaataaatgaaaaatcagtagaaaaaaattttagtaacttaaaaaaactatgttaaagcattttatatacacttatacacatcagttggtaactaccaatcattcttacatattcattaaagtaggcctttgggtatcagtattcatccaaaaccatcatttttctcacataaaataatttagaaatagaaaaataatctattctatattgttattaattcagtttagcttttttttttctggctcaactataatggcaacccacaccattagaattacatgtatatacgtgttacttttagatgtacagcactctagttcttacaagtttgatttgggtagttattactaatggtcaacactgattgaaatagttaccatttttaaaaatgcaatcaacttagcatggcatgcaaaaatcattcaatactttactcttgccttcctttccagactcatttcccataccttcctccttccctggtattctataatactagcaaagcaaattcctaacattccctgaacatgccattctccacatttctgcctttcagctccttttgttagcttcctctctccacattcagtactttttatagacttctattagtacttattgcatgtttttctccaccaccagaccagaaaattttcttttagcctcagtgattagcatcatgttcagcacgcagcatgtgtaggcgcgcgacagatgaattaatgaatgtgagcctacttaaaattccccaaactcaggactcatttagatatccaaaaagaacaaaccttcctttcctacctcctgctctttaaaacaagctttaaatttagcatggtatgctaagcatattaccttttcaagctataaaattataactatcttcatacttagtcctaattggtcattaaataaactcttttgaaagttctggcaacatgtatctgtccattattaaccctctgaggagctagaaatgcagaactatccacttcgttgcctataaaaacagatcctcaaattaaaaaaacaaatacatctgatttgattttctcccagtttataccaggtatattcctctagattttcatttaggttgaaaaatttctgtttgtaaacatatttgcctgaaaccactactttatggcccaggtcaattgcatggttaaataaacaaataattaagcatataaatgaagcatttattatgggtaatttaaattcaaattaaacatttgctaagaaccatcgaagtgtaaaacactatgcaaagagctttcacaatcattatgattcttaaccaggcttcactggccactatgttaggtttaaaatggctcaaatcacctgaaattttgtgctatatgatatgcaataataataatagtaataataacaattataatagttaacatttattgaagacttatcatttgccaggtactaagctaaacagtttacaagaattaccatatttaattttcactacaacggaaagggaaattgagacttagcgaagttatataacttgctgaaagccacattcttaataactgcgcaaactggaaaattaacccaaactgtttgacccactctccgtgctcttctccactatatcaatacctctgttttcctgggaaatgttcattgctttcattagtttctcaaatggtctgtgaatcaaaattgttaagaatgtctcgtaagtattcacttagtcactcttcaaaacatcttgttaggcagtatattatcgctgttaattgatgtggaaagtaagaccacataacttgtatgtttgtaggcttataacattagatacaatttcccttttaatatagcatagcacaaggactatttttcttggttgtttctgtaattgatatttagatatagccatggtagcagctgggattattctgttgctgactcgagttaccaggatatcctgaagtgttgtcatgtaatgacatgtcatgaaggcaaaacttgagcccttgtggctaaaccaaggcctaagagagaattctataacctgaaacgtactctgaactgttattttccatatttttaaagtactctcctgccaccggtgcctctccataacagcatatccacgttccacatgccgcaggaaaaaaagtattaagattatttctaaaaacgagcttaggcactctcacagtaaaagaactccattgttttatacgcctacaggataaagccccaattgtctcacctggcttatacactctgactcccatccacttctctgtgttcctttcccaggactcccctttatgaacactgtacttgcaccatatgggtctttgtagtatttttcaatgagtcacacagcttcagaagtctgcttttaatatacagtcccttccacctgaaatgttcttcttgactactactcatctggaaaactataactcattcttcaagattacattcaggtctttttctctaagacattcccaaactggaaattcagatgaactcctctctatgggttttttgttcatggcgccatgattaatgcttttgtcataccatacatgtaattgttttaagtagaagtttcaaatagaccacaggcctactaagagaacacaatcccttattcacctctgcatcatattattaataattgtcacattgcctataacatcataggagccaaacaagtattggagaaagaaaggaagaaaattagcaggtggagaagggaaggaagacttgatctggttcttaagactgaggtcatctcagccattgtgtcttctcatcaagaaaattattctccttaagagagctgtggttatgttatgatgggagaacacaaaacaccatggaaagacaacattgcatatataaaagaaaatgttcatgtgagcacttgaacgaatcagttttacaatcttagtaatttgagaatacagctttgcaactaatatttgtaagaaaactacattgtaaacatacaatatttttatttcctaagcatttccaccttatccatctcattgaattcatataatatcctcattattctgatgtaggtattttttttcttttttgattggtaaactaaggcatagtaatagagtgacaactctagccttattccttctctctgtcgacctacgacatgaatcctacaaacttttttactggcctactttgttttatcagagaataagccataatttcaaaaatctttcttccaaaacccttggatgaaaggaaaaaagaagagtgaatatccatggtcatgtaacctgattttgatctgtttatcagatcctcttctttttctatttttagacaacaaattagatattaatccagaatcagttaagtccaaatatgggtttgtaatacagagtgggggtgaaactaaatgaaactccaggagagcagatggatttagctattgttaagttaggaatggtttccaagaacattttgtatagtccaaattgtcttctgtatgcaatttattaacagttaacatgtaaaaagtggctaaattgttcgcctcattgctcctgggctttgtggcaccttctagtatattgatgcttatgaatgaatttccttttaatggtcaaagcttctataagattaaaaaaatatgcttcggtaaaatggtccccccttctttgcttaaaatcacaatagccatctgtgcaaagctgctattgtgttccaagcattatacatctactagtgccctttgcacagttctgcagaataggcctaggctttatcaggctcatattacagcagagaaaagtgaattcatagaggttaagtgacatgtccaagatgcactgctggcagaggtaagacttaatccttgaactttttagcttcaaaccactctgttcaacttgcattgctttgtgtggcttatgtaacagcaaacacaacattggaagcacctctgaatcataataatcctaaacactcaactttgggaataccacattgaaagtatttaacatatggcccccaaattaaatgtagcatgcactttttaaaaattacagacagaactgaagtcatcactgaaagaaataaagttactaaaataactggtactgtagaaatttataatagctttgtcagaaagcatggaatgagatttgaacattttgcatggaatggttttgtatcagcattttaaatataatctttataaattaggctataattacaacagagtacttaaaatttattacacacgtattatgtgattggtactattgaacaggaagaacacatctctgcttaaaatctacttacagtttagtaagagagatcaacacatatattattacttaataattaacatatgctgagtaatacatgtaggtgttttggaggtacagaggctgatacaagattgaccttacccttaaggagattgtaacatactgggtactgtttactgaaatgtaatgcttttccctatactaggctgtctgctccataaatactgctaaaaatggaaaaagaaaatcctaccagttttcaaataagaccactaccaatggaaatagtaacccaattttccttcaacgaacacttaacaattgtctttcatggtctccaaagtaagatggagagaaaacaaaattgaatgagtagaacaaaataaaattgaataagtagaaggtctgggaggaatgaatggtctggtaggtaaaaagtcacggaaatacgcaagaaaacatagggcaatttgtgctctgtcagaacaaagaactctatgctacttattataattactgaatcatggtttttgaccccttactatttgccatgcactgtgctaagcacttatgtatgtcgtctaatttaattttcatacaactcattaaatatgccctattattcacccaaatctatagataaaattggggcttagagaagttgggtattttgcccaagatcacacaccaagtaaggatttcaattaaggcagtaaaactccagaatgtagtttcttgaccttgactttgctgttgatagagtgtttagaggatcttccaaccagaaattcccctttagctaagttcgaaaggtgagcagtatatgccatggaagcaagaggcttgaggagcaaggaggtgagtggtgacaaaccaggcagaaaaaaacagtgaacacaaagtcaaggaagcaaaaacaagacagactgtcacttgttaagcaaacagaaggcactttgttatgtctaccatgtagacatacggaggaagaagtgagaaatgaaataatgttaaggatacatatggagaaataatgtgaaggatacatatggaggaagaagtgagaaagaatgttaaggagcctaaatttgagacctcttaccaaatgtcacattggtaagtaaatctgtaaacattatcttaatcctcaaaatttccaagtggcataggtattattattataataattttacatataaggaaattgaggcttaaaatattaaataacttgcccacattgaagggttcaaaaatattaaagagattgactcaggagaactaggtacctcagtagactttggggctaagggaaatagaggagttaacaataacctccaaatttttaccttgggcaacgggagagataaaagttatttctccccctgcctgtgtttatagggcaaacaaaagcatcacaggaacagcaagaaaaatacaagaaacctaatcagttaccaaggttttgtttcaaaaaccttaaggaactattgctggaaaaggaacatagtactgttttctgtaattgtttgactatagctagattctctgaggcagtataatcacaaagaatctaatatgacaagccaacatcttatggcataaacctattcatcctagccgaattagtatcccaatctcttcctaagaatacacacattttgaatacaaaacaacttaattcaggtgaacttggttttaatcaaattcagctataattattcagtttcatgaaacacaatcaggtaatagttacttttcaaaaactaattttttttagaaaaacacacaataaaattgtcttcgtatagtctttccaatgcaattatatggatttgaaatacaatacatttataatgcttacacactgagccacgaagtgtaccaggccttttccatgtattatctcacttaattatcacaacaactccttgaattggtactatcattatctctattttacagttaaagaacgaaagctttgagcctttatttttccaaaatcatttctgaagaagagtgaatattcaagcacaatcattggctcaaaaatgtacgtcattgacaggttttcacagtttttcttttcaaagtattttcatgataataagtacatattaatcatgcacacatcgattatgttacagctagatggacctagcaccattgaaaagcacaaggtgtatttgttttccacaataaaaagtaatgtgtttagtcatgacaccttttgaaaaaaacacagctaatttctatcaccaaatcacttttaaaattcaattattcagttcaattattttatttaatgtctaccatcaaagaagaatgcatcagtataacattaaacatatttcacttgaaattcttaattattctaaatgtgtctggggatttgacctgcttaacaaaaaatacacaatagttcttggatagggcctttgctgataagtcattaactaaatagatgatataaaggtagcatgaaggcagaaagcaaaatagtgagatatagccatctgatccgaactttaaattcatagtgtttgtctttcacatacaaaattatctcactttctctgtttctgatttcagactgcctgtgaacattgagctaggtactttacaagtattagttcatttccttcttacaacagcacaatataaaatatattaaattgagtcaacaaatgaagaaaccaaggtccagaaagattaatctattcgtccaattgctaaacagaaataagtggcagaacaaagattcaaacatctatgatttaaatgacaaaatacaatcgactttttggtataagtaattgtaaaatatacaattcataaaatctaatttactttagagtctacttcatcatatgtaataagtgcatatacttcgttctaagtttaattgttcttttatagcatatatccaaagatgtgtatctgaaaaaattaaacgttcttctaagtaagaaataagatacctgaaattaatgacatatataagaatccttttacatatacattgctttaaagatgaagacacagttaatttatgaaaagtcaactgaatatactgttgcgttttttttgtttttctgccacaattcatcactgttgaattcttacaggacattttaggtagttctgaaaatacattgttattcaaatgtttaaaaataaaatttcatctcttcatatgtatagtatgaaatagtcatcaatcttcactgcgttgctatttttaaaactcagaattttcagtcatcttctggtgaataaaatcccatagtctgtgatccattacaattgtctgcttgcttatcactaccctctgtgccccactctcgagctccatttccttccaatgtctttgcccagtattcaaaatccccaagtctcttcagacctcagctacacatctatattctggatttcttcttggaaaagtgcaaatggatagaatttgtagccaggcagctttgcataaggaagagtcaaagaaacctggatttgattcttattaactgtaagtgcttgggcatgttcctgattttctccaaatgttagtggtgtagaaatttacttaacttgaagagctagggtaaagagtagaaataatgtcgttaaagtgtctgatgcacaggctaaatataataactgttggctttaatttaactaatattaataaaagaaagcccttctaaataagccctcagacttgtccaacaacaggatgagctgtatggtgaggggaagagcattctgtcaccaaaatgcactgaagagtgactaatcctagactaactcaagcaaagtaagaaatgactgttggagttcttattccaacattctaaaagaattctcacctgatttggccctaacctagagctctgatgtcttgcttagaatctggtacagggaaagtactcaaaaaacttgctttctaactcttccattctgactatcttcgtctccctcgttttcctaatgggctgggtactgactctgctttctttcttgtttggtatatgcaactctaaaggactcttttctacctctttttgctttgaggtaattggaaaaagagcttcatataggatagcttccagaattcaagaaggcaaacctcatgcactcatgaaagcagtaaacaggctatgtttgggaaagtgcatgacctgagtctcaacaactttgggtcaaatgtaggctgtaccacttcctagcagtaagacatgaagaaaataaactcatcttagactatttattcatctgtataatgggctaataactacctaatatgccaatatgagtattagagatatatgctttgttaaacacttagggttagctcttatatataataggtagttaataaatgctacttttcttcctttactttctttgctattaattcctaacccagcaagaagaacttgggtgaaaccttacagtgttcattaaagacattatttgtacagtataaaacaataatatttattttataaattatagcatcaagagaaaataattactcaagataatttggagtacactgaaatcaaataggagtgtccagttcagccaacctcagaatacataaatgaatgctaagtgcaaaaaaaaaatgaacaaaaatagcaagcaacaaaagcagtcttcagtttcatgggcatgtaaaaattgatgtgtattgagacattttgagaacgctttctacaagatgttgaagttgcagaataaaattattctgtgacaaaataactgatcaagtatagctaaccaaaatatcaaggaaataaaaatttctacaaaatcagatcttattcaaacataacatcaagaatggcattgtatggtaacattacatttaaaaagtcacattattccttcatctcacatatttggaatattggcctaaatagccctacattccagaggagaaaacagagagaggtttgacggcttgctcagtatcactcagtgagtaggagtgttgtctggatttcaagcttggtctgtcttattttaacatcctcctccatttgtttgcacttttaattattatagaggacacacaacgtaacttgaacatggaaaagcaaagacatcctcactatcagttggtttctggctaccctgacttcttgcccaaccttgaacttgcagtgagccactgagggacatcctgccatcattccccagtctagcacttaaacttccaccaagacatatgtaccggtccttgatcctggattgtctccagtctctgctttccattctggctttcaggatgtaaaacagaaagccatagacaagaccagtcacacggctgggtgaacactgtaggtctaggaatagccactccaatgagaccatcctgtcttcctcttggatccactcccaatcacagttgacttagactttttctcctgttcacaggcacctgttcccaagccatttctcttacttccaatacattttttttttctgttatcttaacgttgcacaattccagcaagagagaagactatttcttctgtttcatgtctacctgaatttgaatctcagcccttctatgcattgtcaggtgactggataagtcacttaatctctataatgtcacacttccattctttaacatgagaactatgacatgatagtgtaggtacttctgcctttcttcattcaagttatcctttacttctaggaattattttgagggaaaatgcatgtagcatagcccctagctcagaatagatactgaatgcatgataggtcctgtactcccattctcaccctggatacttcttgtgggacatgtgtccttaagccaataccctactctctcagacttccaaaatgttacaattgaaagggaatttggaagtgtttgagctcccccaacccaggcacattttatttttctttttactgaaaagtaaactgagtccctgaaaatagaaaagatgtactcatagcagaactgattctgaaatcccagttttataattcctaatatttggcagcttccttcatgcccaacttgcagtgtcctcattgtcttctttctgtggctctacttaaagccccgaacagtgccttcatttgtctttgcagatgtatccagatcacaccttatttttcttctttatttctctaaaggttttctcaagtcatactcagctgtggtctctatgtttccccctttctgtcgaaatcgtcatccacaattttgttttcatcctatgaactctaatggaattaccaaatcccatgtttttctcaataattactctcctctgctgggccatataactgctttgttcatttccacaggcctagcacaaacctggaaaatagtattgaatacatatatttgctaaatgaacgaataaataaatcatcaataacatcagctccctgatccttgggatacttgccttgctttattcctgtggtactaaacctcttggtcttctgtgctatacttcttttaccctgcacctctcaaagctgggatttttgaccttgtggttcttgctacatgttctgcattctgacagcagtaacagtggttgactctcaaatctgtagctacagctttactctaatgtacttagtgctgtgtttcaactgggcaggttcatcaaccatgtgaatggttcactatcaccccaaacttactgtgcaaatggacttaaaatcaaattcttcacttacttctaatttccctagttctgttgacagaacatcattctttcagacctctggacttaaaatgtaaaaggtcttttgattcttttgttttccccttccttacacattaattagtcactaagccttgattatcctctcaaatatttccttttgctctgtctcaaagcacttctcactcttaacacctttaggcattctttgtgacctttctaattctaactcatcctttccaagtattacttctgcattgaaacctttattgacctcacagtttaaatcaggccttatatacacgatctcctatcatgtctttcccttctttctagctgttattgtatatctatttaagtcttctgtctcttccactatactataaactccatgaaggagggactacatctattttcttcatcattgccttctcagaaccttacacagtgtctggcatatgaaaagatctataaatacttgttaaaaagctaatgaattaataattacttatcgagataaaaaagtaaatgaactaataattacatattgagagaatcaactttttcctacagagatttcatgcctgatatcactttgtccttatagtattatcaaaacagggagtttatacttgtaaaaagtttcaccaaaaattcttaaaaataaaaaatgttttacacacttaaaaggggcttaccttattagagaaaaatgtgcttaagcagaatccacactctcattatgcaagatgaatgaagtgttcctatgcttagattaattgagtcatccttctttcaaaaaaatgaatatgctgtctttacaagaaagactgttaggttctaccatacaaatgaatcatggtttccattgtgtctactgtagtagggtttactaaatttctctgaagaaaaccctgagaccctgacttgctctaaatgatcaacttttctttcctcagattagatttgaacaaagccataggataatgaagatgatgatttctaccaagataagcagtgggtgctgaaaaaaagtgattcaacaaatgaagaaaacaaatatttaccattcatgtttgcaaggatcacacagttgcccaccacaaatacaccctctatgagataaacaaataaagctcaagtccacaaaatgccccacactaaactatagttttctcaaaacattagcatacgattagttacttgggtctcaagagcttgagttaagagaaaaaacaaattttggtaggtaaatttgataacaatgaacataagcaaactagccaaatcttcaattttgaagatattctcagtgaaagtgttaaataagagaataaaaatacattttttagactagaaatgtccataagagctcctggataatatttttagtgtcttcttagcttagaaaataatgctaaaactatgtagtgaagatatatatatatatatatatatatatacacgtgtgtgtgtgtgtgtgtgtgtgtgtgtgtatttatatatgtattttagggtaatacattccccagaatagcacattattatattgttttttcctctgttttaaataacagtaataacagcagccagtacttcttagcatatatcatattaactgcctgtatatttaatttataatctcatttaattcttacaatatgtgttttaatatgccactagtcttttcattttgcacttgaagacaagtcttcaggaagtttaagtatctttcccacatccctactgctaataaatggtaggagtttttaatccagatctgttgaatttgcaaactcacatccctacctctatgacactctatgttcacagatgctgattcttaaattataaggagtctaaatctgagttctgcaaagttttgttcttctgtaaagtatttaaaagaagaaacaacatttcacttcagagtatagttttcagagtttggcagacttgagtttgaagaccagcttagcccatttagctctataaaactatgggacgttatttattactctgggcccctaatttctcattaatataatgggactaccatctagacagtcattccttcatgtatacaacaaatattaataagcacctactatgtgtgaggtatcatactgaaaattagaggtaaagatatacataaataagagatagccctggccctcatggagtatacaacctaaattttctacatgtaggctcaaattcacaccaatataatgtttaaaaatatgaaaatatgaataattttactattcaaatggcttaaccattattgaccagagcttttcctaagtaattaattcattaattttgttactttcacaaagcactgacatttcccacttcttgattggttcttctagacagaaaccctgattaaagttgaatctacaggtagtaactagttaattcatatatatatatacacacacacacacatatatatacacattatgtatatatacacatatatatacattatgtatatacacatatatattatatatatattttaaatttaagtaggcacatgagcatgtacacatgtgcacactcatttctagaaaaggatttgaggtggcttgctagttaatttaagaacaaactttttagctggttgctcttagcaacagtctttagcagttctgcctagttggccagaatgatttcttaaagggaatgaagcattcaaagtagtttaactaacacatggaaaataaatgacttacttcagaaagacttacacagggactgggaattctaacgtagttgggatggagaagacaatggtgctgagaagccccctacacataggggaattttccagagatttccttcccctggactatctcatgcctacatgtctaacaaagccagaagaccagagcaacatggctgacaggttcctgtggcagcactggaaccaggcctcatcctacaaagtacaggaccaacccttcttaccagttctattgcaaatcattcagttctattgaagacactggaccatacatggattctatgtcagagagacaaaagctgcttattttataagcaataaaagcaaaacaaatcctttccagctggtatgaaactatcgattattttaagatggatttaaactaactcacaaaatataggttactatgggaattatgtttacagacattcatgcatccattcattcctcaccaagtacttatcaaccaacttctaggtctcagtcttggtgaccaagcgattcatttatttgttcattcaatatatatttatcaaatacctcattttccctctgctgtcatgaagtggagttcagtagaaattatatgcagataaaaatatcttaaaaatgaagtatgatgggtgtcattattcaacaggtccttctttgaaattaacactaggtctcaattgcctaaataattaaacaatagattatatcaaccattcattcaacaaacataataaattgaacttatgttgtaagcactatagcagtagctaggtgttctggatgttaagtcccagactctgacacctcatgatatttacagccttgtgacacttgagttcaatatgaaggaaagaagtccatgactccatgtgagcagagatgatacaaagtccagggatgtcttccatgaagagatgacacaaattgagtcctgaaggaatactattaatatttccttgatggcttccctccttggatagcgtccataccattgtaaggcactaggcaagtttagaaaaagatcaatactgtatttgctaaacaaacgaatgttcttgttggcaataagtagaatatttatatgcaatgattaaataatagcacaaggtgctaacacaattcagagccaaaagcaactatacagagagtgctttgggggctctgaaaagccagattatatacaaggaaagatttcaaactgttcaataagtcaggattattcaattgaaactaagcaactttagacatactgtataaatgatctcattaatattttctgagtgatacattgaaacatcttgattgaacacaattcaacatagaattagattaaatggaactgagtctgtgataggtaataaggatcttcaaaaccatcatctatgaaatacatcaggtcctgaacattaacacgctggtactgatgaaacttactttggaaaatctgcttctccagacagaaagcaagaaagtaatcttgacttgtaactagtaaaacaagtaaataaacaagaaaacagagacaggaggaaagaagaaaggaagaaaggaaggaagggagggagggagggacttctataaatctatttaagtctattcattatctcttactttgctacaaatttcattacattggcgctgaagttgctatacagttttccaaaactgcttcagagagaaactaagtaaacattgtcaattaaacgtaaatacaaaaagttaacctaacaactgtaaaggaagtctagagttttccagatagacctcttctctaaagttatatttaagggagacttgtacaccaatgccaaatgcttattcaaaattgcagaacacctagctgtgacagtgcaaaatgaaacatttcagattatcctttctggtcagaaaaatctgaaagttatcttcctgagtccaaagaatggaagaaaaaacatgaatgagggtctggcaacatccaaaaattggccagacctagcaaatatagctccccaagcgaacacctagagtctgaatactagtagaatgctgattaatctgagatcaaatctataagtgatttttatctgcctccccagaacccagaacatctaccacctaagctatctttacagagagataaagatttttatttttttcattcagatatatttgattctacaaatctcctctgtaggagaagtagcagggttttgggcacatgcaaattcttgctgagtttcctggcttgacactaaaagtgtaaataactgacatggaggtgtatgtgaaactgatttaactggaagtatcaaggtaatatccaggtcctggacttctgaagtggaatggaaaagaataaaacagaaagccagcagtgacttcaactggcctaactacatactcttatccattataagagtacaataggttgtattcccaagctaggagctggctgaaagaggtcagaagccagaggaaagaagagaccaatatctgaagtccttcagctctacttctgcccttatgatctgaaacatttgtcagccttcattgcacagatggaattttacctgagagtatgcattagctgagccctctgtactatgtatactctggctttcaagatttgactaggtaacatgcactcattttgatcatacaaatatataaataaaaactgtggggcaagcaccagcttctccctttgctcttggtagcatcccagaaatacataggtttagtgctttggaagcatggtcagtccccggaaaatgctcaaagagggacaaacaagaaaaatagagactttccctgggctcagagtcagaaacctgggcttaaacccaagtgccacgactttgggcttggtcactttgggcaaggtatagccaaatttatgtataaacatgaaaggaactttaatttggggccatctagtctagcccccaaatagttctttgatcatctgaaaaatattatggagaaatggtcttcagcctgatgtttgaaccttactagtaaagagaattttcatcttaatgtgccttagtgttctcgtctataaaaatatctacctcatagagatgttgtattaagggataaaagataactagtttacgaaggctttctatataataacagtaaacattattttaaaatatgagtgagaccaagattgagaatactttctaaattgccagataaaatcattacaaagagataagttctgtacacagcaagcaaatacacaatccccatttttagtctcttaaaccttatgaccactttctctaagaccgtttttgaaattcaatttagtacttctagtggaagaacaaaggtgcagtttgcatattctgggtttcctatttatctacagccacattttttttttctttgcaaacttttcaagataaaaattttaaaccccagagctctggaagatgcttgctctcccttcagccaaaacaggcatccggtttctacaataaatgagatcatagcatccccactcatactgctgtagctaggaacctgtcagcatttttattataaaacccttttctttcctctggcttgagagaccaaccatagcaatttgttggggaaatagctacagcaaagggcaatgcacaagtacagagagaaaatgtctcattttacaaaattcaaaaaaggtgtatttaggaattaggcaggcctgcagaatcccaaggagcatttcttttggatggtcatctggccttttaaataaagaaaataaagtttactaatatttaaaacaaaattttctcaggcagcagatgttaggaaaaaagttgtctagttgaataccatcaggcaccaatacatctggtaacaaaagctataataacacacacattactgaatctgtgctcacatggaagctgctgtgagggaagggagcattctctatcagactctgaagtgagataatggggatgggaaaggttatgccaactacttcaaataggagaaaataggatatattaataatatgctagagatgataaatgaaaccttatctagcaaagtgatggcacttggtgaatactcagcgaaggaagattgaatacagttaatatatggtctggttgacacagttaactcttttctttctcactcctgagtcttgggtatgaacatgaaaaagcttctttctaggttatttcatactatgttaatgcaaataaaagtgaaaagagaaaggactacatctgagagagtaagagaaagaaaactaatatttatttaatgattactacatgtgagacattgtatttgttgctttcttgtttggttggtataacaaacacattaaatatatcttatctatgtcatatagatgaagaaactagagctcagagaagtgaaagagcttccccaaagtcacagagctaatggttcagtcacaatactttgcagtgccaaactctaccctcaggacttgcttcttacatctatgtttgcctgcccaagagcatacacagagtatctttgcttggtacagagggtagaataggatatataatctcacattctctccccctcttcctccctttctcctttcccacttctatccaaggggaaggcacaccttcaatgccccactactactttcaacacttctcaagaagtgttggaccatagagatcaattgtagacttgaatagaaaatcaaattatttttcctttctgacacagtacaaggctttaaaaaactgagatttactctgactaactcctaaaatccttctctatacctaaagacatcattggttctcttgtcttctcattatctggagcagggccttcaacttactgaagtatgagactacttttaaactactgtatgggccctcatctgatattagttgtacttatgaagagagagtgtcacatagcaattaataacttccaaatgaatagcgtatagattaattttgaatagcatatagattaattcatgtcaagtccttagaataaaacactgtgggtggtgatcacccaaaaagggttagtccaatctgctttgtgagttgtttttcccatgtacatttcttagtactagctcaccagcaaaactgaaaggtccccaaggcaggaactattttaccgtatttgagcattaacctgaggtgcccactataatgttaaacataatatatatgctcaagagagaactagaaattgattaatggacaagtgtacctacatttctccaaatggagattttcaccaaaccataatgaggatacttgagacatggctccaagagaaaaatcgaagtctcctacccttagataataagccaactgacatgtgagtagctgccatcttatttgagaacttataaaataatatcattattatttgataatatgatagtatcattatttgccatatgatgcagtgatatcattaatccctgcctggtttaatccataatgtggatattaaggctgttacagtgcactggaccagcattttagagataatgactgtttttagtgtgctcattcatcaaactaaataatttaaactactttaggaatttggaaaaaaacttcaataaagataatacatgaaaccccatcaaaattatgtattttatattaggaattacacacacacacacatacacacacacaaatggaagtttcaaaaatattaccttatttataagatttccagaagccatcattcaggatgctattgttattctatctgacaccatcatttaaatttatatggaaaaaatattactgtgttctttataatcactgaaatatataatgtgttcataagtctgacaagtacattcatatatatatagatatatatatatatatatatatagagctgaaaaaagcattaaagtagttttaaatgttttctactatttaaatgttttctactatggtgtctctggaagtataatctgtgacttacaataaagtaaatccataaccttatgaggaaactattttaatttcaataagatcaccatggcatggagatctgattgcgtttatgatttatcagcttctctgtaccttactagacaagaatggccaattagtgatgacagagccaggcatctcaccccagatactagctgcattattcagggttctccaaagaaacagaaccagtaagagagagagagagagagagagagagagagagagagagagagagagagagatcgatcgatctagctatcctcccccaccccctcccccaccccccacacacatatgaattggttcccattatcacggaggttttgtcccaaggtcagcagtcagcaagctggagaccccagagagccaacatgcagttccaattctagtctaaaggcctgagaactgagaaagctgatgatataagttccagcacaaaagccagcaggctcaaaacccaaaaagagccaatgcttcacttcaagtccaaaggccagtaaagatcaatgcatcagctcaaagcaggcaggcaggaggagctccctcttactcaggctttttgttctattcaggtcttcaactggttggatgaggctcacccacattagggaggacaatctgctttattgggtctaccaatttaatctcatccagaaacaatctctcagatatacccagaatgatatttaaccaaatgtctggccagtcaaggtgacacataaagttaaccaccacatcaaggtaccacattaagtaatgcctagtctttatttcagggatcttccaggcattatactaaatgaatataatatggctcctgcccctaaaatccctacagtttacacgggcaaatggataagcaaacagaatttacaattgaatattacaattaggatacaattattaagtattacatgccataagagtccaggggtaatttaattcaaaagatactgggaatgatttcaccatatgtactttatttaaaactttccctggatatccataagtgagtacaaggcaaaaggcttcttaaagtctgagctctttcagtattctgaattgtacaattcaatattccctttctgtgaacatactttattggtggcataaaagttaaccctccttatttttttatattcaacgtttttctctcaaattttctaaaattaaaaataaaaactgtaaaagaccttgaagtggcaagtatgtattgtcaagggggtcaaaaggtcaatgcagcctgcttgtttgggacattcagcacctgtttaactccttagctcatttttcattttctctttctgggtcaggtataatctaggatttttgtttttggtatgaattatataaacttctagattcttctttttgtagcattagaagccttcaacaacgtgttggtaggttaaaatacctccaatttactgataggtgaatttcaaagtgtttgatttaatactacccagttgactctatctgcaatctacatcttctcagcaatatgtaaagtagtttaataaaatagaaaaaaaatccacttattttatagttaccacataccaggcattgtgctaaatgttttgatatgtgatctatcacttaatttttacaacagtcctgaaaggagggtgttatttttccaacttcttgcagataaaacttgtcagtttctcttttctcaccttgatttccaaaacttctagttcagagttagaggtcatgacgtagaaagaataacattgagttcgaaactagaagacctagttgtagccttggctgtgtaacttgctgtgtgaccttgagtaagtcatattctatccatgtgatttaataacctcatgcagaaaatgatagtgtgaatactatgagaaatgatgtttggatcaaactcctctcaaaagaaattcttgtacaataaaactgactcctctcatcagtgtaccttacattcaaattcaggtgtgcataaatgacatttttgcaaattgactcatagcttaaaggcacttaagcatagaatcctgctatttgaaagagtacaaaattatattggaaatgagtgtatattccaaatctaacctgcttaggttcaaattttggctctgctatttaagagtgatatgactttgggcaaattacttaaaccacctgcaccccaatttctctacctgtaacactggggtaaccagggtaactactatacccatctcaaaggggcactgtaaagattaagtgagttgacatttctgaaaacactgtctgacaactggtagcaggtcagtgtgtgtatgtattgagagagaaactgaagtcttggcaatgtaaatagctgtctccttaatgtaccaattttgaacacttggattttttgcatattaggtatttttgaggtgatacaaagcaatatagtcgtgagactcctattaactcaaagtctaacagagttttaacccgattcacaggagaaaaactagactacctcttatttacaaatccataaagtaaagatgaagaatgtgatgacatataaagtagcttgcagcaatataaatttatataactatgattaaaataaatgcagaaatacccatcatcaagcatcttaaattattttttaaaatctgacttagtaattttacttattctatcctatccaaaggaaataattttaaatccaaaagagacttattccccaagatgttgattttatttttaatagtagaaaatttaaggggaaaaaagccaaaatatcaaaaggatggttaactgttatacagcaattaaaatacattcacaaagcctaatataaatttaaattattcaaatgcagactcaacatgattacaactacacttttaaaataagtcatgtataaaccaaggaaaccaaaatagtactgggaaactaggaaaatacacactaaaatattaagtttttacatctagtcctctgaaacaaaaagtattttctaaagtttgttttttgaatttctgtttttttctaatatatttcaatgaacacatgttactataaaataaaaaaaaaacatataccaaaatggtcaacctttggcaatattcaaaataggtaaagggaaactaccctgctagtgacaaaaaatatgcataatgatatatgaattgatggctcctctgctaccactaatgttttacaacaaagttggccacatttaaataaacaaatgggcaaacaaaactacttctctgccacagagactgtctaggcaggaaaaaggggtctgggagaggtggagaaaggcagaaggttccagggaactgtccaccaaggaggtgctgacaggccctctgatattgggtgagtgttagagcaccctctggaggctgggagcccacaacccatttcctctttctctttctctttctctttctctctctttctctttctctttctctttctctttctctttctctttctttctctttctctttctctttctctttctctctctctctctctctctctttctctctctctctctctctctctctctgcctccccgccccacccaagactttcccttcccatctttcccttcctatcattctgttctattttctttccttccctgctccttcttctgtttgcctggtaactacggagattggaagaaataacactggtaaaacacctaagatactgtatatatgtttaataaaaccaaattattttaccccttccttttgctgttttagtccttgaactcatccctttcttcttctgattccctcccttttttatttttccattttcttccattttaaccttccacttactctccctattctctcttttgtgagagtcaccctgtagaagaaaggtaggttgctttctagaagatgactcctttcctttgagggttagggcagttacaaaaggtccaaatactcaccagaaaaaaataaaatttcaggactctataacattttcaaaaactttcccctatcttaatatataaaaacaatattgaagatacctgatgtgtcctacgggcttcacagtggttcagttgagctgttatattaacaaattgctattatgagaaagaaagaggtgctcaagttttagccatgtttcttttaaaactgtaaatattcaaaatatacaacataatgttttgatatagtgaaatggttactacagccaaactaattaacatacccattatctgtgttacactctgtgtgtgtgtatgtgtgtgtgtatgtaagaatacctaaaatctactctcttagcaaatttctggtatacaatccaatattaactatagtccaaacactgtacctgagatctctaggtttattcattccacataaccgcaactttgtttcctgcaacccacatcttcaaatttcctcccaatctcccataaccaccattctactgagtttgtatgtgttctactttttttttacattccacatataagtgaggtcagcagcattttcctatcttcagtttatttcatttagtttaatgtcctccaggtgtatccatgttattgcaaatgtaaggttatccttcttttcaaaggttggataatattctaatttatagaatagatataaatgtatctctataaaatagatacatgccacaatttcttcatccatttatttgtcaatgaacacttaggttgtttccatatcttggctattatgaattatttaaaatagtgttgcagtgaacatgagaatgcagatatctctgtgagatgctaatttcgtttcctttggttatatatctaaaaggggattgctaggttatatggtaattctatttgtaatacatttagaaaccttcacactgttttccataattatcacactaatttacattctcaccaacagtgtacataggttcccttttctccatacccttgacaacactggttacctcttgtctttttgataacagccattttaatagtatgagatgatatctcactgtggttttgattctcattttcctgatacttaacgatgttgagcacctctccttgtacccactggccattttaatgtctcctttgaagaagtgtctatccaggtcccttgtgcattttttttaacataagccatatttcaattacatcttccttttaattaaaatagtaaagcaaaggaataattgtagagaatactgtaatttataaagtatttttagaatattaggacaaataacaaatattcttttatgtttgtatgtatttttatcttagaaatattggggaataaaagaagggagacacacacacatggactgtggacctttgcaatgcagctatagacaagataaaggaaagagaaatactatataggctggcccttgaaattaaattcaatactttgatctttgtggatggagaaaacagttaagtgaaggtaaagttgatgcctattttctgataatgacataaaaactactatgacaaagaaaaaaaccttttagaagacctccttccccatggcaagcccattcccataaatagccttgtaggtgtgatgatggcatatggacaggggcaaaaaaaaaaaaaaaggtaggggggaactgatataatagaaaatctttttttttggaagaaggttattttggtttctctcatgagaacttaaggttagatgggactgtaggtgatctgtattttaataaaagaagtggaattacttcctcaataggcttggaattaatttctggaataaatggtgttgtacttacgtttgtatctctaatgcccatcataatgcctagcatggaaagacactccatgtttacagtcataagtcgtatagtcagttaactaaattgaatagctctcaggatgcaacaagacggaccctggagatggctaagtgacaaaagaagataacttttgagtgtctagcttgaaagctcaaattactcagcatccttgaagccattctgagataattagagcaaacagttttagtgtttttgaaactgacagtctggcctacccatgaaaatggttttagactttgccatgtaaataactttcaggaaaggaaataaatattcatcctaataatcttattttcacacttagtaggtaatcttgaaatgactgcaggtttctgaagtatccttattgaaatctgtgtctccatgattttttcaaaaattatttaaatcccattttaattactaaaagattcaatgaaaatccttattttatatttttttcttaaatcaatattgtaagaaatgtaatcatctgccatatcacttaaatttgagaccaaagggaacaagagcagtttattgctatgcctccagtgtgtagaatttctagtgtggtcaataaatatttgctgatcaaatggaataatagtataatttgttaattaattttcataaatgtacttcattttatgaatgtcatatcaatatataaatggttcctatattttacataaacagcatagagcaaagaaaaataactttgggaaaagtaatgattgatttcttaataaagatgaagaatttatcaagagaactatcttaataacagtgggagcagtttctcctataagtaataagcccacctcagtgaagctatgaaaataattaaggccatataagcaacaatcatttgatgaatttatacatagtaagtactgcatgcatctcatttaactgttatttctcacaatgacatagtaatatatactgcagtagttattgctgtggccactttacatatgaagaaactgagacttacataaatcatatcaatagtaagtataaaatttagctttgaaacttaagcctgtctgtgaggtaaattttgcatattattttctgttgtcatctgtcagataatgttgaagaacttcactaggaggaaggctacagtagaaagtcccaatactctttccatatttaagattataagatagaatccttatgtcaacccatctataattaaccttctgttaagtatggttataatataataattgatcccattataaagggatttgagaattatcttattcaaatactttgcaaaataagatgggttagagtctctaaaagcattattttattttcacataacattaatttatttttcaaaaaacgatgtctgcaaacacacatgacataggtgtttcactctattgacatgaatctctctcataaagtgaatttgttaaatccgaataccaaaaggaagagaacataaagaaagttaaactaatgtatttccttagccttaaaaaaaaaagtgtgtgcttgaaattattttaattccctccaatatggtttgaaagttaggggaaaacctaacagcataaaagaaacttgtttgtaaatgaacttgaagggtcgaatgcatattcaacaacattctctacaccaatggcttatcttatttgattattagcttgtgtttaatttcccttgacaaataattcacctttgttaaatatcatttagcaccgctaagtaattcttgtaagttcatgggaatggattttaaacagtagccattgcaaggatgctactgtaaatgcagttaggagagtgaataaaagcatgaggtaggggtggcaggttgtatgggagagaacctaactccttagttattggtgctattcattcacatacatcttcctgacagtgatgaacacacaaaccttcaacaattctaagatctcttcggggtttccaaaggaacaacaagctactctttagtatgggcaatatattttttaaccaaccctacagtgtaacctatcatattgagtagaaaaacataaatctctggcaataatattatcattcaatgacttcatgaaagacataaccagagattgttagagctggcaggtgcctcagagataatctcatccacagtcctcattttacagaagaaaatctgaggcccagagaagattctctaggcatagccaatataagacttaaaatcctgactcccaatttttccgttaagcttacacctcctgtgagcactatccatgaagttcagtgtgtgtgtttcattaactttactgcctaaggtgcttaccagctgtccaatccaatctctggtgttatctttcagaaaaataggaattatgtgatatacattcacttagagaagtcaaacttcagttatttcagatgaagaaagctctctctctttctctctctctctccttagacagtcaccatagtagccacatgaagtgttttatataaataagctggacaaatccactggcttttcacaacaaaaagaagtgaagacttgtaacttacagtaacaggacatgcactcaggccattaatgggctaaaactgttcaaacaccaagttctatgcatctttttcaaggagtgcgtcgtcaggtccaacaaggaagcaccattaatatatttcagaaaaggagcaatgaatgataacctgttttaaaaaccttcaaacctcatttctctgggaacaccaatcacctttacaaaaatctggggtgggacagttatttactacaaacttcactgagtaactgcgccacctcttgataaaatttgtttgttgatttcaagtggattgtataaaagggaaaagcatgcaactgggggcaacctgagcctagctccagattttctgtctaaaataaaaataagctgtttatcttaaaaaatgtcagtttatctagagttcatcgaccaccccacttactcctgctagttagcccagtgggttggggctctaggtggtagtaacctgagatgagttcaggagctcccaaattagcagtctggagcccagtcactagctaaatgcataaggagatcccaagcagagagccacccaaggtgccccatttccgagctgcatctgctcttgtagcctctgtatgttagagaccagggtcccatcaccattgagttatgagcccaacatcggacgccagaaaatcagtgcgatctcttggcccccaaacccagctggctcccagaaagagcagagcagtcgcagcttctgtcactctcccaacaggcagacataaacaagcaacagaaggaattgttctctcccccgagggaggcaacatgcattaaaaagacatgaacctcttcctaccttgcatccaaacatcaacgataaagtgttgttggtgcaagcaactttgcagtggcaaatcattggtgtaaaacagtcagggtccttaacaacaggggacattccttccgggctgcggcagtggcagctcgctgggggacccaaacgctgtgctcgccgggcacatggagcgacagcctagaccgagctgccgcttcgatcactgccccctgcacccgccgtggccatcccggagccccggtggaagcaacgccgcgggcaagtaccgagcctctcggggtctcccttccctggggaacgaggcgtgtggggggagggacagaaccaagaaagaatttttccccctacggtgaatttgggggaggtaaaataaaaataaaataaaataaaaataaaccataaaaataaaaggaagccaggcacttagaggagggttcaaaggaggtggggcagtattagcatgtaaaaggatgtgcccgcctactctccccagtcacacaagattgtcatgcgagctgaagggggctgaaattattccctctgaagaagaagaagaagaagaaaacatactgcagctcccgatttggtaaaaagccagtggcttgctgcaatccagagtcactgtggggagcgctggccgggcaagtggggtgggaggaaggggctgagaaagggaggaagcgctgtgcttgccagactggccctgcctttgggcgctcttggtgccacgaaggagtccccagcgtgggagcgcgggacctccccgcgctgacgtgaccccgagactgcatttggcccccaccgctacagccacccgagggtagaagacctccgaggccgacttcccgggaaggggaggcccgctcggagcgcggcagggaacttcctcccagccctttgacaacagcatgccttgccgggggcagagggccagcaaagaaatctggggtagaaaacaggctcaaaatgatttcgctggtgccctacgaggttgacttctggttcagcgagcctactcactccctgggtagggaagcggcctcagaaccaaggctttatttgacataacatttgtcaaactcaaaaaagaagtgtctgccccttccccaccttgatgtctttgagactccaggaaaccccagaagtagtatttatgttgttccagaagtatgaatgacaagactgatggatgttttattgtttgtttgtttttttgtttttaactgaggctgtcaaaattgcagaaagaccaaaaaaaaaaaaaaatcagcatgtggctggctggcacagctgcaaaattgcttatggaagacaaaaacaaatgtgataagaagggtgtgggggtaggaagtgggtaaaactagcactctttgggtgccacctgggtgcctggcactatgcctcacagatggttggtagaaagagagcaaaacatccgagtttggaaacagattctggctctggtgctagatgtggctttgtgtaagtcatttacattatccaaacccctgtttgcttacctgtaactagatggtattaacccctaacctaaagggttgtcaggaagactagacagatatactgaacaacacattcctgtggtaagccccagtacatggtagctgctcttaacttacatagcttatttcatttcttagcttcagaggtagatattatttgacatattttttttctaggggaagaaactgagccccttagtgttatatcacttgctcaagtcacataatcaataaacctgaaggttaggttcaaagaaaagtagtagaggagagtttagaaaacagcatcatgagagacataacacacttctccagaaacatgttccaaagtcttcagatttatttgggaaggaccaggactgtcacatttacatgaatgtggtaattccaagacacttaacaatttggtgctaaattcagaaatcccacctgaaatacaggaacaacatagtcaaaagtatccatggcaaactgttagaaccacatcctcctgatgcaattccatcagaatgtcagaccacctatatccgaaactaataagagcctcaatatcatggtatgcttcctccttagaaagtttaaatgtattggttagaacaaaagaacataccaacttgtaaacctttaagtcaaagacagtgccttataacatgcctttgccccacccatatccaaaatactctcgtcccttctcccaagttaatagaaaataaacctgattatgtcataattctctatgatgcttattataaatatggattatgaagcccaaccctacattttcatcccataggccagtagaatgtcaataaatctacattttaatcagcccccttgtgagaggaatgcaagtcctctttatgaaataagacttatctgaaggaaactcaatatggaacaaagtatgagcaaaattcaacacggaaagaccctcagagttgagttacacctggttctaactgtagagggcagccatgcctaaggttttgggattcttacactaagtgcagaagtccttgcctagtagatttctccattaggaatcagtactgattcaatctaatgaatagctggagggactcaggaggtctaatctatacgttcttaaatgtactaggtcacattttaggagcaaaactctggtctgaggccttctgtgaaaatttaaagtcaaatgtacagattaagtatatcctttaccattttattcctttatgttagcataaaaagtgtgattgtgtgagcactcccacctacagagcatctataattacggctggtttttccaagagaatagatcctaaaaaagctgtacaacatttcccttattcattagcctataatttggatttcaaacaccccaaaagtattgtatgctccatattgtgatgttccaataatatctaacacagtctttccctgatgaattacccaagctaaagctgacctcctattctagggcagcattaaggctgctatgtgcaagttattccccattttacagtttgtgctagtttagattgataaagtgaaatgacaaaatataaaacaaaatgtatatttcatttccttgactttttatgtttaactttaatcagtgagagttcatttctctgtatgtgcatgtgtatgtgtttatctgttatccgtttatatgtattagagaaaatgctttcccttaattctcctctccaaataataactctggggtaaattggaggggaagatgagggggaaagtggtttccatgacaatgcattccatagttacagccagtaaccactattattaaaataaatgaattactgttaccttaagataccaacacattgcattactggtttgaaaagcactaatttgagagtgtactgcatgggggtgtactgcaatatttttaggagatattactaggaaatgcaaggagatgacgcattcatttttatagtcaaaataactactcttaattagacctttcaatgattgataaaatttacagttcttcctaataattatcacttttataaaatgatgcatcacaacaatacactattaagcatttctcctaatgacaactttcctcaaaatggactcataattacaaaaaacaggattatcaataaatgtaaccaggttttaattttgatcttgtatttattattgttatacttaatcagaaactgggacacagtaagaggcattagctagttatgcatcttttttctttgctgatccttttcatagcaatttttaaaaaaggggttgttcatgttgcgagggaaaagaatagattggctactaggagccatggtgctgtttcctactctctgcctctgtgtgactttgagcaagctactcagcctctctaagcttcagtttccttttttattaagatgaaataggtatactagattatttctaagtttgcttccaatgttgaagttctctgagtgatcttctaaatacatttttatgaatgtaaagtaaatttgagaaaccattttgttcagttacctatcttcagaaaatttgctcttctataacacttactatttgataggcactaatatcatgcttgctatgtacactgttctgaattccacagagtgctagagccaatcctactcatgacagctggttgtgtgtaactcggtctaattccacattcagtgacatcatgctagtagctttgaatcagtcatgagagaatatttataccatgtaaactaacaaacactacaattcaggacttttttctgcaaaaaaccttttaccagtatagcactggtctaagtactttaactacattaatatatttaaccatcacaatcactcaatcttaccaaaaaaaggaaagcaaatgacagggcgagattaagtaatgcccaaggtaacaaaattggtatactaatcagctaaatgaaccaactaacaaaaatatttttgatgactttcaatcacaaatgtttatttcttcctcatgttagatgtccttcatagcttagctatcattctagcccatgttgtccattggcagaagagtacggtctatcagtagcttctgtcagatagaagagtagccactatctaatgttctcatggtggaaggaaaaatgatcaatggctgaatatgcagcagatcttaaaacatctgttcagacattaaaaacatcttccagcttacattttattagctaaggaatgtcatgtggtcaacctgatgacaaaggttggggaatgataattctttcagggggaggaaagagagaatattgataacagtaatataagagactatggcttattcgagtgacagaattgagatctgaagccaagccacctgatttgaggatctaaggtcttaacaaatagactatcccagctatcactaatagctaatacatcccaatttttcatctactctctataatagtgtttgttatttagtaactctttgagagaattcttccttatgacccctataaggaaagcatagtttttagataacacatgaactttggagacaatcaaacatataaggttttggcattattagctgtgtgatttcaacctttaaatccctttccctctcctctcctactgtaaattgaagtccacttatttcatttaatctttagtagagatgttttcatgtaagtggaacattgcatttttatcattgagtttcctgaaacatgtaaggcagagagggatatgaatgtctttctgccatcaatgagtttacaaaccagttgactaggttactctgaaatgagagtaacgaagctcttcctaacagtaacaaagtatatacaattaagaacgaacaaatatactcaaagtccatacaaatgattgaccaatctagttaacttatctaagctaccatttcttgttccgtaaaatggtgataatactatagcattgctataaggcttgaatgagataacatattgcaaaatgcctgtcatctttatctggtttgtattagccactcagtaaattataaaggctttgtgtcacttgtctgattttttttttaatgaaagttaacagaaaagaataaacctattagactcacccaatatgtataatctctttatactgaacaattctaaatctttaacctttcttaacaagttttactgtctcagtgactctccttagaccctttctcagctcttccatactcctcttactgaagaacacacaaatgcaatgatacattctcagaccccatataaatggactctaatatgcatcatgttcccccataattgtcaaccctttgtgttcactgtaatttatttattattattatactttaagttctgaggtacatgtgcagaatgtgcagttttgttacataggtatacacgtggcatggtggtttgctgcaaccatcatcccgtctcctacgttaggtatttctcctaatgctatccctcccataccccctacccccaggcaggccctggtgtgtgatgttcccctccctatgtccacgtgttctcattgttcaactcccacttatgagtgagaacatgcggtgcttggttttctgttcttgtgatagtttgctgagaattgtggtttccagcttcatccatgtccctgcaaaggacataaagtcaccctttttatggctgcatagtattccatggtgtatatgtgccacactttctttatctggtctatttttgatggacatttgggttggttccaagtctttgctcttgtgaatagtgctgcagtaaacatgcgtgtgtatgtgtctttatagtagaatgatttataatcctttgggtatacacccagtaatgagattgctgggtcaaacggtatttctggttctagatccttgaggaattgccacatggtcttccacaatagttgaactaatttacactcccaccaacagtgtaaaagtctccctatttctccacatcctctccagcatctgttgtttcctgactttttaatgattgccattctgactggcatgagatggtggttttgatttgcatttctctaataaccagtgataatgagcatttttcatatgtctgttggctgcataaatgtcttcttttgagaagtgtctgcttatatcttttgcccagtttttgatagggttgttgccttgtaaatttgtttaagttccttgtagattctggatattagccctttgtcagatggatagattgcaaaaattttctcccattctgtaggttgcctgttcactctgatgatagtttcttttgctgtgcagaagctctttagattaattagatcctgtttgtcaattttggcttttgttgccattgtttttggtgttttagacgaagtctttgcccatgcctatgtcctgaatggtattgcccaggttttcttctaggatttttacggtcccaggtcttacatttaagtctttgacccatcttgagttgatttttgtataaggtgtaaggaacgggtccagtgtcagttttctgcatatggcttgccagttttcccaatgccatttattaaatagggaatctttttcccatggcttgtttgtgtcaggtttgtcaaagatctgatggttttatatggtggtgttatgtctgaggcctctgttctgttccattggtgtatatatctgttttgcttccagtaccatgctgttttggttactgtagccttgtagtacagtgtgaagtaagatagcatgatgcctccagctttcttcttcttgtccaggattttcttggcatttgcaggctcttttttggttccatatgaactttaaagtagtttttttttccaattctgtgaagaaagtcagtggtaggttgatggagatagcactgaatctataaattactttgggcagtatggccattttcccaatattgattaattctatccatgagaatgaaggtttttacatttgtttgtgtcctctcttatttccttgagcggtggtttgtagttctccttgaagaggtccttcacattccttgtaagttgtattcctaggtattttattctctctgtagcaattgtgaataggagttaactcatgatttggctctctgtctgttattggtgtatagaaatgcttgtgattttggcacattgattttgtatcctgagactttgctgaggttgcttatcagcttaaggagattctggactgagacgatggggttttctaaatatacaatcatgtaatctgcagacacaatttgacttcctctcttcctatctgaataccctttatttctttatcttgcctgattgccctggccagaacttccaacactatgttgaataggagtggtgagagagggcatccttgtcttgtgccaattttcaaagggaatgcttccagtttttgcccatttagtatgatattggctgtgggtttgtcataaatacctcttattattttgagatacgttccattgatacctagtttattgagagtttttagcatgaaggggtgttgaattttgtcaaaggtcttttctgcatctattgagataatcatgtggtttttgtccttggttctggttgtgtgatggattatgtttattgaaaggcatatgttgaaccagccttacatcccagggatgaaaccaacttgatcgtggtggataagcttcctgatgtgctgctggatttggtttgccagtattttattgaggaccttcgcatcgatgttcatcaggaatattggcctgatattttctttttttgttatgtctctgccaggtgttggtatcaggatgatgctggcctcatgaaatgagttagggaggattccctctttttctattgtttggaatagtttcagaaggaatggtaccagctcctctttgtacctctggtagaatttggctgtgaatctgtctggtcttggactttttttggttgttaggctattaagtactgcctcaatttcagaacttgttattggtttattcagggattcaacttcttcctggtttagacatgtgagggtgcatgtgtccaggaatttatccatttcttctagattttctagtttatttgcatggaggtgtttatagtattctctgatggtagtttgtatttctgtgggatcagtgagggtagcccctatatcattttttattgcatctatttgattcttctctcttttcttctttattaatctggctagcagtctattttgttgatcttttcaaaaacccagctcctggattcattgattttttgaaggtttttttgggtctgtatctccttcagttctgctctgatcttagttatttcttgtcttctgctagattttgaatttgtttgctgttgctttttagttcttttaattgtgatgttagggtgtcaattttagatccttccttctttctcttgtgggcatttagtgctatgtttccctctacacactgctttaaatgtgtcccagggattccggtacattgtgtctttgttctcattggtttcaaagaacatctttatttctgccttcgttatttacccagtagtcattaaggagcaggttttcagtttccatgtagttgtgtggttttgagtgagtttcttaatcctgagttctaatttgattgcactgtggtccgagagactgtttgttatgatttccgttcttttgcatttgctgaagcgtgttttacttccaattatgtggttaattttagaataagtgtaatgaggtgctgagtagaatgcatattctgttgaattggagtggagagttctgttcaccgtaatttctaagtcctctatgtccactcacctatccccaagtatagactactttgagcgagtcacacgtagtgactgcttggcctttatctaagtcatacttagaatgtttgcatgaccttgacttgaaatagttttcttatttagctgattagtcaataaatggatgaataaagaaccaataaataagtgatcttggccaggctttccactgcttccacctaggccctaggtgaaatattgtgaagatctttgagtcctgacccagctcccctccctgccacctcctaggtagaaggagtacactctttattgaagaaatgccagcctattcgttctgaatcaattttgacattttgttttagcaccaagtgttttttgaaataattattgtcccctcacaattttgcctttgagacttctcatgacagtcactttcagccttgtttccattttgaaaaagcaactccgaaacactaccctctacaccacctctgagaatattcttagtggcaaaattcaaataaaagaagaactcttcttaggcctcattgttcaccaaatttgatgtcaatgttgaaatgataaaagttggatctatgttccagtcccagtttggacacttgctatgcaattctgagttagttacttaatctgaaagttaattttcttaagtacaaaaaaaggggaggaggttgttgagtaataatacctctgtcacagggttcctatgagaattaactaaaatgccacatgtaaaagtacctatcaaaatgcttggcacatactattaataaatgcttaataatatccatttgtccactcactgattcttttattcattcattcattacacaccaaagctagccaagaaacttatttaaaacaaatgtcaaccaagcacagcaaaattcctgtgaaatcactaattctatttttatattgtgttgcccatctgtgaaacaaaggcaaattgatcattgtcaaaaaaatatactaaatcagagttcaactttgaaagcagcaattcatgggaagactgacaagaacatggctcattttaaatggctttatattgccactgtgtggttctctactacaaatagattttccttatcagctccctttcatctgaacaatagatggctcttctagctgcatgaactaaatgaggtgtcttacatacccccaggaacaccactctattatgtcacaagaaggggccctcagctaatcatacagcaagttgaatgattactcaatgaaacaattcctcccctaaaactgtgaagacatcagatttctcatacaatctccagctatgtatcacagatttaagataatgatacaattaacactttttctgttaatgagctgcaagcataatggttcaagtccctgatggtaccaaattttaagtacagcccacctagattcttatgtccagtttgtttaaaataagattgttataagaaaattaccttttggtacagtgtgtgagttagttgtattacatgaatgctggtgctttcttcctttaatacaaggactgtcaatctcaaatgtaatgcattggaagatgtgcattgtatttgctttagttagcatctgatcatggaaaaactttgcttggttgacgacgttagcacattaactttatctcccccttttggttactaattacatactttgaagtatctactatgtgctagacactaggccaagttcgggatacagtggttaagtacagatcaatgcagtgctggcctcatggagattacaaaccaatggagaaggcagatggggataagtgcttcgaggagagctacatggctctataagagcatatataggggaatctcatctaaaaatggaggtaggaaggcataattaggagagtgataagtgagttgagataagaaaaataagtgggaattaactagacaaacggaaaggggaaaagcatctcaaatagagggaataggatatacaaagaatatgtggtaccagcaaacaagaacatgggaaggactgagataaacgtaatacagaaaataaggggaaatatcaagtgaacagaggctgaagaagacagtagaggtgagactagtcagattatatttaaaatgtttgttcttattctaaaagccttaggaaactacagaagaaatattttaaagcagatttattggcgtagaactgacataaaataaactggaaatatttacatttaaatctggtaattttcaacatacgtatacatctgtgaaactgtcaacataatcaagataataaacatatctatcaccttcaaacgtttccacgtgcccctttataacctctacccctcatactctttcccaatcccccatcccaaagcaatcactcatctgctctctgtcactaaagatttatttgcattttcaagaggtttatataaatgaaatcatacaatatgtgtttggagtctgaattttttccactcaacatatctattctgaggtttatctagatggttgcatgtgccaatagtttacttcttttcttattgccaagtaatattacattgtaaagatatattacataatttgtctatatttgttgatgaacacttgagtcactttcagtttgaagttatatagctgctacgaatatctgtgcataagtctctgcatgaactgatatatttccttttcttctggaatggatttgcttgataacctgatgaatatgtgtttatattttaagaaactgttaaattgattttcaaagttcttgtttcattttacattcccaccagcaatgtatgagaattctagatccttcacatcttcaccatcacctggtattgtcaatcattttcactgtagccattctaatagatgtgtaatagtacctcattatagttttaatttgcctttccttaatgactcattgtgttgaacatcttttcatgtggtttttttccctgctatctttggtaaagtatcaattcaaatcttttacctacctttaaaattgttagtttcttcttaagttttgagagttttatgtatatatataaatatatatttattatacttttaagttctagggtacatgtgcacaatgtgcaggttgttatgtatgtatacatgtgccatgttggtgtgctgcacccattaactcgtcatttacattaggtatatctcctaatgctatccctccccccacccaccccacaacaggccccggtgtgtgatgttccccttcctgtgtccaagtgttctcattgttcaattcccacctatgagtgagaacatgtgatgtttggttttttgtccttgcgatagtttgctgagaatgatggtttccagcttcatccatgtccctacaaaggacatgaactcatcactttttatggctgcatagtattccatggtgtatatgtgccacattttcttaatccaatctatcattgttggacatttgggttggttccaagtctttgctattgtgaatagtgccacaataaacatatgtgtgcatgtgtctttatagcagcatgatttataatcctttgggtatatacccagtaatgggattgctgggtcaaatggtatttttagttctagatccctgaggaatcgacacactgacttccacaatggttgaactagtttacagacccaccaacagtgtaagagtgttcctatttctgcacatcctctccagcacctgttgtttcctgactttttaatgatcgccattctaactggtgtgagatggtatctcattgtggttttgatttgcatttctctgatggccagtgatgatgagcattttttactgtgtctgttggctgcataaatgtcttcttttgagaagtgtctattcacatccttcgcccacttgttgatagggttgtttctttcttgtaaatttgtttcatttctttgtagattctggatattagtccctggtcagatgagtagattgcaaaaattttctcccattctgtaggttgcctgttcactctgagggtagtttcttttgctgtgcagaagctctttagtttaattaaatcccatttgtcaattttggcttttgttgccattgtttttggtgttatagacatgaagtccttgcccatgcctatgtcctgaatggtaatgcctaggttttcttctagggtttttatggttttaggtctaacacttaagtctttaatccatcttgaactaatttttgtataaggtgtaaggaagggatccagtttcagctttctacatatggctagccagttgtcccagcaccatttgttgaatagagaatcctttccccatttcttgtttttgtcaggtttgtcaaagatcagatggttgtagatatgtggtattatttctgagggctctgttctgttccattggcctatatctctgttttggtaccagtaccatgctgttttggttactgtagccttgtaatatagtttgaagtcaggtagcatgatgcctccagctttgttctcttggcttaggattgatttggcaatgcgggctcttttttggttccatatgaactttaaagaagttttttccaattctgtgaagaaagtcattggtagcttgatggggatggcattcaatctataaattaccttgggcagtatggccgttttcatgatattgattcttcctatccaggagcatggaatgctcttccatttgtttgtatcctcttttattttgttgagcagtggtttgcagttctccttgaagagttccttcacatcccttgtaagttggattcctaggtattttactctctttgaagcaattgtgaatggagttcactcacaatttggctctctgtttgtctgttattggtgtataagaatgcttgtgatttttgcacattgattttgtatcctgagactttgctgaagttgcttatcagcttaaggagattttgggctgagacgatggggttttctagatatccaatcatgtcatctgcagacagggacaatttgacttcctcttttcccaattgaataccctttattcctttctcctgcctgattgccctggccagaacttccaacactatgttgaataggagtggtgagagagggcatccctgtcttgtgccagttttcaaagggaatgtttccagtttttgcccattcagcaagatattggctgtgggtttgtcataaatagctcttattattttgagatacatcccatcaatacctaattgattgagagtttttagcatgaagggctgttgaattttgtcaaaggccttttctgcttctattgagataatcatgtggtttttgtctttggttctgtttatatgttggattatgtttattgatttgcgtatgttgaaccagccttgcatcccagggatgaagccaacttggtcatggtggataagctttttgatgtgttgctggattcagtttgccagtattttattcaggatttttgcatcaatgttcatcagggatattggtctaaaattctcttttttgattctgtctctgccatgctttggtatcaagatgatgctgggctcataaaatgagttagggaagattccttctttttctattgattggaatagtttcagaaggaatggtaccagctcctccttgtacctctggtagaatttggctgtgaatccgtctggtcctggacttttttggttggtaggctattaattattgcctcaatttcagattctattattggtctattcagagattcaatttcttcctggtttagtcttgggaggatatatgtgtcaaggaatttacccatttcttctagattttctagtttatttacgtagaggtgtttatagtattctctgatggtagtttgtatttctgtggcatcggtggtgatatcccttttatcattttttattgcatctatttgattcttctctgttttcttcgttattagtcttactagcggtcttatcaattttgttgattttcaaaaaaccagctcctggattcattgaatttttgaaggatttttttcgtctctaactccttcagttctgctctgatcttagttatttcttgccctctgctagcttttgaatatgtttgctcttgtttctctagttcttttagttgtgatgttagggtgtcaatttgagatctttcctgctttctcttgtgggcatttagtgctataaatttccctctacacactgctagattcaaacctatattagatatatgttgcatatagtttttcacagtctgtggtttgtcttttcattcttatcagtgtcttttgaataccagaagtttttattattgatgaatgcaatttattattttttcctttatggttcatacttttattttcatatctaagaaatctgtttaacccaaggtcacaaagatgttcttctcttatttcttctagaggttttgtagttttacattttgagcaatgatcaattttgagtaaatttttatatatgatatgaggtatggatccaagttcatttttttgcacatgtatatttaattgtttctgtattatttgttgaaatgactatcctttttccatttaattgtatgtctttgtccttatatgtatggtttaattttggactctccattctattaatctgttttgccatctttccaccaatactatattttggttactgcagctttataataattattgaaacaactttgttcttctttgatctccaactttgttcactttttttttcagagctgttttgactctcctaggtactttaaattttcatacaatttttagaattaacctgttaattctacacctacaaaaatttcaactggaattttgattgtgtggaattgtgttgaatctttagataaggttagagagaatgaacatcttaatgatactgattcttccaacctattagcaaagtatctgtctacttttaaggtctttaattttacttaattttactcagcaatattctataatttccaatgtactgatttttttcacatatttcatcagatttattcctaagtatttcatattttatggtattctaaatggaattcctttattgattttaatttctaactgttgttagtacgtagaaatacaaatacaaagtttgtatattgtccttttattctgcaacattgctaaactcacctattagtctggtagctttttaaatagattctatcagatatgacatgtcatctgtaaacaaaaatgagttttacatcttcctttgcttctttttctttactgattatgctggttaaaacatccagaacaatgttgcacaaaagtagtgaaagtggatatccctgttcctgatcttaaggggaaaacattcagcctttcactaaataatgattaaatatgatgttagctataggtttttcacataagtttcttatcatgttgaagaaattcccttctatttatattttgccaagagtttttgttttgttttgttttgtttttagttaggaatagatattgattttgtcacatggtttttctatgcctgagatttttttaggtgattaatatggtgatttttgaatgttaaacaatcctgtattcctgaaataaagcttgtttggtcatgatatattataattttagtgtactactggattccatttgctaaaatttatttagaactttttccatctatgttcatgaggggtattagtctgtaacattttttattgaaatatatttgcctgtttttataccaaggcaatataggcctcatgtagtgagttggaaggtattgcctgctcttcgatattttaggaatgatttgcatagaatgggtgctatttcttctttaaatgtttggaagaatttaccaaaaccaaactatctaggtcaagagagagagaaagaaagagacagagagagagagagagagagagagaatgtgatgtgtatgtatttttgtgtgtgggaaggtttatgtaaagtatttaagcaggagtgggggatgtgatattatattgcatttcaagaagatcgtatagctgtagtgtggtgaaggattggaatggaacaatattgtcagtgggcagaacactgaagaggtgctctcagtagtgcaggcaacagataatggtgatacagactagagaaacagcactggaaacaaagataaatagttcaactcaaggaacatcttagaaagtgagtgaaagtgatacatattgggggtagatcagatatgggggaaattcagtatgacttctaggtttctggtatacataactggataagttgtaatggcattcactgaaatatgatatactaaaaagtaatatagtgtttgtgtatacgtgtgggatggaggaggcattattccgtttggggattttatttgtttgttttgcttgcattgtaaatttgatttacagtgcttttggtaactctaacttggatacattcctctagagcgcagcgtaaactgggttagaaatataaacttatgaagtgtctgtcaataggttgtgttaaaggctcagaaataggtatcatccatcctgagagaagagcatcacaagaaaaaattatctagagtcagactttgcagaactccagtatgtaacaattttcttttttttctttttctttttttttgcttgttaaaaaacatcaggaacctatttttcttagtagctactctgttgattctgcttaacgatgacataatatattctttttcagtaatgtatataccctctagatttggccttagttggtgccagagaggcagcaaggtagtgagataaaataaatattgcaaagaaaaaagaaatctaaggacataacaacaatatgtatggttcttacaatttgctaccttcttgatttcaatatactaggtattctgtttcattcctttgtttctcaatagacatacacctcctatatgttgctataaaattattatttttgagatattaaaatgttagtggatgccactatacaccaattggaatggctaaaacttgggagtttaacaattccaagtgttgatgaggatgtggaggaactgaaactcccctacattgctggtgggaatgtaaaatggtccaaccactttggaaaacagcttggcatttcttaaaaatttaaacataaatgtattgtacaacacagccattgcatttctaggtattcaagagaaatgaaaacatatgtctacacagtctgcagcttttttcataatatctccaaattggaagcaacccacagatacattaacaagtgaatgtataaacaaaacaagatatatatgtaaaacctcagaagtattgttccaattgaaaggcatgaaactgtgcatattgtataaatcattttacatggaaatatataaaataaaaatcaatatatagtgatataaagtagatctactgcttcctaggcctagaggtagacagagggaagggataaaaagaggcatgaggaatcttggggtgatggtaattatctggaactctaatgtggcagtggtttctcagatgtacatgtctatcaaaacagatcaaatttacatcaagttgtatatttaaaaaagattcattttattatatgtaaattcaactcaataatatagattaaatatcttaggtggtttaaaactcaagaccaaagaattacattaactttctaggtaaattactaaattaaacaccaatgatagagtttatttttttaatcaaagtaactcccaaatcaattttttcctaaacaagtgttattacatgaagtgatgactccctactttgttagaagatagaattccacatggggctcagttttctagaactagaaaatatttaccctatgtttgccaagatcactcagacaactactgtgttcactcctatgagcactttacctgagttttaaaaaatattttatatcactaggaaaagatatatctttaaaaatggaaagctgctagtgaggaaagcctaaagttttagagtttaaaattgagaaatattgataaggcagtaagtatatgattgaaacataaaactacctggctaaggaacctgggactttcatttgactgttgattagaatttccatttttcctcacatctgccagaagatcaagggaagacaaactaggtgaaggatgtagccattttacataaagcagtatcaaaacaatatagtagtatgcaaaactatctcacctctatgggcattgaaacttatttgaataatattttatttatgttaaataactaccctgtgatcccaaagtttaatttagtacagtctcctggggtcattttacaggatctgatgaagcggtccttgtgcccaggccccagctaggccctagagtccattgtcttgggggatattaaccagattctcagcctcacaatgactgtgtctactctgtatttaccctaacgttcagaaattgggaagttatcactgctattagtttccatggcatccactagataaaagaaggaaggttgcaagaaaggaccaaagtaatagaaaaacagttaacattttactggagtgccaaagggaaatggctgcagtacagcaggggaatggaaaggcacctattaattggaagcccccgggggcagcatagaggcacccagcttctgcagccccatctccctccttccaagcagatcagcacaaaggcaagagggaggtcctcctgagtgaaaaaggtaaacagaataatcccatcaggctccattgccactggatatacttacaatccttactacagaagaaccccacagttcttccaagccctgagcccagctgggagagatgctggaaattcatgcagctgtattgcttcaaattaggaggacgaggtgtagatgtgctaagccctacccagccactgtgggccaagctgcagcaatacagttccatatagagaacaaagccgcctctggagtgcatcctcctctggaggccagtagctactgcacctctccaacactggtgctccatcttcattccaccaatcccacaccagtggctgaacaccacaactccagcggtgcagagcctgaacccagaatcaactgtgactgtcattttgcacagcagggaaaccaacccctgccacctgcacttccaaccagaggaacagtctggcagtcttacccagggcaaagccaccctgagcccgccaatctgtttcacaccctccctgagtgggagaggttcttgagccactgagtagatgacacatccccaggtcaacaaaatggctatcaggccatgcccaggttctgagaaacagcctcatggtgccctccacaccactgtgggcatggccctggccttcacaaaacccacacacccaaaatcagggcatgagaagcatccccatggactacgcatggcagatgcgccccaggctgaccaaacaactgtgtgcctatgctcttttttttttttttttttttttttttttgagatggagtctcgttctgtcgcccaggcgggagtgctgtggcgcgatctccgctcactgcaagctccgccttccgggttcacgccattctcctgcctcagcctcccgagtagctgggactacaggcgcccgccactgcgcctggctaattttttgtatttttagtagagacggggtttcaccgtggtctcgatctcctgacctcgtgatccgcccgcctcggcctcccaaagtgctgggattacaggcgtgagccaccgcgcccggccgcctatgctcttaataagagtaacagccccatgattccaaccccactgagacagaccccaagtgggccaacctactgtgtgtatacacgtacccttgatctaagaaacaacctaataaatccatctctggcaaagtcacaccaccaccaccaccaccaccacaaactctctcagcctagaccactgagatactcacaaacatcactagtgtgaattacagctgaagaaaccacataaagactaaactatggcacccacctagaaccaaagctaatgcacctactgaaccaacacctcgtctaaatgaatatctttccctatgaaacccactccataaattgaaagaggtgactgttccaccagacacgtataagttaatgcagggccacatcaaacaccaaaaagtaaggaaacatggtatctctaaaggaacacaataatcctttagtaacagactctactcataaggaagtatataaaatgaagtaccagaaaaggaataaaaaataattatcttaaggaagctcagtgagatagaagagaatacaaatagacaattcaacaatatcaggagaaaattttaggatttgaatgagaaactcaacaaagagatagataccataaagaagaaccaaacaggaattctataactgaagaattcaatgaaataaaaaatacaattgagagcttcaacaaaatactagaccaagcagaagaaacattttctcaacttgaagataggtcttttgaaataatcacaggcagacaagaaaaaaaaatgaagaaagcctatacgatttatggggcactattaaacaaatatttaccttctttgcattccagaagaaaagggaagtggtatagacattatattcaataaaataatagctgaaaacttctcaagacttggaagagtcatagacattcagatccaagaagctcaaaaaatcccaaatatattaaacccaaatatgttctctctaagtcacattgtagtctaattgtcaaaagtttaaagacaaaggaagaatttcaaaaacagcaagagaaaagtgtcaagtcacatataagggcatcaccattagattaacaatgaattactcagcagaaaccttacaggcgtttttcaaaagacttaattttttagagcaattttatattcaacaaccaaattgagagaaaggtacagagatatcctacatacctctgtccccacaaatgcatagcattccctattattaacatcctcaccagaatgttatatttgctacaactgatgaacctttattgagacatcataatcatccgaagtccatagtttaccttagggttcactgttggtggtgtacattctgtgggtttggataaatgcataatgacaggtatcagcaattattgtatcatatagagtaatttcactgcccaaaaaatcctctttattttgcctattcatccctttacctactccaacccctaggcaacccactgaactttttactgtctctatggttttaccgtttccagaatctcatataattggaatcatacaatatgtagccttttaatattggcttcctgtttccagtttttacctattatgaataaagctgttgtaatttttttctttcaaaaaatatatactgacacatatcatagagaccctagtagtgagctcttaaataattcacaagatttattcactttttaaacgttttactttgaaataattataaattcacaggaagttgtaaacacagtacagagaagtactatgtttactgtaccatccacccagtttcccctattagttatattttacataactatagaacaatatcaaaaccagtacattgacattggtgtaaagagagggaacagtttatgttattcctaaaaactcccaggaaagaaaattcatatctattaacactgttacaactcttaaagatactaaaaatcaagaagttatctattgatttatagttctgaaggatctttaagaggccatgtagtataccaaccatctttagtaagaatttttttttgcaattaattattcctatttacttatattctgatttggctatcaacccatccatccatttagcattcattgagttctatgacacttcagatattaaactataagctaaggatacaaggatgaataaaacatgctctgtctctctaaagaatttacacactagagaagacaaagagtcatgtaagctggcaacttacatgacgatgtgagaaaagagttgacagttaatatatacattggggtcttgggaaggagaaataatttgctatatggataagtctggatgagtttcaagtagagaatgacatgcgccaagaaagtctaacatactgaaggaaagagaattttcttttctttttttttttgagacaggctggagtgcagtggcacgatcttggctcactgcaacctccactctctgggttcaaatgattctccttcctcagcctcctgagtagctgggactacaggcgcctgccactgcgcctggctaattttttgtatttttagtacagatggggtttcaccatcttggccaggctggtcttgaactcctgacctcgtgatccacctgtctcggcctcccaaagtactggaattacaggcatgagccaccgtgcccggccggaaacagaagtttcatatggttgaatcacacgtttctctctgggaggtgaagaaactacaggttggttgggtagattttatccaggctaaaaagtttaggttttattgttttgtcattgtatatatagaagagccctgaacaacaacaacaacaacaaggacatagcccagggatcttcaatgagctactaaatatattgaataatgagaaaatgaatcacattctctgtatatctaataatacataatttctatacatagaaataccttagattgggcaaaccttttaactcttgcacaatgcctttgaagtgcaggtggggctataaaatataggccttgtgacatcatcttgaatgttttttcttatgtatcatgctgtggcaaatttctgcatgaaagaaaatctgaaaatttaactgacaaaaatgtaaactcctgtgtgaatacagcttttcaggaagaactcttcagttctgactgcactaattagggaatttaccgttctgtgtcctcaaaaggattaggcagcacttttctataaaaatactaaacataccttaatctattttaaaattgaaatactaagctaaaatgaaaaatgcagaagcaaagtcaaattcccacctgaggtaatgtttgaacattcttattttcaactaataaaaaaggtacatggagtttctcagaaagctttctcccacagctggatacaaatacaaaacacattgagaagaaagacaaataaataagtctgatgggaagctgtaaagcccacctgcatttttaggaaaggaagctactaagcatgaggaatttttttgaactacgaaagtttctgctctccagatcctgaaattaaaagtaaaggtctaaaaaaaaaaaaaaaaaaaaagaaacctggacaaatcacctccataaaacacaccctcctcatcttttaaccaaacagatatccaaaagatttctcgcaccaagcactgaaaactaggaataaaggtgaaaaaaaaaaccctgaaaatactaatagttataccgacagttcacatattagagatcactattcttgaatccatgaaaaagaggggctcctagccctctactcaaaaacaatgttttcttactttacctataatttatatgtaaggttcatgatatggtttggatctgtgtctgctcccaaatctaatgtcaaattgtaatcccaaatgttggaagtggggtctggtgggaggtgactggatcatggggatggtttcttataaatggtttagcaccattctgttagtgctgttcttgtgataatgaatcagttctcaggaaatcttgtttaaaagtgtatagccctgttcccatccttcttcctggtctggccatatgacatgtctgttcccctttcacctcctgccatgattgtaagttttctgaggcctctccagaagccaggcagatgctgctgtacttcctgtacagcctgcagaactgtgaaccaattaaaccccttttctttataaattacccagtctcaggtatttatttgcagcaatatgagaatggcctaataacagttcatattagaattctaagcccatcttagattaaaaataaaaggcgggatagctcctctataagcaattataaagagagcaaggaagaatgaagtaaaatataaacagcagcgataagacttaaaaaataagttattacagatcagccatcataagatcaaatatttatcaatccttgagtaatatctgaggacatcattacatgaagtggctaaaacataatccctatgctttaagaaaacagaacatgatgaactgcatttaataaatattcccattcaaaaatgaattgaaatataaaagtttatgtactggcaatatttagcccttagctatctgcaaaccttagctctgtggaatggcttgctcctcaaaaattccaggtggattgctgaaccacagttcaggtctataaacattaactgactgactactatgtgccagaagtgagaggtacaaaaatggatgatatattgtttctactctcagggagcttagaccgtgtgtgagataggcaaaaagcagacaattataacaacatattttgacagctgtgggcaaggggtcactgggaactcagaaaaggagtgcttagtcaagacttgagaatgaatggaaatctgtgaggaaagagatggaaaacaacaagatatgaaaagaaaaaaaaaaaaaagaaaagaaaagatcagccattctatttatttcttggattccagaaactgatgcttcaaaataattctttactactgaataaaggtgacaattaatatgctgtattattttacatttgaaattagcaatgaacttaactctgttcttggtctttatttcagcttagtttagacttgattaaaaaaaaaaaaaggacaggattttaattacagagttagaaacgtgaagttaaagttattttgcagggctgtagccttagacaagtcacttaactctgaggctcagtttctatatctataagatgaggctaatgaaaagaatgagagaaggcagagtccaatgagttgttaataataaaatgttatatatgcaaaaggatcaattttattacttattttccagcctgggaatgaaggctattttgatgttttggttgcaagatacagaaaagacaataattcaaactgcttaaacaataagaatatttgttgaccacaagcactaaggtcattattctaaagagttcgggcccacttccctgccaatcttttgccctggccttcctctgcatggggatggtgtatcctcaggaaggtagtaagataactgtggcagttctagacttcacctccatgtgcaacaaggaggttggcatatagaaggtctctcagaagatcaaatccaacttttcccaagaaccccatggaaattcttcctgcattttatagatctccaaatgaatcacatggccagtccagaaccaaacactggcaaggcggatagcattaaccttagacaagtcaggcttggagtttgagtaggcaatgtttctcctaaggtacatgggttttgtagttgaggaataaatacttgtacaacaagttctgtgaggaagaagggaggggacaaatgaatgatgaataggcaacaaaaagcattccccaaagctataaaggtatatgcaattcccttttttaatttttttattagaaaacaatattactagaaatattggcataacttttaaattatatacatattcatacatattcacacaacctgtatacataatcagattgaaattacagtaaaaatacacttaccatgatggaactaaatttcagctattataccaaaggaaacaatttagtaattttgaggcagaaaaaaaagcatgggctttgttgtctgacaaatatgagtttgaattctagttttgtaataaactagatatgtgatcttgggcaacttagagacattccaaccctcttcacagtaaaatgagaataaaattagttaacatattgaattgctataagataaaataaaatgacataatatgaaaatacttgtccttgcactaaggtactgaataattattagttcatgtctcacgagctgcctttttttcctctatccctagtgctccaaggtatcagtttagttcaaataattaaaatctaaaaatattttatggtacatacttcttatatgtgctaatttaggtgctgggtatcgtaaatggttagaacgtgattcttgtcatcaaaaggtttttgattgaacacatgacacagatgtctgaatagtcaacttgacaacaaaacagaatagaaaagttctgcgcctaatagaaggagacaacagccaggccccacttatctgcacttctagactagacaagtcattttcccctctgtggccgagtgccatatttcctctgtgagcacaccatataggctgccattcccctgttgctacagtgctgatgatttgtctgcaaccagtttcctgtggtttcttgagtagaatcaaagacacctgacagggcaacatctgctctcaggctgtgcagctgcagggctctcccatttggataccaggacaggaaatcatgtgtgagaaatctgctctctttttcagagacaaggtgcattcaggaggcctgccaactagattctctacaaaaatctgctgaggcccccaacatgccaattggtcttcactgagaccttctgaataacagacattaatgaaccagaaatgaggaagacttgggccctgctctcaagtagctcataatcacatttatgttcattacaggatgtgtaccaataactacataatgagaagttgaaaatggtaaggtgataacattttcatttgcacagcactgtacaattttatatacttcatttcctttctcttgagatatgggcatgtatttttggatttatttattaaattaacttttactgagcccctactttgtgctatcagggaatataaaaataaatacgctagatattcatttgcttatttgctaatttatttgtatatgtccttccaaaagcgacctaaaacataaataaattttggtcctttattgctgagagatgaggacaatgttattcttggtttgtggtagagaagtaaaggttacgcggactgtaaattaagtcatcttggtatatttggctgcagggtcttctgctaactcattgttctctcttttaaaatacttggctactaagaaggctatgagaggttacacaaagattatcttccttcagggaagctagaacaaatttatggtagaattcccattagcctgaaagacagaggctgggtgttatggctcacgcctataatcgcagcactttggaaggccaaggagagagaactgcttgggaccaaaatttgagaccagcctggacaaaacagcaacacccaatctctaataaaataaattaagaataaataaataactaaacaaataaatggaagagagatggtagagaaatacttgagatgatctttcaagctttataacccaccctcccttatatgttcactagcctcagtcaactagaatttttttggtctttcagtaaactctgatcttccctgactccaggcttttcttcaaactgtctcactcacctgcaatgtcttcctcatgtccaaacaaacaatctaaaagttttctacacagttacagtgaaaacacattttgcaacttctcaatcaaatcaaggaacagacctgattataactgacatctagaacctctatagccacccctgggatataaatgttatcatgtgctgccataacaacgttttggtcaatacaaactgcatataagatagtggtctcataagattataataccatattttactgtaccttttctatatgtatatatgtttaggtatataaataacattgtattacaactgcctaccatatgcagtatagtaacatgctgcacaggtttgcagtcaaggagcagtgggtcataccatgtagcctaggtatattgcaggctacaccatctaggcttgtgtaagtacactctatgatatttgcacaacagtgaaattgcctaatgatgcatttctcagaacctatccctctcgttaagtgatgcatggctgtttttgtacaatttctattttaaaaaaatatatataaggaaactaagccttcagagttagttcttcccagggagaaagttaatctcaggccctttggattccccctgctgttggtttcctctacgtgtttagcactatagtagcatgtcctgaagttgaatcaatgtaaagcagaattttcacagtaatccctgtaaggcagagattattgcctgtttttctcacctgctatatccaaaatacctagaagagtgcctagcatatagtaagttctcagcaaatatttgtgttttttaatgatttcagaatttaataatacatttctatacaatttggctcctaaatatatgccacctttttcatttgccgcaaagaaccactcacttgttccaacagtaaaggaagactattagatttatttaaagatggtagactttgctctgtactttttttttccttcaatttttatgttaagttctagggtacatgtgcacgatattcaggcttgttacataggtaaatgtgtgccatggtgatttgctgcacagatcatctcatcaggtatgtattaagcccagcatccatgagctcttcttcctgaatatttgttgaatgaattattaaatatttatttaatcaaactgatttctgtatgtacaatgaggaagataaaaagtgaggtttgaagtcggagtctgactctagataccacaactttgttaagatttgaggtttggcataggcccgtacatgtttttctattgctgagtttagaaagaaaaatctttgtttaaaacattttccaaatttatttttaaaaaaataaatatcatatataaattatatctcaatgtttttaatagttattgaaaaaaactatataccaaattatactcttatgttcatgacataattaactctgctgagagagtatacatttctgaaactatcatagtcatcatttcccagttttattacatggatcaaggtgtttaacataggctgtttttcaattacttcatattgatacaaagttgaacgacaaaccatagaaagtcaaggatttcaaatcacatctggaatggatactaggatgatatgtgtaatttatgatcttaccacctgattgactgcaaaattgttaagaaagattccctgaggtaatccaatttgtttttagtacctaattaacacttcccagtggtttctggatgggataattgagaaatgtaatgcttataagattgaaatcaggcattgaggtatcctattaagtcaagaatttacctgttattggcaatgtatttaactgatggcagagacagcattagaaaaaaagaatggagtagatatttaggaaaaagaagacaggtagctgaattatttgcacttttagaggaattgatggcaaatacatgttcgactcttatatcaaaattgcatcctggagggaagaatatacagacttaaagttccaagtcagaaaggatgaatcaaagagaccatgggagagatagtactaacattaattaagtgactggatcagatactgttctaataagcatatgtgctttatctcacttaatcctcaaaagaacaaatatgaggtgcatatatcactatcttcattttttatatgaagaaaccaaggttcacaaagcttttaagatttcaagcagcaagaaggtgacagtgattggtattattgtaaaaactgtaggcattatttatgataatttaggagtgcaaaggccaggtacaaaccaaaaaaaagtagcttggagtggtagttctcactctctttctctgtgtggtgacgtacatggaagaaatcacagcattcacatacagccacaatttcctgggcatcctcagatcacatgctgcagcatagcaaaaatcggctgtggttaacatgcaattctatgaacactacaactcaagaaagcacatagagaggtaaaagaacttttattttcctgatatccttaaatcaacttgaatttgttttttaagtaaataagtgcttaattagcaacaaattgcaattgatcacaaggcagtaatgtgtagcaatcttatgttttaaagttgcctagaagaggttaggatgccaggtacaaaattaaaaaccatggattggcaaagaaaaaattagataaactgatttttctttccttgatttgagtggtaggttacaagcatagaggatgcagtagctctcatttactttgttcttagcaagtgttgtactatttcacactacactcttctccagtagcaaggtaacagggaatatcttggctgaaccactggaaggtagaagatggccgagtccagggaaatattcaaaaactcaaatcttccactgcccagttcagtgaaaaggccatcttatgtcgtggagaaaacatggggtttagaatcaggtggtttgtattcaagttctttctgtcttgcttgcctggctttctagccttggatcacttaacctcttcacttcactttccttcattcacttaagtatgtttattgaagacctactatttcctaggcatggttctaggtgctgggaatatagtggtaaaaaagacaaagttctgctttcacagagcttacattctaatgaaagaaacagccaaactatgaagctgtaactacttacataaaatattaggtagcaatatgtgctgtgaaaataactttttaaaaaaactgtagcagtgtaagaagagagagtagaaggatgtatgtggactattttattttattattatttttttatcattagaaatacatctgtatttttaaatccaaaatctaactagataacatggctgcttctttggttttctttttcttttttttttttttttattatactttaagttttagggtacatgtgcacattgtgcaggttagttacatatgtatacatgtgccatgctggtgcgctgcacccactaacgcgtcatctagcattaggtatatctcccaatgctatccctcccccctccccccaccccactacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacctgaactcatcattttttatggctgcatagtattccatggtgtatatgtgccacattttcttaatccagtctatcattgttggacatttgggttggttccaagataaactactcaaagaggtctttttcaggaaggggtatttgaacagagacctggaaaggaagaagtaagcagcatttattttttccaccagaagttattagcaaatgagtcaacagtaatcacaaagatttttgggcaagaataaacttggcttattcaagagacagcaaaagatcagtgtggctacagcaagaaaacagagaagagagacagattagtctgagtatgttggaaagcttttgaagccaatttcccgttaaaatagacctttctggccgttggataaagatgtgactggataaagaaaggagtggaaacagggagataagttaggaaacaaatcccatagtgtaggtgagagataatggagggtttgaattagtaggcaggcacagacatatgaccaatggtaacagtagtaagaagtagccatatttttcatactttgaatatagagcttataggattttctaacaggttggtggtaggctctgaggaacataagcagtcaaagattaatttatgtttttggcctgggaagatcctaaagctgagggaaatgaagaattttatttttatgtgataagtctaaagtgactatgggatatcaaggcagagctattgaatagttatgtattcacataggagatcaggaaagatgtagaaactggagatggaatttgggagttataagaacgtgtaacttatttaaattatctaaagtcatggaatgggcttgatggagtgaaggagcatcactagaaggctaagccttggtcaacagtgatacttagagactagcagagctggaaaagtcaaatagattgagaaagagtggccagcaatataggcactaaatcagatttcactgtactagagacaagtgaagaaagttttaggaaaggataagtgatcaactaggttggacattgctgagaggtagagaaagatgagaactaagaaccgaccaatgcgttttgcaaagtggagatcatgagggacagactgaagctgcttcagtggaacagcagggagaaaagcttaaccaaagtgggtggaggaaagaagaggaggtaagaaaacagataaccttgagtatagactactcctttgatgagctttgctaaataggaggacaaaaaatatgggaaagggtaaaagaaattaagacagtgattctatttaccagcaaacagtattttgaatattaaacaagtgagtggatgtagaagatctttatgaactccaaagcactatataaataatatgttattttgtgacaggaaggatcggtagagataggaaatgaagcatattgaacagtatcctttatggcattgaacttacccgccttattctgtatgttttgaagtggatgttttctttacttttatataacaatgcatctgctagaataaaataatctggaaatgtttgagtaaatgatcttatttaatagataaataacaattatatattgtgcattgggggaatctggaacttagaaaagctttgaaataaattatacaatatatattttatagggaagttaagttcatgaggatcctggttgtaaaaaataaataaaatagcaaaaccacggagatagcaaaaagatcagtggttggtaggggttgggaggctggaatttgactaagcagagaataaaggaattttaagacagtcaaaatactccttacaatgttttaatcatgaataaatgtcattacacgtttgttgaaacccacagaatgtgcaaaaccaagagtaaaccttagcgtgaaccatggacttaggtgattatgatgtgtcaaggtagattactcaattgttacaaatttaccattctggtggggaatgtcgttagtataggaaactatgcatgtgtgggggctggagtatatggcaaagtttctgtaacttcctcttagtttttctgtgaacctaaaactgctctaaaaaataaagtccaaaaatgaatgaattaaaggcttagataattcataggatgttatgagaaaataatttacttgtattaaaaatcccaaatttttgcagcttctccaacatatcttttactatcatattcaacatcaaagcagcaagctagatttaaaacaacacaaacttaaaaaatttaagtttgaagagaccggaagaaccctagatgttacagtgaatgttttgaaggtcacagttagtcacaaatttattttgagtcagagaaaaatattaacccaagtacgttctgcacagaacttggtaccaataaatttttgtagaataaaaggtaccaataaatttttgtagaatgttacatgagtagataaacctttccttaccgacaggataaaatttgctgatttctgggctgggcctgtggttctggacacttcatctcatagtcaaggaaattttcagcaattgttttttgttttgttttttttgagacggagtctcgctctgtagcccaggctggagtgtagtggcacaacctcggctcactgcaagctccgcttcccgggttcaagacattctcctgcctcagcctcccaagtagctgggactacaggcacccgccaccacgcccggctaattctttgtatttttagtggagacggggttacaccgtgttagccaggatggactcaatctcctgacctcgtgatccacccgcctcggcctcccgaagtgctgggattacaggcatgagctaccgcgcctggcccagtgtgtcttttacccagactatctaaggtaggtcaacagatattgtgaaaactgtccaaaagcaaaaaggaaacctgcccaattttcaatatatgctagggtgaaaataaaggtcacttttagtgtgagaattaggcatgttagtcagtatatcatagtgaaagtttattgttcccttcaaaagtataatttggaataaaaaaattaattttaactagatatgtaaaaatgattctaatagaatgactggcgtacttcatcagtatataaaatttgcaaaaaggttataaaattcattaggaaacatggtggtcaaggtataaaatgctaagatggactattgaataaagctggggatatgcgagactatttcaaaaaatcataaaaaaaatttaaaacatcattcatttccacaatggaatatgtatttgtaactaacttgtaataattataattaaagaatacttttttatgcctttgttttctagactctgtggaaggctttgttatagcagcgtaggagaaagaagcaataagtggttgtaaagtctcttgcaaacacaaaatgttatgtaaattctaaatagaaataactgttgagagaccaggcatggtggctcacacctgtaatcccagccctttagaaataactgctgaggagagtattttccttcaagagcacgaatacactcaagctattgactatgtttatacagtgatgtggagaaaagagaaaaactgtaagcaaacagacctgggcttgcatctctagttctaccactttctaggtgtgttcaattgggtaaattgcttaaaatttccagaaaaatacagataattccacttaccttagaaggttgttaagagaattaaatgtaatattatgtgtagattctagtatacacaaagtggatacataacagttactatttttctttcctcgtctctgagtaaaccaagcttgtccaacccctagtccaacacaaattcataaactttcttaaaatataatgagatttttttgtgattttttttaatttttgttttttagctcatcagctatcgttagtgttagtgtattttatgtgtggcccaagacatttcttcatcttccagtgaggcccagagaagccaaaagattgaacaccactggttaatttcccctaaactggataagaaatactacaaggcattacaactcccaatgagataaatgggtggaagaggcatcagcctacagcaactaccagaatcataattcctggtgtacatatttagttttttatcaacatcctcaatccttaagtgccctaaatgataatgaactaagaataattatgcttgttaggtaacaatgggcaaatctttctctactctggaattctcttcctttgtgtttagcaggaatgagctagattcctcatatattcatccaaggactcagtgtggtccttggatgaataccagtctgcaaaactgtttgtttcccatctactacaaagtattgaaaatgaaagtaagcatttagagacttttataacaatttgaccaagtaagtgtatatcttttgttaaaaaaaaaaaggattttatcttgtatgtttttggtttatttccccatttcacttctccagtaattcatttttattgcattttacaaaagtattggtctgcagtagattgtaaatttaaacacacacacacacatacacaccttttatcacaaaaagtttgaggagcattggacagataatcgcttaagccctggtattctacaagattattttctgtccatgttgcctgaggctgaccaactccagaggaagataaggtgtttattgcctaatgtcctccaaagaggcacctcctctccatcaaagataatgaagatgaggatgatgatggtgatgatgatgatttccctctttacatgcattatctcatttaatcccttactgttattacaccatttaatagaaagaggtaattaaagcccaggaagacacaaatggctttagttgtatttgattccaaatcctgtatgtttcccaccatgccatgttgcttccagtgatactgctttcccaagaaaaactgcttgccattagccaagtctatcccgtgcagcctgggggaatcacctggtaaagtcggcaaacctgtgaagtctcagccaaaaaggcatgcctcttatcctaataccatgggaattcccctttagcctaaccagcagaagtcaactaaaatcatagagcctcaggatttaaaagtatctgaggaataatctacaatctgtattccaatggttgggtcattgccataacatactttacaactggttatcacttgtaaatctgaatacctccagctacaggaacttactacacacagaggtagctcattgtcagtatattcttataatctaataaggattgtttcagttaaattaatctgagagctttctctttgtacctgtactgttttgggcaaaattttactgtgtggagccatggaaaacaaccatgtagaattgttctactttgtaacaacaagctatgtatctggattttttacaggcagctgtagagctgttagaacttgagttgaattctggctcttaacatttagatatgacctgagacaaactatttgccctcatcaatgttgtctgtaaaatgaggacaataatcctggcatcatttaaatgttatgataattaaataaaatattacatcaagtaaaagcaccaggtaggtactttagaaagtttgttgaactgattcctttatattttctcattgttttactcttctgaacactgttttctgatactgattcattctgtttcttaccctatagttttctcccctaggccacctcagggattcaaatttgtattattttaaatcataccataaatgaccataatattgaaagatgctatttagtttacaaaacgttttcatgttctgattcaaattaatattacataaatcctatgaacctagaagaacatattaacatttcataggcaaggagttgaagatctttattctttatatagaaggtaacgtagattcactaagttgaaaagctcgtaaagattacttttctacaaaatacacaagcaattaattaatttattaattctttctgtttatttatttattttgagacagagtttcactctgtcacccaggctggagtgcagtggtgggatctcagctcactgaaacctccacctcctggattcaagtgattctcatgcctcagcctcctgagtatctggaactacaggcacgcaccaccatgcctggctaatttttgtatttttagtagagatggggctttgccatgttgtccaggctggtcttgaactcctggcctcaagcaatctacccaccttggcctcccgaagtgctgggattacaggcttgagacactgcactcagccctaacttattaattctaaagtaagtaaccattgtcactagatgccagtctaacacctggagatatagatgtgaataaaattctcattgcctctgcctttgagaagctattaggctaaaggggaagaaagatatggaataactgtgatgagtgtaaagctatgcaggatgttaaggcagcataaaatagattggcctacctgcactggaactgttagcttatggtaacctctcaatcagaaccactctagtgatgataaatactattataattatcataataatatcatagcatcatctgttttctgcacagctatacttcattgtgaggcttgagcgtttatgataatctatcttctttcatttaaatcaaacaatgctataaactcagtcaactgattccaaaaacaaatgttttgaatgtagttattgggaagtatggaccaccctatttttatgaaataaaagtttgtttacacaaagcaaaagtggccctaataaaaacaccatcccttttttcaaaagtgttaggcataatgatggatgacattttctccattgcaacaaaaacttgtcttcatatgctactgggttctctggaaagaagtgatcttttttttttccttataagttcagaaaagacaataattatcccttgaaaaaatttatacatagggatcctggtatctttaataaatactttccaaaattgtcttgtagtaactatggtatcggtggaattacacctgtaacaagcatataattttctatttaaagtactcctagagtgcagtacgtttatgatgtaatgaactctttacacgaaggaagaatcattggttttgtcattggtaagcttttgtcattggtaagcttttaaaattaattgtgaatcctaatgcagcattttataaaacatgctttagtttagaaacctgggcatctcatcaatttcttctcttcccaaaggatttagatcaatagtagccaacacagtccactcatgctcatattaagtttcatattcctgttcctaggatttaattctctagtaataaatctcttagtaaatgatgttctctatccagggctgccaagcaaactcactgttttgataaaggttcggctttagccttctgagtcttctaatggacttgctaggctgtctgccctttcagagatccattcaaaagaaagggcaaaaagtccccataaccatttagtaaattggcttcattaccaaatgttacaggtttaccaatagtctggggtttgcctttccttaggggagagaaagacaacctagcaaacaagtgtttcagacacaatcaactctttaatctctgcttctaattgtgatgtgatgacctgtgctgcttctgcagcgttctccatagtgagttagcagcggccccacaacactgtgcacaccttcatgactatacttttaactgtgtatttaaattatttttaaccacctcttctgtgacattatgagtatttgggttacagggacaataacttgtttttctctgcagtcctgtatatactaatatgaacaggagacaggaaaatactgattagaagagggcagttccccagcaaaggtggaatgatgtggtagagaaagagaggagggatgtctggacactgggccggcgacagtcaggagcagagaccggcagctacgtggcccaactccaggggaagaccaccttcccactccatccccctcttcctgctccccatccatctcgctgagagcccacctccaccactcaataaaacctggcactcatcctttgcacccacgtgtgatctgattcttctgggacactgggcaagagctcaggatacagaaagctgtcacatggccctctgcccttgtgaaaaagcagagggtccattgagctgattaacatacaaggtgtctgaaaatgggaaagctgaaacagcttggtaacactggggttgcaggtatccaccccaaactaagtaacacctaaaccaagctggctaatcagattctctttcttgggattttagaattgaagcaatgcatttttacccgtgatggtgtaatggttactccagactattggtaaacctgtaacatttggtaatgaagccaatttgctaaatggttatggggactttttgccctttcttttgaatggatctctgaaagggcagacagcctagcaagtgtcaactttattggattgaaggacctgaagtactgttcctgggtgtgtctgtgagggtgttgccaaaggagattaacattcgtgtcagtggactgggaagggcagacccaccctcattctaggtgggcacaatctaatcagctgccagcatggccagaataaaagcaggcagaagaacatggaaagactagactaactaagtcttctggcctccatttttctcccatgttgaatgcttcctgaccttgaacatcagactccaagttcttcagcttttggactcttgaacttaacaccagtggtttgccaggggctctcaggccttctactacagactgaaggctgctattggcttccctacttttgaggttttgggacacagactggcttcctggctcctcagcttgcagagggcctattctgggactttactttgtgattgtgtgagtcaattataataaactcctcttcatatattcatctatcttatccgttctgtccctctagaaaaccctaaataatacagatggtcacttaaataaaattataaaaatgttttcttattccttggtttcatttcatttctgagggcccatcctattcttgagtcccatcattcacatgtatatttatataaaaaatgtattttggcttgatctaaacatagctgggtttgttactttgaaccaaaaatatatattattttaattactcattttcatttatagaaacatcatatttgaaaacaaggtggggccttcatcatatgcaaccttcatattttaggtaagaaataaaaatgcaattgctaaagatttcatttaaacatttttattacacttgccaactgtccaaaagaatgcctcaaatattaagaatacacaatttttgacatcttaagtcttcatatatttccttttatcttcatggtactttgcacaaggtcttagatggtggcgttcaataaaaaattattctattagttaacttaatacaatgctcggaatctgtgtacagtagttgttgacaacttaatttattataatctccttcctgtattttctttcctaagaggatttaaagcagctcccaaaggataggagcttaggtcaggtcagagggagataaaggcaagaaaactattcatatcagttaatatagttttttgctttgtttcaaaatttgactacaacaagcatagagaggcaaggatttccctttttctctcttctacttcttttccactaccctggcactaccttccaaaagaaatttcacattggagatcctgtgtccattcatttagtcattcatgtattcatttaactaatatttattgaatgtccatgtaccagtcagagaagtaggtgcttgagatacaagacagagatgaggattgttccttccaacacagcattcacagtgaggatctaagagtaagtgagtaatttcaataaagcatactaagggctatgttgggagaaatacataatcctatgggaggaggcagggtgaaatctaaccaagacacagatgcatggaaggtttcttaaagaaaatgttcaacttaatatccaaattgaaaaaaaaatattttataacaattctccttgcccaaggccctcatagacatgccattcactctgcagaatattctccccattatgacttgtgcccacaccattatttgaccaatttatttggctaactcctatgcaactttcaggacagagtccgtatctgtctattcactgccacatttccacactagcaagtgccaactctaacataggagctcgacagcattttgaaaggtaatcacactatattctaattattaatagttggtttacatgactagagccttctcaagggcagtgatggtttcatttcttcactctcaacagggcctgcctctttctattccttgacataaaccggactcttcatgctaatcaggctggaagtgtatcgtaagtcctcactgatactcacattccatctcttgagtttaatcagcttccatttacctatccatttgcttcttagtcttggtattgctgtttccttcatctctcaccctcatttggatccatatttcaatgatcacattctctgcccaacccctctgattgatgctctggtttgaacataacacaattctggcgttaccatcagcatcttctcctagacacagtttctcattttttctatctggggtcacataaacacaaagtgtcccctgacatgccactgctctctacttaccccaacttctcaattggctcctccctcaggagaagaaagaggatacacaaacattcagatgagtgccaggtatacagtagtcattccacttattcagaataactttttttaaatgccattaattttatagtggaattcaatgtaagagtattaactgatctataaaatgtttcacatatattgtgtgagatatatacctctataatttacctccttcaaaattccttaaggaatttaagaaactgtgtttgttggggtgaggggctacatcagcaaaagccaggggagatttttactttattccataatattctaccatagatattatttagatgcatttattataaaattttcctggcttacaattagtacagagtctacctagagagcttgcagtttatgcccccttcagtcaacattacaaacctgcaatttccttttatctcaccattttattggctcccactagagatactgtgagacagtaaaagagatgggaattacacttgcaggaagaatgctttccaaaacatgttctagcacttgactcttgatagtgtgtggcagctggaggcaggtggccaaatgtcccagtgctataccctacctgactctaattttcccctatagttactctctttctgtagcttacctatgactctacttgtcaaataagtacttattcttccatttcagatgtttccacttgtataaagacttcaatgactgccctctatagagttctgcagttgttctagtcaatattttgacgcacctaacaatgatagttaacatttacatagtgctcattttctgccaagcactgttctaagcactttataataaaaaatggctaattgaatcctcacaacagtcctatcaagaagacactgttagtatctccattctaaagagaaagaaactgagtttggaagttaaagcaggtaagtcttgaagaatgagttcatagattttaatcaggtaaagaaagatattctacacaaatagaagagcatatatatggtatatatatgcatatatggcatgaggttatgaagcagaatagtatgggtattcattaatttattcaaaaattatattttgaacattggctacattgtagacactgtgcttagtttggcattctgggagtaacgggtagcaaaggaaagagaaggtgctacaagcagcttattgttactggtaagtaaagatgaaaggggaaatgtaggcaggttcagttcatggaggatgaatgtgtgtaatgctaagcagcttagatttgacccaataggtgctggagaaaacaaaggaactttaagagaggaaataagaagatggttatatttgcatgtccaatggcagaaagtgatgccttctttcctaaacttccagagtattttgtacctttcatattatttattgtatattaccttttagtataaatttaaactggattcatataaagtacctcaaggggattttaagcttctaataggcaacaaacttgaccactaggtttttggatcctccataatgcctagaacagactgtactttctacttaaatgtgttcagtaaatgtatgccaggttgaattatatagtccctgtttctacacctgcatcaaattcctccctgaaaactcatgtccctttttgtcttagcaggctgagcacagggacaaactactaatgacataagcaacgtgctacatttgtagtagattaagaaagttctcctggataattagacatctgatagtactgactcagcctcccagaattcttcacaagaatacggtctcccctcaaccaaacactgccttctcaaaatcctggatcatgtcctgtcacatagaaattggacaaactactgaaaaatatcattttttaggatctactgttgagtaattttaaggtttctgaggaaaatatcacacatacttgagccagaacagatatacaacttccttgctgttatcagaaaggtataaaaattattttgtcatactcagctaatttaaaaatatttaagcaacccattctttatcctactactgaaaaataaatgaagttaaaaaacataaaagtaatttacataaataaggtgttcagcattctaggtcacttcattttggtgtaagttttttttatagcaatcaaaattatttatctggataaattctaccttttcctgcttgccctcactagtaaaacaatttaattctattatatcagcatcaccttttcttgatgctgttttcccaaactttaacccacaagacggtattcattcataaagtaatctgtacactctctgaaagcacacaaacaagtattcccacaataccttcagttcacttacattcccataataccttcagttcgcttaaacagacatttaatgaagtgcaatactccttccgtagcggcctttgcatcacctaacttattactgacacatccaccagagggggaaggaacattgtggagatgaacagttgaatggtatttacaggagaccactgatccctatcaaattgtagtgtcattttagccttcacaagtgcaaagataatttctatgatataggaactgattgaaattttctcttccctttccatccaaggtgcatttctatgtggagtagatgaggtgtcataacactgtgtacctttcttcctattatagtatgagtaattttacatctatttgaaattttcatgagtacagtgaccatgtcttcttttttcttatcatcgctcagggataatattcaaaattgttagcaactggcctagcacagtgacaaatcaattagaatggatgctgcttagaacaccactttgttatgtacaaacagaatatcagttcagcaactggcataatgtggagaacataacagctcatcagtaaataattgttaaacaaatacgtggatgaagaaattaaccgacttactggatcagacctgtctcacattcagtttcaaatcattcattacttcagtgctttcattgtatttaatcattcactttttaaaatccctacaaagtagacactacgtttattgtttagggtaattagtaggggaggaaagatggttaaatagaaatagcccatgctttaagatgtttatagtcgttatagtcttgcttatagtcaagatgcttatagtatgggaaataaaatattttcataaataatcataaacaaagtagaaatgaaaagtatcaatggcttacttttggggacacttgagattcaaaaatagatctgttggattccaaagaccatgtgcatctcactatgtaaaacattggctttggaatttacacacccggatttgaatctcagcttcagcattacctggtatgttggataacattgggaaagtcattaaaccattttcagtctcagttttcttatctttaaaagaggggtaatagtacccacctctcagagtttgagtgtattttaagtataaccatattttaacatatttagcacaaagtgtaataatacagtagatgctcattagatattaatcattttatatatgcaagttaactgtatcttatattagaatactggtattatggtggtcataaaactatattgttttaaagaaaataaaattatcagcttctaaaatttcatattagattgggcaaaggcttgaggatcagacagacgcagaaacaaacagttattccataaactaccacgtttatggcttgaagcatattacctaacatatttgaacctctaatttcttcatttttacaactatataggattgctatggggatttaaaagaaagaaggtgctcatgatacattaactgcttcaaaatgcaatttaaaatatgaggagccttaaaggtcctgagcagagataataaagtcctcactttctattttaaaactaaaattaagattgttcctaacctggaacatgtttcctgtcaagatttttttttttattaagctatgtgataggatgattgattccattggaaaacttgtagtggataaaacactcacaagaggtcccctatgcagaaggctgaatgtgaaaagagatgtttggagaagcagagtattatctgcataatagctgtaccttggtccccagagtaggtagcttatattcctagataacaggactccaagacctgaagaaattctttccctagttgagatatagtagatattattgaccttgagtttctctccctttggccttctcttaaaactctggatacatgtattatcaggagaaatctagtgcaaggcagacctgtgcctgcattaagaaaatgatactgaagttatggaaggagaacaataaagaggaggactcaatctgagtctcaagtctttccacatctcagcaatgttatgctgggcaaatgacccttcttttaaatcctactttatttcatctgttaaatgagaatgccaatgtttctaagcttaacaactttcaacgtatatttataaataaagttatgcacaaagaaaaagtacacacaaatagacgattcttatcctaccccaagatgtcactattgctcattatggctattttagtctgagccatctcgttattctatagcttatgacttgtttgttgtgtttatgcttattttgagtcatttttaaaacagccaaccctattatgaagccatttaatgccatattcaccattaaatgtaaaagaattagtattgttttttcataaatgtgtagaacttgttacttcagagtgtcacttcagaaattaagaaatggaattttaaaatagcctatttgatagtacagaatatttgaaatagtaataactgcctgacttgcctacaggagtgtgcaatatataatagtacaaatacttcataaaataaaaaatgtgactgaaatatattcattggtatatgtctacccctacatgcagtgctaggtggattcattgttatagaggaagtcaaagtaaaggagcctggagataaaaagtaggcatatctataaaccctaggacaaattataaacgactgaaatttctgaaaaaaaatgtagatgattattagaaattggtggattctactccctctcaccagattcctgggagaccaaatgctcccaggaatctctctagcccagctcctaccctctccaagaatctctcctttcccagaaatctctctctaggccagctcctcccctctccaagatttctctctaaagctggttctatcatttaatgatgttccaataagaaagagaagagaaaaaaatatattaataacattgtagggaaatacagaaaaagaaaacatcttactttcataaaaataatttaaaataattagaagtgccagtgtcttcagatgagtaggaatcagtgcaaattttctgacactatgaaaaatctgaatgtagtgacaccaccaaacgctcctattagccctccagcaatgatccctaaccaaaatggaaattcagaaatgacagataaagaattcgaagcatgtatttcaaggaagctaactgaggtacaagacaaagttaaaaatctacacaaagaaacttctaaagcaatctggaaaattaaaaagaagataaatatctttaaaagaatcattcagttcttctggaattaaaaaactcacttaaggaattttaaaatacaattgaaagctttatcaacagactaaaacaatcagaagaaagaatttcagggcacgaagactggcttttcaaattaacccagtcagaataaaatatacatatttttaatgaacaaagtctcagagaaatatgggattatttaaagtgaccaaatatataaattattggtattgctgagaaagagaagaagtaagcaacgtggaaaacatatttcaggaaataattcaagaaaatttcactgatcttgctagagaggtagacgacatttagatacaagaaacctagagaacacctgtaagatactatacaaaacaaacatcaccaaggcatacagtcatcagactgtttatggtcaatgctaaagaaaaaaatctttaggcagctagagaaaaaggccacattacgtacaaaggaaacttaatcaggctaatggtggatttctcaccagaaaccttataagccaggagagactgggtgcctattcctaaagaaaataaattccaaccaagaatttaatatcctgcccaaccaagcttcaaaagcaacagagaagtaaagtatttgccagacaagcaagtgctaagtgaatttgttaccataagagtaacattataagagatctcggtatagttcagatatttgtttctgcaaatctcatgttaaaatatagtcaccaatgttggagatggggcctggtgggagatgtgtgggttatggaggtagattccccatggcttggggctgttcttgcagtagcaagtgagttcttgcaagatctggttgcttaaaagtgtgtagcacctcccttctgtctctggctcctactctggctgtgtgacattcctattcccacttcaccttctcccatgagtaaaagttccctgaggcctcctcagaagctgagcagatgctggtgtcatgcttcctatacatcctgcagaataataatcccattaaaaatccttcttttaaaactttcattttagattcaggggtacatgtgcaggtttgttatataggtaaactcatgtcatatgggtttgttgtacaggttatttcatcaccaaggtaccaggcctagtatccaatggatattttttctgctcctctccctcctcccatcctccgccctcgagcaggtcccagtctgttgttgcctctttatgttcataagttctcctcattaagctcccacttttaagtgagagcatgcagtatttggttttctattcctgcatcaatttgtgaaggataatggcctccaactgcatccacgttgctgtaaaggatatgatttcattctttttttttttttttgagacggagtcttgctctgtcgctcaggctggagtgcggtgcagtggcacgatctcggctccctgcaagctctgcctcacgggttcacgccattctcctgcctcagcctccctagtagctgggactacaggtgccagctaccacgcctggctaatttttttttttttttaagtaaggacagggtttcaccgtgttagccagggtggtctcaatctcctgaccctcgtgatctgcctgcccaccttggcctcccatagtgctgggattacaggcatgagccactgcgctcagccgatttcattctttttatggctgcctagtattccatggtgtatacgtacgccattttctttatccagacaactatttatgggcacctgggttgattctgtcttttctatgtgaatagtgctgcagtaaacgtgtggtatgtgtctttataacagaataatttatattcctttgggtatacactcagtcgtgggattgctgggtcaaatggcatttctgtctttaggactttgaggaattgccacactgtcttccacaatggttgaactaatttacagtcccaccaacagtgtacaagtgttcccttttctctacaaccttgccagcatctgttatttgttgactttttaataatagccattctaattggtgtgagatggtatctcattgtggttttgatttgaatttctgtaatgatcaatgatactgagctttttttcatatgctttttggccacacgtcttcttttgaaaagcgtctgttcatatcttttgctcacttttaatggggttgtttttttcttgtgaatttgtttaagttccttccagatgctggatattagacctttgtcagatgcacagtttgcaaatattttttcccattctgtagtaaacctgttttctttataaattacccagcctcaggtattcctttgtggcaacacaataatggcctaataaaaatcctaagggagttttataaacagaaatgagagaactatacctgctatcacaaagacacaccaaaatatatggcacacagaccctatacaacaaccacacatggaaactagaaaataaccagctaacaactttatgacaggatcaaaacctcatgtatctatatcaaccataaatgtaaatgctctaaatgcctcacgtaaaatgcacagaattccaagttgggttaaaaaaaaagacccatcaggataaaaaatcaatgtacaaaaagcagtagcatttctaaacacaaataacattgaagctaagagccaaatcaaaaacacaatcccattgacaatagctacacccaaaaataatataccatctgcagtcttgaagggcatctttcacatgtaatgacccccataggctcaatcaaagagttggagaaagatctgtcatgcaaatggaaaacaaaaaggaaaaggaattgctattcttatatcagataaaacagactttaaaccaacaacaataaaaacgacaacaaaaaccaaaaaaaaaagaagggcattacgtaatgataaaggttcaattcaaccagaagacttaactatcctcaatatatatgctaactatcctaaatatatatgcactcagcattggagcacccagattcataaaacatgcacttctagacctgtgaaaatacttagacatctgcagaataataggtaggatttcaacacaccactgacagcattagatagatcattgaggcagaatagtatcaagtaaattctggacataaatttgacacttgacaagctggatctaatagacatctacagaataatccactcatcaaccacagaatatacattcttctcatctgcacatggaacatactccaagattggccacacacttggccacaaaacaagtctaaatacatttttaaaaatcaaaatcatactaactatactcttggaccacagtgagataaaaaaagaaaccaataccaagacgaactctcaagaccacacaattacatggaaattaaacaagtcactcctgaatgacttttggttgaataatgaaattaaggcagaaataaaaaaattctttgaaataaataaaagctgagacacaacataccaaaatctctgggatgctgcaaaagcagcggtaagaggaaagtttacagtactaaagtcctacatcaaatattataaagatctaaagttaatgacctaatatcacaccaagaaaaactagaaaaatgagaataaactatccccaaagctaaaagaagaaaaaaataactaaagatcagaagtgaatgacattgataacccaaaatccacacaaagaatcaacaaaaccaaaacttggttatttgaagggataaataagatcaataaaccactagctagaataaaaaagaaaaagagtgaagatccaaataagaaactaaaaaagtgctattacaacatatcccacagaaatgcaaaagctctccagaaaccattatgaacacctccatgaacaaaaactagaaaatctaaaggaaatggataaattcttggaaacatacaacctcccaagagtgaaccaggaataaaatgaaatcctgaacagaccaataatgagtttcagaactgaatcagtaatacaatcctaccaaccagaaatagccctggagaagaattcacagctgaattctaccagacatataaaacacaactagcacaattctactggaattattccaagatttcaagaagagactcctccctaactcattctatgaggccagcatcatcctgctaccaaaacctggcagagacacaatgaagaaagtaaacttcaggccaatatccctgatgaacacagatgcaaaaattctccaccaaatgctagcaaactgaatccagcagcacagcaaaaagctaaaccaccacgatcaagtaggttttattcctgggatgcaaagttggttccacatatgcaaacccatgcaaataatacgaaaatcaataaatgtgattcacataaacagaattaaaaacaaaaaccatatcatctcaatacaggtggaaaaagatttcagtaaatttcaacatcccttcataataatgaccctcaacaaactagttattaaaggaacatacctcaaaataataaaagccttctatgacaaacccacagccaacatcatactaagtgggcataagctagaagcattccccttgagaaggggaacaagacaaggatgcccactctcaccagtcctattaaagataatattgtaagttgtagccagagtaatcagacaagagaaagaaataaaaggcaaccaaataggaaaagaagtcaaactctctctcttcgctgatgatataattttatcccaggaataccctaaagatttcaataaaagactcttggaactgataaaagacttcagtaaactttcaggacacaaaatcaatgtaaaaaattcagtagaatttgtaaataccaataaagttcaagctgagaaccaaatcaagaatgcaatcctatttacaatagccaaaaataaataaaatacctaggaatacattcaagcaaggaggtaaaagacttctacagaagaactacaaaatactgcaaaaaaataaataaaaaaacaacagatgacaaaaacgaatggaataatcttcaatgctcatagattggaagaatcaatatcattaaaatggccatactgcctaaagtggtctatagattcaatgctatttctatcaaacgaccaacattctttttcccagaattaaaaaaagactattctaaaatccatatggaacaacacaacaaaaagtccaaatagccaaaataatcctaagcaaaaagaacaaagcttaaagcattgcatcacctgacttcaaactatactgtaaggctacattaaccaaaacagtatggcactggtacaaaaacagaaacatagaccaatggggccgagaacgcagaaataaagctgcacaactacagccacctgctcttgacaaagtcaacaaaaataagcaatggagagaggactttctagtcaataaatggtgctgagatacttgctatccatatgcagaagaataaacctggacccctacttttcatcatgtacaaaaattaactcaagattgatttaaatgtaagaccttaaactctaagaatcctaaataaaacataggaagcaccattttggaaatcacccttgggaaagaatttatgactacatcctcaaaagcaaccgcaataaaaagaaaaattgacaaatgggatccaattaaactaaagatcttttgcacagcaaaagaaactaccaacagagtaaagaggcaacctacatattgtagaaaatattcacaaactatgcatctaacaaaggtctaatatccagaatctataagaaacttaattcaaccaacgaaaagctaataacctcattaaaaaatgagaaaaggacatgaatagacacttctcaaaagaatacatacaagcagccaacaaacatgaaaaaatgctcatcactaatcaccacgaaaatgcacatcaaaaccacaatgagataccatctcatacccatcagaatggctattattaaaaagtaaaaatcaacagatgttgatgagcttgtggagaaaagggaatgcttgtacacctttggtgggaatgtaaattagtccagccactgtggaaagcagttaggagatgtctgaaagaacttaatacagaactactattcaacccagcagtcgcattagtgggtatatatccaagagaaaataaatcatcctaccaaaaagacacatgtgtgttcattgcagcactattcacaatagcaaaaacatggaataaacttaagtgtccatcaatgccggactggataaagaaaatggggtacatatacaccatgaaataccaggcagccataaaaaaagtgaaatcatgttctttgcagcaacatggatgcagctgaaggtcataattttagacaaattaacagaaaatgaaagctaaataccacatgttctcacttctaagtgggagttatacatggcaacaatagacactgggtactactggagggggatggtacagcaaggggcaaggttgaaaaactaactattgggtactatgcttgctctttgggtaacataattaattgtaccataaacctcacacagtatactcatgtaacaagcttgcccatgtacccgcagaatctaaaataaaagttaaaattattttaaaaaggaattaggaaaggagtgagtccatttaaaacttctgttggatgtatgtgcgaagagctcttttgtttgtttcaatatcttattgctgggcttataatactgtaatttctgataactgatatttcttatgtttttcaaatattggtgatcaaatatgcctgattatttaacctattaagtattttatcccctcctttttgtttattgaggtacacctttttaggcatgtacaattctatcactttttgttgttgttgtttgaggcaagttattggtctgtttcctaggctggagtgcagttgtgtgatcacagctcactgcagtcttgatcttctgggcttaattaatccttccacctaatcctaagtagctggggccacaggcacacacgaccatgcctggctaattttttaaaacatttttttgtactgacagggtctccttatgttgcccaggctggtcttgaactcctgggctctagcaatcccccagccttggcctctaaaataatgggattacaggcataagccactttgcctggcctgtgatgtttgattaacatttctactcatgtaatcactgctacaggcaatcgagatagaacatttacctcatcccaaaagttcttttatgtatgtttataattcatagcctctcccaatccatatgtcctggcaaccactgatctgatttctgtccaaaaagttttctaatttccataatggcatattagtgaaaacgatataatatatagtattttgagtctggtttgagttaacataatccatttgagagtcatccatgttgtcatgtataccaatatttcatttgcttatattgcagaggggtattccattatatggatataccacactttatccattaattacctgatggacatttggtatctttccagctatagaagattagggataaatctgctataagtattattaaaatatattgtgcaaagatatatttttcttttttatttgtataaattactgggtagaagtgtaattttgttataagcatagattgttatagtgctcaagtcagggcttttagggtatccatcactcaaataacatacattgtacccattaagtaatttcttatcatccagctctctcacttcctcacctttgcgagtcttgggtgtctgtcatttcactctgtatgtccgtatgtacacttttttaagcacccatttatgagtgagaacatgcaatatttgactttctgtgtttgactttctgtgtttcacttaatgacctccagttccatccatgttgctgcaaaagatgtaatttcattctttttgctgtctaaatagtatccattgtgtgtgtatgtatatgtgtgtgtgtatatatatatatatatatatatatatatatatatatatatatacgttttctttacccagtcatccactgatggatgcttatgtttattctgtatctttgctattgtgaatagtgctgtgataaacgtaacagtgtaggtatctttttgatatattgatttcttctcctctgagcagatagcttagagtgggattgctgtatctaatagtagctgttttttagatttttttgagaaaactccatactgttttccatagaggttggactaatttacgctcccactaacagtgtataagagttcccttttatttgcatcctcaccaacatttgttattttatttatttatttatttattttgtttctttaaaaacagccattctgactggggtaagatatctcactgtggttttaatttgcttttcttgataagtgacgttgagcattatttcatataccagttgtatgtcttcttttgaaaaatgtctattcatgtcctttgcccactttttaatgggattatttgttgattttgttcagttgtttgagttccttgtaaattctgaatattagttccctgttggatgaatagtttataaatatttgctcccattttgcaggctgtctgttcactctgtcaattatttcctttgctgtgcagaagatttttagtttaattaagccccatttgtctatttttggttttgttgcctgtgcttttcaggagttagtcataaattctttgcctagaccgatatccagaagagttttccctaggtattcttctagcatttttatagtttcaggtcttatgtttacgtctttaatccatcttgagttgattttggtatacggccagagatatggatccaatttcattcatctgcatatggtaatccgattttcccagtaccatttattgaaaagagtatccttttcccaatgtatgttcttgtcaggtctatcaaagatcagttggttgtagttatgtggcttcatttctggattctctattctgttctattgatccatgtgtctttttatttttataccagtatcatgctggtttgattattatagccttggaatataaaatcaggtaatgtgattctctcagttttgttcttcttgcttaagacgttttgagtcttctggttcatttttgattccataaaatttttaaattgctttttctaattctgtgcaaaattgttggtattttgataaaaaatgcattgaatctgtagattgctttgagcagtatagtcatgttaacaatattaattcttccagtccgtgagaatgagattttttatttgtgttatctacaatttatttcatcattgttttgtagttttccttgtagacatctttcaccttctgtgatggttaatattgtgtcaagctgattggattgaaggagggaaattattgtttttggatgtatctgggtgttgccagaagagattaacatttgagtcagtgaactgagagaggaagactcaccctcaagaagacccactcccattatgtgtgagcaccatccaatcaactatcagcatggctagagaaagcaggcagaagaaggtgaaagaagctgacttgctgagtcttcccgcctttctatttctcctgtgagggatgcttcctgctcttgaacatcagactccaagttctttggtttttggactcttgaacctacgccagtggtttgccaggggctctcaggccttcagccactgatgaaagcctgcactgtcggcttccctacttttgaggttttgggactcagactgagccactactggcttccttgcccctcaacttgcagatggcctactgtgggacttcacgttgtgattgtgtgagtaattctccttaataaattccctttctcatatatatatatgtgcgcacacacacacacacacacatatatatgtatatatacacacacacatatcctattagttcggtccctctggagaaccctaatataactttttttgtgaaatttattctcaggtactctttttttgttgctattgtaaataatactgctttctttatttctttatctgctagatcttttggtttctacaaatgctacttatttttatacattgattttatatcctacaactttactaaattcacttatcaaatctaggagtttttttgtggagtcattagttttttctaaatacaagatcatatcatcagcaaacaggaataacttgacttcctcctttccaatttggatgccttttctttctttctcttgcctgatcgttctggctaggacttccagtgctatgttaaataggagagaggcaaaactgataaacttctagctagactaaccaagaggagagaataaccaaataaacaaaatcagaaatgaaaaaggagacattaaaattaatgccacagaaacatgaaagttcatcagagactattatgaacaactacatgctcataaaatagaaaacttagaggaaatggataaatttctggaaatgtacaacctccccgtattgagccaggaagaaatagaaaatctgaacagatcaataataagataggatcaataacaaaacaatctctcaacaaaaaaaaaagcccaggaccaggaccaggaccagattgtgatattcacaaccaaattctaccagatatacaaagaagaactaataccaatcctcctaaaatcgttcaaatcaaagaagagaaaattcttcctaatacattctaccatgccagtatcatcctgataccaaaacgaggcaaggacacaacaaaaatagaaaattataaaccaattttcctaatgaacaaagatgcaaaaatctttgttcattactagcaaacccaatccaacatcacatcaaaaagattatacaccatgatcaaatggtttttatgctagggatgcaaagatggctcaatattctcaaattaataaatatgatacatcacataaaattaagacaaaaacgatatgatcatctcaatagacaaagaaaaagcatttaataaaattcagcatgacttcatgataaaaaaattaaaaaactatacatagaagcaacatacctcaaaaaaatataggccatatataatatacacacaggaaacatcacactgaataggaaaaagttgaaaacatttcctgtaagaactggaacaaagatatatttctcagattgctggatttatggtaagtttatgtttaactttataagaaactgccaaactgttttcctgagtggctgtaacattttttcattctcatcagcagtgtgtgtgaattctgattgcctaacatccttatccacatttggtactgtcatttgttattgttgttgttgtatcattctaataggtatgtggtgacatcttattgtggttataattttctcttacattgaattgaaaacatttttaaaattcagatatttccctatagctccaatatacacatttagtaacaaatgatactattatcgcaaaatttgtggatggatttaacttccttcttccaggtatattcatcttaatgattgttttgaattcagcttcctttatgccattatagttttttcccactagatggcaactgctcagttgtttagaacggctgagtagctaaaagcaaggaacataaaggatagagtcaagctatgaattgtgaagtgctttactccaggattgtacaaaaaaaaaaaaaaaaagcgacaagacttcattgtctgccaaaagttcatcataacttaatgtgtgtgtgtgtgtgtgtgtgtgtgtgtgtatactttctaagtaatttcaatctaagtttggaactaccaaatgtggatggagcacagaatataaaaatacaaaacaaggtatcttttgaatgtaagttagtgtcacaaagtaaacaaatagtttgtagaaaacattcagaaactatctagtttcttcagacagtatatacttctggagaatataatttgaaacacagatattttagtagttttgacataccaaacatatattttctggaatacctgtaggtaaactgagaagttagttaagggttttctgattgctttttgctgttattttagcaccacataggacctcctccctgagttgatttcattcattaatcaaatatttactaagtttctattctgtttcaagctttgtggtagcatcaagaatactaagaggaaaacgacctaatacatgataataaaataataatataataataataatagaaattgtcctttaagtgccagaaagtattctaagacatttataaacatactacttcttattaccacaatcttatgaaatgttattgctcctctttaggagacacaaattgaagactgagaccctctgacaaccgcagtagttatagttgagacaaaaatgattttaaagaatattcatgtttagagtggaccagagatgtcaccccaaaattactctttgcagccatgtagtatggaaggaaacaagatatttccatgtcctcagtgctgaacaacttttagtagtcgagagattccaagcctacccatgcagcttctatagtgatatacaacagagatggcagagggcagggtctaagacagaggctggatggaggacagacctaggatgcaagaagcagaattgaagcccaaataggaatcaagatagagccaagtcatcgatctctagccatgccaaaagaagatgcttggaataccattagcagccacaatcttcacttgacaatatcagtatgattcttggaaatcaagacaagaaacacttccatggatacctgcaaaaccccacgggtaacagacacacacatgtagcccaggtgtttactcccattataaagacatgtaaacttccccacactccaagatactatccggggtggattagatgggaaagacaaacttttgagaggagagaaatataacttgattaaatatttatccaaaataatattgctttaaatatatcactaggtacctttaagtttttaagttttggggaatcaaagataactttgaggatttagtaaaagttatgaacattctttcccactggcttcctacccacccacctacatacacacattctctttcccactaactacccctaccacacacacacacacacacacacacacattaaaatgagtaattcaaaatatttgcgtatatctctatagggcttagtgaataactgaagcttagtcattaactcctggaagatctatgaatcccgggttaagaaatcctaggttgtggaaatggcactagacttgagttttgactcaatcatttgccacctatgagaacttgaataaatcaactcttctctctgaatctcaggtttctcactgtttgtgaaatatctattacatggaggagtgggatagggatggctctatcataaaaaacatatcttctttacactcttctttgcaaaattttataatatatgaatacacttacagtcctacatggtcctatatagttattttggatctgtcattgatcacttttaattttcctcttaagagtgtcactctttttctctatcccaccagcatcagcgtacctttctggcagtcctcatcctcacatatgagaaactgcagtagcatcgtgtagcatcttgctgtttcaacctttagtccttcctatgtatgaagcacattattctcaacccactgcttcttcctataactctcttgcttaaaatctaccaagactctcaattacataagagataatatctaaaatctaacagtcaaagacttaaaaaaaatcaattgatctcaccctgcttaatcaatcttacatcctcagctctagtagtctaaattttactactaagaggaagctttcataggaggaaaaatgatgtgatttgaagtcgttggctcagtcacttactagctattttcatcctgggtaaaacacttatcctatcacggccttagttttctcaacacttaaataaagtatttgttctggacaatttctaagatccctttcagttctgacactgtctgactccatcaccctgtgccccttaaatgctaaattcattcctactctgaatccttgatctttctgtgttctctttctgtagcatcctttctgccagactaagcattttctgttctccaaggttcaacttatgtacttgctcatccatgaaatcttcagagctccaaagtttgtgagaatcatttccttctctgcggtctcatggcatctaaattttgtactaatcaataagagtatcttacactgatataacactatagctttagtagagatgtttacatacaatatttcactggagcctctcaaaagatctataaaggtaattactattcctactcaaactcagagaagcctaaaatgtctcaactctaatgcaactgatctagagtcagaattaaaggtttttgattcctgtttcagagtttttcctccatacatgttcaacatgtcaaataattattggtatctgtatgtttcacctatatagctattatttagctcagtaaacatatatgttaagctcccatcatataaaatctgcttaggtataagctatggctaagggagttgggaagcaaatggagttttctagcatgggtgcttgtaattcttattttgtctggtaacccttaacaatgagcttattaaaaataagggtataggctgggcacagtggctcacacctataatcccagcactttgggaggctgaggcgggtggatcgcctgaggtcaggagttcaagaccagcctggccaatatagtgaaaccccatctctactaaaaatgcaaaaaaaaaaaaaaaaaaaaaaaaaaaagcttagctgagcatggtggcaggcacctgtaatcccagctactcaggaggctgaggcataattgcttgatcccgggtggtggaggtttcagtgagccgagattgcaccattgcatttcagcctgggcaacaagagcgaaactccacctcaaaataaataaataaataaataaataaataaataaataaataaataaattaaacaagagtatagaacataaaataagaacattgtccgtggagtcagaaatatctgggtcctctctcattctttgtattaaggaaaatttcaaatacattaaaataagactgtgtacctcctcattcatcttcaataatgatcaacttgcaaccaactttatgtcatctatactcctaaccactccctcagattattttgaagcaaaatcagacatcatttcacttcatctgtaaatattttaagaagatctacatataaagactcttgcttttaaaaataactctagtaccaacaaaaattctttaaaatcatgaaatagttaatgaagattcaacatttcttggttttccaatttaaaaaaaaagcttgctcaaaaaaatgatcttatataaatagagagtagactggtggttactagagactggggtgatgtggtggccgttggggagatgttggtcaaagtataaaaaatttcagataggaggagtaaatttcaacagatctcttgtacaacatgttgactatagttaataatacattgtatttttgaaaaaagccaagagagttggtgtaaagtattctcatcacagaaatgataactatgtgaggtaatgcatatgttaattagctagatttaatcattctacgatgtatgtatactttaaaacatcgcatggttcacataaatacatacaattttgtgtcaatttaaaaataaataaataaatgtatgatgagaaaaaaagtttgttcagatcaggctgcaaaacaaggctatatatggtttgcatgtctcttacgtttcttttaatctacaggatctcctcattctatcactctcctcttgcaatgtatttgtttaaaaatatgctttttttaaataaaaaaaaattctcctgtagtgcttctgacagtataatttttttctgatcatattatcttatgttatggttccctatatctcccatgaattggaagttaaatctagatttgatcaaactgaggagcaatattttacgcaagactcctcatgagttgttaggtatacttccattagaagtcacatgatgtctaattgtctttttatgatgttgtaaccatggacaaatattttgcagatctagtaatttaaaatggtgatattctattattccttcataattgattaggtacaagaccactataaagagaaatttcatttcacttatttggtaaccttgaatttgaaattgtatagaaccaacaaggtaaatgttttattcttcctattgattcgttttcaaaacaaaaaataggttccctagtatttccaaatctagtaatcaggtgatttttaaataatatctttatgaaatcatggatctaaacatttttattatgttttaacccattataattattatctttattgatgctcagattgccttattttgaccagtggaagctggtaggctttcgagtccttttatgatgacactccatatcttggtggataggttaattgctttctgacataacaaaatatttcagttccatcttgtcattttcctacctaagacctagaataagtctttttcttgaaaatcattttttttcccaagaagatctgttaccttttattaggaaatggtatttggaaaccacactggaaacactacagatgttcatatctactatgctatcattacttctagctcttttaagtggacaaaactaggaaatattcttaaagataaaatatatcatcatcatgattcattctgaacttattcaaattttacttaacattagtcatagaagaagtttggtttttatcccagctcccccagttgcctatagaacaagtgatataaactgtaactaccctaagccctcaattttgtacctgaaaaattagaataataaaaccaactactcacttgaacactcataagaagatagttggtctatcctgaccatatggaaaataatgaagtatcataaaccacagatatatagaactaaccatttggttttattataagaaaacgtagaaattctgaaagccacaaaattatcaattccaagctaggacattccagaagttaatagctaaatacagctagaaagaactactagaaactacaggatgactgatcacttttataacaagcttctaagatagagcactgagctccctatttctctgttccgccttccgtccactcatgtaaacactggcttcccccaaaaaacatcaattccattgttaggccttcttcctgtaagatctgaataaagctccaatgagccataaccaatctcttctgaagcattccacccattgataagagctgcctcaattgaatatttccattgcagcagcaatagggcagacagttgcagaaaatcctcaaaagaactaccatagacacaaagttaactggcagtaaaaatcgctctgtgacaccaccaccctatgttcagaaagataggcaaagctctcctctttgtctagaccttcctttaattagggtcccgggggccaggaaaattctctgaagtaagtctgtgcactgctccggcttttgaagagtaatggctttggtgggaagaaacatttgtaaaaattcagatctaatctaggaacccaaaccaatctaattagagtgtctgtgcactgagatgttcactaatgagactcaaagaaccaacacaggagaaacaatgacttttttgcagcaggcattatcaggctgccttaaatgtgacccacattcactcatgccccagtaccccaggagtagagccatgtcctttttctagattgactcttggcaagtgtctctggtaagttttccattagggggcttctgtactttctattgcttctccataagactccattgttctcttttcttctgcttagtgtctgacctggcgtgctccagattcctatggtttgaattctgtctttttaactcatgtcctactctagccaaatccaattacttgtcctgtgcctctgtgcctttgcaaatgctgttccctatgcacagaaggcctttccttctctaaataattaatttattctttctaaactctcatagctccactacaaagtttttctgaaatccctctctctactccatctctactatgaggaagaaataaatgcttattccctctgttccacctctttacccaatatatatctctaccacctcacttagtatggcaattatgcacctatatgtgtatttcctctataatattctgagccttgtgtctaaagaatatatgcctaatttatttttctgtgtccaatttctatctgagttcctgcacatcatagtacattcacaaatacttgaaggccctcaccactggaagataaattgcagaacatccattaaactagtggttcatacaaaattatgtgggaatgtgaagaagggagaaactgacctggcacagtggctcatgcctgtaatcccagcactttgggaggccgagacaggtggatcacttgaggctaggagttcaagaccagcctggccaatatggtgaaaccctgtctctacttacaaaaaaaaaaaaattagctgggtgtgatggtgcatgcctgtagtcccagttacttgggagactgaggcataagaatcagttgaaccagggaggtagaggttgaatgagctgagactgagccactgcattccagcctgggtgacagagtgtgaatatgtctcaaaaaaaaaaaaaaaaaaaaaaaaagaagaagaagaaaccacatcaatctccacaagacacatccagataaaggacaaagtagccagcaggtaaaaacaaaaatagtaaaacaaaatcagtcacaaataatgggggtctttccccattacacttctcactttctctgctgagagagggtcagaaagcaagagcctcctatgtaagtactacgacctatattcaacatgaggcacattacttggaacacaacaggtgttcaaaaactacttactgaataaataaagtaggtatgcgctactttcagaaatgtctctgtcactgcgacctaataatatcaatcagggtaataaaatgcatgcctgtggtcctgagtcattctccacatacattcatacctttgagtgcattttctctttcatttatattacttttcttagtattccaatgtataatgtagttataatacattttataacgtatatacaatgtttccctctactacttgtgtatatttattataaatatagatttataggtgtatgtcatatactaaataatacagttaaaattatttgattacttatctctcctactacagtgggacctccatgagaaagggaagattgtcattatttcgtccaaacattttgctcttcaatcacctagcagaaacctagaaacagtagcatcacataataatgtatgttgactcaataaacaaatgtatcaaagttagcagatttgatcctccagggtttcctcatattatggtccttttccagcctcatcactaaatgatatcatggcgactcagggaagctctgttttcctcactaagaccagaacagaagatggtgctatcaaatagagtttttaaatccagaatgaattcatccctatgccttgtctacagaatcactcagaaaataatgcaaggaagtgaaacaaagagagacatgcaaaagaaataatcttggcacagcaccttgcaaatcaattttctatgcccttgtttctgaactttcctgtaaggtggaggcttagaaactgcagtgttttcatgatgattggatagcatgttctgccactcactgcctttcctggagtttctaacaggactgctactatttatcctccagtttcacccaatctgcagtctttctcataatggctgcagtgatccttccctaaagttatgtacagcactcaaaaaccttccttaagactcacttactgtttatcaaactttgttaaatagcattaagacaatgattgagtaaacattttaggacaaagctttattttttttcctaatttttattttttgtgggtatatagtaggcacatatatttatggggtacatgagatactttaatgtagttatgcaatactttataatcacatcacggtaaatgaagtatctatcccctcaagcctttatcccttgtgttacaaacaatcgaattatactttttagttatttttaaatgtgcaattaaattattattgactacagtcaccttgctgtgctatcaaataccatcttttattcattctttctaacttttctattttttctatttttttaaccattaaccatctctacatccccccattaaccctcactacccttcccagtctctggtaactatccttctaatctcaattgaatttaaacagtaagttcaattgttttaatttttagctcccacaaaaaagtgagaccatgctaaggttttctttctgtgcctggcctatttcacttaatataatgacctccaattctatccatgttatttgaagtgtcaggatctcattcctttttatagttgaacagtactccattgtgtatatgtaccacattttctttatcaattgatctgttcatgaacacttaggctactcccaaaccttggctattgtgaagagtgctgcagtaaacatggaagtgcagatatcttttcgatattcctgtttcctttcttttcagtatatagcgagcagtacgattgctggattatatggtagctctatatttagttttttttaggaactctaaaatgttctccaaagaggttgtactaatttacattcccactaacaatgtaggagagttctcttttccactgatcctctccagcatttgttattgcctgccttttggataaaagccattttaactggggtgagatgatatctcattgtagttttgatttgcatttctctgatgatcaatgatgttgagcaccttttcatatacctctttaccatttgtatgttttcttttaagaaatgtctattcaaatcttttgcccatttttaatcaaattattgaatgttttctatagagttgtttgagctccttatatattcaggttattaatatcttgttagatgtgtagtttgcaaatattttctcccattctgtgggttttctcttcactttgttgattgcttcctttgctgttgagaagctttttaacttgatgtgattgcatttgtccatttttgctttggttgcctgtgcttgtaagatattagtcaagacatctttgcacagatcaatgtcctggagggtttcccttatgtttccttgtagtagttgcaaagactgaggtcttagatttaagcctctaatccattttgatttgatttttgtatacgatgagagacagtagtctagttttattcttttgcatatggatatccagttttcctggcaccattcattgaaaagactgtccttcccccagtgtatgttcttggcacctttgttgaaaatgacttcactgtaggtgtatggatttatttctttgttctctattctgttctattggtctatgtattagtctgttcttacactgctataaagaactgcctgagactgggtaacttataagtgactcacagttccgcatgactggggaggcctcaggaaacttacagtcatggtggaaggggaagcaggcatgtcttatgtggtggcaggtgagatcgagtatgtgaaggaggaactgtcaaacacttacaaaaccatcaggtctcatgagaactcactcactatccggataacagcatggggaaaactgcccccataaaccaatcacctgtcacccagttccctccctcaacaccagctgaagattacaatttgagataagatttggctgaggacccagagccaaacagtatcagtctatgcatctgcttttatggcagtaccgtgctattgtggttactataactctgtagtacaatttgaagtcaggtaatgtgattcctccagttttgttcttttgctcagaatagttttggctattcaggtcttttgtgatttcatataaattttaggatttttttctatttatgtgaagaatatcattgctattttgatagggattgcattgaatctgtagattgctttggctggtatggacattttaacaacattgattcttccaatccatgaacatggaatatctttttatgtttttgtgttctcttaaatttctttcatcagtgttttatacttttcattgtggagatcttttgcttctttgactaattcctagatatttaattttatttatggctactacaaatgggattacttttaaatatctttttctgattgttcagtgttgccatatagaaatgctaccgatttttgtatgttgattttgtattcttcaattttattgaatttatcagttccgatagctctttcggtggagtcatttggtttttccccatgtaagattatatcatctacaaacaaggataatttggtatctgcttttccaacttgaatgccttttatatctttctattgtctgattgctgtagctaaggagttccagtactatgctgaataacagtgatgaaagtgagcatccttatcatgttgcagatcttagaggaaaggctttcagtttttccccattcattatgatactagctttgtgtctgacatatatgacttttattatgttgtagtatgttccttctatacccagttttttgagggtttttatcatgaagagatgttgaattttatcaaatgctttttagcatcaattgaaaagatcatgtggtttttgtccttcattctgtttatatggtgtatcacaatgattgatttgtatatgttgaaacgtccttgtgtcactgggataaatcccacttggtcatcatgaatgatattcttaacatattgcttaatttggtttgctagtattttgctgagtatttttgcatcaatattcatcaggaatattagtgtacagttttattgatgtgtctgtctgatttttgtatgaggttaatactggccgtatagaatgaaattggaagtattcctttctcttctttttttttggaatactttgagtagaattggtattacttctttaaatcttggtagaattaagtagtgaaaccattgggtaccaggtttttctttatgggagacttttaattatgaattttatcttgttacttgtcattgctctgttcaggttttggatttcttaatagttcaatattggtaggttctatgtgtctaggaatgtatacattgcctctagatttaccagtttattgacatatagttgctcatggtagccactaatgatcttttgaattttggcaatatcagttttaatgttttcttttcatctctgattttatttatttgggtcttctctcttttgctcttagtctggataaaggtttgttaattgcatttatcttttcaaaaacatctttaatttcatttatcttttgcattgttttctttgtttcaatttcatttatttgtgcttgtatctttattattacttttcttttactaattttgggtttggtctgctcttgctattctagttcttgaaggtgtatcattaaataatttgaagtttttctctttttttgaggtaggcacttatagctataaatttcccacttagtactgctttcactgtatcccataggttttggtatgttgtgtttccattatcatttctttcaaaaaaattttcggtttccttctaaatgtcttcattcatacactgatcattcagaagcacattgtttaatttccatgtgttgtaatgtttcaaaattcgtcctttgatttctagtttgttttcattgtaatcagagaagatgaatactattatttcaattttttaaatgttttaaggcttgttttgtgacctaacatatggtctttgagaattatctgtgcgctgaggaaaataatgtgtatttttggccactggatgaaatgttttgtaaatatctattaggtccatttgtcctaaagtgcaggttaagtctgatgtctctttgttgattttctttctgggagatctgtccaatgttgacagtggagtgttgaagtctccagctattattgtactgaggtctatctctttatttagctctgatgaatatttgctttacatatctgggtgctcaagcattggctgcatatatattcacaattgtcatatcctcttgctgtacggacccctttatcattatataattaccttccttgtttctccttacagtttttgtcttgaagtctattttgtctgatattagtatagctactactgctctttttttggtttccattagcatggaatatctttttctatttttattctatgtgtttctttagaaaggaagtgtgtttcttatagggaacagataaatgagtcttgctttttatgcattcagccattctatgtcttttcattggaaagcttagttcatttatctttgatgttattactgatgagcaagatcttactcctgctattttgttatttgtttttgggttgttttgtgttcttctcttctttctttccttcatttctgccttccttgtagtgaaagtgattttctctggtggtatgatttaatttctaatttgtgtgtttatgtatctgttgtatgttttttgatgtgaagttaccatgaggcttgcaagtactatcttataacccattcgtatgataatttatcactgattacataaacaaactaataaggaaaaagaaaactatttagaaagaataagacctactattgatagcccagcaaggtgaatatagtcaagaataacttcattgcacattttaaaatgattaaaagagtgtaacgggattgtaacacaaaggataaatgtttgagagaatctgatggcagtggtggcctggctggagcagctactgccataacgccaactgcaataggggaggtacagctggggctgtgtactccatggagccagtgggagctgggaacaggcagaagacccaactccttccgagttggcagagtaggagcctcatgctccctgggtgcagctgcagccacccagcaatggttcaacacctgggcatccctgtgctcttgggggcagggagcaggcagaagcctcacctcccaggatgcagctgcagccacccaggggtggttatgggcccaggtatctctgcactgttgggtgtccaggaagcccctctgcccttgcaggctccgaagtgcctgctcccgctccctggtctctccccactcctggcacccactttgatttcagaggaaaattgaggccaagcccaggtgctgtcacaacccaactgggtgtgcacatgctcagggcagcactgacatgccagcccctgctgactcagccccctctggactttggctgctgaccagcacagaaaggatgccgaggtggggctgagggcagctcggcaagagcctgcaggcaccgcttggcatgaacagcctgtgtgccgtgggcaccatcgatagacagcaggttgatggcagcaggaggcagataagctcctgggcagaaaggagcaggtccctagtgaagccctaccatcaggcctgggacagcctgaagcctggggaccaggctaccagttccatggacaagagtgaaaacacatggtgctttttcccaccccacccatcactgcctgtggaccaatcagcatgcacttcctccactctttagcccataaaaaccccagacttcgccggacttgggcagatgtcaggatgacctgcctgtggagaggagctccccactgtgggtctcctctttgcttagagctgaacactcaggacactctgcctgcagagaggagcttcccaaggtgagtctcttctctgctgggagctgaacagatgccaggacaacctacctgcggacaggagctacccactgtgggtccaatctctgctgaaagctgaacacttgacacgacaccttgtctgtggaggggagctacccactgtgggtttcctccctgctgagagctggacactcatcaggatgacctgcctgcagagaggagctacccactgcaggtctcctctgagctgttctgtcactcagtaaagcacctcttcaccttgatcatcctccgcttgtctgtgtacctagacaggggacaagaactcaggacccaccaaattgtggagctgaaagagctgtaacacaaacagggctgaaacacatcctttgcctgccatgttgtggacaatgagaagaagagaagagagaaggagagaagagctccagccctttggggagcctggatgtagacgcttccggagccagggctgccaaaccctctttgaggctctatggtttctggcatctccaagcttccaagtgccaccatgttccccggtgcccaccgtgaaagccacttgtggtacacctggttcaaccacaggctcgcaggaagccagcacgcacgctgacacctggagctgccctccccaccacagctggtgtgcctagctttgcgcagtgcctggaccccatgctcacttgctcacacaccccttgccattctgtgcctggctcaacctggctcaagtgcagcctgccaggccagatgggcagaacaaacccagtgggcccaagcaaaacttgggcaaaggtaccactagtcaaagaggtttccagctggaaaaacgataccccaagtatctcgtgacagatggataccctattctccaagatgtgactattattcattgtatgcctgtatcaaaacatctcttgaattccataaatatatacactactatgtaccaacaaaaattaaaaataaatttaaaaactaataaaaaatggatcattttaactttgtctccctgctttttatctttttgctgtttctgtttatgtcttactgtattgtctatgtcttgaaaagttgcagctattattttttattagttcattgtttcatctttctacttaagatattagtagtttgcatgccacagttgcagtgttataatattctgtgtttttctgtgtgcttactattaccagtgagttttgtacttttggaagatttcttactgctcattaacatccgtttccttcaggttgaagaactccctttagcatttcttgtaagacagatctggtgttaatgaaatccctcagcttttgtttgtctgggaaggtctttatttctccttcatgcttgaaagatatttttgcggataaactattctagggtaatttttttccccctgcagcactttaaatatgtcatgccactctctcccggcctataaggttcccattgaaaagtatgttaccagacatattggagctcctttgtatgttatttgtgtcttttcttttgttgtttttatgattttttattttttattatattttatttatttatttatttatttagagacagagtttagctcttgttgcccaggctggagtgcaatggtgcaatttcggctcactgcaacctctgcctcctgggttcaagcgattctcctacctcagcctcctgagtagctgggattacaggatgcatcaccacacctggctaattttttctatttttagtagagacggggtttctccatgttggtcaggctggtctagcactcctgacctcaggtgatccgcctgcctcagcctcctaaagtgctgggattacaggcgtgagccaccatgcccggcctatgattttttatttatccttgacttttggtagtttaatttttaaatgtcttgaggtagtcttctttgggttaaatctgcttggtattctgtaaccttctaggacttgaatgtttatatctttctctagatttgggaagttctctgttactatctctttgaatacactttctaccccaaactctctatcttcctccaatttaaggctaataatacttagatttacccttatgagggtatttctacatcttaggcatgcttcattcttttttgtatgtttgtttcctctgactgtgaattttcaaatagcctgtcttcaagctcacgatttctttcttctttttgatcaattctgctgttgagatgctgtgatgcattctttagtatgtcagttgaatttttcagctccagaatttctgcttgcttctttttaattattcagtctctgttaagtttgtctaataggattgtgaattccttctccgtattttcttgaattagattgagcttcctcaaagaagctattttggattgtctgaaaggttacatatttttgtcactctgggtttagtcactggtgttttgttcaagtcatgttttcctggaggttttgatgtttatggatgtttgtcattgtctgggcattgaagagctcgggatttcttgtattcttcacaattttatgcttgtttgtacctgtctttcttgggaagtctttccaagtattcaaagagacttgggccccaatctcagtaatgctgtgcttcctggagactcacagaggtaccactatggtggtcttggataaaattcagaagaattctctggattaccaggcagatactcttgctctcttgctctcttcattttctcccaaacagagtctctctctttgcgctgagccacctggagctgggggtagggtaacacaagcaccactatagccatgacgactggaactgccctgggtcagatctgaagagaatagagcactgtaccttgtccaagaccactgtaaccactgcttggctaccacctgtgttcatatgaggtcctaaggctctagaatcagcagatggcaaagccattcaggtttgtgttcttcccttcagtgtgacaagttgctctaggctcaagaagtttcagtgatgctatctgaaagccagggactgaagtaaaaaaaaccatcaaaattttcctggtattctattctactgtcactaagctggccctcaaacaacacaaagtccttccccctctttcctctcttttccacaggcaaaggaggctctctccatgatcatcaccaccaccactggcccatggggcattctggcaggccactgccaacattttcttagactcaggggctcttcagtcagcttgtggaggatgctgtcagatctgagactcacccttcaggacagaaggctctcctctggcccagggaatgtccagaaatgctgtccaagagccttggcctggactcaggaaccccaatagcctgcttggtgttctatcctactgtagccaagctggtccctgaggccagcacatctcagtccaacctaaggcccaaagcatactacctggctattactgttggttattcagggcccaagggcactttagccatcaggtgacatatactgccaggactacatccttcccttcaaggcaggtgggttcccttctggcccagaatgtgtctagaaatgttgtctgggagctcgggcctggtatgggggctagctgcctgtcaccccatcctagtgtgcctaagctggtatccaagatgcaagacaacgtcctctttactcttctcctcttctcaagcagaggaaaggagtcactttcattgctagaagctgcactgcctggaggcgaggatggcacaagtactccctgagccatcccatctggtgtctcactaggtcacacattgccccagtccactggctctaggcccacaacggcctcaaggcttgcctaagaattacagtccttgtgtcccagactgcctttcaagttcatttatgatcccagagcactttatctcatggtggcgagccttgctaagaaattcaaattctaaatgctgggaagggctcttcctctcttgctgttctggtccagatgctttctctgtgggactgggcagcactgagttcaatgcaaatccctccagctgctgtgctcttcctcccccaagtgcacagattctctcttggcaccatgcagctgctgccggaggttggaagaggggtggaagaggggtgtctttcccagcctcttcagtgcctctttcagtaatataaaattaaaaccaggtattgtgattgctcacctgattttttattcttatgaaggtgcatttttgtatgtagacagctgttaaaatttggtgttcctcttacgaggacaatcagtggaggcttcttttctgctgtctttctccacactcaaggctttatttgtaatcctctatcaatttcttacgtctagaggaaagataattttgagactctcttcttcttcataatttttttttaaacttctcaattttacttgtcaaacggcactgtaaagtgttaaatccaaaggcgtccaggaaatattcaagaggtagttatttcctgagtagccttctctgttctattcccaccctcctgctttctaactttggtctctaagtgttttcatttgtttttctattttaaagcagtaacagtaataaataatgtcctggaaccagtgtctagctgaatattaataataatactttccatttgcatatgctttatgagaagctctttctcacatcttgtctgattctcaaaatacctctatagaataaatggggcatcaataaaagagccaagtaataccaaaccatctagtctgatggggtgaatgcattatggatatcaaaggatcaggttttaccctaagttgagtggagactaaaattttaaaaatctgtatgtacaaaattgaacaagagagtaagacccaatacacagcaacataaaagagctagagaaattttagaagagaacacagctgactcaggcattgctctccctttctctccattctttacatatatttcctataaatataaatttataggtgtttgtatatcattttagttttaaaatacacagcatgcatgtaaaaataattttaaagatagtgtttcaaaatgcagcatacagagcctctgaaatttttaattagctggttgtacagtttaacattttctagctggaaattgcatggtataattaagaggatttaaagcataatttaacaaaatattactctatacttgacattttttaaaatgacaaattaaaatagaaatcatgcccttgttttgcagataaggatgctgaagctaaaaacaatgtccaaggccaaataactgacaagaagaaggccaaggcatctagaaaccatgtcttctgattcacagttgatcatatttttctatcacctttgataaggcataaaatattattttgatgagtaaataaaaagactttggacacctgctgtttgtctaatttatggtttccttctcttttctctagttgatatgactatattaagccaagaaaaaagttagatttgacaaacggattttaacaattttatgcacagaatattttttaaagttatttttacgagtctacagttttacaagtttaatgacatgttcagagggactagaaaatttacaaataacatgatttataaaatccatgatttcccaggaatatttttgccaccacatgggggtgtagtgttcttaatatgtactttgcaggaattctgagcatctcagctgagcaagcctggggagcagcagggagaactggattttatgtgcaagtttgtcttatctgcaccaagcatgaggccaggaataggagtcgatcttaattcatcctccaagtgtctcaaatataaaattggctttgtgatattaatttgtttaaattgttcaatctcaggaaaaacttcacagtatgtatgagttacccacatacagcagcaatttcaacaaaagcagccatattagtatgtgccatgctatattctccagtccaagaaggttattagaaaattgtttaattgaggccaggcgccatgactcacgcctgtattcctagcactttgaggccgaggcgggcggatcacgaggtcaggagatcaagaccatcctggctaacactgtgaaaccccgtctctactaaaaaaatacgaaaaactagccgggtgtggtggcgggcgcctgtagtcccagctacgcaggaggctgaggcaggagaatggcgtgaagggcgcttgcagtgagcggagatgcaccactgcactccaccctgggagacagagtgagactccgtctaaaaaataattgcttaattgagaaaaagttgcttttgtcgctggaattactgtgagataattgaccgtgatgggagctgtgtcccccagatgaaagcaaatcatgggagccagggtcaatcatattaatgtctgcagtgaaaagaggtgttgtgatcatcataagacataaccataaaatacttaaagtcttaaatggccaaagcctttaaactacattataatgattacagatccaataaagtttaattaaaacaaaactactacattgaacatccataatgattagaaaggtttctaattggggacaaatttggtattgagaacacatcaaaagaatttcccacgttctttgttacatctgtttgtgctggttttctgcttctgcatctgtacagggcacatttctaaaaaactgaccagtttaaaaattactttttaagtttataatgctcattttaggtaagtcattaactctttccataatttaggtgatcatttaatgttttagggattgggaagcacagcttacttttagttaaaaaaaaaaagcaaaaaaaaaaaagcatgagctttggaatcaggcagcctggggattctaggctagaattctaggtttctcatgtactaattgtgcaatttaactgcataatctctctgtgtccatagggtcctcaaagaaaataataggaaattatggataggaaataggaataataggaaagatggaattccaaagataatgtaataaagggaggtatgataggttaggggaattaacaaggaataatgaagcactccggaacccagcagcagcagcagcagcagcagcagcagcaagaaacctttactatccctaaggattagggcaagagagaagaaatagggagttacagtctgatgagaagaggagccttggaagaagtgttgactgacaggagctacggttatggagtgaccaaccccagtcactactatggcagaaaataaataccctggtatttttcttctcttctcttctgatctcttgcaggaatcaccctttggccaaacccaattagacaaccagaaacaagtcagcaaaaaaaaaaaaaaaaactctgggtggtgcagtcaatagtggtaagccctctaggcactgaaaaaaggccagagatgagcagaggaattgttctgtgttaggggggatgaaagtagaaaaaagcaatttacgctctttgtttctttttcctcatcttttcttttctttctttcttttatgaggcagagcctagctgtgtcaccaggctggagtacagaggcgcgatctcggctcactgcaacctccacctcccgggttcaagcgattctcctccctcagccacctaagtagctgggacaacaggcacgtaccaccacacctggctaattttttgtatttttggtagagacgggtttcacagtgttagccaggattgcctcaatctcctgaccctcgtgatctgcccgcctcggcctcccaaagttctgtgtttactggcataagccacagcgcccggccctttttccttgtttctaagtggagatatgaatcaactcttgtccaacaaaattgtaaagataaaatgaaatatacataaagaatataatgcagtgtagaatatattgtagatgctcaataaatagctagtgctgatcttatttttaacagtaaccaataattgtgaagttgaatgtatattctctattaaaacccaacaaccatccaatcaatttatcacttagggagctattctgtgtcttctttaatgaaagctgttttgttttcttctttacaaaaataggagactatgaatagagagattaaacactagaaaaattaattctctaatactgtcaattatatgtttacttggactttgatatgagggccctgaaaacgcagtaagttatatatttctgataagcacaatcctccacaaagagcacatgggcaggcagtgatttagactcagggttctaacattttacaccttacactacatgactaccctatgaaatatctgaaatgaaactatgattccaatagaaagcaaaagcttgcctttttgaggatataaatgtgcctttaggttttacatttaaagttacgagtaatcatcaaaagcattgatgtttgacaaatgactatgttgcacaggtctgcctcgactagcccataaaggagtccttactacctcaagcattctctgccacatcttaagtttttattgtccttaaggcatgtttctctatctgaaatgttgctttctgacttcttcatgagaacagagacctaggctatcctgttctgctttatgtctagtatttcctagaacagagcctgatagataactaaatgatcacacaggtacagaaaagcatgcatataaaagtggtagatgtgagaattaaatgacatgatatactcaaactacttttaaaaatgcattttactatggtagcaattattattgttgtttgcattattattgctactattaagaatgatggatacagtggttcacacacagtaaatattttggtgatgacaaatattattatttttcaaattgactagtctttgccatacatgcctgcacttaggacaagactggcagcctttgcattcagactgtgactactgccaactttatgtttacagtgactttgccagccagaatttgtagcttggaatgatatctctcaaatattagaggcaataatgtctcagattccagaacaaaatgccaagtgctaaatgccaagtgctaaacaaatcagaaaaggcaaaaggaaaacccacgtacttccacttccaagaacatgaagtagaagagattttctcaattcttcctactatgtacaaataaaacccctgggcattatatataaaacaagcatgagaatactctaaaagttggaaggaagcagttaaaacaactagtgaccctgggacccaaggaacaacatagcagtaacttctctaggttttcttttgcttcaaatattccagggttgaagctgaacaagcccaaaactcagaaacatcaacagaggcacacaagaacagccctaactaaagcctgtcttctttagccaaaggtccaggaaaaggcagaaagaacatttttacattataactgtcctcctccagaaaaacactgcacaacaatctgtgaccctaaccccacccaaaaagaccaaatgagagcctggagttgtacccttgtcagcctgtaaggaggttccccatcccccttgctcagacagtatcagaaggagcctagtagggagctgaaactttcatagacactaggcagtagtaaagccatccctccaacattgtaaccgtggagaaaaattagggagcttagatctccactcccacctgatggcaacaatatccatccctttcctggctagggtggtatcagaagaggccttctggagagtcagaactttcatacctgcccaagagtaaaagtattgcaccttcccacctttgcccctcattgtgtcagtagaggccacatgcacagtagcagtaaaagtgtattactaccccttccagccacagagctaacaatggaggcttagtgggaaacgggaactcccacttccactcagcagtattgaggagccatgcccccttgagtgtcaacagagacagcatgggaaactgggaattttatccccatttgacagtgataaggcagtatccactcctccctttctcctgccccaaaatgtacagaattacatagaaaatcagtcatattaccaagaaccaaaaagacctaaagtagagaaaaaaaaatagagaatcaataaatgctgatatcgtttagatctgcgtctccacccaaatctcatgttcaactgtaatctccagtgttgaaggaggggcctggtgggaggtgagtggatcatgggagtggtttcttatgaatgacttagcaccatctctttggtgctgttctcatgataaattcctcaagagatcgggttggttgttttaaagtgtgtagcctccccccatctctgtcttcctcctgctccagcaatatgaattaactggctcctcctttgcctgtcacagtgattgtaattactggctccaactttgcctttcatcatgattgaggcctcctcagaagccaagcagatgctagcatcatgcttcatatacagcctgcagaaccatgagacattcaaacatttttttttaaataaattaccaagtctcaggtatttctttacagcagtgtgagaatgaactaatacaaatgccaataccaaggtgaaagttaatgtcataaaaatgcttcaaagagcaattttgaacatacttgaaacaaatggaaacatagaaagtctctgcaaagaaagaaagtttcaataaaaataaaaggtatgcaaaaaccaaactggaattttagaaatgaaaaacacgataaatgaaataccatacaaaactccatggatgggttctgtaaatgaataaaagagacaaaagaaacaatcagtgaactggaagataaagcaatatgaattaaaacaatatattgacctaaaaaatcacaagagcctcagggatctgtagcattatttaaaaaatctagtatttgtgtcatcagggttccagaatgaaaggagaaagagtggagaatgaaaaaagcactcaaagaaaacatggctgaaaatgctttgaaataaccaaacaaatcataacaaacagattcaagaagctgagcaaaacccaaataggataaatggaaagaaatctgtgcaggcaatgatacattatagtcaattttatgaaaactaaagataaaaaattcatgaaagcagcaagagagaaatgacattttacctatagggaaaaatcactttgaatgacagcagatttctcatcagaaaacattttagaggttatatggaagtgatacaatattttcgactgctgaaagaaaagaactgtcaaccaagaatactatactcagtgaaaatattcttcaggaattaaaaggaatttaagacattctcagataaaggaaaactaagagaatttgtcaccagaggacctatgataaaatggcttctagagaaagatttctaaacagcaagaaaataaggaaagaagaatgcttcgaacatcaaaaaataatgataagaaaaagccatagtaaaccttctgggcaaatacagtagattttccttcttctcttggatttcctacattatatttgatggtagaaacttaaatagcaacagtctaatgtagatgaaatattttttaaaaaatatatagggaagactaagggaatataaatgaaaataaggtttctatgcttcactcaaactggtagaaagacaacacagtacactgtcatatataatgtgatattaatacttagcccaacacctaagaggaggaattaaacaaaaaggtggacccaaacatactctaggaaaataaaacgggattgcaaaaattgttcaagtaacccactggaaggcaaaataaaaaagcagagaaataaaaaacagagagaacaaatagaaaattagaaataaaacagaaggccaggtgtggtggctcacatctgtaatcccagcactttgggagaccaaggcaggcagatcacctgaggtcaggactttgagaccagcctggctaacgtggtgaaacctcgtctctaccaaaaatacaaaaattagtcaggcatggtggtgggtgcctgtaatcccagctactcaggagactgaggcaggagaatcgcttgaacccgggaggcagatgttgcagtgagccgagattgtgccattgcactccagcctgggcgacaagagtgaaactccatctcaaaaaaacaaaaaacaaaaaagcaaaaaaagaataaaacaaaagatttaagccttaacatattaataattaccttaaatgtaaatgatctaactttatcaattcacagtcacggattatcagaatgggttaaaaaaaataagccaactctatgctgcctagaagaaattcactttcaaatgtaatcgaggcaggttgaaagtgaaaaataggaaaggtgtatcaggtaaatatcaatatttttaaagtagaattatctattgtaataccagataaagtatacttcagagcaaagaaagttaccagatcagaaagagacattatttaaaaataatagaatcaatccacaaagaagacagcagtcctttacatgtatgtacaaataagagttgtaaaatatatgaagcaaaagcaatagaactaaaaggacaaatagacaaacacataattataattggagacttcaacactcctttattgacaattcacaaaatacctacgccaaaaatcagaatgcatatagaataataacaccatcagccatcagaatccaattgacatttatagaattctccataaaaaactagaagaatacatattttttctcaagtgcccatagaacatttacaatgcattgtatccagagccacaatgcaaatctcaataaatttaaaataacttaaatcatagagagtgtgttatctgaccagaaaaaagcaaaattaaagataacacaaagaaaaatctccaagtgcttggaaactaaaaaccatactactaaataatacatgtgtcaagagaaagtctcaaggcaaattaaaaaatacacatttcagtgactgaaaatcagaatacaatatatcaacatttatgggacacagttaaagtcaccctaaagtgaaattgaaggcattaaatgtatatattcgaaaagataaaagtctcaaataattagtctaagctcccacctaggaaatagtaaaataaaaccaacgcgaacagaaggaaagaaataacaaagagcagaaacaaatgtaatttaaatcagataatcaagagataaaatcaatgaaacaaagaatttgttgtttaataagatcaataaaattaacaaacctctagcaagactgataaagaaaagaaatagtataaattacaaatatcagaaatgaaataattactaaagaccctggagacatccagaggacaagaagtgagtactacaaacagttctatacacataaatttgacaacttagataaaatgtaccaattacccaaaaaacacaaactaccacaagcaacccaatatgtgatagataatataaatagctccattacctttaaaagacttgactttattattttaaaaattcccaaacaaaaaaagaaatctttaggctcagatgattttactggagaactctacaaacatttaaaaataattaagatcaatttgatacaatcttttacagaaaacagaagaggagagaacacattcctattcctttctaatattattaaaatacttcagacaaaagacaaaagaagaaaactacaggtcaatatccctcatgaatatggacccacaaatcccttaaaattagcaaataaatttcgacaatatataaaatagtggataccatgatcaagtggaggtcatccaagcatgcaagactgcttcagtatttgaaaatcaatccgtgtactcaacaatataaacaggctaaagaagagcaaccacatattcatttcaatctatgcagaaaatacagttaataaatttcaacacacattgataaaaagtcttaaaaactgggaatagaaggaaactttctcaactcaataaagtgcatctataaaaaatctgtacctaacattagatttaagggtgtaagatgaattattttgtactatgattaggagcaagacaaggatatctttcccaccactcttatttaccataatgctttaaattcttgccataaagaaaaaaaaaataaaagtcataagaaagaaagaaataagactgttcctatttgcatatgacatgatcatctacaaaaaaagaaaagaaatcctaatgaacctacaaagaaaaaaatcttctagaaccaataaataagttcagtagggtaacactataaaagcatacataatcagttgtgtttctacatattatcaatcaacatgtggacacccaaattaaaaatataataccttttacaattgctcaaaaatacttattctaaataaatactgtatatcaaaaactataaaataatgataaaataaaccaaacaattttattctgaagtgtatatgaaaatacaaaagaactagaacacttaaaacaatttaagaatgaagtgagagaaatcattccacctgatttcaacacttacagagctacagtaattaaaactatgtggggtccaaggcaaaatggacacatagatcagtggaacagaaaagacatgcccaattggcttttgacaagggtataaaagtcactgaaagagaaataatcttttcaacaaataatgctggagcaataaacaccaataagcaaaaatagaaataaaataaaatctcaacctaaatcttatgatataaaatttaacttaaaatggatcattgatttcataaaaagaaaaaactgataaactggatttaatcaaaattgaaaacactgcactggaaaaatcatattaagaagatggaaatacaaactacagcataggagaaaatatttgtaaagcacatatccaaaaaagatttggtgttgagaatatataaagaactgtcaaaactcaacaaagtaaaataatccaattggaaattaggtgaagataggaagagatatttcaccagaggaaatacagattgcaacataagcatgtgaaaagatgttcaatatcttctacctgatttcaagacacataacagccacagtaattagacactaaggacatgcaaattaaaatcacagtgagacatcactacatacaaaatggttaaagtaaaaacatatgacagcaattgctatttaggacatggagaaactggatcgctcacattcctggtgggaatataaaatggtacaaccactcttgaaaacagtgtggaggtttctttgaaaacaaaacatgcaactattaacaaataacctagtagttaacctagagaaataaaaacttatgttcaaatagttttattcacaatagccaaaagcctgaaataactcagacaacctcagagagaataattaaacaagctgcagtgtgtcagtaccatggaatactgttcagcaataaaaagtaacagactactgatacacatatcttaaatgaaattccaaaatattatgctgagttaaaaaaaatctcaaatgtatgatgatttcatttgtataacattatttaaagtgacgatattatagaaatggagaacagatcagtggttcccagagattaagaagagactaaaagtagagaagggggtgtggcaatgaaaggacaacatgtggggtccttgtgataaagaaagttatcttcatcttgactgtgtaaatattttgattgtaatattgtgctgtagacattaccattgggggaaacagggttaagggtataggggatctaacgctctgtattatttctgacaactgcatgtgaatgtataggtatctcaaaataaacttaatttactaaagtgatgacttaaataaaatttccttccctgtcattccccaacttccacctcacctcctgtacttcttgtagctgattcaaccaccagctggtatataaggtatgcatgtgtgcatatgcatgagtatgtttctgtgacagagtgaaaaagaggggagcaagaggatggctcttccaatgctagccctgctgtgcacacacagtaggggagtaggagaaagtgcaataaggacctcaagtgagtttaggtgcattctgccttcattatagtaacataaacctttggatatgagagtgccaaggagggaaagcagtgtcattttattcagtcagtcttacttttttttgttttgtacatggaaaataacattaggatgaggatactaacaacaaagacaattaggccattcccctagtctcatcatcttataagggagatgtaggctattttaaaaaagagaaaataggagatcctgaataacatttctcccccacatgattatatgtagctatatgactgataggcttaccattcattcacttatttatatatccatttatttatttaaaaaatatgtactgcatgcctactctgtgatagaaactatgctaggccatagatattcaaatgtgaaaaagacacatattctttctataaagtagctcagaatctattagagaggcagattcttcaaaactgtcaattttagaacaatgtagaattgttctgctttattcaggagctatgaacagagtatcacaggaagatacagtgagtggggaacctaacccagccaggcacaagggtgtcgtggaatgctcccagagaacatggccccagaactgagcttatttataattccacagttattctctgtctaccatgtgtaagtcattattctaggttaagatatagataaaagcgtttcagacactgaagatagaaacagcatgatccagacaaatatgatccagcattatccagcagcacctcaaatatttattaaattaagttgaattaaatttgtggaaaactaatagaaatgtacttaaatctttctcatgttgagaagaagaggcttaagactttgaactccagataaataaaatgttactgtaaaatactggaataattgaactttataaactcacaaacatacttgcacctttataggcacatactgtgtggattgatgcctggtcagagatgagtcaacaactaacttacaatgtaaaagcacagaatagtatctgatacttttgtgtgcacaataaaatttttttaaagcctcagattgcttagcctcctatgcacagattgcactgttcactaaaatgctcaaattagttatgcaaatcctgtgtcatgtgatgcctctccaccatatgtgactagttaccatagcagtcagcttaagtgcatattttccatagcaacgtaggaatctttaccatacagagacctaagtgagacagaaatgaaagcaattccacagcaatatgaaatataaatgttggcaacatcccctgaatgcttctttaaaacaacattgacttttaaatgtcacagcctctgggtggttctcttttagcctatatcagcacctctctcctgttggaaatgtgaaactctttgagaacacacaacatttatgattgggttaagaagactgagcagtggtatctgcaatctgcaaattgaagttccatatggtggtgtgatgtgatgcaattgtcgttttcattggctcactgtgtggccacaattcctgcctcatactacaaggctggaaccaaacggagctgaaattttcccttgtcttgttggtcttttgagagcggttatccacccagttacatcaatctcattcttgatgtttaataggaaggctgtttatccttaaaaaggcttctagatccactggcatatataagagtgaatatatagatgagaaacaggattccagaaactccattcatttattgtaggtttaatctttttacaaaattaaatacatacacacacacacacacatacacacacacacaaatgtaggcctgaggagtggtcctggtgttgagctaaatttacctgtgggtaacactatgagaggttgccattgagcactaatgtgccaggcactatcctagccttctagatccattataatgaaccttcatagcaaccccttgagaaatggcagcaactctgaacttcccggaggagataactgaggtacagagaagatgattaacaccctcccaaccacaaagatacctgattagaaaataatagcactaacattgaaagtcatgtttttctactctaagacccaaactcattccactattctttgcaatgtataggaaaataaaaaagagaaaagagctaagactgagaagaaaaaggctggtgtgggactcaaagatatgtccagattgatggggaatcgctgacagagaatgcaggtggaataacagatattgagacaaccccaggcaggtctcagaatgacatagaatgggtcttttggggatgttgtcctcattaagcactggctccatccatggttctcctggattctttacacattacgtatttaaacgatgtgaagacacatagcttctctaatggtgattacaaacctaatagaacactttttctattactcagcttctcagtaccccagtgttaatttcccccctccctctacacctctcactggaaagagactaacttttcttgctcttctatcatttggaaataggatggtgctcatttcagagccagaagctgtaacagaaaggaaaagaaaatacatttttcttgtttctacactatattcctgcagagtaaccccttaggagaaatagtctatttgattcctaaaacattattatgaaaaagtaacctcttaaaattacactgctgtggctttagcgaaatgcgcttgtagattttttacatttgtttctcattttccaagactcccctcaaagaaagtttgcagtggattgctgagctgtgatcattcatgtgaattagttagagactgtgccaaggagtctctgagcctacacccagcacgttgagcagtggatgagcatactagtgtaactggtatgcaatggagaaagtcgctatcgggacctcaaatctttccttttaaaagtaaactggttatgaactagacagtaatctaggctttttctgctctagatcactggatttcagacacccatagctaccagagtgatcaatccaaaacagaaatctcaccatgtctctccaatacgcaagcccatagggcatggctccccactgcctttctaacatgagagtctaggccttccctgacccagccctttttgccttccagcccccactgttaccactccctccctccacagccttcatactctgaaacaccttaaattacgtgcagttctctccatgcatcatgcttctcatctctgaatagatgtttatgtttgttcatgtttgttcctctgcttagaaggatctacttccccacttcacccccacctcctgcatttgtctagccaacttcactcattcattagggtcaccctgagttaaatatgccttctctgtgctttgctatactcttacattgctattcattacactcacactgtcgtattataataataacaatatggaaagaggttatttgctcaggaaaatctctcatagtaaaaggtctgctttattttttgaagacatgctttgatgagcctatttaacatatagatgctttgcctgatggggctgctttctgggagacatgtagagaaggggagtatatgctgaaagagaagtaagagaaggctttggaagaggaagaggagcattagggaaccagcaccagaggcaaaggtggagagcaagacagtaggaaagtctcatgatctcaaatttgacctcctcctcactgtgactatttagttcacaaagtcactcaactctcaaactgtttgtaggaaatacaatttaaggaataaactaagaaagaggctttgctttatatctgcactcactaggagagaggaaaacagccatatggatacagaaaacactagaggaataaaggaatagaaagtaacttagagaaactagaagaaattgtgaggagagtttttgactgtcccaggacatggaatcctggtttagtcaaaatttgatgacatctccaaggggcagaaggtgtcagtaatatctggcttacataattacatgaaacgtttctgcttccatcaccaacctggggaatctttacctgctgcatcaccgaagctatcctagcacctggtatattgtagatgttccataagcagtaggtaaatcaatattattcatatgctatatgaatcgctagtttaaagtaaatttaaaagaatgacatcttgagaattgtttcctggatcctagagacagctagagatatccttcattaagaagaaaattacttgaaaattaagagtctaaggaaaactaaattaagaaggtcaatttgccgaaaaatgcatttaatgattttcaaagccatatataaatgaatcttggattatctgccccagtgctcacatctattaactgggaggaatgcataaaatgggttatgatgagagggtctggagctgttaaacatagtgtgccacctcatagtggggtctcaagccatttccttctctcatcttgagcctaaagtgcatccattgcatttttcatgtatcaggctccaatgtagcaattgcccaatagggatgacgctgatattggctgttactctttcagtttgctgcaaacaactttcatttgtcctgccaggatgcctgtgtttgggggtaaggacaaatgagtggaagtaacacatctcaacagttatactgtctcaaaagctctgcatcatagagtggcaccagggggttgctggctcattttagattacaaatgcaacacctttttgagttgctccatacgttttctgccacctgaagcaaaaggaacttgattcaatagtaggatgagtttgatttattaaagttgtagacagagtaggggctgcctccagaggagcagagaaaagaaacaactggtaccattttattattcctgtctccattcatctgaaaactaaactggccactggaaaaccttggagtacaatttgttaaataccttcatctcagatcaaatagagccaagaatcttggtaacatacacagagactgttttatcttaaggccgtttgaaatctaatgaattttcttcttcttttccacatggtctcggtgttctaattttcaaagtggtctaacattttttgattcatagaatggttaataacaaaaatggcagctactatttttgagcatttactgggtgcaagaatctgtactatgtaccttatatacagaatctctaattcatataacagccctgcaagaaagctgttattaccctcacttcactaagaaggaaacagagttcagtgaagtgaggtatcttgctcaagatcacattgctagtaaataatgatgctggaactaaaataaagatctaactcatatccccaaccattacagtcaaattgcctcagaaataataatatacatgaaatctctgtgtaaactgtaaaccaaaagcaaaactatgtataatgaaatgagaattattttggacttcaatagcttatatacaacatttactgccattctgttaccatatggtctttgccaagtcatctaaccttcctgagagtcagtttctgcatctgtaaaataggtatcccattacccattttattacctacttcctattacattatactacagaagaactagtcctaagagcacattagataatggatgtgaaagtaatttgtaaactgtaaagcaccatgcaaacatgagtttcgcttaatgaagtatggaatcataaattaggcactcagagcaatcttttaaaagaggacaagcactctctctgattggtgcctaatttgatgcttacattgtgcaggaaccatttcagttgaactgtttgagtggctcaaagcaagttactttttctaggcagcttccatttcaatataagtgccagtaaaagatcatgcaaagcaaaagggccctcctgaaggtgatgcggagtcaaagctgtctgtacaccaaggacctacctaggtcctgaaaaaagcagcccctttaggcttagagtaaggactcatattatgttgttgtttttcaatccaggaagagctctagatgtgcccagcatgaaagaaaacaagtgatacacattcttaagcttacatctcagatttagggggttgttttagagagaacatctataaaactctcttggattctagccagtagattctgaatactagttgacaaagaagattactccagccacctgcagcttatgagtctgggagagaatgatcatattattctacttttaggttaatgcatattatgtattctctacagtaatttgctagtgaaggtataacaatggtttcaactagtaatgggtgaagacgattactttggcaggaagatgtcctcaccttgaatgtcatcaaaaaatcatctcctgcttagatgggaggaatttcccttcaacaagacatttctgaaaccagagggaaagagaaagggttgggtgctaatacaagtaaatctgtgatcacataattcagtggacaataggaagaggtcttcttctgagaatattttcttctctaaaataatcataacaattatatattaatattactaataacagattcctagtgctcccctcaatcctgagtactagcatatgccaaacagatgatgaatatatgaaaaaataaatacatcttcctaacaatcttaactgatgcctcacaactcttgagctctgaaatatttctatactatttcataatacttctctatcagaggagaatgacttcaaggcacactgcagaattcaaacacttccacgtagaggacaatgactggcaggcattctgcccttaggaaattctgtctctatttattactcatccaagaaatattctattcttcctatgcctagcacagtgccgagcacttacatagtcagtaaatgtatgtttcgaaatggaagtgccctgcataaagctataggaaacttttttggtttagattttttaagaaataaaaaccctcaatagagttctttctctcttcttcccataactttcccatttattatttataagccttaggcttgttatattaataaatttatatttattttccattaacatctccaataaatatttcttacattaaatatattatataaatatacttaacaagccagaagttcagagacatttaccatgaagctaaagaaggtctcttacttgcatgaaccccttacaaagccctgtatctaattttgtaattacaatttgtgctctttttcttaaagttttctatgccaagttatagaaagctcaggcacacaaaaattaggtctatctctagagaaacttcactgtgtattttaatcctataaggtacatatgttatagacacagggcttgagaattacagaggtatatgacttgcccaaatactcatcttgagtggcagactaatgaatcaagctaagatcttcagcctctaaattcagaactttttgattgagccacaatgccttcttctcggatatggatgagactgtcatgttcataatttccaggcagtccattatcatcattgctgagatcagccatctgtttcacaggtgggcagaagctaatacatttaatgagagcccacgactcaccaggcactccaccagggcctttttacacatacatacactggcccacactccctcactcacaaatacacacacacacacacacacacacacacacaatttcgtttgatgcttacaacaatctagtaaaggtacacagagaacagaagaaagcctctaaaagatcaacttgctgtaagtctcacaatagaaagtatgtggtatttaaacctatatctacctgactctgaagtctatgatgtttctgttatataaagctactgcttcttcctgtgtcaaaactgggcaaactagtcacctcacagaaaaagccaactctcttaagtcttggaagcctgccaggacttccagtgcatgtcagcagtggtttttcttcagtgacactgagaagagaaaagccttcaccagtcctcttcagattcaaatgtcacaggtgaatatttgagattctaacatcactctctaacactccatcggctgaaaatgagcccttttcatgcctatatgcctggcattgtcatgatctcttagacaatggagataacctgataaaaaaaaaatcactctacaatccgagcctgctgtaatacccagattcactcttcaaatccagataaaatgaagcatcaactaaattacccattgacctgccaaggagaagaatttaacaggaaacctcagatagctgagttaccgcctcactggggatgttagaaacactgacagcacatgcccagatttagccaaatggctttgaagctcaggaatgaaagtggcagcagctgaattccacagcttgacaagtgatcacatggggtgtaccatacagccatgaggagaaacctgaacagagctgcagcatcattactgtaggagtgaaagctccccagcacatctggagacctgtctgggtaagtgtccacatagtcttacctggagatttatgaatctgctacaaagaggtaggatttccaggaaaaattctacttttcagaaccagggtttccaggccagagcagcccctcatactagatgtagggcctcttctcattgtggatttaaaagcacagagatccacaagacaatgtacaactgtaaattaaatacaactgcaattaaggccattataccaaatactggaaataccagcaggactcccttcttctacctcccaagattaaaatctaggatattcagaaccattatcagggctcaagctgattttaatataaaggcatggagcaatacaatctattacttttcaataacctccttgtgatggccttacttcacaatgacccttaactctcaattgaactatagttacagcctcataaccagtatccctttccagtttctttctgttccactttatcttctacattgctgctggagtgcttttgaaaagtgtacaggtaatcacgctttgcccctcttaggatctctgttggctctctattgcccaaaggatacaggaaaaatcccctggactcacagacaatgctttacacaatcttttcctccaaattccaaacttatcctcaaatttttcccttgatgaaatttgtactccagccatatagtcttccttgacattccctggacacccatattcttttatgtctctgtccagtgcaccttggtttctgttcctaaaatgatattttctactttcaagcatgcagaatcagtatttatccttcagataaagtgaaatacctttttttttttgagaagccgagccccactcttctgtaaggaattattcttttccttatgatcctatgggattttcacatagaataagagaaacacttctcacagtacattgtaattacttgttccaatgagtctcttcttccatagtctgtgaatttagcaagggctgagttctttctcattctactttgtgttaccctgaattgtttctcagccttttggctaagatcaagtgttctaccaccctagaaacttggcatggagtagatagactgtaaatgcagtagattataatagaatgaatgaatgaacaaataaaatataaggaaatgcagaaaaaaatcaaatgtgacacaagaatgtaccgtataaattagtatgttttaaatttttacttaatgataatcatttttccaaagcaatttcatttgagtgctaaacaatagttctcctccaaagtaaaagagacaacagacgaacaactgtgtcttcccaaagacagaccactttcacttactacaatcttatgattcatgaatataaagaactctgatcatgatctgtactaggggccaaaaaactttatgaaacgcagatagaaaacagtttaggctttctgggccctatgtctccatcgtaactgttctaccttgtcattatagagtagaagaagccatatataaatgaataaacgtgaccatattccaataaaactttatttatgggcactgaaacttgaatgttatgtcacattcatgtttcacaaaatattattttagattgtttttcaacaatttagaagtgtaaagacatgtctagcctacagagtgtacaaaaacaggtggtgggccagatttagctcctatgtatagtttgctcacctatggttcatacaatgtaaaaaaaaaaaaaacaacaacaacaaaaaaaacaaaaaaacaactttggttaaacttctagtcattttttgttgttgttgagttcctttccaatgtagaagattctttgccactggaactgataacccattgtgtattacaaagagttagaaacataaaagaaaaagcaagataaatgatttgtcttactgaatatagatagggcttgtctggcttggtatatggagattacaggatggaaaacaatgctaactttttttaatcatatcaaacaagaaacaagcagatgatcagtctaggttgattagatgactatttgatgaaaaattcaaaatatcctataaaaaattcactgccaaatgctattgttatttttgattagatgtgctacatactggtaaacagaagcaatattttactattcagcaaaattatgagagaaagccattttggtaaataatatcctttgccctccaaaagatacggcccataagtggcaactctgtcacagtagtttacctctgcacaagagccacatctagtctctttgaatgtccaaaacactttatgtggcaaagtgttttcaattatttattagttaattaaactaattaactcctcctcctactcccagttgcattgatacagcattttataaatggtaaaatcaagacatttattacctatttaaggtaactgaaatgactggcaaatgataattggaaggaggggtaagcttattttttaaaacagattaataggaaaagagtatgaataattaattagataaggattgtgaaagtggtttaaatgtgataaagcactaaactcaattattaaagtccatttagttattttccaaaaatttaaactcgcctcaaaagttgtttatgaaacattaggaatcatcttaatctagacttcatttcagaagctgagatctgtgaagtttaaagaaactgtcaagcttaaatggcagggtcacaggaactagctttcaaagaactatgtttctctcttaagatgttaagatggtagtatttataaactacattgtattttcttatggagagagaaggactggtctttggaaaccttgacacatgtctacacttttcagaaatacaatgaggatataaaaaatactttcaccagaattatattttcaagggattaaatgggtaaaaggtactgttatttgatcctctgtctaaattctcctaacttaattgagccacagtatttataaactgttttgtacactacgtgtataattatctcaattcccttgtaaaataatgaagcctttgaagacagataatatatttaaaagtagttttgatatatcagtttcctcatctgaaaatagcagcacatataaaagtagttactttattaggttatataagggtaatttaaaaatgcatgtatgtaaaacatctttttagcatatagtgagtgttcaataaatataagttctaattaaaggtgttcaataaacactcatcaaatagtaaattgatgaagaggaaggaataaacaaattaatgaatgaataacattgtgcatctgatatgcaaattttcacctgacttttagaaatctactaaagaatgccatcaagtccttaaaatgacctactagtattatagaattgaatatattaaaggaatacatacatttctatatataataagaataggaatataataggagtttgtctcttactgtgttcatacttacccctctcctccagccacaccagcctggcctgtttgctccttgaaaatgccaaacatactccagcctctaacctttttacttgctattccctctactttctcctaggtaatatgtggcttgacctctcacttcctgcagatctttactcaaatcttatcttcttagagtggccttcctgaaccatcctgttagaatgggatggttgtatatccacacacacacacacacacacacacacacacacacacacacacacacttcatattcccctgccgagcccagttattttctccatagcacatatatcatcactcaacataaaaaaaagttccatatttctttttatttggaatgtaacttccatcatctgggatttttgtttgtttcgttcactgctttagaacataagtcatttgaatagtgtctagctcatagtagatactcaatgatatttgctgaatgaataaaccacacaaagatacaattttaatataaaattggtagcatgactatataagatataaaaatataaaaaggtggcacggctctgtccattactgcaaaaaatattgattgagtgattactatgttctaggcattgtgagaagcacttgagtgagttactaataggagtaaaacaatctctgtatagaggttggaactaacaaactggcattgggggtttcaacagcattctttccttcttgtccaaaactcaactcttgttgtatgtccctctcaccaatagcaaatctaaaatcctagcaatcctagcaaccaaacactttgcaggcagaactgcagcctagcaagagaaacactaacttcaagctgtgtccttatcttctgctcacatctttacaaattcaggcagctgataaacatttaatgaggtcctcattctatactaggtgctatggaggattcagaggatttgaggcacagctactgatctctaagagaagagaacaatgttaaaattagaaacacatagctaacaaaaaaagagattttcagtaactgtgaaatgtttgattttaaacagtaaatactatggggtttacaaagataaatttctttatttgggatgatttatgggcagaaatttagtaagtgatgttggaggtgttgtatgctctattcttgagaaggttgctttttattcatgaaaatcagaagaaagctaccaactgataagtcatcctgctgggtaccttcacctgttttcacaggatctttatgacagctcagcaaacttggtcatattgttcccatttgtatggaaaaactgaggctcagaaaggttttgcatcttgtcagaggctcttcagagttgcttgatgccactggccatgttgtgaagaccacataggctgtgtatggtcataggcaaaatgtgtggctcaggcttaagtgtcgcaacactcagagctaacaattaccagacgcccacagtgcatgtgtggcaacataccagggctctctttttagcaggtggcctccccctcagccacatctcccatattatagggaattaagcatttgttctccacgagacacattgctcctatccaaactgaccttgattgtgggctcttgacatttggaatctttagaactgtaaggaaaaatcactgtgggtgtgagaaacactattgaaaatcctacttattaccattaactcacttcatcacctatttattatggtttactcttctgagagacagtctccgggaagaaacaatgtttggtggggaatcatctgctcaagctctgggcacagtgtgatatagcacaccctggactggacttcaggcccaggtgttaggagacctgagtttgaatgtcagcttaatgctcacatgctgaagtcttgtgatcagatcatcttactgtatttgtattggtacaatgaggaagtgaaggtagacagaatttactgtcctttcacattcctaaggcccgagctgacaaactacacacactcaacagaggcttctgcaagtcatgaggaccttggaaattttccatgggttcttgacttaataagatccttttaatgaccctgtttcttcttaaagagacaccatctctgagaaatgaactatttaaaaaatccaaaagcaattaagttcaggaatgccgtaagctgtgataaagttgtatttcttgactcccgctggtgtttatattgctatttctcttctgcctgtcagacacatttcagactcctataattactgagggcaaccatctcatccagagatatcctcactgtgtagtctgtttggattagcaggtgattccagcaactcctcttcagcatcattgttgtttcaaattacattataaaccagcaggatgcaaaaattatattggttcatatagcatttcaattactgttattccatagacatatcccttgcctcacttgttcaccttcttcatcagtcagtcacagaatgttttctttctcttcttttattaccctgtaaatgctgttttgttaccctttctcatacaggatctaatccatcctttcccttatctcagcatctccagtcccactcctccaaaccagaaaaacatttaatggtttgatatataacatacaccctcagtgtttatttttggggggtttgttgttgttttttgctcctcaccatgcattctatcttttcttaatttttaatttttctgggtagatagtaggtatatatatttatgggttacatgaaatattttgacacaggcatgcaacatgtaataatcatattaggttaaatacggtacccatcacctcaagcatttatcctttgtgtttcaaacaatccaattacactctttcagttattttaaaatgtacaattaaattagaatttactatagtcattcttttgtgctagcaaatagtaggccttatttattctttctaactatttttttgtacctattagccttcccccttttaacttccactaacttgcttaaatctttgacttccagaatccattccacatcaacagccttgctaaagtgtaagagatggtctaggagagcctcggaggcaaaaatacaaactcgttccaatcacatagcttgtagttctgtgctcccattgccaaacaaacaactgcaatttccttctggaattgttctttaattcctcagtatcagaaatattatttctcagcaagctatgctctatttacctttattaacttgaacatttatgcccaagctacttagtccaggcctattttggggccctggtagagtctagagacagtgctctattcatttgtgcctcacatggtagagaacttgattgcatagagggcacactggcactgccatggtgtgaggtgccatgttttctaaccaggacaacctctgctgctgccttgcctctactctcaattttctttggtccttcctccacacaataaccagactaaccttctcaacaggaaatcttatttatttttctaattacttcttcaaaatctttcaatatttctccttgtctatatggtaaagtctaagcctggatgttcagtaaagaatggagatagactttctaacaaggtttttctgtgtgacaggggagagactggattgaagagtattaacaaaactcaatttttttactatcttcaatatagctggcactgtggtgtggtacggcctctaaagaaaccacctgcttcatcactaataataccgcagagcacagtaactcaatatatagttgaggaaaatggaaatgatcatacaagtaaggagtgaccatataaattgaccaaagtcacacagatagtaagtgatggggtcaacattcaaactttccttatgttaaagtctctcactacaccgtgttcgagggggcatcatggtaataaaatgggctagataggacagtgattacacagagacaggaatgggaatttacaatgactagaagacagctcagaaaccagctagaaaaactaaaaaaaaaaaatttatgtctgatgcaattctgatgtgatttcatggggtgtttaaaatccagacagtgttcattctttagtcaataggaagcacagaagcaatttagatttttgaacttaggaggataatattgattgatcaaagtagaatttttggaagagtagactgggtataggagatgaaatccccattccaagagttaggcagaagagcatggcaggatggcagccagagggtaaagctttgggaacggtggaagttgatggaagcactgggaacatgataataaggctggaactgagtacatacagtcaaaaaaaaaaaaaaaaaaaaaagcccaggtcagaaatacaaacttagagactttgaaacaaagaccaagagccatttttttctattcactggtggtcataaaaaaaaattccatcatttccaacgacatggatgaaactggagatcattatattatatgaaacaagtcaggcccagaaagacaaatattgcatgttctcacttattagtgggatctaaaaatcaaaacaattgaactcatggacatagggagtagaaaggtgcataggtttttattttactattatgcttcataatgtagatatatgccatgtgtatgctcttatatacatgccttaaatacgtcagacatttaaaataaaataataaaggttgatagacaacttttgacatggcggtggaaacgtttgtaaaattgaatgtccaatagccatgccaagatggaaaactgagaataatggtgggctccaaaaggactggataggcaggggcaggagagaaagaaagcagggaagtgtcattaggtaaaacagacagggtgggataggctggctttcattggagctgctaacattttacatctatatgttcagtgaggaattttgtaactttggttcttaaagccaaaacaattctccagccatttctgttatctttcatgaataaggatggaggaagatactcaagacaggaagacaagctaggagactttcactttattcaaggactaaagtgttgaagaccagaataagaatagctgatgagacagtagaaagaaatgaaatgagaattccattttaaagggataaatagcagtaagtaaaaataaaagaaaagagcacttacagaagaatcacatgaaagattttcctctgactttactctcttgttaccacctatactcatctcctgtcattgatcttctcatatttaatctgccagtgaagccaaaagaattctcctttggtgagagtagtgaggaaaaataaagacatggaggtgccaaagctaaggcacaatagaatcaccttaataccatcagcttggtttgaattgaaaatacaattctagcccagtacataatctcagaaacacaatttaagctctactgaatgctgtaaaaatgcagaataatcatttattgtacggctatgtgttggtatgctcaaaaatggcttagagcactgaaagaaatgaactcaggaaatggcaggacagtccctatgtactaatgctgccaatgcaatttccatagtatcacttcccaataatactgtagtccattagacagaccaaatcaatggtgagtctctggctgagtctcttttcaacagaacccgcctcaggctctctgtcccctaccacactcagtagtggatatttcaggttacacaaagacatttttatataagcctgagtaaaacataattagacaagaaaaataatgatatataatcttatggtagattattgtaattcccaaataatcactgtccttcttcctgtgtgaggaatatacctccctgccccactcacataggacttgaccatgtgatttgttttgattaatggaatgtgagcagaagtgacatatgccacttctgacaagaagctttaagactcatcatacagttgcattcttgctatttttctctgcctgaagactttcacagccaccataggggctgtttctttagcctggataccagaataatgattcataatgaacatattacataggtgagatgtatacttttgtggttataaggcattacaactctggataaactgtgctgacaaaaatgatcatgaattataaaggtaattttacattattcttagatatggaaaggcagcgtagtaaagtggaaagaccacgggcttaacagttaaacaggtctatattttaatcctgctttagctccttaagcctaggtgactttggtcattaattaacctctctgaactctagattcctttccaatcccaaagttaataataattatttctttcagaagggtcgaagataatgaggtgtctcatgtagtgtacttagtacagataaagccttcaataagtgctagttaaatcaaaagatacttgagacattttctgtttttattatttatggaaaaagtgatcacattttctgcagtaaaatttgggacatacatttaaaaataaatagaatagaatagaatatcctaactcaggtctacattaagaatgtacaatcctttaatttacaacataagtccaaagataggatttgaggcagagagtttaagtcatcaatgcttcattagaaaaacttacaacaaagttgggtaaccgctaactgcacaggaaacatcagtgaaaaacatctatcattatatataatatacaaatatcaaacattaattactaccatgtattcagagcttttacatgttacatattatgcttagtgatatttactcttacattttttccttaccccttcattttagaattaagggcactggtgctcagagagagaaacagatagagaacattccctgtcctggtatgaggaggcaagtatgaatgaggcttaactattctgtgccatagatcatatgaccttcacagaataaaaatgtagggggtctctaccttttaaacagtatagctctctgtctaaatgaaattttgacagcaggcgtcatctacgtttttttttttttggcaagtggaggaacttaaaggaacaggcagaagccattctaaaaggaaagtgtgttggaggtgaagtgagaaagagtgaaaaatggttttcagttaatttatctaagtttatcttccagctgaggagtgaactcttgtcaccttgtgaaattaggcaaaacaaaagccttcccacacaagtcccaagtgactccaatatgcaaagtactctccttcacccttcatacttgtagcattaaactgggtcaggaggaagaagcttgtatccaagatttaaatgcaggatgctctgactgaagcctgcataaatgtaaaatgagaggaacttggtaataagcaagcaaggtattaattagtacatatgtagattcctagagaaaaccaaccaaatttaatcttagaatatctttacttttcaatgtataagataataagataatatttagcctggcctcactttaaaaattacctctcttaatgaaatacaagaatacttgcaagaaataacagtacagttgtgtataaaacttataacattaagcaaaggaagcagtctctctctctcctccccccaccccccccagctctgtctctatttcttttccccccatattgaaaaaagaagcacttcataatacaatacattttaaagaaccaaaaaggggcaacagatctcctaaaaaaaactgttctctctttgagaacatgcatttctaggagttgcacagatatagaattctgaatatcaaagtaacacagatgtccatatttgctttcaactctatagtggctgacagaacaaagaagcagaaaggcaatttagagaaagacagtttaggtcatttaaaaagggcaagtgagagattagacacgtttggggcatgggtgtatttctattttacgttgtttctatgtcatctcttacgaatagctgctacttatctactcaccccctcctccaatgtgaacagtaaaaaacagaaatgtgttacctatgttatatcattagattttctcaaaaataaactgagataactatcatatctactttaaatctttgtgaactgggtaaaggagagtataacaattccaaatctcattcaagatcacacagcaagtaagtaaaataaaatgaagtcacgaatataaactgacttcaaaacttatgttctcttcactttacaggaaaaaattaaaggaataaaaagaaggcaaaagataactttctccctacccctgaattaggtttctgatggtttactgttctactaattcaacactgcctaataaacatctacactctgcatttctggctgcctttaccacctcatttaataagccacgccccttcaatatttaaatggaaggcaaatactcatattcaactgtttcccctcacagaaaaaaagtttaactattttaaaataatgtttgaactatttagaagtgcagtttcgtgggatgaactgcatttaatagagcagatacagtgacgacctgctctcagagggcttgcaactcacttcaggaaacagagcacaagctcattaattgaacaattagttaacagcctcttaaatggcaggtactgttcaagttcctaagaactgcaggaaataaaaagtattgtggctaagcagtatctgccataggcacaggaaaagcaacttcaacacatgatatatatttgccagccctatcctaacccatacatgaagaggaattctggattcttcttttcttcctttctgttttttactgctttaagctcacagttagaaactttattaaaaacaagaattccaaagacaactcagaggaagaaatcaaatgaaataaatttgcaccagaaacttaaatctttggtcagcactaatctaatatcaaatactagctgaaacactcaggttttgtaagactgatttaggttcagaagcaacaaacccttttggtcttttgggttaaagtacattttacaggtaataaaaagaaatgcttttgaagtaggacaaacaaaagcctggtgcttctagaaatcttaggagtggcctttcttgacttccaaaaggttagtaacttaactacaacataaaacagagacaactccagagacaaagcacggaaaagtgcagaggaaggtgcccatgatttcagcaaaggaaggcaggacaacaaccattaagtacttttttttattcaaccatgggataactgtaataattcttaggcctgaaaagcaacataaataagtaatcatacattatgggatcagtgacatacactctgattctatttatgaatcacagtacttgactgtattacttatttatgttatttaccgacctaagattgaaagccaaatattctgctgatagaaatttcttaagcttacaaaactgctgaagttcagcactccagaaagcaattcccccctccgcccccagtttggattatatccgtggcatttaacacaagtgattaaactgctaatagcaattttgctcagcaacttccaccagcttttactgtctatatcccaaagtcttatctgtgccagggtatatcacctaaagatgaagaacgagagttgtatgtgagtttaaagcatatattttgcttatttggtatgttggactatgatttttaataagcaaagtcaaacttttcaaaatgaactatagaaaaattttataaatttgctctaattgaatcctcactcccaaagaaggtaattgaaagccttctctatttagtgaaatctaaatttaaaaagaaaaaaagaaattatcattgattttcctccatgccacagagtgccctctgcccccaacccttcactttcccaacaacctgaaactactgagcttactgagctaataaattcacatcagcaggcagaggtagctgaaagccaataccagttcaacgtctctcagagcttcacttcagcaggatgcttatttactgctcctagcacaagaaagggaatagaatggaatgaaaactggtttttatctcacccctaaaatgtgtctcacccctacaatacatttatctcacccctacaatacttagacaatgctctaagtattttacacacatcctatagaactgtgacttagaccacactgggttttcacattgacatcatcaactccttagtatgtaatttagcttctctgagccccacttttatcacatttaaaaaggaactatcagcaccataacaacagggtgatgaaaaaaaaaagagcagggagtggtggcagttgtgggggggtgggcaattattcttaccttagtgggttgttatgaaaccaaactaagataatggaaagttggtttaaatccagaagccacaaacacctgttagctcatgcattaaggtccattttaaaggcaataaaaactattgttttttgcacagaacagacttcagatttttcctgaagtcaagtggcatttctggacttccaaatagctgtgaacttctcaacggcaacttgcatagagttatgtacatacttgtaaaattggatgtcaagggaatggggcaaatatttgttacaacgcctaccatatgctaacttggcaatttacactccttacaaaatagagtaggcacaagtttaagggcatttccttcataaaataataaatacacttctctggatagaaactgtgttagatatttctaaaaactataattttaggaaaaccctttagagaggacagtagaaataatttctaatattaattaaataaccatttcaaatagcagtttttactttgaatgtgataaggaaaataaatcatttcccttagttatttacaaactaaaagtttagaccccaaatctattctgaaaactcaataaagctaagcaaagaaaaaaataaactacccacaatacctcacttctcaatctccatcacctgggaatgatcttttccagctgaggtaaacttttatttttggttctacttgttcacagacaactttaaaggtaaacagctcatctcttttctatcctcttccctaatgttaaaaattccttgaaattttatttgcctattgaacaacctctgcaaatccctccaaattgctcctcctcagccttcaccacacaactgaacctattaggcaggcagaaaagaacatattgtgaaaaaaataaaaatgaatggtgaagtaatggggaaagcacaactctaaagaaaaatagcaatgaaaggaagagaagcagggggttaggactgaatatggagtcttttttatcatgaggtgcagggcaaacattttggaggaataagtcattaccataacttcataggagagctgctgtaagatacactgtatgagatttggagtactaggaaaacacaaatgccaagaattttagtcttttctcagaaaaaaaaaaaaatcaacaaaaggattaaatatcaaagaatttctccagggcaacatttcctaacctatgtttcatggaatactggtgtctttcagggtgttaatgaaaaaaaaaaatttttgggaaaaaatctgacatcaattaagtttggaaaatgctaatacttcctaataataagacttctcattgactttagtaagctaatgtgtgatgtgcacctacctctaagacagtgatacagcatgcagagtgtcctaaagttattagagtttggattactttttcatttaaaagcaaaaacagaaacactgaagatacccttggtaatattatttaggaaattctgttttatatttactctgggctatttgtgctgtatttagagccagatttcaaatccaagagggcagggatacttttgttttgaaaatttttttaatctcaggaactaatatatagataacatgcaataaacatttataggagtagtatatagaactttagttctggaggtagacagacctacattttaatcttcctgtgtttgctttatgatagatgcaaatttgggtaactcatttagactctctatggctatgatttcttatctacaaaatggagttaataatattttcttcatagggctatagaaaaattggagatcaatttatatagtgcatatgaaaaggttagcataataaccagaagccaggaattgtgcaataaattctatcaccattattgttgttatgcagtgatttgtcttagtacatatgactttccgcactaaatcttgcctattgaacaacatgtacaaatgcccacaaattctccttctcagccttcatcatacagctggctgtactggctatatacattttgattaatatatttttacgaatgaaaactttttcaaatggtagctatctatatacatcatagtcatttatttatttcaaaggctattatattaaatatattttaatgctatttaatcaatgaatatagatgtaataataaggagattatgtaaatcatggtaaacagtgatctaaattgatgtctagttgcctcttatttaagctggaaaaatgtagaatttaataacagaaactcaaataaccttaaatttctttaggcctgcaaatcatcttttttactaaaataaactgaagaattacagtatggctgcacagcctgagaagaaagaaaacaggagagcaggaactctgaactcaaaattccacctctcagtgtttgcttcactgacttaccctgaggcagttactcagtgtctttaagctcagctctctcattatctctgtaaaatatggatgatttttacaagattccagtaagagaattggtaattaattgtacaatagggtctgaaaatacaagctggtataaaatatttaatacttagtcagaaatttacaagtaacttaaatactgtatttttgttataacactgaatggttcatattagaaggaattggtggcgcaggagtgggaaaaataatattttttgagtgccaatgtacccgtcacttacttcatttaaattccaccacaatgatcttagacaaggaatagtatccagtgctcattttataaaccagaaaactgggttcagaaaaattgataaagtcatccaaggacactcatacaataaaaccaggatttaaaatgtcccatggacatcaaagcccttgtctttttattggactactctaacattccttatcattattttctattcattcctttaacactttctctatgtaagggattatctttaacaagggttattcaaaaataaggaagacagcttttgccctcaaggatcttacaggcaaagtatacagaaacctgcctcacctttatacagtgctgattgcaatataagaaatcttttatatgttctatttctaacaacctataatgttatgccataacattgattttatttttgttgttaaaaatcagtaatattttatttacagtgtaccataaacagggctctcaaatgattaatttatacccagtgtccataaagcatatacttttttttattacactttcagttttagggtacatgtgcacaacgtgcaggtttgttacagatgtatacatgtgccatgttggtgtgctgcacccattaactcgtcatttaacattaggtatatctcctaatgctatccctcccgcctctccccaccccacaacaggccccagtgtgtgatgttccccttcctgtgtccatgtgttctcattgttcaattcccacctatgagtgagaacatataacatatacttcttagcaagcctatgaccatgactgtattagctatatacatttcaatcaaaacagttttacaaataaaaacttttttcaaatggaaggcataggaagaaatggtctaaaatgtgtacctgttgaagtaggtaggttcccagaatttcaccttgcttctctttggtatagtattgaaattctcaaatttaagtgaagaataactgtaaatattatgtaaacaccattgtttaaataaggaagatcactgaatatctcagtttgaagacactgatgagaaggcaaggtgctggaaaggagggcaaggtggataacctaaaatcaaaataagaatacctggcaacccctgcccattctcctagatggctcctagtacgaagtagctccctattagtaaaaactgccctaaatctcaacctgcttattttagctcatttgtaatcagagtcagacacacaaaaagaggcaatgaaattcaaccattgtgtgattttatgattttatgaatcatcagggaaatatgctgagtaaagaaggaaggtagaacattatcccattgctataggaattttcacccaaataaagcataagggcattcaagggagccccaatattacatagagagcaatatcagtgccttgataagtggaataataatgtaattctgaaaacactcattccgcaatctccagtgacacaccactcttgctgatgcatatggattaggttctcaaagtgtggtttgccagaccagcatcaagagcaaataacctgggagcttgtaagaaatgcaaactcccaggccccacaccagactcaccgaatcagaaactcagtcagagcttgtgccttaacaaatgctacaagggatcatgatgcatgtcaaagcttgatatcactgatctaagaatatttacacacataaacaaagaaaagtgtacttagtgattatgttgagtacttcttaaaatagggaaataaaacaaagcaatattaactaagctcctattacaaatcagacatctgatatttaatttctataacctaattatgtacatattagaatatttatatacctcaaattaccatgacatgaacctccactgagtttgctctcactaacaagcctccttcaaagtgttctccagctatttactaggagttccaagaggaggtcttatgtctgcctcagaaaatgtttcttcaccaacaattgatactgggcttaagctagtggatcctgtctttatgtgttttagccgaagcacaagacagattgaatgactgaaaaaaaaaaggaggatgccatgttgcatctatcaaatagacaaaaatcactgaagtattggtgaggatgaagggaaacatatacattgctgttgacattgtcaactgctacaaccacttgacaaagaaatttggcaatatgcgtgaagttaaaggtgcacatacctagtgtttcatttttattcataatccctagaaactctggcacaactgcacaaggaaatgtatataagaatgttcactgcagaattgtttataaaagtataaaatcaaggctggttcaacatatgcaaatcaacaaacgtaatccatcacataaacggaaccaaagacaaaaatcacatgattatctcaatagatgcagaaaaggcctttgacaaaattcaacaacgcttcatgctaaaaactctcaataaattaggtattgatgggacatatatcaaaatattaagagctatgtatgacaaacccaaagccaatatcatactgaatgggcaaaaactggaagcattccctttgaaaactggtacaagacagggatgccctctctcaccactgctattcagtgtaatgttggatgttctggccagggcagtaaggcaagagaaagaaatacagggtattcaattaggaaaagaggaagtcaaattgtccctgtttgcagatgacatgagtggatatttagaaaaccccatcgtctcagcccaaaatctccttaagctgataaacaacttcagcaaagtctcaggatacaaaatcaatgtgcaaaaatcgcaagcattcctatacaacaataaaagacaaacagagagctgaatcatgagtgaattcccattcacaattgctgcaaagagaataaaatacctaagaatccaacttacaaaagatgcgaaggacctcttcaaggagaactacaaaccactgctcaatgaaataaaagaggacacaaacaaatggaagaacattccatgctcatggataggaagaatcaatatcatgaaaatggccatacttcccaaggtaatttatagattcaatgccatccccatcaagctaccaatgactttcttcacagaatcggaaaaaactactttaaagttcatatggaaccaaaaaagagcccgcattgccaagacaatcctaagcaaaaagaacaaagctggaggcatcatgcaacctgacttcaaactatattacaaggctacagtaaccaacatagcatggtactagtaccaaaacagttatctagaccaatagaacagaacagaggcctcagaaataacaccacacatctacatctgatctttgacaaacctcacaaaaacacgaaatggggaaaggattccctatttaataaatgatgctgggaaaactggctacccatatgtagaaagctgaaactggatcccttccttacaccttatacaaaaattaattcgagatagattaaatacttaaatgttaggcctataaccataaaaaccctagaagaaaacctaggcaataccattcaggacataggcatgggcaagggcttcatgactaaaacaccaaaagcaatggcaacaaaagccaaaattgacagatgagatccaattaaactagagagcttctgtacatcaaaagaaactaccatcgagtgaacaggcaacctacagaatgggagaaaatttttgcaatctacccatctgacaaagggctaatatccagaatccacaaagaacttaaacaaatttacaagaaaaaatcaaacaacctcatcaaaaaggggggaaaggatatgaacaggtgcttctcaaaagaagacgtttatgcagccaacagacacatgaaaaaatgctcatcattactggccatcagagaaatgcaaatcaaaaccacagtgagataccacttcacaccagttagaatggcaatcattaaaaagtcaggaaacaacaggtgctggagaggatgtggagatataggaatgcttttacactgttgatggtagtgtaaactagttccaccattgtggaagacagtgtgactaattcctcaaggatctagaaatagaaataccatttgactcagtgatcccattactgggtatatacccaaaggattataaatcatgctactataaatacacatgcacacatatgtttattgtggcactattcacaatagcaaagacttggaaccaacccaaatgtcaatcaataatagactggattaagaaaatgtggcacatatacaccatggaatactatgcagccattaaaaaggatgagtttatgtcctttgtagggacatggatgaagctggaaaccatcattctgagcaaactatcacaaggacagaaaagcaaacactacatgttctcactcatagctgggaattgaacaatgagaacacttggacacaggtcggggacatcacacaccagagcctgtcctggggtagggggcagggggagggatagcattagcagaatacctagtgtaaatgacgagttaatgggtacagcacaccaacatggcacatgtataaatatgtaacaaacctacgtgttgtgctcatgtacctttgaacttaaagtataatagtaaaaaaaaaaaaatagtaaaaaaaaaaatggaaacagtaagtaggggggataaactcttcatttattgccacactatgcagcaataaaaagagtgcagtaaaaatgatcacataagaatgaacatcacatgacaccatttatgtaaagctttaaaatccgtaaaataacaccatatatgttccgttatataagaaaaattaaaacctggatgagtatgatacatagctgtaccaagagcaggattacttttatataagaaaggagaaggggatgaggagatcccagttttgctgtgcctattttgtttcccgaaagttgggttgtgaaagaaataaaaaataataacatctgttagctctgtgtttgaagtatatgcatgagaattttgttgttttccatgtttctatatatgcttgcaatattggataatttaaaaattcttaattgaaaaatcaaatgctaatttagacataacaattatctgaaaaattaaacattactctgataacatcagtataaatttctaagtttttcatctgttttgtttacctatttttagttattccttgtagctagaacagtacctggtagatggtaggcatccataaatatttattctatgaacaaatgaatctcatttttgaacagattaaaattttctgaaaaacacaccactgaacagttccatttttccacattcctttatggtcttttccaatgtgcacattatgttacagtataatcaaagtgcatatatcatttttattatttttcacttcacactatagcataaatacaattccctgttttagtcttaggtcttcctaagaatatgctcatttgatgcatcataatttttttaaccattcctctacaggtttctaaatttttattattacagataatgttgcagtaaacattgctatatggacagctttgtgcttgtatctttcttcttatgatatattatttcctaatgataaactcccaaaattgagattcctagatctatgggccttgaacacctttatggctatttttacttactatattctgaaatggttatatgtatttatactgccaccaatatcatataacacatcatcccttcctttacctatcaatcttgctagattcccagtctcagaatcatgagatcaagagggactatagagatgaggaaatctaaccttccaataataaagacactaaccaggtttctactataaaccagacattattcaaaatactttacctgaattatctctgcttctcataacaatcttgcttggtaggcattcttatcgccactttacagatgttaaaactgagattcaagtaatttatccagggccaccaattaatgcatgatgtgcaggattcaatgtcccccgtatgtccattatttaacttacctcctaaatgaataaagtttgaggtatgattccaaaacacattcactactgagcagggtgatgtcaaagaaataagttctagaagttcctaactaccacaagcagggtagaaaaaatcaatagttcatcctttgctctcaaacgcactttacttcatagggccatacacaaatgccccgtccagagcacttcaatagttagagaaatttgctccagttttacctacctaccagctcaagtgccatttccacagaaaggttgtgcgtagtagtaggaggatctaaataaatggttcccgagattttgcaatggaagagaaatatctagtataccagaagttttaggatcattaaaggagagggtataatgaatatctggacagatatttgtgtgtgtgtgcatgcatgtgtggatgcacacatatatgtgtgtatacagactctttcttggtatattttaccaccaccatttctatcccaaaccccaacacacacagcaaaaattggccgagttatgtaagtggcaagggctctggaaaacatagatatattcctaccagttatcttgacttcatagtaagaacaaagaatactgttcaatgggtataaagtttaagttatgaaatgtgaatatattctagatatctgctgtacaacatagtgcctatagttaaccatatagtattgtgcactgaaaaatgtgtaaagaagatacatctttaaaagagggatagcagtgcaaaacttttggaagtaatggatatgttgattagcttgattatggtgatggtttcacaggtgtatgcatagattcaaacccttaaattgtatacatcaaatacatgccattgtttgtatatcaattacaccttaatagtactgttaaaaaaaaaaaacagagcaagggattcggtactggatctgtcttaaattcttattccaccacttactcactatatgactgttgatagttacttgagtgagcttcttcatctatgtgtataataatatgaatattactggaatatgataaacatattccccagaatgtactaagcacgttaagtacattttagccacctccatcatcatcatcattattcctttgtataatagggagagatataaaaagtgtccttggggagttggttccaggaaccctcccagacaccaacattcacagatgctcaagtcctttatataaaatggtatagtatttgcatataacctatacacatcctctcatatactttaaatcatctctaggttacttataatacctaatacgatggtaatgctatggaaatagttgttatactgcattgtttagggaatgatgacaagaaaaaaagtctatacatgttcaatacggacacaaccatcctttttccccaaatatttttgattcacagcaggttgaatccatggatgtggaaccaaagaatacagaaagctgactgtgtgtgtatatacttatttctttatttatctctataatatttgtatgtgtgtatatatatgttcccattatatgtcctatttatatacatatatccccattatatgtaatagatacatatataaaggtgatatatatattatgttcccatacatatttttatgtatatgtacgtctgtgtgtacatatatatatatgtttgtgtgtgtgtgtgtgtgtgtatatatatatatatatgtttgtgtgtgtgtgtgtgtgtgtgtgtgtgtgtatatatatatatatatatatatatatatatatatatgtatctccccattatacaaatgaatatgatgatgatgatggtggtagtgcccaaaatgtatttaatgtgctttgtacatactagggaatatatacacacacacattacttttttttgcagggatcttgatacataaagattacatgtgtaaagtggctaggcacaatgcctagcacagaatacatacaaaatgggtatatctgttatgattagtattggtaatctcaggtagatgagaggacggtcccctccccacattccacaatttctcttcatccctccagggactacccatcttcaagtacctgtattctctctggatcatttctatctctacctcttcctcacttttctcaaatggcttccttgtttatccccatccttctcacctgtctgctacctcacactttttctctttcttgctctatttttatttctcctttcagactctaggtaacttcttcccataccagttgtcttatatctaggtctctagacagtataaattaaatttggaagtagaagcaaccaagtaaattaagcagtgtgtatgctcattttaagttaaatctcttgcatgttacgtgtatgacataaaattgtgcatttaaaagatacatataacaggttaaattatttgttgttttgcattgcatatgtttaaaagactgttttggttatatcatttaatgtattacttatgtgaacatcttccctgttacttgaagtgcaaaatgaatggattgatatgcaaatgataagcaaatccagtgaatatgcatattaacattgttttgaagaacacttgcattttaagatagaacttccacagaagcaaatacaaattttattattccaatcatagagttaatcaaacagcaatgactattacattgctttttaaaaatatgcctaagggttaaccactagaatattctcagttaacctacaactgtgtgacagaatatctcaggagacaagggttggtttagtaaaaagaacaggaaacttgtgattcagacaactaaatttgaaatttggttatccaatttatctcccatgtgaatctaacatttctgatcaagtgtccttttcagtataatgagaataattatagttacttcctaggattatgaataaatgaatgaatggtacatattatgggccaggtacaattttaggtgttggggtacaacgatacacaaaacaaacaaaattctctgctctcctggcacttagattctaacagaggacaaagacaataaacaaataatgatataatgaatatatggaaataatatatatcactgaacaacttttcaggatgaaatgagatcatcactactaacatccagtgaacatgtctatgtccttatcttatagatcattgatgaaatctaatggacatctgtttgtctttatcttatagatctattggcagaattttaatcagataacccatccttccctattgaaacacttccttcatttgaattctgtgatcgtcactcttttttttttttttttgacacaggatctcactctgtcacccagtctggagtgcagtggccaatctcagctcactgcaaccttcacctcttgggttcaggtgatatccctgcctcagcctcttgagtagctgggactagagatgcacaccaacacacccagctaatttttgtatttttagtagagatagggtttcaccacgttggccaggctggtctcgaactcctgatccacctgcctcagcctcccaaagtgctgagattacaggtgtgagctactgcaccaggcctgatatttactcttttgattatcattgtacctcaaggtcttctcgtcttctttgctgtctttttttcctcttcctgacctttaaaagttggagttttctaggttcagtcctaggttctcttatctgtaactcctttcaaggtgatctcatctagaatcttatcctcttaaatatcatacatattcttatgaggatgaaatatatatctctatccctgacctccttttctgtcctgcaggtttctatatatatctactttttgacttgaaatcttcacttatgtgtctaacatatctcttaaacttaacaagtccaaaacagaactataggttaccaatgcctcaaacctcttttctaccccatgtagaggtaaatggaaccatctttcattctgttacatacgcctgtaaactaagaatcactcctagtcttccctattactcatccttcacaaccaatacatcaacaggtccttccaaatctatctccaattatttcttgaatagtttactgctctctatctccattgtttctgctctgtaataaactacaactactctcacctgtgatacatcaaaaatgtcaccctccaatccattctctccctagcaatcacagtaatgtttaggaaactgaagttataacgtgtggtagctggtttccaaatattgcccccaatcaatcctgttgcttcttattagaaccctatgtagtcccttcccacaaggaactttgactggtctgtggcttattttaactaatgtaatgtatcagaagttactttatgccagttttgagcctaagccttaagaaagcttgtcaacttctgatttggagagtcatgagtgtccatgtaagaattatgccactatttaaaaatatccatgtataaatatcatatgcatatctatatatgtgagatttttttatatgtgagaaggcaagccctgagactacatatagagaaaaagagactcagccatctcagcatcacagtcaggcttccatatgagtgcagtcccagctgctatttgaatactgtcaatttagagaccctcagaagaatttcttggctgagcctacttaactcacagaaacatgagagagaataataaatagttgttataagtcattatatccacatagcaatgaataatcaaaacagaaattgatatttgaaagagagccctaccgaaacaaaaatataaaatatatagcattggctttggaaccggatagcatgcagaagccaagaagggcctacaggagatggttaatgatgactggaagaaaagtgggggagcactgctatcagaggctagagaaaaggttgtttgcatgacagtgtaaagtatgacattatctcttgcattaacatgaaaagtagaaaatatagccaatgaacttgtctatttagttaagaagatttccaggaagaatactgaaattgtccagtttgttttggagtttgggagttttatgggttttttagtgatgtacaataaataccaatagctatgagctaatgaaggaactgtccagttttcaagcacaatctagaaaaatatgaccaatctaggacttgctaggttggagaagaaaaccatttcttcttcatagctttgccagaccagcagaagattctcaaagtaagaaacggctttagctcaagaaacaattccaaggtgctgccaataaagcatggcctaaggataaatatttgattaagtctcagaaaaatttgaggccatgcctgatacactcttttgactgggaaaaatagcttgtaagattctcaatgatattgccccacagacctcagattctaatcccaaggtagaagggggcctatttcaaaaatgtatgggtgtgccttctgtctcataaagtacattaagatcttaatatacaggaagctgacaaagttttcaaaagaattatataagcttagactgggagggacagaggccatcaaagaaaagggacatttgggtctccaactccctagagacagaaagaagatgaggaagctactcaactgtaaacattggtcattttttatggaaaagtgaaaatgagtcagaggatggagccagaagcccagagaacagcgaaaagaactgaagagaactattcccggagagcacaactattctctaatcaacatgcattccttgcccccagaacagtgagttggtaacatgtgccaacctagatttcagaattattaaaagccagtgacggcctggtgtggtggctcacgcttgtaatcccagcactttgggaggctgaggtgggtgcatcacttgaggccaggagttcaagactagcctggacaacatagtgaagacccatctctactaaaaatacaaaaattagccaggcatggtggtgcatgcctgtaatcccagctactcgggaggctgaggcaggagaatcacttgaacccaagaggcggaggttgcagtgagccgagattgcaccactgcactccagcatgttcgacagagtgagactccatctcagaaaaataaaaaataaaataaaagccagagaatgctatgtttactccccaactccagctttttacatggaagtgtatattagcgtacacctatccctgtctcaccattttacgatgggtatgtgggagaaagataacttgtgtccctggttcatagttctatagatccatctgtaccaatacataatttagctgataagatcttggactttaaatctatgcctgctgctttaatggatgagacttaaggctttggggtagaaggaaaggatattttgcatgtggaagggacatgggtcacttggggccagaagtccaactgtgttagctagtcttaatgatggtacttaattaagcctaacttctggtatccatacccttatgcggtccctttttccacactgactcaggactggtctgggacttatattaatcaatatacataacagaggtaatacagtgccagctctaggcctatgccttaagaaggcctgacaacttctaattttgtgttttagggaggcctgaagtcaccatttaagatgcctagttacttagctggagagcctacctggcaaggtcacatggagaaacaagtggaaagatgaggttatgagaggaacctcatagagatggagagaggccaaattgtccagcttctgaaccaacagtcaaacagcgtaagagactcaaaattagactaaagaactacatagctgaaacaagtcaactcatagaacactgagagataataaaatggtggttgttttaagcaattatattttagagtagtttgctatatacaacaataaaacgtgaaacagcatgtcaagcatgtcgctcattcacctaacatcaatgacttctcattaacagatagaataccatccaaaatctaaaatccttcccattacatttaagttcctccataatacttgtcctttcctacatatacaacctcatcttttgccatattcctctccatgctataatctagccatattatctcctttttttttcctagaccctaacaaggtgttgttgttgctgttgttctgccatagtctttgcacttgtggttgcttcattcttgaattatttctcatcatctcttagcacaactggttccttcttaccctctagatgttagttcaaatgtcacttcctcagacaggtctttcttacctatgttttcttcagttacgatatgtcacattttctaaggcatttcttttatagcacttacaacgacactgttgcaagtatttgtgtactttggtgctgtttccatcttagaaagcttgaacatcaaaagacctatgacattatctatctttttcactgctgtgtgtccccacttctacacctagacaggttttggcatgtagttggcagtaacatattgctattgagagaatgatttaattaaagtgaagaaatgggtattatttataaaatatttattatgatatctaactgcctccagaaaacgattttcttttacaaaatattccatttctaattatttattcaattttgccttactttgactgattaaaaattccttgatggtaaaaaaccatgttatttctgactaattaatgccccttggtcttgggcaactaggatggttggtcattctatctgccacacactaatgctgcttgaagatatatgttgccctgttactgaattctgaccaatggtatgagaaaagaaatcatgtacctcttttccagacctagcccttaaaaatttgctatgcaacatcttattatttccccaaatggcagttgaacagagagaagtctgaagacttagaggaggaagagtctgaattgctaaatgactagctgtagcggaccttaccacccacttcgactttagcaaaacatacaggactgtgatctgagcaataaataaacttttatgggatactcacagctaacatcacacctaatgctgaaagaatggatgcgtttccactagggtgaggaataagacaagggtgtttgctcttaccacttgtatccaacaatgtactggaatatctagccagggcaattagtcaagaatataaaataaaaagcatctggattgaaaaggatgaagtaaacttaactctatttgcagatgacataatttatacagagtatcttaaagaatccacaaaaagctaatagaataaacagattcagcaaggttgcaggatgcaagatgaacatacaaaaatcagttatatttttatacactaacaatgaataatccaaaaatgaaattaagaaaacaattttatttttaattacatagaaagaataaaatatttaggaataaatttagcaaaataagtaaaagacttgtataccaaaattacaaaatatcattgaaaaaataaaagttctgaccaactaaaaagacaggtcatgtttatgggctgcaaggcttaatactgttaagataacagtgctcttcaaactaatctacaaatttcatgcaatctttttcaaaatcccagttacttttattcccccagaaattgatatgactcaaattaataggaataagtgaatgaatattcaaaaacagaacatatcatgtaatcagcatccagaacattacttgcatcccagaatacctccatatgctgccatccagtcacttctttccaagagtagccattatacagcaatgtgacaggatggattaattttagctgcttttgtacttgacagaatagaatcatgttgtgtgtactctttaatgtctgtcttccttcacatgttattatatttgagagtttcatgcatattgttgcacatattttctggcagtttatttttattgctatatagtattccactatatgagtatatgacctgtaatacagtgagcctggctctggtcccttgacatatggttctctcagttcctattaactcactggaattgaattcctgcccaaattggagcccaggagttttgtggcttcagcccccactgttagctgtatgtttctattccatttctgccctgaagaaagatgattatcagtcttacatgagcaatgcaatgctattatctttgtaccacctatgaccatgggtttagagcagtaagatgtaaactcataaaaccaactttttggggagttgatggagggtgtagtctttctgattttatcataaagaaagtctcatttggtgtgagtaaatctcaactatacacacacatatatattttttaaatacagagataatatgtttcttagagtcattaacagacaaggtttctagctataatttaataatatcgttttcaaagtatttttatttaaattatattctatatatgttaaatgatatagatttttattatgatagttatatacaattttgtatttaagtaaacatgaagtaaaattgggtcacaataaaaatattaattaaataatatttcagatggtaaatgaacatgtcaaaaatcattaaggtggtaagtaaatgatttaagcttgggatacttttaatgaaccgatttgacagctcagctttcatttatttatttagaatacaaattccagatctatatttaccttttggatcaatgggtgagcctacctgcaggaaatctgcagctatagctgcttctttttatacatcatcccttgctctaatctcctccatagcaatcagagctaatgagctgcaactgattacatagggtcattgtgttaataattccatggagtaaaaacattttcaaaaagatccttggatctaagacatgataagacaatccaaggaaagtgcaccagatgatataatttcaggcacaacatcaagaaaacgtgatgcaagtctgaaccttacttatggtttaatccatgaagggcaaataggtgtaaactcacatgctaacaccagcctattgatacttgcctctgtagtgttgtgttcagaaggattctgaaggaaaacctgcaatattaggaaagaatgtcaccggcatgggtgtgggaagtgtcagaatttgtggtatgcgtttgccatctttgatttagagagtaataaatagtcctgatctttgatgatctcagataccagaaaaaaagttcttcactagaatgctgaagtataagacagtatatacttaaggtaactacaaaataaatgaaatataacctggttcattgtaccaaacatatgtttattgggacaaatcaacttcaagagtaaaataaaatgaaaatactagaagacaaatgggttaataaggatggaataaaaaagggatttggcagatatctggtagcttttaaggagaacagtttaatcttcaaaattaacaacactagagaaaatgtctttccagaaaaaaataaaataaaaaagttgccatagtaactagtgctagaacctccacacagaccaaatttagcaaagctaaacttactttttaattgtataaaatattcaattgaaaaaggaagaaaagcaaaattggatttattttgcacctactatgttccaggtgcttcacacagtttcctcagtaattatcatgagaatccagtaaagaaggaagtattaacttcagttttattgatgaaaaacttgaggttcagagtggttatttgctttgaactacactaaaattggaggagcaaggtttcctgagtctgtgtttttaaaagactctgaataaccctatttgcttctttgatagactacattatttgtctggaggctacagaaagacactattgccattttgaaaggcaaacgtgacccagtgaacatcagggtcttttatactaaagagataatataacgtgaaaagggaaagtttctttttcaataatattactcactggggaactggtggactgcccaattcttcctgaggacagtcagacttgtaagagaggcatctggacaatttcttatttgtcttgttcaaacattatccaaatacttaccaaacttctctcaaatcatatatcttaaaataagataaatatcataatttccattccaatttcagtttatctgttctctcatgtattaaagaaacatttatttagtgcctaccctgcatcgagcactgtgctaggtcttaggaattggagaaaatcagtccagcaagataatgctttcctctgccacatgacattagcaacaatccttaactttactgagggcaaacaagaccattgaaaacccctagtcttccttcttctcacagcaaaccattccacaattagcccaagtctttgttcagaaattgaatcatttgtactcaagggaaattccaatataagccctctgaaatttggttatctgaggatttttatcagacagggaagtaaagcaagctgactgaataccaataaagaatttgatccgagtgggagttagatgatctttctcattttaagatgtcttaaggaatcagtaagagaacaattgaaatgtggtatgtgagctctggaggcctgcaattgtccctaacagccatggaggatggggaaatcccattgacctagtttgctacagactcataatactggggattaactaagccattgcttatatgttgacaggatgaggtgaattgggttccagcctagttcccacaaggcattaaggacagaaatgtcttcaacaaccatccacaaacaatggaataaaatccaaacttcttagactaactttcagcatcaaatcactggccctcttacaatctcttgttattgcccaatataaacctgcctaacaagtagaacaaaagtgtatctgtgaccatggaaaagtttttcttttttttttaaacccctctgagcatcagtttcctcatttgcaagactggaatggtattagtatttgcctctagacattcctggatgattaaataagttaacacatacaaaacctgtgaagtagcagatgatgctaccaccactaccaatcatactacttttggtaacagctagactcactgttcagcattaagtttaccaaaggcaaaaacatccactgaaaacccctgtcttctattttcatgaagccaactatttcccagttaacccaaatctttgttcagaagttgtattatttgtactcacggggaattccagtgagagccattttgaaattcagtcacttatgggcatctgcatgatttatacattcctgtttccatgtctgtccctgcccaaaatgccttcttcattcctcattatcgaggcaagttcaaaccgtgtattaaagcctactataaatcctacccacccatgaattgtggactgctctctgtaccccatagtgattcttttattgtgaaatgccacttactgtgacactcatcacatatttctattatatattggtgcaaaaatcttctctcattgagaagacttagctctgtgagggcagttgctaaactgtctactttatttttaaacctctctaagtatctacctagcacaattcatatctagaaggtgctcaggaaataatagttggttgacagattcaaatggaggacaggaagccttgtagttccatggttgtgtcagatgacgggctcagaggattaaggctttaaaactactagagaggcttattcatgaggcctgagcttcaactggccaatcatgtttctgccccatgttaactgctactggcataaacagataatttggttatggaatttgaatctcacacttggatttaacatcaagtattatacaagctagtacctgtttctgctcataaatgtgactcccattttgcttcatgagcaaggttttggtatcaaagtgataaccgggaataatgaatgcagctccttactatatttattgacagaattgctattttaatgtgaacaacagctaaaaaatgaaatgccttgtttcttacttaaacagcagacaggcatgagacaatgtagctagagagtaaaatatctgaagagaacattattttccccttatctctctggcactcaaaactctcccatatttctagaagcaaacaattcccttgtttgggtcataaaaacaagaaacatcttctctcattattaaaacatgcagctcttccaaggtggtcactccttgctagctaagaaaggcagagttcatactgcagaagaattatgcatgagttagggctaggagttacacttgggtaaaatcctcaattactgtagcttcattaatacattcttggtgtcttactgctgagtgactgttctgaataaattttcctttcatgcatgcactcaaagaaatgacaaaattctgaatgaattagcagtcagcatccaggagagattcttcaggtcatagttattcagaacttcctttatttgtcataatgggaagaaaagaaacgtggaaatttcatagaaccacagaatctcagagttggaacagaggctagcgatcatctatcaggtcacccccttcccagatcctcttccatctgatgtgtaaatcctctctaaaataattcccctgaaatggtcacagagggttgcataaaaaattccaattgcaagggccttactaacatctcctgatgcattccttttcattactcattacaaagtcatttatgcttaactaaaatctgccttcccataggtcctcattgtcctctctagggccacacaaagtcattctaatccttcttcgaaaaaacagtcttttcaatatttaaagggatgtcacatatttcatcctgtgaaagtacgttcatcaatgataaggagactgagggctgcaaaaagtcatggcacttctccattgggaaagctattgggaaataaggacagttgggtcccattagcatggaagagaaggagatatcatgcaggttcccttcagccaccagcttcactggcttccttccttgtgttgtaccctaaactttctcctctctctgaagatgactctgccatttaccaggtgttcaagctataaactaccactgtgttacccttcacatataatccattacctgtcctaaatataccttgaatatattcacttatttccatctttatcactatttatactagtctaagctattatccttctttatctaaactcattttaattttctcatggctagtcacctcacttccatgcttgtcagtctgtattctaaattgaaaatcagatcatatcccactcctgcttcaaacccttcaaaggtttcctgctcctctaaagactgagacgaaagtccctaacataactttcaaggctctgcctctcctagtgtctgccttctctcagcctctttctgcctcttctctatactagccttgctgcggttcttgttaaataagaaaagagtaaagaaaataaatctgaggaggctgaaaaagtaatataaacaagtaatatgaagaagttattgaggaagtaaaagaaccaaaagtatgttttgtcacaagccaagggaagagatcatttctataggagaggagtgtcaacaaattcaaaggctgcaagaaggtcaaagtaagaagaagtttggcatctttgaagccattggtaaaattaccaatggcttcaaagatgccaaataaaaataccaacttttctgggcaaaaacagttagagatacagacaggttacaatgaagtgaagcaaatatagaggggagaaagcagagtaagaaaagtaggaagtatctagaaggagaagcaaagtcgaaaagaaaatctgtttgtttcttttttaaatgggcaggtcctatcaggattgaagaggttaaagaaacaataaaggagttaactgattaaacaaggttccagaagagatgagaaggtaagatcaaggcaacacatgattatgcaaaatagctagcacagtgagtcctcagtgagtaatttgaatatatgaagaagtagtattgatttttttttaatgagctggaaactagtatgtttcaaaggcacaggaggaatcagtctatggaaaagagaaggaattcttatttcatttttaagtatgtaatatacaatggatttaaataagttttctgtgaaacataagcaaatgttttaaatatttttagtaagtgtacttttaacactaaattggtatgcatttaacatattcttcatactttatttagtccctattttaaaaattattcccactttgctatgtctccccatctaatccagaattatactcatctcaacattgataaattacagtctaagttggattctgtactttcacatcttgtcttaaaggaggaaccaagatctttggcctgttgtttggatctgtagcttgacatcttgttatttcaattctaaagttgttaccaataaaatatgctgttattcacccaatatttgtagccactaactttttttttttttctttgagacaaggtctcactgtgtgtcatgcaggctggagtgcagtgattcagtcaatgctcactgtagcctggactttccagactcaagctatccaccttttttagcctcttgaatagctgggaccacaggtacatgccatcacagctggctaatttttgtattttttgtagagataaggtttctccatgctgcccaggctggtcatgaactcttgagctcaagtgatctgcctgcctcagcctcctaaagtgctgggattacaggcgtgagccaccatgcccagctaacctaaaaatgttttctttttttttatttgcatatccttaagggccaagtttagaaacagcagtaggtttatagttgcccagaaaagtcattcctactattaacaagtagaaaagtgcaagtctgattttaaaaaaaaaaattaagttacacaaagtgcaacttctgataggagtacctgttgcttgaaagagtggaaatctgggaagatggtagagtgagattttctttcaaacaatggctctgaaattgtgcatttgtcaaagatttggttaaaataaagcattgaggaccttaccagagctctcttcttactgatagagatgaattaagaaacttcccaattgtctcatatcttatttctacttactggtaatctctactgtctttcctctttagaatcccaaactcctggcacatggcaggatatttttgtgaattaattaacacatgagacatgtttttgtgaattagacaagtactcaattacttgagacaagtactcaaacaagtctcaagaattacatgagacaagtactcaaacaaaaagaaacaattagttgtctttttaataaaaatatacacactttaaaactaacatcatgggaaatagtttgtacttgtttgtttgacaagtactcaaacaaaaagaaacaattagttctctttttaataaaaatatacacattttaaaactaacatcatgggaaatagtagaaagaggagaggaagcagataaccaaggtctaaatcacatttcaggcacttattgtttagctatataactttggtcaagatgcttaatctttttataactttttatacgcttcatctttttataccttagtttacacgtctacgaaatgagttaatacaacctacttcataggactcctgcagggactaaagtgccagatacgaagcacctagcataattcttgcaacctagtaggtaataaataaatgtttcttcacttctacttcttcccctgaaaaagtataaaatgtaatttgttgctcttaaagaaatacaaaccaataggaggatatgtgtatatatacatatatatacatgttttatatatgtatatatgtacatttcataaacatatatacctatatatgtatatctacatatataggtatatatgtagattttataaacatatatgtatatatacacatatatatgcatacatatatatgtatatatacatatatatgtatacatatacatatatatgtatatatacatacatatatacatatatatatatcctcctattgggttgtatatattttatatatatctaaacttatattgaaaaagtcaaaatatgttataaccaacatactaaaatacaagtaatgttagaagatcaaaggaaagaatgctagataataatgaatttgtggaaataacaagtagtaaacatagcagaatatgcagaagtaatataaagccactattttcctctttttccttttatctttccattctacaaagttcttctataaactgtgacacttgtagcaaaatacctctgatctcttcattttcctcagcaccatataatttaacatccactgctgataataacagtcatgaatcagcacactcaaagagaagtagaggcaagtttaaaaaaaatcaactgtttcactttcctcttagaaagtgcaaactgcccttcaaaattcaagacttaagttaaaagtcacctcctctacgcagcctctctgacttcttgaacaaagccttctgtatgcttccttgtacactgtccctcacattattgttacaacagccatgcattgtaatcttaacaggctggtagcccttcagcagcagaaactgattatattaatcttggcatccccaggatctagcacaatgttttacgtataaccagaaatcaacaaacatttgttgaatgaacaaataaataaatttcaacctcttcgacttaaaaaaatatttattgtattggctcataagctagtgctaaatgatacgcctcctcaacctcataattgtttcacatttgctaattatattcctaaaagaatactgtaaactcctcaggtatgacccacaatctatgtttctttgtttctgtcaccacctcaacactaatcccagtggggacaagtacaatagcagagaatgttcattaagtactttctgactgacttatctttagaaagtaattttctgacaatgaagctagggcttcatttgtaggtagaatgtattttatgtgtatggactgggattttctattgttgaaaataaaaagctatattaatggtgactttcatttacaccattaattaaattcctttccacctcctgtcaaaaagccctgtcatgcatatactgtacttccaagttgactggtaaagaaattcatctgatgaatcacataatagtgtctgtaaaataataataaaggacacctgtgttagtaataacacacataggtagaccaaactctgccttcttttcattgtcagtttactggcacttggcaagtagctaatgttttggaatattatgcattagtatctaatccagaagatttaacaaaagatataagtcaagcaagaaaaatgaaaacactgaagacaagagaattcccaaagccaagggggaactgcaatagccatgaaaggaaggggggaggggtgataaataaatactaagaatgaaaaaaaaaataagctttgagttagaaagaacatgcacttatttttttatccagtaaatatttactgaacatctactatgtgttcatacactacaccgtatgctagggacttttaaggagctcacaattagtaagaggaaggcaaagaagtaaacaaccacaatacagtatgagaaataccactaaaatggtacttggtaacagcacaggctgctataggaacaaaaaaggacatacgcttctgttgcttgagggtcagggaacaatttccagtggtgggaatataagctgagagataaaagaactggcttcctaaaggagatcatatgaggaaaaagaaagggggataagcatgtgaagaaaaatcttggtttgttcacgggcctgagagaagtttgtagaaacagcagtaggtttatagttgctagactggtatggctagattcagatccaacctctgcctccagctacgtaacttctgacattaccgaccctttctgaatcttgatttcctatcatttgaatactttatattcatactactggcatagtaactgtcacctagaggaggcttaagggatattagttccaaatggtattgcctaagttttcttctagggtttttatggctttaggctaaaacaccaaaagcaatggcaataaaagccaaaattgacaaataggatctaattaaactaaagagcttctacacagcaaaaaaaaaaaaaaaaaaaaacaaaaaaaaaaacctatcagagggaacaggcaacctacagaatgggagaaaattctgcaatcaatccatctgacaaagggctaatatccagaatctataaggaacaaaaacaaatttacaagaaaaaataaacaactccatcaaaaagtgggcaaagaatatgaacagacacttctcaaaagaagacatttatgagaacaacaaacatatgaagaaaagctcatcatcgagttcatgtcctttgtagggacatggatgaaattggaaatcatcattctcagtaaactatcgcaagaacaaaaaaccaaacaccgcatattctcactcacaggtgggaattgaacaatgagaacacatggacacaggaaagggaacatcacactctggggactgttgtggggtggggggaggggggagggatagcactgggagatatacctaatgctagatgacgagttagtgcgtgcagcgcaccagcatggcacatgtatacacatgtaactaacctgcacattgtgcacatgtaccctaaaacttaaagtataataataataaataaaaaataaaaaataaaaagaaaagctcattatcactggtcattagagaaatgcaaaccaaaaccacaatgagataccacctcatgccagttagaatggtgatcattataaagtcaggaaacaacagatgctggagaggatgtggagaaataggaatgcttttacactgttggtgggagtgtaaattagttcaaccgttgtggaagacagtgtggcgattcctcaaggatctagaaccagaaataccatttgacccagcaatcccattactgggtatatacccaaaggattataaatcattctacaataaagacacatgcacacgtatgtttattgcagcactattcacaatagcaaagacttgaaaccaacccaaatgaccatcaatgatagactggataaagaaaatgtggcacatagacaccatagaatagcatgcagtcataaaaaagaagaattcatgtcctttgcagggacctggatgaagctggaaaccatcattttcagcaaactaacacaggaacagaaaaccaaacgtcgcatgttctcactcataaataggagctgaaaaatgagaacacatggacacagggagggggacatcacacaccaggtcctgtcggggggggggggtgggggactaggggaggaatagcattaggagaaatacctaatgtacgtgacgggttgacaggtgcagcaaaccaccatggcacatgtatacctaggtacaaatctgcacgatctgcacatctatcccagaacttaaagtataatcttaaaaagagatattagttccgtcctgcttctctcccaccaactctgcttgctatccttgtcttccctaaggaatttattagccagttcatgtgaactcaggattcacctgaccaatgaaatagctgtacgtatttaatgtagatccttttatcacaatttaaagctgacctttaattgtccaggcccagctgtttatgcggctgcaaaagttcacaattccagttttaaaagcctgcagtctaatggattgtccagtttcattcttctaatagcttctgacccagtgccagctcttgccatttagatctttactatggctgtcctttccatcttaaattccctatttgaggaagtttgacaattttcctggataaacctctgtattatcttcttttccttcataatgttttctcagttaagtgagtgtctcagatgcgcttttccttatcctgtgacatatattaatttgttgtagaaaatggaaaccatctatattgataacattgtgaaattaattttatttcttattatttaatccatcccttcctttactctctcattacaccaacacacatattgaacaaacaccatacttgcttaaaatacacataaagaaatctggcactatttctttgcaaagaacaaggcaacatcctagcaccaaatgggcttccatggaagaaaaaggcaaggaaggagcttagactctgatgaagagataaaatggaaagataaatacagttaataaaataaaagaaatgatgactgtggtaaaagaaataaagcaaaaactctggaagttcaaataaaagagcatgggatttgcagtgcactgaggatctaggaataaagcccagctgggttgttttctgcagcctcggaccagttgcttaacctctctgagttacttcatatttaaaatggatacagctccatgtctgtatggtttgagtttttaaaaaaatactgctggtaaggattcagtgaaataaaatacatgggatttctttataaactgtgaagtttcaggtaattttaatgaaataggctactacctgggaagagatactttattcaagacagtggagaggaatatattggacaggttacatacttctacacaaccttattaaagactggtggacatgggttgcagctcaattctctgactacatgtttggttttatgtacacagtacgttaaaaagagaatttggaaacctttagaagggatgtgtgcttctcagttgatttagtccccacctatttcccttctgaccaggcaagaatttattaatgttctcagatacttgcaaagaagccttagatctaccatatatgtccatctaggaaaaagtaaactctgtcctcagtctgaggacatgcagaacctatacatacacttctatggattagcctggatcaatttcctcattcttcctgttaatgttcttctttggccacacatagttttactgttttctttgttggattctacatcaaatatatatttctcttttctttactatctccttccctctaccctctcagcctccattgccaccatatttgcacccactgtattctttataagcttcagaaatccagtaactttaaataaggaactatgggtttttctgaacaatgttcgatccacttcaagtctacaaacatatgtataatattcagggctagattctgggatgtaaacaagtaattacagagcaacatggcagtgtaacaatagagattcaactaattgttatggatagatgaaaaagggagccatttatactacccgggaaggtcgggaaagctttacggaggaagagacaatatttcgggcagcccatgaatagtgagaaaattttctctaaatgagaaaagaaaggacagtatttttaggtagaagagatggcttaagcaaaggcatggagatatgaaaattcataggtgttggggagtgaattatttataattcttggtacacaggagtaatataccaagacagagtaatacactacattaggcatatacaaagaaaaatctgactaaagatctttaaaaagggcttgacagtggccagaggtaccctgcttaggattctattcataacaaatatataaaaggttactctctattacgaagcaacatcatataacataaaattgtccagcccaaacagagatgatggccagggtaggaccactcctgactcttgctgtatccgtggaacacactgctaatcaatcaaaacatttgtcttactaaggctggatatggcctcagaatcctccccagtagagatttatataaggcctataactactgaaatgaaacatatttccaacactgttgtaggttatgcattgagagtgaggaatgaccctaaaagatatattgataagccagtagaaattatttcattatacctcacatttacacatgtagagcccaggaatgcatttctgctatatttatcttggactatgtccatcagtgactcagaatggccctatgctttgggtcagagagtttggacactaaatttatgagagaaaatgacaagcttcaatcacaccaaattctaaatgtagccaaaaaccacataattaactgcagatttttcaaaggtaacagttattgattttaaattaattttaagttagcccacactgcttaacaaaagtatcctaacacaacaaatagcatagacaggctgcatagaacaaagccccgaaaacaatcttcaatgctcttatatgtgaattagccatcaaagctgaaaatgtttggaaaaaaatccactttcacaagttgattaaattatttccttcataagcataaacagtttagagaagaaaaacccaagactgattgctcagaatctccagggtaaaagaaacaaacacatttttaaaatcttcagcctcacaaggtatcctttgccaaccccctaaggagcaaccttagaatctgctacaggctgcagcagctgcctgcccactttctcagcagcaagaaatatgctaagcagtgattatcaacagggaagaggatcaaaaggttgagggaatgattaagcaagataccatttcttctaaaaaccagtttcctatagaggttgtaaatgatagaagccagggtaatctcaaatttcaatcaattacatgtgaaacacatctattctgtgctccttctgtgggagctcccactagtgtagtcttctgacaacaggagcagcatcaaagccaaggtgatttgctgctggagcctgatcaagtatgtgtctgtcccttccaaaccattaaaaacaacaacaacaacaaccacaaaaaccacaacccacaaacccatgtgaggagaccaaagccaaagccagagccagattctcagtcttccttgcaaaaagcttgtagtaagatttcacttggaagttatcattggtacaagcaatgttacactgagggaaggcaatgacttgcagaaaagaatcagagtgcgaggaggtgtgagatgtagaatggaaatccctctcaatctgcagatgctaggtagagtcttgtcttgctacttactggctatttgagcctggctatttgagcctggaatcactgctaacttcactgaactacactgttctcattggggtgaatgaaatccatttcttgctctatttacaggatagttatgaagaaatagaagggagggaagattataataactgaagacacaacttatctcatattgtctcatttaatctttattataatcctatgcggtagttataccatttttttgaaaaaagtgaagaaacttaaaaagtgaagaatccagagaggctgtgaaatgtctaaagtgatagctgataagtggcacgagaagagttcaagtcttgactcaaaagttaatattcttttctctgtgttatatctgtctttttagactgtaacatttttaaaggcaggggccatagttgtatttttcttgtatcccttgcacacattcattacatagtaggtaagcagtaaagattttatgaataataaataatgtctttaagtatataaactggttcagctcagtttagctaaataaacattgagtatattttattgtcagacaccttgtttctaactgggagctagggattcaaagataaataacagtcatttccggccctcaagggagtcacagtagagtgagagacacatacagaaacaaaatcaaccttccacaggttttagttttatcttctgaggtttcagagaattcatgaactcctatttgaacacgtgctggaagtgtctgaagttacctctctgctagccattggcctcactcagagtgggagtatggactcctttagcttgttgcagagaatgagccatggtgaacagagacagttgttttcggttcccactttggaatttccaggtaagtaatctttgagtctcaaggttcaagttttggaaggtatgaggacccaaatactcaccatgcttctaaagctagcttttctgtctctagttagcctttgttttttaaggctaaacatcagcagcattattagaacaaagaagagatttgaacaaagtaaaaacttacagaggattcaaaatgcagggaattagaaaacactgccaagcacagagtaataataatacggccacttagtagaaagaaacataggtgtctctaggactaacatgggcatcaaggagactcttatgctgacaaatcctgagaatgtaaacacatcaagggtaccagagtaaacacaaaattgtcaggaccttgtttcataataattatggggccggacgtggtggctcacgcctgtaatcccaccactttgggaggccaaggcgggtggatcacgaagtcaggagatggagaccatcctggccaacacggtgaaaccccatctctactaaaaatacaaaaaattagccaggcgtggtagccggcgcctgcagtcccagctactcgggaggccgaggcaggagaatggcgtgaacccgggcggcggagcttgcagtgagctgagatcgcgccactgcactccagcctgggcaacaaagcgaggttccgtctcaaaataataataattcttattaataatatattattatatattaataattatatttattaatattttattattatatttattaatatattatattattattattattgttatggaagcatgtaactatcatggccattgaaggtttattttattaggtctcttcctgacctagacagagtatccaataaggctatcaagtctcctcttgttcaaattcgaggcttgccaagaaatttgcagtagtaaataagtaaataagcctttttaaacatatgcattttcttaaacacatgccctttgatctattcagtcagcaaggtcattctgcattcattgcttcaagtaagagatagttccaaaacaaacaaactgggattcaatttttggcttttgagttttaaaagtctatttcgtaaccagagaaacagaaataactccctgtagatttgggggaatatgggatgagaaatgacaacttttcccacctctgtaaaaatctcctaggctaggaggcagttgacttttgaaaggaaataggagtgtgtagatgttgtaaacatctgacgaggcaggaacttctcagtctcagcacaatgatgagtcgggcagacacagacccccgacatagactcgtaggattcattcacagaagagatctgtagctcagcgacgttgccaatatctcagacaaaacaaatgactacaaaggtcatttactaggaaaacttgataacaaagtaaaatttactagcaaaatttatcagcaaggtgctgggcatatagtacaagcaaataattattgaataactggataaagtcatatctgactatactatgagttttcaaattctacagctggagaccaggctttgacaagagtgactaaactatgtcaagctagcatattgttaataccccctaaaggatgtgatatgaaaaattttacatatctctaacaaatgttatcaattaagaacaggacagagtaaaatgtacatttaggttcctacttgcctatttgttacagctgctgtaatatcactatttctctgcatctggcttatttctaatctgtccacaatgcacatcatacggaattgaacatacaagtcactgatactgttcttatttcttttctgggctttataggctggaaatagtcattacgtggtagctactgagtgatctgtggtgccatggaccttcctatttagtaagaggcttgcttgaattttagaatatcagatgcaacaggcggtacctaatggatagctggattcaatggctgagccttttactgccttcacatgtcacgggcaagatgacaaggatgagttaagatagttctgtttcatgccattttttaaattagtgtggctctgtcaatctctgaaaggttgaaccttatatataatcaaagtgaacaaaaagcttcttcctcttcaatttgaactaactcagctatggaatctacaaatattacatattttatgcatctgatggacaacctaagcatgtagagaagatgctatataaatcaaaagatatattaaaggctcctgacaaaattgccactaagagaaaccctacaataaatcattttgtataacgattttctccatttgtctcttctagactatactctctgaggaaaggggctgtctcttctcaactcctgaacttcagagcccagtaccacgcctgggttggtagaggacgaataggcagtggttggtaataaacctaaataaccaacaactaacttatgcaatttgtgaatttaaattaggtatttcagggttttcctaaactagaatacttaagagtattttggaatattcccttccgtttggcagaaaatatgtttttggaaaaatgccagtggagatgtacatgtgtcagcacaaagatggaaggactcaattccactggcttcctggtttattgcatgggtttttgaaaacataaaaggataacccatgaagctgagaaatacactaaatagagcaggttttgatgaaaatatattaagttcaatgttgtacatgcaaagtatggagtacatatatgccatcaaggtggacatatagatttgtgtgtcattagcatcattttatgcataatatgagtgaattacatcacccaaagagaatagataaagtgtatccagccccgggaagagcgatgttttagcagtaagtggaaaaagaggagcctgtgaaccaggatgagaacaattagagatgtcagaggttaaattgaaaaacactcttcctctcattttctttccagcaagatcctgttattcttcaagcttaacaagtgacctagaggaagaaaagactaagatattccaactggttttttgaaaaggcctgttatggttcctttcctccccgattaataggattatgagagaatgacataagaatgcttttttcttaagagaaaaatgcctattttaatattattcctattgatcacttctgaatcactctccaagtaactcgcaatagctgttgacaatgaagaagtgaaatgccatacagatagatgggcatatgtgtgtcttcctgcctatttacatatattcatcactgtgtacataatacacacatttatatatttacatatacacataccttcccacttagtaacatgaactcttttgacccttcctatttgtagtgtgacagaatataaatgtgatcaagttcagactattaatatcatcctcttctttcaggggaagacatgcccatgacagaagagattattacagtttttggacctgaatttacaacaaaaaccaaacaaacaaaaacgaagtgaactaacatttattcagaatctattatgtaaaagaactgttctaggttcattatatttattatttcatttaaccatccttttacaaaatgcactggcattgtatgtatcatgattgcagctaacaaataggaaacagccttcggaggataatggctgggacatgttctgtttcagatatgcctcttcacacttttctctgccttcaactactcaatttatgggcataatcactccaaacttaaagacaggccatagatttccaacaccactggtgcgtatgagaatttacagtggaacttctgaaagctactcagacccttttccaggcttcctgcataaggatctcagatagctccctagaatcttatttttctaaagaaccacaagtgattctgatgctgagtcagtatcggaaatcactggctgtggtgttctcaggacttccagaaagcatatgacagtgtggtttggaaagccattaaaactatagtggcttaacaaccttcacaacctattacccagattctggaagtttggggaccactatttgtaacataggctttttgtttgtgtgcttgaaccttgaggaaagctatagtgaagcttgaggaaaccataagattgttgctaaataaccaaagggatgaagaagactcttaagtagacattaaaagcatatgattttttaatctgcaaaaaagcaagctgaaaagaaatataattgggtataaacattactggtgggatagagaactgaattagattcatatgctctgaatctagtatataactacatcatttcattgtttatttatttatttatttatttatttaatgagacagagtctcctctatcgcccagcctggagtgcagtaccacgatcctggctcactgcaacttccgccttgtgggttcaagcgagcatgtgcggctaatctttgtatttttagtagagacggggtttcaccatgttggccaggctgctctcaaactcctgacctcaggtgatccgcctacctctgcctccagcagtgctgggatttcaagcgtgagccaccatgcctggcctgattaagatttaagttaatctaattaactcagttaatgcagtattttaaatgttcactaacaagtttatatcctatctaattcctctgaaggtacatttacttttctttaccagtactcgtgaatacatggctatgaatctgtactgatcaggtattggagtgcactttatgctgggaaataatgctactgactcatcattagtaagggcatgtgttcagatttgctttctcaggaatggaagtagattcctattgtttcatctttactctttcaagcagtcttattattgtgctcctcagtcaatcttgaaaactaactagccaattaattagtagaggaatataaaacaggcttgcaaagggattcattcccttataaaacatcattaaaacaccagccatgtgtctgacagtgtaataggcagcatcagtactaagaaaaatgaaacagagtccttgcccttgaggatcttaagggtagtttgggagatagtcatgtagctagatcaatacaacactgtggaatgctataatagagttgtacacacaatgccctcgtagcaaagtgtaagtattgcccagttttattaaggaagtcatcaataatttcacaaaagagataacatttaggttgtatcttgaaagttgagttggatgtgcttagttacctctaatctttgttgctttttagtcagctataatgtgcccgaatttcacatgtaagcaaggaaaaccatagtctcacatttttaaacagtcttactctctttacagtttcacaaggtaatttctattagatcagagattgtaatttaagttaacaaattatgcttcacatttgagcaatgatggaaacttaattaaagacactaactataagcaactgcgatacatacatggctttttatgtgggaaaaatcaagaccttaagtgaggcaccaaagagaaaaagacatgctacaaatttttgtttctggactcaaatcctacctgattagcatttttagaaatatggaattgttacatctatttcacatggtagacagaataatagccctttcaaagatacctatgtatcaattgccagaacctttgactattcccttacatggcaaaagggatttcatatacgtgattaagctaaggagcttaacatgggaagattatcattagcttgggttatccaggtaagcccaatgtaatcacaagggcctttataagagggaggtaggagagagtcagagttagaaaagaagatgtgatgacagaagcagaggttggagcaatgcactgtcaaggtggaggaaaaagccacaagcaaagaaatgcaggcagcctctagaagctggaaaagacaagaaaacagattctctcccagaacctccaaaaggaacacagccctgctggcaccttgattttatacctgtaagactcatttttgacttctgacttcaggaaatgtagataataagtttgtgttgttttaaaccactgagttgtaattcattacattagcactaataactaatatatttaccaaagccttgaaaggataactagagcagtaagcatgtaagtaagtaagcatggaaagccatacaatcctgtgtcaggtatgccaattctacatgagagaacaaagatttcctgaaagattagggagagagttactcctgatcatcactcaggaattttgtcattttcagcaaagctacagcatccctgctcttttccttaaaattttcaaaaaccgtgttgaggttcattgagcaataataccctgcctttaggctctttaaccatctttcctgaaaataataacttgaatcttaacaatctattgataagccaactgctccttatctgaataaaattagcagatcaactggaaactgaaagatgactaatggtctaatgacagtccacaagatatggagcggaatcatttatcatgatggtcaaatctgaacgacatcacccttcaccttactgatcttgcatataaagctcaaagaaagtgtcaaagcacaaggaaaaacacagagattaaaaaccctaggggaaactaaaccctcacatcttttgtcatttttcttaggaacaaggatgtggatgaaaattattggtctcaacaacttcaccaccactggcaggtgtcttagtttgcagaaaagattgttggggcataacacacatgagggtattaataaaatcataggatcctatgaggaagtacctttatgagaatcctgactatcttataaatagtcaaggaaggcttcctttgaagaaatgtgaattaagctgacaatagaataaaagtagaaaatccttgggagaaagagaggcagaatattccaaataaggcaagaagcatgtgcaaagattctattatgggaaggagcttgataatattcaaggaactgaaagaagagcagtgaggctgcagtacaaggagagagagagggattggcctgagataaggctggcagggggtaatcacccagcattttgtgggctatcattaaaggttatgaactatctctttaaaatgaaatgctgtcaacaactttaagtggggacaaattgtggtaagatttatctcttagaaatctcactctagcttctatgtggaagatggattggcatggaataagaattgaatatggagagactagttagcaattcatgtgagagatgattccttgaattagactgatagaaggaaatggagattgaaagacatacataagaaagatttaggccgagcactgtggctcatatctgtaatcccagcacttccggaggccgaggcgagctgattacctgaggtcaggcattcaagaccagcctagccaatatggtgaaaccccgtctccactaaaaatacaaaaactagccacacatggtgtcaggcacctgtaatcccacctacttgggaggctgaggcaggagaattgcttgaaccgggaggtggacattatagtgagtcgagattgcaccactgtaccccagcctgggcaacagaccaatacttcatctcaaaaaaaaaaaaaaaaaaagagaaagatttaggagtcaatattgactgatgcatgaaagctgataaggcagaaaagtgagtcatggtatctgacatgaccaaatgtcaaatgatggggccaattcgtgatattaagaatgacggaggaggggatttttcaataaaaaattataaacttagttatggatacattggtttaatacttttgtaaggcatcaaagtgaaaatgctgagaaggcagttggatatataggttaagagttcagaatagaagtttcagtggcagatacaaatttggggtaaaaagtaaataaatgataactaatttcatgcaaagaaattatcccaccttgggagaatgtttaaaataagggtactgaggccctcatctacaaggaaaatgtacacatggacatgactaaacagcctattaggagctcaagggctttgaatccaatatgaattcttgatttcctggtggaaaaaaaaaaaaactccactgatgattcttcatcaactatgtacatcatggttttcctttctcccaccaaacaatcctatgttacctcacatttcctaattcactttaggttttttgccattattacctatcatcatcaatcaagaagatagcaatatttttcattgttgctgtcatataagatctaaaaagaggagcaactggacctcaataaaagtagaagaaaaatcttatttccttctcctttttttttgagatggagtttcacttttgtcgcccaggctggagtacagtggtggcgatctcagctcactgaaatctccacctcccaggttcaagcgattcttctgcctcagcctcctgagtaacgaggattacaggtgtccgccaccatacctggctaatttttgtatttttagtagagacggggtttcaccatgttagccaggctggtctcgaatgcctgacctcaagtgatccacctgccttggcctcccaaagtgctgggattacaggagtgatccaccatgcctggcctttcttccccttttcacttgcgttattattactgttattattctccttgacattttccagaattctatgttttagatgaagcccttgaaaatgagacaagttaagcaacttacccaagaacgcacagctaatctaaatatctctttttgatatagcaagctgtgagctccctgtgttggctgataagaaataaattgtttggaatagtttcagaaggaatgataccagctcctctttgtacctctggtagaatttggctatgaatccatctggtcctagacttttttgattggtaggctattaattactgcctcaatttcagaacttgttattggtctactcagggatttgacttctttctgatttagtcttgggagggtgtatgtgtccaggaatttatctatttcttctagatcttctagtttatttgtgtagaggtgtttatagtattctctgatggtagtttgtatttctgtgggatcagtggtgatatcccctttatcttttttaatgtgtctatttgattattttctcttttcttctttattagtctgggtagctgtctatttgttttgttaatcttttcaaaaaaacagctcctggattcattgattttttgaagggttttccctgtctctatctccttcagttctgctctgatcttagttatttcttgtcttctgctagcttttgaatttgtttgctcttgcttctctagttcttttaattgtgatggtagggtgttgaatttagatctttcctgctttctccagtgggcatttagtgctatcaatttccctctaaacactgctttagctgtgtcccagagattctggtacattgtgtgtttgttctcattggtttcaaagaaattatttatttctgccttaattttgttatttacacagcagtcattcaggagcaggttgttcagtttctatgtagttgtgtgattttttgagtgagtttcttaatcttgagttctaatttgattgcactgtggtctgagagactgttttttatgatttccattcttttgcatttgctgagaagtgttttacttccaattatgtggtcaattttagaataagcgtgatgtggtgctgagaagaatgtatattctgttgatttggggtggagacttctgtagatgcctattaggtctgcttggtccagagctgagttcaagtcctgaatattcttgttaattttctgtctcattgatctgtctaatattgacagtggggtgtaaaagtctcccaatattattgtgtgggagtgtaagcctctttttaagtctctaagaactgacttatgaatctgggtgctcctatagtgggggcatatatatttaggataattagctcttcttgttgcattgatccctttaccattatgtaatgcccttctttgtcttttttgatatttgttggtttaaagtctgttttatcagagactaggattgcaacccctgcttttttttttttttttttttttgctttccatttgcttggcaaatattcctccatccatgtatttggagcccaggtgtgtctttgcacatgagatgggtctcctgaatacagcacactgatgggtcttgactttttaccgatttgccagtccatgtcttttaatgagggcatttagcccgtttatatttaaagttaatattgttatgtgtgaattaaactaaagagcttctgcatagcaaaagaaactgtcatcagagtgaacaggcaacctacagaatgggagaaaaattttgcaatctgtccatctgacaaagggctgatgtccagaatctacaaggaacttaaacaaatttacaagaaaaaaacaaccccatcaaaaagtgggagaagaatataaacagacacttctcaaaagaagacatttatgtggccaacaaacatatgaaaaaaagcttgtcatcactggtcattagagaaatgcaaatcaaaacacaatgagataccatctcatgccagtgagaatggcaatcattaaaaagtcaggaaacaacagatgctggagagtatgtgaagaaataggaatgtttttacactgtttgcgggagtgcaaattagttcagccattgtggaagacagtgtggtgactcctcaaggatctagaaacagaaatgccatgtgacccagcaatcccattactgggtatatacccaaagaattataaatcattctactataaagacatatgcacatgcatgttcattgcagcactattcacaatagcaaggataaaaacccaaatgcccatcaatgatagactggataaagaaaatgtggcacatatacaccatagaatagtatgaagccgtaaaaaggatgagttaatgtcctttgcagggacatggatgaagctggaaaccatcattctcagcaaactaacacaggaacaggaaaccaaacacttcatgttctcactcataagtgggagttgaacaatgagaacacatggacacagggagggggacatcacacactgggtcctgtcggtgggtgggtggctaggggagggatagcattaggagaaatacctaatgtagataatgggtggatgggtgcagcaaactacatggcacatttatacctatgtaacaaagctgcacgttctgcacatgtataccagaacttaaagtatagaaaaaaaatccaaaaaagaagaaataaattatattcagtcattgtggaaacagatcttctctaacagaaaaatataagtgagctacaagacaacattttctgtatcaaattagaagacaaggataattcagttttttccattgacttactattttttgaaagatggtttcaccatgctaaagcctgatatttgccccctgtggcaaagcaaggactagaattcctgtttgtctagagactggaagcaaaattattgtgtggttgaggtaggattacatttgtaaaatatgaaattgctagatcttctctgctaatcagcaggggtgtagagcttcccacaaagtaatgagaatgagtcccccactaaactatagttgtgaagcatttgtgttccttcaggctgtacatctggtttctctagcttcttagcaactagttgtaatggccaggagcttctcggagtctctgtcaatcactctaatggctgcaagtcaatcaccaaagataagttgcttctttaatgactccataaaatacctactgctcacaaacaggataaaatttctggttcaattagactcttagaaatcaccaaatatttattgagtgccaaaaccccatgatatatttaacactgtagactactaagaaatataagataattcttggctttcagaaacttacaatttagtgatagctcaaaatgattttacaaaactataggttggaagggcatttaagcttatgtattcaggacagagtggttagcagggacacttgggaggaggcctgatctttgtttgtgtgtgggtggtattccaatgatgaagatgtcaagagacagggtcagaggaaaagcacattttcagtctgattaggaatgtacaatatggttttgggatgttgtaaggcaggatggaggtctgttggtatgaagcaaaagtactggtttttagggctaggacgttcaattgtcaataatcattatctgttggtgatacctatgactgcctgacagtatctcagaatcatatgtatgtcatctatcaaaaatagaggaccactactgttcatttattacaaagttttaaatctatgaggttcaaaatacattttgatcaaagtgtaaaagatatcaagctccgctaatcccaacttcttttttgtggcagtgaattctggcacttaaatagacaaaaacgcagcctagcataatttatactaacagatgtttctagaaaaattccaaatcagtgacagcctaggaaaataaccaatttcaaaggctgttaacaagcaagctggaaataagaatagtactataaagtgattttttaaaaaagcacaagaatcatactattaatatgaatcacttgggacaaagagatgatgtagtagtcatagtgaatgagaataaatggaggggaagcatctcaccagacagagagatcaaatactggagaaagaaatcaccatgaggatgcacaaggataaccctaagcctgactaaggaaataagcaggaaaagtaaaggaaggaaagttggctctcccctgcctacaaaacagagccagccttcattggaattgagagcacacttaaaacatgaataatttccaactgggaatctgtattgaaacacagacattaaagtgcccagccaccgggtgacttatttcagagccccttcctatgtcagtcaccatacacctagcaaattaaatggtgcacaagtttagagctggaacagcctgagacatggttgctttgtcccgaatattttgaaaggtatatttttcacacttccaatttgaataaatataaaataattaaaagataaatatatggccttgcagatgcttatgctacagatgatgaagattctttgaacaaataagcagtatgataatataccctatctcccatgttataagtacttcaaatataacatttccttctttcaaagtagaatatctaacaagcttaggacatggtgtagctgaaattttaaactttggcatttttgtacataatagtcaactgtgttcagaatgcttattgcattggtattggttgacttttaggagagtacacataaaaattcaatatggtctaagctctttcaataatttactatcttttgacttgtactgtgaaataattaattaaggaaataaatcattcatttattcatttaacaagaatttgttgagcacctattatgcaaggcatgtttctaatagtagggttacagagattaaaaactaacagatctttacgttttcgtgggtcagatataattgtaaataattatacgaggaatgtgagatatatcaaaaaataagactgtagcatattgtaaccaaactgaaatatagaatttgtcatcatattttcaaactaacctaccagtgttggaataagtgggggacaacaaaaattagtaagtgcctgctgatcagacctggagatgtgacctttcccatgacatttgcaaagcctcctattatctcttcctgataacaggttataagatttggttttgaaaatattacaagatgtaactaattccatgttctccatgtcagcttcccaacagaagggaatggagttcaccaagacaagcaagtttcatgaatttctctttgccaaatactcctcctctctctcaggctgaagccaacaagggagatcacagcctgatcactgacttagacttgaagcatgttgtaggaatcccagataaataacatgtctcaaaggcaaaagccaccttagtcaacccaaaactggggtgccaattcaaagggtccagtatttcttaacgggggtgctactgacatttggggcacatgattgtgcacaattgtctcacaccctgttggatgcttattacccctggcctcctctcactaaatgcccatagctttccccagtcattgcaacaaacaaaaacttgaccaaacatttccaaaaagtgcctagggggattgcattgcctccagatgtaaaccaccattcaaggcagactgtgatactgtaatgatgcctggtggagaaatcagaaaggcagatggtaaagtaataaagtaagcaactggaagtgacacaaagaaaccccaaaggctgtaggcctacacctcttataacttttaatgctatcctgaactaggttagccccaaatgctgtccaggattaattaaagtttcaaaaactcagcacatattctaccttttattctgtttaaagttcttaatatactttcaaaatataattttaaaatgtttgctttaattgatttgtggctattgttctcagatttgagttttgctaataggatgctggtcactttatggaattcttgctgattctaaaggaattattttaatccttgaaattaaatgaaattactactactctaaatctcttgtccttaaatgagacagtacaccttctttaaggtgggagatcactataagaagaaagaaagctgtgtcaacaccaaactttctgaaggaaatgtaaatcatactcccaaggcacagcaaatgtcaagtgcctaggaaaacaggttcttgtggggaaagggtttgtgacttaaacaaacaaaaggcaaaaaagaaaaaaaaatgccgtgtgaggacatgtttattttcttctggaatcggggaaagtttgggattttcttttttctcccttaagaagtaacaaaacaagccttctcctacaggtgttcagggcatgaacacttacactaggaaaataaggttaagagaacactgatagggtcatttgcaaaatgtagtaggaagaatcagaggagagttagaaaaacagcaccagagcgcccctgagtcatggagataagagaaatatctactcactcttcttttccagtgattgtgagagatttgagattggactttggaatctgcagccttatttttaaaaatgttttcggtaaatcaaatctatccttattcacttacatgaagtaatgtaagggagatgggtacattctgtgtgcctggatttgtccttttggggcaccagaatcttcattaaaaattaaagaatccttgtattcagatgagtcaacctagttctgtagtagaattttcaacagttctttaaagcctttcttaagatgatgaaagttttagagaggatgactaaatccacactcctaagtgagaattgtatacagaattttcaataggaatttgccatttgacccagcaatcccattcctgggtatatacccaaaggattataaatcattctgttataaagacacatgcacacgtatgtttactgcagcactattcacaatagcaaagacttggaaccaacccaaatgcccatcaatgatagactggataaataaaatgtggcacatatacatcatggaatactatgcagccataaaaaaggatgagttcatgtcctttgcagggacatggatgaagctggaaaccatcattctcagcaaattaacacaggaacagaaaaccaaacaccgcatgttatcactcataagtgggagttgaacaatgagaacacatggacacagggaggggaacctcatacactggggcctgttagggggtgggggacaaggggagggatagcattaagacaaatacctaatgtatgcggggcttaaaacctagatgacgggttgataggtgcagtacaccaccatggcactttatacctgtataacaaaccagcacgttctgcacatgtatcccacaaaagtaaaaaataaaataaaatacatctacatgttgaataattttaaaaaacaaagacattaaaaaaagaaaattaaaaaaatattgttcacatatcaatctccattcctccacttctcctcactaattactgacaatatcccttcacctgtgtgggtagaagaaaaattctagcagttcaaatccttggcctaaaccatcattgctaaaatattcactttttaacttccaagaagttagttaaatcatattctcactcaaaatacaagtaatttaaatgagtttttatcagtgagtttcttctggaggctttgtttctttcattactctcagcagcatgtaagaagcaatagggtgatactaaaatggttttgtctaacctgaacgctgtgtgtctggatcttcattcactctgtggaatctgtattctatggaattttaagtccttttggcaggaaattgtaaagtgaacagaaacatgggtcccatgagacttcttgtgccaaaacactatgcattatcctggtacctttaagtccaaagagaattgtttaacttcttcattcttaatattatgttgataacaataacaaataaaggattctaagctactcacacatgacatataaattaaagagtgttttttgtcacccaaagtcaaaacacaaattaggatatttactctcttgctttccgagggtgatttctattgctgtagacaatttttagagaaaataaaagcttttaattttaagtgacctgatagtctgatgttagttatctctgttgagcattttctgttgaagataggctcactttatctttaggctatgaggtcttagtgtgatggatttgtctaaatgtaaaacaaaacaaaacaaaacaaaactatggtctctaagtaaccactaaattctgatttataaatagaaggctaaaaaatgaagggtgatatgctacttgaattcaattaaaaggaactaaaaaataaattataatattatgcagaagcatcctcagatctatttaagtatttcagctttatagtcctaaggaaattcaaaagcagtgacagtaatgggtgaccattcaatgtaaccttgattggacaactttgactatacaactaacttcagattaatttttagtgagagtttttaaattgctctttgtaaggtggacagtgatgtgagtggtccttttagaagttttttttttcctgatctcaaccactagtatattttattttcattagcatatccaggggatacagtattgccttcttatctgcagattctctttccacaatttcagttacttgtggccaaccatggtccaaaaatattaaatgaaaaattacaacaataaacaattcatcagttttacattgtgtgccttttgagtaacatgctgaaatcatgtgctatcccactctatgccacaaggaatgtaaaatgtccctttgtccagggtattcacactatataaactagctgcccattagccattaacattgtctgatcctgacatctaaccaacaacatcatcatggcttgaagatccaggatcacctaaagctatgtcgcaatgcctgcatcactcacctcacttcttcttatcatacaggcattttgtcatctcatatcatcacaagaaggttgaggactactgtaaaatggaaagcatatccattaacctcacagagatcagtaccctggcaaaggttgtttgcatactggaggacaaatattttatcgtaaagaacttagaaaactttcaaaaatgttttggtaacaatttaatgaaccagaattttttaagcatctaatgattttctggcatgcacaaaggtatgcacattaggaaagcaatacagaataatttttttaagagatggggtcttgctctgtcacccaaggatagattgcagtggcatattcatagcttattgcggcctcaaactcctgggctcaagtgatcctcctgcctcagcctcccaaagtgttgggattacaggtgtgaggtaccatgcctggcctggaataatgttttgtaatgttttatagtatggaaatcagagttggaaataagtgactttaattcttggtcctgcatattactggctctgtgaggtcaggcaaaccacttagttccttaaagcttcagttttcatacctgcaaaatggagattaaaatacccatctcataggataaatgtgtgtagcacagtacctggtgcatagtaggtattcatgaaatgtggctcccgctataagcaatgaaaaccagcaccaccttaacattgacccttttaggatacaacgttccaaggaaaagtttaattttgcactggttagaaggaatttcaaatcattaccaggggaaaagtgtaaaaactgcaagataactcaataatattgagttattctcaatagatacatgaaataatattctacttggaaattcaattaaataagctccacaaatgtttattgaatgcccactattcactaggtattgcattgggttcaggagatttaaagattagttaagacagggatcttgtttccatggggcttacaatctcatgagggagatagactcacaaacacaaaaatcccttaaaggagtttcaaagaaggggaggcaacagcttaacctgggaaggtcaggaaaagctttgaagaatggataatactgaaatataagctaggtttagttgctagagtgtaacaggttttctttatcatcaatctctgtcaactgcctcatcctctgccacaaccccaagatatttcctagagctactttcaaattttcatgtcttttggggagcagaaaagacatatgcttattgattatcatatttatagaagaaacaacaagatcattttctttactgttactcattgtctaccaatctattatggctaatgaatgagaagaaaaaataaggaagatgtttagagttattttccttaaagggagattccacatcctgtgcctgccttgggaagccttgaagaaatgactatgcttacccacaaacatctcttggcaccactgtcaggtttgagtggaccacagccacaactcatgagatcatttatatttgtatattcgttgtgtataaacttggaatttatctaaaaatagcacattagaaggtgcaaaaccatttaatttgccaagtacttgtcataaccttaatgaagcagttcacttggttgggaaccaataataacatagacaggtagaaaacacagtgatcaggtgaggacatgaagaatgtttgacagaatgtatttatttctgttcatcttcacatgcaaccttgtcaaacacggtcaaattttcaatgcaaaagattaagcatgctaatgcataattctgagatacctattttaaactgcaggttgcatgaaattaatctttttaaactactcatcttcaggagttctcacccttctatcaaagtagtatataagctcagattctcattcagattctaattatatcaaacaatcacaagaatgctactaaactgaagagattctctctctgttaagggagaagtgttgatgtggacttgaaactatacagtcacttttccttttccatatattttcagttatacaatgttaaattcatactttaggttctgatatgaaagagatacagagcacctttaaaaagacactgaaaagcaccatctgttcatgctcaaatcttgaagaaaaaatttttaacttgttaatcataaattgctctacaaatagtatactggaaacatccggatgtgaggttataattaaaaatgaaagcaaaacagcttccctgaaaagaaagaaaactcttaattcaaacctaccagatagctgatttatgaaagtgaaaatgctggcatgtatagatattgggaagtcttgggatctggattttatcactgaccatctggttatagtcagagtgaaattttaaaatagcaaaatattcattaaaagcctgaaagaagctcataacaactgacatgccacaattagttatatatccatgtatccccttctgatatcaattatgtcagtttccactggtgacatcacgctaatatttgatgacacataaacgtccagtccacttaattaggatcaagagaatgggcatcaaatgagtatttttccgtcaagctgtggaataataatactttatcaagtaccaccttttgatccctacatgtgggaaaactgaggctcagacagttaaattacttgcccatagtcacatttctagagattgggagaggaggaaatcaaatctaggtctatctgcctccataccgtttcttcacaagaagagactatcgattccctgagctgcataatgggatttgtttgttcctttcagtttcctcaagcatgaccactacatctgctgtaactagtatccacaattacccagctgcatttaactaatttaaagctcctcataccaattcattacctcaaaaactatttgagagttgaagaagtttctcagaaataatgttgtaataaacaacaacaacaacaatactgtggccctctcattgattcatattttcttatttatcccttctccatagaacactgcaaattgataaacaaacagaaatttctctttgtgatagtttattttacatgtcaacttggctgggctaagagatgcccagatagctgataaaacattgtttctgaatgtgtctgtgagggtgtttcggagtaaattagcatttgaatgagtagaatgagtgaaaaagatcgactctcaccaatgtggacaggtattatccaatcgattcagggtctcaataaaacaaaaaggcaaaggaagggtgaatttttgctctcccttcttgagctgggctatctatcttttcctgccctcagacatcagacctgcttgttcttggtcctttggactctaggacttaaaacagcaccattcctacttttcagttcttaggcttttggagtgaaattgaatgataccattttccaacttgcagacagcaagtgatggaatttcttggcctccataatcatgtgagccaattctcataataaatctctttctctcctttttatatatctcctattggctatttctctggaaaaccctaatatactcttgttcatatattttgttacttttaaactcatttgcatctcaggcaaaaaaaaaaatcttttcttattagcttctatcctccaatttctttccctatctccaagaaagatcactatcaaccctcttcttccttcattctttccagagatgtcaacccatgttggctggttctgctatcatctaaatcattctgctattactgtggtcagtggggaggcagaagtgataagcagcaaatatacatcatctagaacttcagttctgacccactggcaaagcgtcttcaccacaactgaaaaggttctgaggtagatctgggtttattatgaaagattgacacaattgaatattaatgtcttccactgaagaagaaaggtaatgatacctatgtcttatgttttctatccttggcataaggcctcaataatctcaattcaaatccaaaagttttcaggaggaaacctctggacacattaaaatctcttaaacttacagatatttatttagaccttttcatggagtctaccatggcttatcactgacaaacggacaaagaaatataaaggcacgatcctcatctctatagttacttaaaagggcaagacaaactctacagcattatggattgttaagcgctaggtaatagcaaatagaataaacagtataagaatgcattagatgataacactactgagggctgtaaaaatctctgaaggcttcatggtgagggggagatttaaactgggccttaactgatttgcaaaactaaaacaagaagacaagatatgggtgttccaagatagagtgggaagctttagcggtggtatttggggaaaattaattggtcagtattcctacaaacaaccattactacagaaaacagacaacagtatagacaaggaactgtctgaagggacaaaagtgaaatgttcagcagggtaaataggggatggtgtgataatgataatttctttgattatagctatctgctaagccctgtgctaatttaattttttaaattaaattaaaactgcataattcagagataattattatcgctttttcttatcagaaaattataaacagttgaggtcttccaaggcaaagcccttgttgttacccatcatgctgagggttagttcaggtgcttgcgcaatggcatgtacatctatctcctttgttttgatacatccatccttgactcaggaatagacctagagacctacaaaagtctcgagtttgccaagacacatggcagatgagggaacacaccactgtggttccctcaggaaacagattctaatctggctttacattttccattgtaatcttgagatgcctcatagtcaaataatagttcctcagtgaaatatatggatagtcatatgatagtagaatgaataaagaccttatatagctacttggcatttcaggccaagttttattgacagactagtttgctacaaacttatgaaaccctttttattttctagatggcaaaatgttaacaattaggggacctgattgaagggtataaaggattgattgaattattgttgcagtttttatctaagcttattttttagtactttttggatattggaaatgtggctaagagactgtggacacttaagcgttcaataactgttagttcccttctcttgtgctgtagaaaaagtacaaaaggtccaagttacctctcagacatcaggcagatgattaattgtactgtgaagcggtcaagtcctccagaatactgcattttgggaacactgattagtcatattcttataagaattgggagctgccatttttaacagtttgaataagaaagttgcattgccaattctgtacctatctgatatgttctctccccggaggagaagaaacaggccttattcatctccccctccccaaccctaaacattcttcccaagtcctgaatatgcctgaaaagacatgtcattatggtttttcctgtggagtctagagttcccccacctgcaccctactgaagtcattcataggaaaaggcaatgacagccagatcttgacagatcacccctagcacagtttcactgtgatcccacaggggctttactgaatatcagtcccagagctgtctgtcttttccatttgggctgtggcagactgagctgagtaggtcagggatatgttttacaggcattacgcaggccagtcttcagaggccagtgtgcatggtgggtccagccatcctcagacatactctgcacatgtcatgctgggggacagagcagcgtgtgtgctgtctggatgattcctcttggaatgttggttgcctagcaacaagatcatgctttgctcttaagtccaattctcaggactttggcttagttacttctgatccttagactttttcttaccatccctcacccgggttcccagaaagtacaggggctccaaattccaaataatgtagttattttagctacgtggtggcagtctatatgttagatttccctttggcatcctacctgtactttatacacaccagcatttctctaacagttttaaatatgctacattttaaaagactacacagttggctttccttttttaacacagacacatgtacagcatatgtatgtattagaaaaagaatggaaggatataccacaatataaaataacagcagctttccctttatggtaggaatattagtatttttaaattatcttcaataaatgtgttaattttgtaataaggataaatattagcataatatatattgggattatatgctattaactgacatttaaaaatatatacaaagtaatggtaaaggaagaaatactgtcacacataagtacaccacaatttcaaccctatatatgtggaaaaatatgacaggaaattaatgaatgaagagggtttcatcaggataacagtaattttttcttaaattcttgaattttaatttaaaaataacaaaccttaaaaatatatagtattggcatatttacagccatatgttttaaaaggcagaggaaatcatctttatcatggcaacaagggtcatttgggcagattcccatagtaaaagattaaaatatattttggacccagagtttgttcaatcattcacttcttcattcactcaaaagccatgtctaagcatctgctttgtgccagatatgtgaacagccctgtgaatacagacctaaagcagagcatctctgccctcaaagaatctatattaaaagtcagatgagggataaaaaaataggatgcaccatttattataatacttctcaaaccatgttttgtgggtgttttcaagtgaattttagatttctctacaagtcttaattttatatttatatggtaatctatttaattaagcaagtttttcagaatcatttaaatggcaccttataactgagtgctaacacaggacttcaaggtctacagttatacttgggaatataattgcatagtactgagtattatttcatagtcttggctaatgagaaagggacctaaatataaatgatatgttgtgacacatgaaaggcaactgatgtcataggatatttgccaataatttgaatagtgacaaatggccagataattgagtcatattgggatgtgcaggatggcatggtcatgccaaactcaaaagctgttagaactatattcatgctgtaatcagagatcttgtttcagcaaaatgtcattctttatattaaataaccattgttaatgttaatttcattccactagaatgcagctctatggcaaaaaaaaggctttatctgttttatctgctgctatacccctagtacctggctcataactgcctattaaacatttgctggatggattaataaataaattgagtatttttatttatttatatatgttttctaaatttatgcttatagtttaataaaagttatgcctgttttgtgttgacatgtgtttaaatatattttataataaaaataacactggtggacttaagagaatttttctcctttaaagaagaaatatttaatattaattaagggtgctgttggccctttaaaaaccatagggttaaacctaactcttcctttttctgtgatatccgttttctggctcttctcttctacttttgcttcccaccaattcacttttcaaaattcccacatgccctttctccctcttacccttttacttcctatacttgccaaccctagcaacttcctcactctatcatcatacactaaaacagaggaagagaagagaagaaaaaacaaaccagagaataaggcaggttttccacagccccccaagaaccctcaagtgaaggtaagagactcagaagttacacagactagggttcaaatgctaatttcaccatttatatactgcccatcagaaaccgagtagacattaaacaattttgacgcgtactcttcttgtcaataaaaattttaagcgcttagcatattacttgccaatagctctgggctggagcatccgtttcctctgttcacatactttagaaggtctcactccgatctttctctgataagaactcctcctcatcaggtgaggagcttgtaggatcaaggggatgtgcccatctggtgcctaagcaccacctcatcaagagttcgaccctgcatcctgcccaaattgtcctgtttctagaccctagatatgtgcctaattcattttttaatggtggaccatctctgcgggtgtgtgtactcctaagtatcacaatgggtttcaaatggtgtggcttaaaagcatgtgctaaagtgtcaatagctctaaatgtgagtcatgagacagtgcagaagaaatcttcatggggagggaagaaaacgaggtggttcttagcccaggagctcaggtcccttcttcctatgctacctccttatggctaggaattctgaagagtctgaaagtttactcagttgagtctcactttgaacgtggatttgcaggttcattttgaaaaaatatttgttaaagtaggaggattaaatatattcagtgacggtttgttagcttgttttagaactttaaaatatttggtatatgacttccatttgaacttttgtttcaagccacataaatgttatgaatgaatctccctgagacatagtaactgtgtaagtagatgctattattattaatatcttacaaggtgattgtatagtcaattaataagtatttacaggaaattgttagcttacagcactgtacaggcacatttgggcagtacaaaagaaagagaagaaacagcataggctttagggtatttatgacctcgctggatattataaattatatacataagaaatttaagaataatctcagaagtgttcagaattttatgaagccagttctctgtaatgactatggaaaacagtctcaaatgaattatggtcactgaggttctataaatctatgtatacaatgccatcctttctttgactgattaaactttctcatctttcaaaggttctcaagcttggcctcctaggtaaagcttcttggttgcccttctctggaatccttgtacagtcaaggtcatcaacaagactttagtttttatttagtctttaatcatttcatgttaatcagtgtatgttcctaggaggacagtatttaaaaagcagaaatcttatcttgcctttcacttaaataattttctttaaattgtcccttccaacttctcccacttcctcttctgctcactcttctttaccactcaagcttcatgaattgccatttcatgaatccgctattcttgtacaattccatgttaagctccaaattatggcgtgtaatttagtatacatacacatactcaccacatgtttacacacacaaactcctgggtctcctacttggtggagtacttagtaaagaagggctttcattaaataagaaaaagaactctacattcttgttccagtgaagacaagaattgtttgagtaaatatgaagttctaaggcagggaattctttgaagagtaagtagccacattgttggaaggagcaggagggaggcattgttgggagttaggttcaatgatactctatatcacatggatcaggcaaggatcactgtttgactagtgcctactgggatagagatggaaggctgactacttaagttacatgctcagagatgctaagaccaatctcctgcctctggcctaggatgtctacaatttatgtcagtgtctttcaccacagcacacctgctgagaccccttgcggattctgagccagcttagtcctgctagtgccctcaccaggcaaagggggctccacggggcaatgtctgtctcactcatacttgaatccctagtacaaactggattttaatattgtttccattattaacacactgtatgacattggataagccacttacatattctcatctaaaatttaatttaaatgaagttaaaatttaattgtagaattattacaaaattgtgtttactcaacttatttacatgatttgcctcattttagagagggtgtaaaatgacgtttaaacataacagaatttaaaattaaaatattaatattagtttaaataaggttgtaaaaaataaatagaagaagaaaagatattagtggaaccacattgatgctattttaaaacaaagcaatggttagttattgaatacaaatatgatactaggcacctcagcagtgggagaaagatataatcagtaacctgtttcactgtgattttattattttttaaaaaagaccaaaaagaccaacgcaaatgactcaagaatcaaataaggtcataaaaatatttcttccatgggttctgataaagattaatacaatggcagaacactactgtagacagagcaatgatatcatagctttgcttttcttaccacctacatctatgacatcatttcaaactacagttcaataaagtaattttgggggcagtgagaagcacaccagtaccaaattaaaaggcagatagttttttagttttattagttttattgtaaggggagtttcacaaagtttaaggcaatcttccaaaaatatctgtttctctgaggcaatatttactagttattgggtattgactaatgtgaagttatagtttgaataagtattttggtcatgtatcaagttaagagcagaggtatgcactataataatcatctgagaatggagattaagtgacatctttgtatgaaatctgagaatccagatagtttataacaacctgtcagtgcatgtaggtgttcaccagggcacctaccacttagcagacttgcagcaaatggctactttattaatatttttgaatttatgaatgtattaatagatatactgtatctatcaatatgtatcatttattaactggttgattagttaggagtgagcacagaaaacaatgaaattaacagtgggcttcagtcagattttctatgaggagaaaatattaactgtgaaatattgactcttcaaattgtttaaatcattagctttatatacattttgtagacttctatttcaatgcagaatgaaaatatgatctttaatatatttatgccagcaacaaatcattatccaaacttatatgcaaattctacaacgagcagagggtccactaatattgtgccaaagatggtgatgaagatggagaatttagtgaaccacctacatgttctcaaacagttagatgcttgttaaagatgtggatgcttaagtgctacaagtttttcctcccaatatttcccacgatgttgttgatatactcatcaacagcaagaaatctgggaaaatctaacacatctttgataagagaaggtgtaatccatttaacaagtatttactgagtaacaatgataaatagtaattgtatcaataataacagaacctgccatttgttgagttctcaccatatgccagactgtcatttttgtcataaaaatgtatgatgcatatgaaaacagcataaacagagatagtagttgccacttatccacagttttgtattccatggtgtcagttacgtacagtcaactctggtcagaaaatagatgagtacaatatagtaagacattttgtgagaaagcaatactatgttcacataatttttattagggtatattattataattgttctattttattaataattgttcatctcttactgtgcataatttataaattaaactttatcacaagtatgtatgtatgcatagctggaaaaaaaaaacatagtctattcaggtactgtctacagttttgggcatccattgggggttttgagcatatcccctgtggctaaggactactgtacatacaatttttttcattataaaatgagtttctatgtaccaaccaaccagcttaagaaatgtattaatacagctgactctgaagcatcttgtgtaccataactaatcaaatcacactccttcaccccacaatattttttgttaatcattcctttgcttttcttgtactagttacatatatatatatatatacccctaaataatactttctaattttgtctgtttctgaactttatgtaaatagaatcaccttatatattgtcttctcttttgtcaattcatccattttatggtctatatgggtaattcattcatttttaccactacatagtatccattgtattaataagtcacaaagtacatacatttatgttgtttctagtttttgcaattatgaacaataatgctataagcaatatagcttaagcatgttctgttaattcaacagttattaaatgaacctagagaaagggcatggccttgtttctctcctattctcccaagtaatttcctagagattaaaataatatttatactcttctcttcaaccatgaatctatcctggtatctggcaaccatgatcattttttccaagaactcacttatcatatatctttctagagtgaacagcattctactgaagatactcatcaaatatattcctagaatttctaggagactataaagattaaattcttctgtgactttcttaaaaagactaaataaaaattagatgctgagttttaaggaaaatatctgtatctcaattacatagtgtttcctaaatcgaggctttgggaagcaggagtcttatgattttataacttctttagagtaaagcatttaaggtaatttaacacttactggatctggccgtgtaaaaaatattgggtaaaatggtccagagataatatggaacacatagtttctacccacatgaactattattgttggaaaaatacataagctcctataaaaaagactgaagtctatttcaaattaactgtgcttttctaccctgaagacagcaaacttgatggtaggtaagtttgagatggatctttacaattccctaaataactcagtgtgaaaaataattttaagttgaaaatatggcttcactttgcaaagatataacaataaaaatggtcactttatataattaaaatgtacttttttcctactcagtttttacatgactttgttaaataagctaagtttgtattagttgagcacagagctaggtgggagagtaaaaaatttctaatcagctgtaatacttcactaatttattaaacaaaaatagtcattttgcttgaatagtatcttcatgtttttgctttattggtttctttccttgttctaaaatatcaaatctacccaatccccaaagacttttataaaccatgcttttttcgttagctaccatcctatcaatctccttccctctaccactttcttgaaagagtactcaaagcctcctgcattatcttcatcatacaatttcatttcttacttcatgtgagagtaaactagcttctgtcctttcccttctactgcaaatgttctttgacattagaaaaccaaatgccaaatttagaattatttctgttactatcccacttaatatttctggaaaatgtgccacaatttcttatcctttcctagaagctctttttttggcttccattcccaagtataccaagatcctctctcccctccactgttctaaactacatggcataccctcttcctagaatgctttttcttaccttacctgccttttcttctaaaaaactatctagctatcttccatggcccagcttaaaacatcacttccttcctctgtatgttcccctccccagcaaagattcagattgaatttagtcatttgtgtagtaagctctgtatatctctattacagctattattacactttataacaattattcattcatatgcctacctctatgtactaaactgtaaaattccttgaaaggtgagattgaattttattcatttttgtattcccagtgcttgtgcagaagctacatggtgggaaatcacaaatttttgtgaatgagtgagtgacttaaaataggcttcaattccggccaacagaatagatcactaaataatcttctataaagagaattaaataaataaaactgatatttcactgaacagagaaaacatcaaaacctatgaaaaatgtatcaaagaatgtgtgatggttcttcagatacaaaaccccctctagtgtcatgcttccccactctgatgaaattacaatagatttgaggaaggtttgctgaaggcaaagtttgatctgctatggttgacctaaagaaaatctaattgtgtagcaaatgtcaaatctgagtcactgccacaattatttcaacactgttgcctcctagctagcccacatgactaaattaaaagacaaagaactaaaaatgttggtaatctcacttgcatctagcaattactggggcccaagggacctcaccgtgcaacaaatgttggtaacatccaaaaacacgtaacatttttcttccataacttctcttcttcccgccacctctgctatctgcttctgcttaaggacagtttggaagcaccaatattattggtttatataaaccattatattacataaatgtcaattttaaataaagctaccccataatctattccaattcccctagaaatggcagtgagcaaaagagaagcagggagcatcttcaccactcagagatacatttacataaagaattgtctgtgtgtgctacaaggtaaagctatgcattagctgtttcctttaagcatcaccttgggaaaatatattctgaaccagatttttccaatgcttaaacttctctctgggaagacacaggcccttctggaggctgcaataactgagtaagaccactggggtaccatttggtaaactgcagcttcagtgcactcaatagtaccttagtggcctgaaagagttaatgcagcatctagtggtacatgacttaattccttgggaattatttccaggctgagagaatttgccttagatcattaagaatatttcctctgaccttcagtatcttacatatgatggctggtggtaagaaatgctctcacctaatttgtaggacaaatagatttgattaatgatttgaatattttgtcagaggcaatactgaatacattactgaaacttttctttctggtaagcaacacctttctaaattatttttcttaaatcattttacttatcaagaacatagatgtgaattttaaaatcaaggattgtaggtaaaacctaacttaaataaaacagctctattcttagcaaattaattaggtaatatagacattaattgaacccacaaatattctgtactatattatgtgttaaactctaacaggcactgggaatacaatcgcaaataagcatccttgtcttcaagatacttttactcttttgggggaatgaaaagtaactagagaatcacattcttctataaaagggatatatccttcagcatactttaacaatgtgaaaatctctattagtcaactattttaatatcataaagcttagtagttaaaatataaagaaatcaaatttagatatcactgtatacatgcagagtactacatttggtggttattttcataataagaaacaacattatgttcatgcataactggatcattgaagatagaactaaatgaaattagctcttcaattcacttttcacacatttaaaaatgatcttctgcaacagaaatgaaaatatatttcttgggagttttattcctttttctatttaccaagcttctgatctacataggttacgtaaggttttaaataatacattattttaacccttgagatcaaaatgtcaacctcagtattaattttcagtacacaatatgcaaggccattgaggatcattataagaatttattataattctctaaagttcatgtttttccttccagcctttcttttattcttcttttcctctttcagatacttagcgagtccatatgtaaattagctaacaaaataaaaggtagaataaaatgtttttaatgtaaaagaaaaagcaattaatagacatttaaaaatccatttaaaagcgaagacataccctctgacaccatgttttcagcttactagaaaagatccccaacaatagccataatatatatttccacatgataaatgctatgagaaattacaacaatcttcagtgggagcaactagagtagtagtcattgagaatcttcttttagtaagcccaaggcttcaggagggtcacaggctgagaaggaagggatgaggaatttaatgaaactgagagctaggtctccgcaatatatcctgacaatcagtgggataagagatgccatagccaagttactcacgcactttactaaagagataagttggttttgagccctgataccacacattcaatattcaatcaggaattttccacgtagttccctcttcttgagacttagaaaaatgaatatccttcaaaattaaacatttggtgaaagttaattaatcttaaactctgttactccattaactagaataaatctttaaaatcaaacttctttcagaataagagagttaactataattttatatttagatactcccttatattaataatgtgttttaacagcttaaaatgttgttatagggtcatttgatttatacagcagaccagtaatttagctattactcacattttgcagatgaagtaactgacattcatgaaaatctagtttgacatcaacaattatcaaaagtagaaaacaaactcttaatatatttgaatccaaattctatagccatttctattgtaccacacagtttactaaacattttcttagtgttgaattaaggggggaaaaaaaggaaggctgagtttgcaacactaaattcaaaatataggaattctggaaatattttgggagataaacatataggttataataagaaattatttaattttcttcctattgccctaataaaaatatctccagtactacaaattcaaaaaaaactatgtacaaatgttaagctaaccttgttaatgaaaatctcttgggctttcttggaaggcaattttgtaaaattcttgaatggaaatctggacgcaggccttgtttctccagcactccatgggagatgactcagtggcaacatacttgcttacagttactacaaattcccagatggcaaatccatggctacagttggaacctgcaaaactaagaactctggctcttgtttagtcttacaaaggcttcttttaccttagcatttgaaatgtttttataaagtatctgcttacagattttcacaatgcctctgaggttaaaatggcaattattcttctgcttcaatgcatcatgtggtagcacttatctctatccccttacagaagccgaatatcttaataataataccttatatctaaaaagtgcattatcactcaaagtgctttcagatatagatctgatcttcacaacatctctccccacaatggtggtatcccccagggttctgtccgtagctattctcctttcacttttcacagttgccctgggaaatgttatccacacctgtgatttcaactgccacttacatagtgatgatggccagatgtctatttccagcttgctattcacaccagagatgcagactggcatgtatagctgtccactgaatgcctctcagggcttacccatagtactcaacacgtgcaaactgttattttcttctccaggtctgtgctgaaattctctaggatagctaacaacaccataatcttttccgctatccaagctgaatgtatgagtctcagcttctccctctctgccactcccgtaactcacataatagctcacagttattgtcttacttttactcccctaaatctttcttcattagggttctttcttcctttcccaagttattttcataggtcaagcctttaccttttcttttctgaagcattacaatagcttcttaactctattcatcatttcctctctgattccatacccaggccatcttccaactctcctgtgaaaatggtcttcctaaaagcacaaatctggtcagaacactcctctatttcaagacataagaaaaattaaactggtgatactataaaacatacaagagaatgaattctaaacctttagcgaatacaaagaccttcacaagattactccaaattatttcttcccttctttactctctgaacacagtagacatatatgctatttcctaaacaagatcagcatctttcaccactttcatgccttatgttttaactaacagatatctcctacctcctactaattctttaagagttgaaaatttccccaacacccctttgcgtagttagctaaggccccaccattcctatagagtatgcttacatcatcataatgatataagcacataggtaccagtatgcccttaagaatataagctactcaggggcaggaatctttcttactcatcttcatatccctgatagttggcattgttcacaaacttagttgaatcaagtaatgtacacatatagtgttatctccatttcatagatgtttcaaaaagtcatattatcatacaggtaaagctagagtcaagttgctgaatatagtttccctcaactacaaaattaggatagttgtgcagttctttctctacttcaaaaagttttagtaagaataaaattttagagagtattaaaagtaaaaggagccacaatacatagaaatgttttttggttcattgagattcatagccaataatgattaaaggcaagttacatccacctcagaaaaattatttccaacaggtgataaaaatcattattattcttaatatgtaaaaaagttttacagataaatgaaaaaatttccagttttttcaataacatgatgtgaaaggcaatttacaaatggagaaatacaaatgactataggcttatgcaatgttcaacattattgagaacgtaagaagtgaatcaacactgagataaaagttttaaccaaactgacaaagattaccataacaaaagtactcagttttaacaataattctttaaaattggcatcatatacccttgataagagtatagaaatcttctagcagagcaactagacccatacgcaccaagtcttaaaatgtcacaccatttcctctggaacataatggtgcaacaaattctatctatattctacctactgtgtaatgatacacttccttttcttcaagatcacattttcttaaatttcattttaattgcaattatatccctttgtttgtgtaattacattgtcagatgcatcatgaacaaaataatattccaaaaacttcataatgttgcttttccactctgaaagctcacctcgatattcatgatatggcctccgtttactttttcagatcttattttttaactaaatcagactatactgtttcctaaatgttttctatgctttcctactgtcacacattgccgttcgctacttcttttgctagaaatggcttttctgctgcccataactgagggtttgaatcccatttgtcctttaagtccagctattgaaactatttccgtcatttagtttttcctgatctgtaaaatgtagataataaaccaatcttaaatggtcattgtgaagttttaataaaacagtgtctaatacacacaaaaaaggcaaaataaacatttatggaacaaagttcttccccatttccctgccaaggccctgccaaagtctgaatacaccacaatttcttacattttcacggtgcaaataatggagaaatttactttaatgagcaccctgatgtttattaggctcattgtaatgtatatctctataaagccaactggcttgacctgaattttttgttttgttttttgagacagggtctcgctctgtcgcccaggctagagtgcagtggtgctatcttagcctcccaagtagcttggattataggcgtgcaccaccatgcccagttaattgttgtattttattttatttttggtagacacaggatttcaccatgttggtcaggctggccttgaactcctggcttcagtgactctcccatcgcagcctcccaaagtgctgggattacaggcatgggccactgcgccctaaaaattcaggcatgacctgaatttttaattgtttagaaaaacatctggaagtttttctatcggtttacatatctgtgtacaagttcttctttttctacttctttagtctctcctccaatgttaaatacttttcaaaactcaaagaattttgtaaaatctaatatccgaatgaagtatccaatgctttctctctctgccattaaaagacagcccccaatagactctatgacttaacacaatacacttctgagatattttaatttggaattcaaaaagattggtaataaaatagattttctctttttttctgcattttaaaaccttttgtattgtaaaataaaacagacacagataaccacaggaaatgtatgatttgatgaattatttaagcacaaactcctgtaaccaccactcacgtcaataaatggaactttgccagccaccacagaagtctccatgtgcctcaggccaatcaaacaccctcctttccttcaaaagtaagcatgggctgacttctataataatccatttcttgtattttttatagtctattcctgaacactatagcttagttttctatgtctcttaaactttacaggtttttactccatctctttctttttcttattattaatctgttgaaaagcctgagccatttgacctttagacttccccaaagtctggattttgttgattgcatacacatggtacagtttaacatgttcctaaaattggtttttagtaccacttccagattgtctaaagtataagcaaatcacaccaatgattaaaaatgccttgtataaacctcatctggcagttaaagcctagtttaaactaagattcctagttcagcaaattcagcacaaataattgctctaatggagtcacatggcatagctagaatatatgatcagtcaaatataattttaaatatttaccttaggaatacactctataatttttattttcttgaacaacagagttaagttcccttttttccttttttttttatctttatcttgaactaatataaaaacaagttttggtttttttgttttttttttttttacatccctaaaaaattaacttttaacatacaccaaaatacagcaggtgaggtatgggcacatgtgtgtgacagggaaaaaagtactcgatgacttgacctgtgttgtccattacccacagcaaggctaacacacacacacacacacacacacacacacacagagagccaaggggtggcaataattagtgtgctttaagtcagggaagacgggatgatggatatattatcaaataaaaacatatgagacaggagacatgataatttggagacaattaactgacagcttattaaaaaaaacaaaaaagcttgcctccttctaccatttatgacgcccataactcctaaggatataatgtaggtaaaactgatatggttcctaccaccatggaatttgaagtctatcagggaggcatgtcgtaatcaaataatcaaagaaatacacatattttagcaaagtgtgggcagggggaaaaaaatggaaatagtgaggccaagggactagggctaggatttatccatattcaaattatctcctatcctgacatagctgcatagaaagagagaaaagaactgaatccaaggcatggaaagctaaaaaattcattcccttcttctttaaactgttgtagatgtttaatgctaaaatgagggtatcagtatacacaggttttataatcaattttctggggaaatggagccatttctaaatcccaccttgagaaagccaaaaggccaaaaggagtatattcttaacacaaatttcaaaatagaatttttaaaacccaaaaggaatgaaagctgaatttgttttcatgagagactaactgctaactggagatgtggcatttaaggcatacaccatggaaatgagactgcatgaatcatggcttcttcaggcctactcaatccgcccctgactgacaagtccgacttcatttatttagagagggtccctttgatgaggcaattcaacatacgactaactgggagattaagaaagagtgaaggaatgatatttccaaaacatgacagcattttccaagtatgagtgattgagaaaaaatatatatgtaaagaaagagaaagttgagggttttgtttactattttaatgaaattgaataacaagaatagaataggaagattcaggacatcaaagggagtctgtgagagttttcccaacaacagttcaattaaactaatatttactgcaggcctaacatgtgcctgatgctaagcccgcaaaacaagcaccttgaattaaggagtttatgtgtgagtcagtcaacacaaaacagtttcttcggagctgaaatagagctatgtaaagaaggaagaatagaaattaactaattttgcctgggataggagggatccaccgaggagattatactagtacataattttgaaagtcaaataagggttctcctctgggaccacttagaacatggcagaggagaaaaatttccattccaagaaaacctgtctgcacccaatgacagagtttgcattctcccaagacaatataaatattgagaagagtggtcatgcacttgagaggctgtacattttaatggaaaaagtgctggacattagccttctgggcaagtcacttaacctccttggactgtagttgagtgttgaaacttggaatctcaaagttcccttttaaatctagcattcaatggttgtgtcaagatccaggactacagagctagaaagattcttacccatcctatctgtctttctcaagatagggaggaagagcacaaaccacactgattataaaaaccctttcagaatatcaatgtcaagggcctctccatccatggaaagaacgagttaccctttagcctccacaacagcaatgtctaaaaaaaatataataagaaccacaaatgagagccatatatgtaattttaaattttctagtagccacattgaaaaaagtggaaaaaaagaggtaagatcaattttaatactacattttatataaactaaaatatacaaaatattatcaattcaacatataatcaaagataaagattaatgagatacttcattttttcatactaaatcttcaaaattcaatgtgttttttacacttacaatgcatctcagttcagactaccaatacctcaagtgctcaacagccacatgtgtccagtcgttactctatcagacagtacgactcaagtgtgtgtcttcagaagctgctggatagccctagggacatccatatttctcttccacatgagggtttagacttgaaatttattgttatggctgaatttgatacagatttttaaggctttgattctcagaaagtttcccctgtgagtagtaacattgcccttatttagacctcatcggaaagaaagactgggaattagttttcacattatgttgtggggaagggtgggacatcactgagaaaagaaggaatctaccattgaatcagattttttttatgtataagacaccatggagggcttgtaagatgggatgctaatgtctatcatataaacaaagattttgttgaaaaacatatgttgaaagcatatttcaacatataagcacttatatgctttcaacatataagtttttcaacaaaatctttgtttatatgatcgacattagtatcccatcttacagctgaagaaacaaaggctaagactggctaaataactagctcatgatcacacagctggtaagaggtagaaataaattcaaacctagggctataagacttaagtggcagggttactaaagctaactctacttgttcacatgtaattccacagcaatcatggtctgaatagtccagaaacctgaaatttcttttctcgtctttgaaaccctgcatcgatgcaccttttaaccagcctgagctaaatctttcctaaatagtatttgaggtttctctctgttcctgctcttccttagctaagctacaaaaccgttcttgctcatttctttacaagattactgaatcaaaacaaattccagtatctttcccttgatctttaaacagaggggtaatgtttccactctttttaattatcatagcttttatataaactctcagaaagaaaagtctgcagttctggaagacagaattgtgtgtatagaaagactagctttgccattttcttgctatgtgactttgggtatgctaatttgcgtttctaagtttcagttttagagtctgtttagtgggggcagtaaccctcacctgacaggttttaatcatgattaaaataaataaaaattaagaaatttctagcatgcaaaaagcaatcattgagtacattcttttcttctgcaatttcttctggtcatctacggcccaattatgtactactgctcttttgacccattttgataggtggcctcttccccaggagtagtgtctatctatccgaataggctcagtaagaattatacatggaaacaggatctcagggctttcactactcagtgaaattgcagtgaacaagatagacattttatgtgcgtttttcctctggaggatatattaccccttaagttaagactatatcaaaaatattctgcccaggatgttcccatgagatttgatggcactgaccatcccccgcatacccagccaaatccctgcatcctgcctctggccattttggttttacaggctctgcagattgtgctgcactccagggaacatggctttgtttagccctgaaggaggggataatgagggaagaggtgagaatcacctagtgctgtaaaaatcaatgttattgactgctggacaaaaggaaaaggaaaacagccttgctgactgcagtggactggaaggaagggaggaaattggaggtgggcagcagatcttcctaatgagaatgggcagacatccctgactgagtgattaaagatcaaccgccttgtctaaccaacctctaccctccttcagcctctactgctccaatcatttctgcaaaactatcttccaaattgtttataagaatgaaaacaatgttttaggcctaagggaaaaagtaagtgctatactggtgaagcttcaatttttctttaatgtattttgaatttttcttatctgctattttcattacctgaatttttttcttgaactagtcaaatgctttcctagaaatttgtattataaaattttttagacagaatgattttttttacttcaaatcaaattaactttaataaataaaaatttaataattcattattacccattacagacagacacaaataacatttcttattaatgactctggcccttgtacagaatacagtgtttagcccataagagagactcaattaatgtttacttttaacaaatgaactggaaaagatatagaatttggccaggtgcagtggctcacgcctataatcccagctgtcagggaggcagaggcaggaggatagtttgagcccaggagttcgagacctgcctgggcaatatagcgagattcccttccacaaaaaggaagaaaaaacaacaacaacaacaacaacaacaacaacaacaacagatacagaattcacattctggtaaagaaaagcagatataaacatctccaaaacaagggatatactagtgttacactaggaatgcaaagtgtattaagtgttacactagaagtacaaagtaataaatgtatagaaaacaaagaagttccatgttagagaagaaactagatggcagggtctggaaggacaagacaattattatgtagaggaaaggaaaggtaaatatttttctgtactgaagtgacagattaagcaaaagcaattagaatgaaaaataattattaatatttttataatattctagaattcacaaagtaatcccacatgttatattgtttatgcttcataacaacccaataaggtgcaatgttaatactttgttgttttaaggcatctttcttggacagaaaagattatgtggagctctttcccttgtgaaattcatatttaatttgtaaagttataaattcaaaagcctacatgttgcttaacttttaaattttaattcataattgtactgttttacttataaacctatcaagttttttacaatcatcattaagggagttttatgacttaattatatcccattaaatattttaacctgtatttataaatttaatatattaaaattttaaaagcattttatctaaacaacaaaaaacttctcaattatttgaatcattcttttaaatctaataaatattaataaaacaaagtgtgaacattttaagcttttttacatgctccaatacaacttacaaatgaataaggttttaaaatatccttaatcttaaaattgcaagtcaaaatcaattccttgacatccaaacaccaatctgttaaatgttctaatctggcaaattatctttaaaaacacaaatatatataaatccaaatgtgtacaaatatcttaacataaaaatattaattaaaaagtttactttcctccattattctgtaattaatctaaatcttttcaggattagtgacctctatgcaccaaagaaacaattaatgcaaactttgtgattgctttcccaagcaatttggggagtggttatatttagatgattactattgtatattacgtagaggtcttggctgggagatatataactgccgatactgcagttaatttttttcatctcctcaactgtaagactaagcatcattttatcatcaatatcccaaaattttacaaaggagttaggtcctagcccatgttcttgggatccaaagtataccataaggaaatgttcagctacataagccagtttgagataaccaccaaatttaaagctaaccttcactgcttcagttaacatttccttggctttcacaatttatttatttatttatttattttaagacggagtctcactctgtcgcccaggctggagcacagcggcgcgatctcgatctcggctcactgcaagcgccacctcctgggttcacgccattctcctgcctcagcctcccgagtaggtgagcctacaggcacccgccaccacgcccggctacttttttgtattttttggtagagacagggtttcaccgtgttagccaggatggtctcgatctcctgatcttgtgatccgcccgcctgggcctcccaaagtgctgggattaccggcgtgagccactgctcccggcctttactgaaatattttaacatcttctgaatgaatcttgcatatatctggggctttttttgtctaaagccttgctcatgatacaaggtagattcttatcattactaaccatttcaattacaccatcttgaaattaagcatcagaaaaactgatttcctcacctagaagcattgcagactactttgtaaatggagatgacggattttcaacccaggctttctaccaaacaccccagtttttccacatctcctatatggcgtgagccgtggatgggaagtatagctggaattgattctggctgtgtggactgaatgaggttacagtaggtctcgcagaaggtaatgatggaaagtgactgaggccatcatgaggatgaaaattttgaaggcagtgagaaacacataagctcttgaacagagaaatggatggccagttcttatctgtatttaacaaaaataagtctggtgccaatatggggaggacaaatttggagaggacagagggagattagggaagccagtcacaatgtttcccggggcaacacagtgagaaaaaatgagagcctccactgaggaaaggagaggcagaaagagacaaagtcgaagaaattacaggtagattctacaggatttgtggattaattagctctccatggtctctggagagtaaaaatgatttcaatgttttcaatctaagtgcctgggagaatagtgatagtaagaaaattgtctggttggcttctgtttaaaagaatcattaaaaccccagctcaaagccattatttggcaggactgggtgttgagacaatgttaggagactagctagagaaacttttgcatgaagtatgtattttttcccctgttagaactacaatggcaattatccttttgaaattcagactcaccatatatatttttttcccaactgcatctcatctcaaagctattccaaggttacacttgaaagctttctaacctctgctgaaaagtaatggtccaagaaaaacaatgctttcagtccctgcttacctgtatttatttacttttcaaaaagagaataaaaaagcttccctattatgcagccactttaaaaagaagcctatgaataattattaatgacatgattcttatcttatcacatagtatgagcaagaacacatgacaaataatacatcttaatccaatagacatgcattcatatacatatatataggataaaagaatatacatttctatatatgaatagcaaggatatgaagaagtatacatttttgtcattttctgtacttctataatttctataataaacatgtattacttttataatgttaaaaacattgaaaaatataatgtattctgacccacttaaaactgattcattagtttacttttcctaacgagtctgaaaaagtgcagttcataaattagtcaactaaacatccaacacaaatgcaaagggctcttttatttgcgccaagattcagaggtccatttcagaaatctcccttactccctcccatccaggctcactgtaaactcctttgggccagtttcctcttccaatgtaagtactccttgaaaaatgaattagacacttttaaaataaataaatgtatgtgtacctttttaaagttgtaaatctagttatacctatagaaataaataacaaataaatttaaaaactcaaaataagcctcccactagtcatctaactttcattttaaagaaaggtattcccttggcttctttcaaattctgcctattttgaaagtgccaaagtctacacagaaagaaaaaacaaaacctccagctgaaatttgagaaatatttaaggccagaccctcccatggtcaaatgactttttattttattgtctacttttctcttgtcaattctcaagagctaggttccccaagacacagtacaatatcacttcatcgtggggagttttattatcatattcactgcattaatactaagtgcagatattagcaaatagatttctttcaacggatgctcaaacttcaatttgttatgaagtcttctaagtataagcaccccaaccctgaccccagatccatgggagaatataggttatcaggcccataagaattcttctggtccctggctaatgaaagaaactgtgacacactcaagtcaggggaacctaagtctaataagggtgaggaatgcccaatgaagtcatcaaaaccaaatggatgcaaagcagtcctttcgaggcactggcctgtcctaagcattggtgcctgagcctagcatttattgtggtttcaccagttacttgctgtgaggcccggaacaaggctctaaacctccatggcccagtcctttcacatgtaaaaataggtttaatagaaaactttctcttggggttattgtgaagatgaaatgagtgatgtacacagtgcctgactcatcataaatactaaacaaacattagttattattattaagaatattgaggtatgtaagtgggtaggctaaatcccaaaggccagggacagggaagtaagcaccgatctatgaattcccagatgaatatgctaatcggcaaatgaaccaggctatatggagaagccctagtgttggcttcttagtgttgtctgactgttgtaattcatcatcttttcatttgcatattcctaattgaggttgtatttttcttaaggcagggaacatgttacagtgtttttcaaattatgagttatgacccattctacaccccttcaaagtcaataaagaaggttaatgaaggaatcttttaagcgggtcaatatgaattgtatttccccccccattatttttctgattataatacatttaatcttgaccaacattataaaaaagaaagaaattgttaaaagttggaacggaaaatatcacaatgcataacttttgctaaaggaggtattgctttttaaaacatactgagttgcaattttaaatttatttcttgctgcatgttgcaatccagcatttggaaaatctttgggtctatatgttacttaaacaactattaacacatagcaatttctgaacacacttgagaattccaaacatatgctatatgacagtgttttccaaacttgtcttatgaatggtttacctagggtcattttcagattcccaggctgctttcctaagattctgatgctggaaacatactatcataatgaacattagagaggaaattaattagagattaattaattaatcttaatttttcattagagaggaaactctccttgttgtgcatctattcttatttggtggtaacacatccagtccaaagaggtactttataaaatatttccagctttctgaacggctaacattcattcattcagtccattattttcaaatatttattaatcatttgtcatgtgcaaggcaatgtgtacaaaaatacatataagagacacagttcctgccctcaagtagcttatagttgactcatttaagaactagggcagcatcccctgaggatcagaagaactgagaccaaaagaaaaggaaatcatgaacgtatacatatgactcaaatctagggtaacctaccttctaaaaatgttcagaggattaagaagcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaaaattagccgggcgtagtggcgggcgcctgtagtcccagctacttgggaggctgaggcaggagaatggcgtgaacccgggaggcggagcatgcagtgagccgagattgcgccactgcactccagcctgggcgacagagcgagactccgtctcaaaaaaaaaaaaaaaaaaaaaaaaaaaaaaagaagcagtaaaatggcatggtaattacttatcaaagtatttttctctaattaatacagcagagctgaaaacccacacaccacacctaaggaggactcaatatcagtgtcgaaaaagacaagaagatagatatcaaaaattataattatatacagaattgaacaacttgtccccagtcccactggcacccatctgatctaagttttcaacatatttcccctggattactgcaggaacttctacctggtctctctgctcctgcccttgctcccttaaagtctcttttcaacatagcaacctgagtgatcctatttaaatgttagctaaatgatgtgacccttccgttcaaaacacagctggcttcccatctcactgggaaagtcctacacgatcttttcactgtgacatgctcttgacctttctctcttcagccacactggcttcttagatgttccctaaaatgccaggcaggcttctagctcagggcctttgcatgtgcactttctgctaccttttccaacatgtatattttgtttatgtgttttaggtctttactccaagccatattctcagtgagaccttcactaaccatcttatctaaaactctaaaccaacccatcccccaatgcacacttccaatatccttccatgattttttgacttagcacttatcactatgtactatgtattttacttaactgtcttatgttctacctacctcactagcaataagttctatgagggtagagattattgtctgttttattttaccctttatttataacacctaggtctgtgcctgacccgtaataggtactatatcaaatatttggtgaaggatgaacgcagaatacaaaagaaagcctcaggcctgactctggccaacatgtattagaaagaagccaagaaaaggaatggcaaggtcatgctatgtaagacatatgcaattttattgtttacttaattccttacctaattttaaaaaaagatttgagatgtctgtaacatattcattgtagttttcatatctatattatctatttaggtagattgctaaaaaggtttccagtggaacagacttggtttagaaggtgacttcactggcacttaatatttgtaatattaggcaagttatttgtgttctctaaactttagtttcctcatatataaaataataatgatcaaaatgcataaatcttaggtcattgggaagcattttgagaaaatacattcaaacttgttgatgtagtctagggtccatactaagagtttgacaaatggtagctattattgttattgttcaatgtgctgttttatcctttacttattaactccttgtttaattttttaagttttgagttaatgggctttgttagaaattgtaaatctaacacgttaagtaggcttagatattataaacccaatataccaaattggtgtccaaatggctcacaaccatttggagaccatactaaaggagtccagtaaggaactaatacgttataggtatcctaaaagagagagttattcaactggaaccctaagaggtaccatctctgacttgttatgagccataggtgttactcgaacggtccatacattgtgattcataattccaagtcctgcctacaacaaattatgtgtttattaaaagcatcaatatgtgggacacatcataggatctagcaaagagtaggtgtcagcagcataaggagacagagtttctggaagtttccctttcaattagtccactgatcattttttgaattcctaaatataaataaactgtaaggaaaaaatcaagaaaatagtttatagttcctgtcttcaaaattcttaaaatttagttggggtgagggcaatacccaaacataagcaaaattaactaccagtataaaataataatgcaagttatgatataaggcagtataagatgtattgccataaatgatggagaaattgtactcactaagtcaaaggagagataaagcactggagttagtgtgactgggttccagttcttcgaagatagatatagacaccctgtactgtttattaaaggaaggacagaatttagacaaatatggtcaatgcagagaaaggattcccatcacaggaaaacaactctagaaaatgatcggggcagagagggtggggtgtttggaaaagagcaatttcactgaataaacctggtgaaaattagcatgataaatgtctgaattctagagtgtttaggcttcaataaattgttttagtgtgaattattgactccctccaaactagctgtacaacctggctgagcagatccaaaagagtatgtgacttagtgtaagtggtttgcgattggcaaatccagtactattcaaactgaagcctatatgacttcaaaggctatgaggttttttcttcctttttttctttctctcaaaataatttaaccagcattaagataaacaaataatctgaaaagaagctgagtgaataaaaaagaaatgtgagattcgcttaatgcattcatttaaagcatctcttgagtacctactgtgtacttagcattgttctttgtgctgatgatataaaggtgaacaaaacaactagaactccaggttccatggagctaacatgtgaatatgcatatatgtcattgtgatggttattatggtgggacaggaaatattatacctaaatgtgtttctaattaattatagccatattttaattgagcccaatttctaatgtgattcttattgaaggcaactctgaagccttactgctacttggtggtcttcattttctcaatgatgagttaatttgattgagttattactatagtctaagaactttttatagggttcacatgccttatctaacttactgcttataacagctaagagctattattaaacctttttcacagatgagaaaaaactaaactttcttaagctatgcaataaatggggaagacaagttcaaagtagttcttttgaaatcccaaaaatccatgctttaaaaccattctgttacactctttttcttaaaagttattgtatttacgctcagtaaattttaaaaataaaggagcagaattcttgaatttatgcagtaggcagcaggatttactctaaagagtagtaagtcaccgctcaagagactctgcttctgacacactgtggaaaagagtaactagtcattgcctctctctaccttagttttcttacctgtgctataggtctaatacttgcaattcatatttcagggattgtggttttgtgagtgtacatgtgggtatgtttgtagtagcaatgaaaaaagggaaatagtgcgatgaggaagataaagttatttagaaaattatcgtcagtatcactaccttcaaaaattgatccatttccaaagacaaaatgatacagacatctgatgcaacaagcttcctgcatattttctcattaaagaggcacttttcctataatatagacaatttcagatggaaactgaactgtgtacgtgatgatcacattgcttctttttagtgagtagactaaaactaaattgtattttgtaaaactaaatcatattttgtaaaaagttaaaataaaaacccaagccaatgtaatgtgaacctttatcaaactctatttaaaactaacaagaaaacacaggacataaataatggacattgattagaagttttcattcatttcatttccttctgttgaaagctctccttctagaaaataggtagcaaagtaaaacaatttacaaagtgttagattgtgatgaccactcagtcaattcaagcagcattggtttatctttcttttatgatttacccattatttcactcttcagccttgtaagaacccatgttctaaccatttcaaactatttgcagctctttgaagtgctctgcttcttagctccatgcttttgccactccctttacccagcatgccttccttactccaagatgcttggcagaagtccattagctgtcaagattcaacttaaaagtgacctcacagcaaaacctttcttgattagtccaggtaaaattagcctgtgattttgtttgtttgttttgtttgcttgtttctttctcctacaacaaaccctgcatagatgtccattatgggtcagaaatacttcaaagcatttatttgtttatagtctgtgtctttttccgactggaagcttcttaaaagcaagcactgtttctatctatcctagtttccaagactctaacatagtgcataaatcatagatgtcattcaaaaaattgtaatagatgaatgaataaatggtgacccaggagtcatattctgatgtttgtaaatatgtgtgtgtgtgtgtctatactagtggtccagatttaatgacttgttacataaaaatatatgaaatatcttaaaacataccactctcaataaaattctttgttatattttataaaggtcctattaacaaaaaagtttattctagaataaaagatcatgacattagtggtctattgtgtgcagagaaaaaaaagacgaaaaatgtttctatcctttgaattttaaccatcttaaagttttggataactgtaacaagaatcatgttaaatcatgttaaaacatgagaaactatataccataagagagaattcaacagaaccaagtgataagtagttcttgtaacaatagaaataaaagcaaacacttttaaaatgtaatataaataaaataaaacaaaagtcaaaatagataaaaatattagatgaaactttattgcaccaatgtgataaaataatagaccgcaaatgaactgcaaactctttggcaaaacttgttgtctcagaaagacaagataaccctaaaaaattatgaattatctaaggaagtgcaagagctaattactgaaaaggtagaagcataattcaaattaaaactaatctactcaaaggaaggttatatatgctgtttgtggcaatgcatatggtctcaatttctatcaatcaatacataagaagtatatctcagtacagattagccaaagtactaggaatttattattcaaaagtaatctgaatttagttaagatattgttagtgaagcttttattactttgcttatgaatttaaatgagaaaaatgtaaagctaaattcataaagacgactgttagtaggtaagagtaaaaagaaatttcccaaagcccattatgaaaggaactttggacttaagttttcctgcacttccaaaatataacaatgaaatagcaaaacaattgttatctctttatctaaattatttatggagcttccgctgaataaagtacttttctcctttcaaaaagatgaggagggaaaacatttacaatttactgagtttacaaaacaatgcatgtcatacccatactttggaacagaagatgataatagagaaaatccaagatgatatttgggcacacttttcatatttttaattatttttttcatgttgtttactgtctacatcttatacatggaggaaaattgactgctaaagttcattttaaaagtagtaaaaagcaaattctatagaactctgcaaaatgatccacagaatgcttccgggttgtagttgtaaaagaattggtcatcaaaacataaatacctacctgtttgaaattcaaatagaaaacagaaaggcttacaaaagagtgagcagcagggagttctttaataaaacttgcaaacacagaaaatgaaactttagtacccagacacattaaaacactcccctagtaaaataaaaaggggaaacactttatattgactttaaaaaaaaaaaaaaaagattcctattttaggttgtcttaactgcttcttaattattttttctcaaaggcaatcactttccttttggacttctttctccaagaaatgtaagcttaaaatgttaaccaaggatgtaattcacttaaattatgcaactggaattccacagctggtctggccggctcagtgctgaatgaacacagtgtcagaaaaccttctcaataataatgccctgttcgtgacaaggggtaaatctcccaaacttgggctcaacttcagaggctcattagctacagcaagtgaatgtcagtggggtgacaacagcgggacagcagcgcccacgcagctgaagcaaccagcccacccagagctgacgatttgtataatcagtatcaccaatttccagtgaaaatcatttgttgatatgcacaggatggtcaggtatcccacagagcacatctaatgccattacagtcactagatttaaccccccggctcttaaacaattcagctgcaagaacacaggaagctcacagcactttttaaaagaaagacaaaatcataattcaaagcatgctttatagctttttaccttctctgatttcttggttctggcctacctaaataattttcatcttttcttcccccctctccaccccccaactatgagcgtgaacctgaattacaaacagttaaacctgaaggtcacttcacagcagcgttccaacatgctcccccagcgaggctgcacggcaacaataaaacaaagcctttgcaaccacctgtaataatctgcctgctcagccagcaatccgaaaagtcctgaagctacacaaggtagacattttctgcagctggtttaacatgtatattgtgcccagttgccggctcgcctcctcttaccttcacgttagtccggagtgcacagtaacatgcaaagaacattgcagtaaataaggagcatatggaccggtattcagcttctcagcacagcgcaagccccacacacacgatcctgggcatgtgctactaaagagcatccgttccctctgtcagtttgaaaatgcattgatctctgttttctctgactacaaaacgacatgtcttgaaggcactgagtgagagctcaaaatctcttcattggctatatatagcattatgcccagtaatttcaattagatgagaattcagcgtctgaaagttaagacctcagttgcttttccttctagcattttaaatcactggattaaaaaaaaaaaagaagaagaagaaggaggggggaatgagctcactcaggaaggagggggggaaaggtgaagaattgaaatttaaccaatgagttacttatatttctggagagccccggtgttatcctattaaatactttacaatgggatcgcatcgcagactgtaaatgaagaggaaacccttcttcctttggaggtttaatatgagctctgcactatattccaggctattctggtgcagcaccctgtttggcaaatactacaaatcaccgcaagcatgtctcattctgcttctccatgtggaacaggaccaggaccagaggatcattgtcatataaagtcccctaaaatgtgaactgggttcctctggggtgatctgtggttaaaggactgagaagtaccaccttctcctacttccctgccctgttacatcttttagagctatctaaagttgccagactccataataaaatgatgtggccaattttccaaaactatgttttattggtacatgacaatcagtaatgagatggggttgaaatggagacagaagatttcaggggataacataacctcagattcagtagcaactgctgctgaatgtaaaatgttcagcaggctccagaagggagagagcaagagagaaaaataaaagcttctgcccctataagtccgtaaggaaaaaaaaaaattaaaaacatccgtcagatccttctatctgttgtcattcctgtcaggcaccggatgctgcaaattaactcaatttttacttaatcaaaaggacaaagtacaatttagggtgctatacccttatttccagccttgggaagccgattctcagctagaattctaaagctatctggcaaaatgcaagcagaaatgaacagttttcactgcagcaaaaatagtgggaggaaaaaaagtggttatgtctttgccacgatgctccccatcagcttccagcaacaaggaagatcagcataactcactagaaaaagctgcagtgacttttaggatctttctttaatatgctttgcataagccacctcccctctggagcctgcagaagtgctgaagcaccatcagagttactgggcatttctcctgggcaatgaggtgaggcagcttcaggaggaagaaaggtatttcagggagagaaattaaaggaagaagaaaagcaggattttctatttctctcttaatgacaagcattcagaaagtgtcgtcagttctgactaaatagctattttgggctgtcattgtttgtgcctttttttaggaagaaaaaggcagtcttatcctaagctggagatccttgggcaacgtaagagaaggcagccacttattttgatttccagttccgtctgtcttaggagcctaggtaatttacaaattataagcacttacaacacaaccagtgacttccaggacattaaaaaatcgacatggatgcccagctctcatcattccacaactttttctacggactttaaatgcaaaactgagtatttcagttaataacactttcccctcccaaggttatagcaggtcacatttcctgcagctcttcctaataaatgaacccaaatataacaactcaatgccatgcaaaacatagaagaacttaaaaatgcctttctccactgaggattcagaggaacttttaaaaacctactttattcaacctgtgaataagtaccatttttttccattagaagctgggaaaatgaaatttacctattttattaatattattttagtagttgccgggatatttggatggcccaggagagagagaccaaaaagaactggaaaatgttacaaatctcagaacagctcgcaagcaaggattaaatgaaacaagttacaggtgaagaagtacatgtaggtttccctgtcaaggctatcagggaggacttctaacagggctttagataccattttaatgtgtatacatttttttaaaaaggcccttagccttaaaaacttctttaaaacacctgagtatacctgtctagcctacaaaatcccagtgctatacctgtagatttactgcctaattttcttaagtggactaggatagccaacttactattctcattttatagatgcaggaaatggggcattaactacaatggcaatgtcccactaaagaatattccatattttaaggcaaggaattcatcagaacagtatatctgcaagaataataacatttgctatagtagaagaaagttataactgcctatgcatatttttgtaggcaatagagtaagtctaggcttccatactgcaagtgagtagtcctggaaaatcacttccatgccagattcccatttgtaaaatggggataacatgtatctcatagtgtccaatgagaatattaatgatgaaccctgccatcaaaataaactctggaaggatcaatgatttaaatataaaaattgaaactgtaaacatactagaagaaaacacagatttgattttgcataatattggaatacaggagcctgaagccatgcaagaaaagatagacaattgtgactatatgaaaatataaaacttctccttgggtaaattatacacaatgacaaacaacaaactgggaaactatttacaacacattccattgggaattgttttaatatacaaagaactttcataaatcactaagagaaaacataaaactgaatgaagcactcaaagaacataaagtagcaattcacaaaaagaccacaaaacacatttaaaatgctcaacctcatatttaagaaaaaacataaaagttagaaaaggttattaaaattgacacatcaagtatttatggagatgcattaattggtaaaaactttttggaaggtagtttggaattatctatcaaatatttaaagaggcaaattatgattgatgtagtgattcaactttcaggaatttatcccagatatatgtgtgtatgtgtatctaaaatatccatcagtatggaatttatttctttaaattacagtttattcataacataggaatataagatatatatacatattcttatgtggaaagatgtccaagttatatataatattatatgtaaaaataagtttgcaaaagaactgatattgtgtgaggctatttgtatttgtatatttacatacacttgtagggagaggtgtggggtgtgggtgtgtgtctgtgcatgtgtgaaattttaacagtgttgctattggcttaggaagggatgcatgacagtttttattttatacctctatactataggaaatcattcacaatgaacaacttatccaatccaactatcccttgtcagtaaatgagagaaatacagatataaggaagaaggaaatactagaaactgtgaggggatttaccccattgcactccatgagcaaaagtcagggaatgattgtgagaggagaaataagaatctatcaatttctgaattgatcttagatctgagtgtctctctgaatgtgaacatctcccagtaatgcatgtaattctagtgtgtatgtatgtttttcttaaagcatagcccttaaatacaagccaactaccttgattcccaaaaggaaaaagtgactatcaagaaaattggactagttgattttcaccttatgcactgaatttaaacctatctacatatatttggcttgtatttttaacagtgggcatgtaatactttaaaaaacataacctggattataaaaaaagttttcaatattaaagcaatatgcaactacaatttgttacaaatacaataacagcaacaccctcttttaatatggacaaataattcatattgctagacatctttttcctaatctataaaataaggagattggactatctagttcttataggtagatagagtagttttgttagataccttgctttttgttttgttttctttagataggacaaattaggtaagtttatacgttaaggattctctagattgtactacaggccaattaagtcagaatttctgagggtgggaatcaggaatcagtattctatagagctccccaagtgattccagtgtccagctaggattgagaattactgccttagagcatgggtcagcaaactgattctgtaaatggccggataataaatatttcaggcttgtaagccatacgatctgtcacaactactccattttaatgttgtagagagaaagtagcctacataaatatctacttaaacagacattacatagtgtgttccaataaaactttattattgataaacattaaaattgaatttcatataatgttcacatgtcagaaaatattatgatgatgattattttaaccatttaaaaatgtacaccatttcttagcttgtaaattgccgacttttttctctaaagtctagagcagtggtactcaaagtgcagtctttgggctaggtgcatcagtgtatgttaggaatttgttagaaatagaaattctccataccccagacctactgaatcaaaaacactaggtatgtggctcaggtatctgtgttaacaagccctccaggtgattttcaagtaagctaaggtttgagaatcactgctctgaagaaagagaggaaaattgatggctttggctctcacaaaaaataggaagatatcaactccagagcacaggtataaaaattaactttatagaagaggaaagtatagaaaacaaacagaaggtaatttctgttgtaaatgagataattttagagtggaggctaaagattctgagatggatgccacttgagaaaggaactatataatacctgataatttagaatcctttctctcttaaaaactctaacagctcttgggcctttgagtaaaaaaataaaataaaataaaaacagaccttggtttaaattccttttcttgcacttgccagctgtgtgaccttgggtaagttacataacttctctctgccacagagtattcctctgtaaaataaaggtaacaaatctacttcatagggatgttgtgagaagtcaaatatataacttgtgcacattgctagtcccattacctagaacatggtaaatgtaataagtggtagtttttagtgaaaagagaactgaaatgatagaggtaaaggtgaaggtaaaaaggtgctatcattccttttgactggcttcttttaaatacctagacgattctttcaggggtttgtagatcatctagaacttccctagtatttccagtcagccataaagaggattctcagaaagtctggcaatctcattataaaccctgaatcaatttactattattggaatttcttgcatcctccttgggattttcctgagataataatacccaatttacaaattaaaaatcatttcagggcttctcaaaaatttccacaaaagtatccctaaagtcataagataatgcatttatatacctggaagtgtataaaatatataaaattggatgtcattttgtttcatttcttatcttaaaaattgatataaatttaacaagccaagaaggctatgcaatacttataatactctctgatatgtgtgtgtgtgtgtgtgtgtgtgtatatatatatatatatatatatatatatatatatatatatattactgtgaatgcctaggggtaggggtattcttgcctcagctcacaagtaaagatatatcccatttgatttttgatccttacataagccctaaagatactgccaccatcccctggtgtccagtgaggaaaactgacacagtgattaagcaaattattcagatttatacagaagctagaggtggaactccaatactaagtcttttaattgtaaagcccagaggaaatttctcaagaccccagtgcctatacagtggttgattaactctttcacacaaaacaattcttttatatataaatatgtttcatattctacttacaaccatgataatataacctacttttacatggaatttaaaaactcaacataacatatgatataaagaattaaacttaaagttgaaattaaaataacgtatacttcaatggcaatactcaggcaaaattccatcaatggcataattaaatgggcaggtgcttgcacccacatgtatagacagatgcaggtatattgaattggctacacaaagcttaaaagcagcactgctatcagtgacacaatattctgaactgttgaaaacttttggtaaagttctgagtaaaacaaagaacattcttcccttatatcagaacggaatttcttatagagaaattgcgttattgaaaacttcagtgtatatcaacttaatgcaagagatgctttgtgttaaatacataaaacgaagtatgattccaggctcaggaaattttatcaagtatctaatataaattaatgtccagtaagatatttaaagagggtagtactggccttaatgagaaccacttgaacgcacagcctgagagtaaatgtagatttaggaatacatacttgcaaagatttttttaaattccttaccacaattactcaccaccctgtaccaaggaagttctacatgtactttcagagtgtaaaaagcctactcttctggataagagaaaagtctaagaatgagtgcctcacaagcaatcacacattctaaattaaaagactgaaaggacaatggaatggacatatcttaaccaataaagaaaaaaagccttcagggagtgaccatctcaaaatcctgttactccttaatggttggatcagaggctatctttttatgagatcagcccctacagagtcttttttctgaatgccttcaacatgtattatttgtattgcccaatttagtacctgattatacagtgtcttgtattgttctcttattgccttttgtgcctaaaattcatctcaaccccacattaagcacttcaaaagtaaaggacaactatgagctggaaaatagttcccttgagcacatagtattgttaattattcttcatgaactgacagattggtgagcagctggaaaaaaattaatgaaaaacctcaaaaaggctccaacactgcctgataatcctaccctgttctttgaacaacctcctccatcctcttttgaaaggcgattgcaaacattctccactctcctcaaacctcacaccttcctccatcctcattccacttagtagatagttgccttctactaagaagaaaacaaaaacaaaacaaacagagaaaacaaaagccaacacacaagtcctcaacttttaccgcaaaataaaagaaaaatcagtgactgcccttccttcttttgctcctctcagtgtatgttcccctctcatcaagactggatctttctctcttcgtgatcctccttatgacaatttatattcatgtgcaagactttcccatctaaaaacaaatgcaaaactataactacttcctctaatcacagttccatatcaagctactactatccttcctcattccttgacacacaacctttttaggaaagccagcccctcactctccatccatttcctcattttccacactgactctgacttcttaacacattgatttatgtcctgtccccagccccttaaaattgggcatcacaaccaacatgtcacttatttaactgtcacttctctatcttcaccctcaccctccacacttctgggcagattccaaacagctgagcttcccctcctcttgaaacacccttaccctacggcttctgaccttaggtttccccaccacaacctttcagtatttttttttaattttaagttcaggggttcatgttgaggtttgttaataggtaaacttgtgtcatgggggtttcttgtacagtttatttcatcacccaggtattaagcctaatatctgttagttacttttcctgatcctctcccttctcccaccctttattttctgatatatgaaattgaatgtctttgtgtcattcccctctatgtgtccgtgttttctcatcatctagctcccacttgtaagtgagagcatgcagtatttgcttttctattcctgtgttagtttgctaaggataatggcctccagctccatccatgttcctgcaaaggacataacaactgttcatttttatggacgcatagtatttcatgtactacatgaagaaaacataccacatttctgcaatgaacatatgcagccatgtgtctttataataaaatgatttatatttctttgggtatatagccagtaatgggattgctgggttaaatggtatttctgtcttgaggtctttgaggaaatgccacactgtcttccaatatggttgaactaatttactactttactctcctagcaatagtgtatgtgttcctttttatccacaaccttgccagcatatgctatgtttttgactttttgataataactattctcaccagtgtgagatggtatctctttgtggttttgacttgcatttctctaataatcagtcatgttgagcttcttttcatgattgctggctgcatacatgtcttcttttgaaaagcgtctgttcatgtcctttgcccactttttaatggggctgtttgctttttttcttgtaaatttgtttaagctccttacacatgcttattattagacctttgttgaatgaatactttgcaaaatttttctcccattctgtaggttgtctgtttactctgttgatggtttcttttgctgtgcagtaggtctttagtttaattcattcccatttgtcaatttttgcttttgttgcaattgcttttggcatctttataatgaaatctttgcccatgcctatgtcctgaatggtactgcctaggttgtcttccagggtttttataattttaggttttacattgaagtatttaatccatcttgagttaatttttctatatggtgtaaggaacaaggtccatcttcaattttctgcatataactagccagttagcaccattatttactgaataaggaatcctttctccattgcttgatttgattattttatgttccggatacatgtgcagaacatgcaggttagttacataggtacacatgtaccatggtggttttttgtacctattgacctgtcctctaagttcccacccctcacccccaccacacaacaggccctggtgtgtgttgttcccgtccctgtgcccacctgttctcattgttcagctcccacttatgagtgagaacatgcagtgtttggttttctgttcctgtgttagtctgctggggatgatggcttccagcttcatccacatccctgtgaaacacatgatctcattccttttttatggctgcacagtattccatggtatatatatatatactacattttctttatccagtctttgatgggcatttgggttggttctatgactttgctattataaatagtgctgcgataaacatgtgtgtgcatgtgtctttatagtagaatgatttatattcctttgggtacgtacccagtaatgggattgctaggtcaaaatgttatttctggttctagatccttgaggaatcaccgtaatatcttccacaatgcttgaactaatttacattcccaccaacagtgtaaacgcattcctatttctccacagcctcaccagcatctattgtttcttgactttttaataattgccattctgactggcatgagatggtatctcattgtgggtttgatttgcatttctctatcagtgatgttgggcttttttatatatgtttgttggccacataaatgtttttgtcagctttgttgaagatcagtaggtgttcagtcttatttctaggttctattctgttctattggtctgtatgtctgttttgtaccagtaccatcctctttcagttactgtagccctctagtatatttttaagtcaaatagtgagttgcctccagctctgctcttttcgcttaggatttccttggctttttgggctcttttttggttccatatgaattttaaaatagttttttctagttctgtgaagaatctaaatggtagttaataagaatagcattgaatccataaattgctttgggcagtatggccattttaatgatattaatttttcctatccatgagcatagaatatttttcatttgtgtcatctctgatttttttgagtagtggtttgcagttctccttctacagatctttcacctctctagttagctgtattcctaggtattttattcttttggtggcagttgtgaatgggagttcattcatgattcggctctcagcttgattgtggttgcagaacaggaatgccagtgatttttgcacattcatgttatatcctgagactttgctgaagttgtttatccactcacaaagcttttgggctgagactatggggttttctagatataagatcatgtcatctgcaaatagaaataatttgacttcttctcttcctgtctggatgcactttatttccttctctttcctcattgccctggcaaggacttctagtactatgttgaacaagagtgatgagaaagggcatccttttattgtgccagtttttacaggggaatgctttcagcttttgcccattcagtacgatgttggttgtcggtttgttctacctggctcttattattttgaggtatgttccttcaacatctagtttattgagtttttaaagaatttttaacatgaatggatgttgaattttattgaaatcctcttctgcacctatttagataatcatgtggtttttgtctttatttctgtttatgcgataaatcacatttattgatttgtgtatgttgaaccaactttgcatcccagatataaagcctactttatcatggtggataagctttttgatgtgctactggattcagtttgctagtattttgttgaaaatatttgcatcaatgttcatcaagaatattggcctgaagttttctttttttaatgttctttttgctaggtttgggtatcagaatgatacgggcctcacagaatgagtcagggaggagtcctgtctcaattttttggagtagtttcagtaggagtgataccagctcttctttgtacatcctctttgtacatctgtgaatctgtatggtcctgggtgttttttttttgttttgttttgtttttttttttttttttttttggtgggtaggctatttattactgtctcaatttcagacctcattattagtctgttacaaccctcagggaatattatgaatacctctatgcacataaactagcaaatctagaagaaatggataaattcctggacacatacgcccttccaagattgaaccagaaagaaattgaatcccttttagtatttttactgtctcttcctgcagtaccagacttttatatgcccgagttccttaagactcagactttgtttctcttgtttttccatttcataccttttcctaggttttcttgttaattccattacatcttattatcacttctgtgatgataacttccaagtctttttctaacccacatccattctctgagctccagacccatttaccaaattgtttgcctgttactggaacttcgaattcattattgccaaaactaaactgaatttctgcctgaaacttcctcttcctcctctctttttcctattttaagaaatggcacttcatttatccagttacataagtcagaaatctagcagtcacctctgacaatctctttccctgtacttccaacagtcagtaaattatcaagtcctactaattttcttagatatttgcagaatgtgtaatgttttcaccagattcacagtaattatccatattcttgagtggttattgcagaaatcacctaaatgttttccttaaatatattcttgacccctctaatccacttttgacccagatctatgaaagagatcttttctagacataaatatgaattatatcattctctgttcctcacaagtttgctagcttctcagtactgtttaaatacagtcccagatatttaacaggatcctcaaggtcctgcatggtataaacccagcctgatttagaatcaggtatcacttcatattctatgatccagccacattgaacttgttttgattcctctaaagtactatgccctcttcaacacaggaccctcctacctgcttttccataggtctggaacagtggctgtcaaccaggagtaatctcacccaccctctagaagacatttggcaatgtctggacacacttttggttattataactggggaagagtgttattggcatctaatgggtagagatcagcaacaatgttgatcctcctgcaatgcataggagagcatatcatgacaaagaattatccagcccaaaacgtcactaatgctgagattagaaaactctaatctagaaagctttcccttctacctgtaccccacatgaccctgcatctagccaaaacatatttaaatatcctgtgtcagcttaagtggcctatcttcagagtaaaacctccctgacttttgtctataggtcaggtctacctcctatttacgcttataatatttttctttacttttttagcccttactaaaatttaaaactagttacttattcagttaatgtttggcttccatgccagattttaagctctgtgaggttaggaaatacatttaatgcaatatccttatcatctggctagatactcaacatacttattaaaaagtaaattaacggatgaatgaatgaagctgttacctagaaagaagaatgttaggcctacgatactgtataagtgatcctagctttggcattaactagatatatctctgaataagtcctttaacccttcatgtggcctcattttaagttatataaacttttactataatgagttttatgaggattaaatattttgataattctaaagtattttgtagtcctattagaaattataggttagcataaaaattggtacaactacatggaagggattaacatgaaacaaaagccttaaacacatatttttacttaaatatttcacttataaaaatttatgaaaaaattactaagcaaaaatatagctatgtggattttatcattagttaaataaataaatgaactatagtgaatattttaaatataatgtatatttgataaggaagatatatatgtgcaatataatacaattctatatacatattttatacacatgtatacacatgtacaataaaaaaatctaaatatcaaaatactggcagtagttatcttaaaattacaggattatgcaagttttaattgtctttttctgtttcaggactttcctaatttttctacaatgagcatggcttttgaaatttaaaaaaaggtaagaaatgagtgcggaaaagcacgtcttacactatgaagggactgtaaggagttgctatgttataaagaataagatataaaccttaccttttagaggttttcaaatgaattataaaaataaaataccggccgggcatggtggctctggcctgtaatcccagcactttaggaggccgaggcagctggatcacttgaggtccggggtttgagaccagcctggccaacatggtaaaaccacgtctgtactaaaacacaaaaattagccaggtgtggtggcagatgcctgtaatcccagctattcaggaggctaaggcaggagaactgcttgaacccaggaggcagagtttgcagtgagccgagatcatgccattgcactccagtctgggcaacagagctaaactccctctttaaataaaacaatccaatcaatacctatctagataactgttagataagaaaaaaagttaagaacagtttccatcataatcatttaatgagcacttactacatcccaggctttccatgcattaatttatgaaatctgtaaaacaaccacattagttaggttttatcatattcatttaatagatgaagaaactgaggccactggggttaaacaaactgctaggtcataccagaccaaaaaaaaaaaaaaaaatcaaattcaaactaaagtctcagtgatatcaaaacttctgttcttttcagcaggtacttataaaagatatataagtcaactgggagtccagagaaggggtggttacttgacagtgagaaggcaaaggaagcgtatatacaggagttaacagtttagctaactctggaggacgagtaggattttaataactgaagatgggggagaggacatgaggaaaggcatttcttaccaagggacacttgaacaaaagtgagaggtaaatggatagttcatgaaattttgggggaagtttgtaggcagactggttagaaatgaattaaatacaggaattttgtttaatcagtaaagggaattgaaatttgataggacttcaaagatcaacagaaagtggggttagaatactagaaaatctataatattttgacatactagaaatatgactagtcttaaaagtacagcatatgatggcacattgcactgtctgtgttttcaaacacagagaaacttagaggtaggaggggacttggagagcatctgagaaaactctggcccagaacagagaaattgttgtcaaaagtcataaaactagactagaatccaagtcagctcagtcctcattctggggtcagttcctagaaaaggaaccttgaaatactgtgtggctttttaacagttctgtgaggtttgtattataataactatttcataccagcagtcactggagctcagagaaattaagtaacttctacaaagttatggaaccaaagctcatctcacccagaactaatgaccttcttatgaatggagatattgccttattctgctattatgtccccatagcatcttccacagggttcttagatacccaacaaaaatcaataaaatatcagccattattcattactcttgataaggatcatatatattgattttatggatagagaatactaggtgactaaagaaggaaaaataattgagaaaatcataaattatgaatttaattacatataaattttaaacatagcttacttttgttaagagttttgccttgattatagatcactagctgccactaaaaaagtaaactgtttagattttgaaagtcttatatttcccactaaagaaattcagccaacagatccctatgggaaatgtttctttcttgtaaagcatacagatttacttaaatccttaaataattagacttcagaaccagaatgcaattagaattaaaattcataaatgtgttgtctttttccattggcaaaatgtatatggaacaatccacagctggccacatctgcatatgctaccttccccaaagccagcaaccatgctttctaattttcgccaggggtgtctaactgtgagtacacaggaaatgagagcaataaggttattaggggaaatgcttcatcttatataagaacatttgattatgggaaatttatctaaaatatagataaattataaacatagataaatataaccctttgtgtgcacatgtttgcatttcttgaagtactcccaaaataaaattaagcacattcaaaattatagttggatggaaactttgtagacaaacggctaaaatttcctttaagtgttcaaaaggagataaattagaaagataaatacataagataaaacaatatgattatctccaaataatacaaatttaatgattacttattaaaaatacaaaattacatgagaagtgaccttatacaactttgactaagtgtccttatagctccccaaagatattataacaagtatacaactcaatttgagagcctgactatacaaaaaaatggccagatcatttacaacaacagatcttaaaaataaatatttatttttaatttttatgggtacttactaggtatatcaatttatggtatataagataccttatagagacatacattgcataataattacatcagagtaaatagggtatctatcacctcaaggatttatcaattctttgtgttataaacattccaattttacttttagttattttgaaatgtataataaatttctgttgactgcaataattccattgtgttatcaaatactagatcttattcattttatctaactatatttttgtacccattaaccattcccatttccaccatcacccttcccaccatcacccttcccaccactatccttcctagccactggtaaccatccttgtactatgtccatgagttcaattgttttcatttttagctcccacaaatgagtaagaacatgtgaagtttgtctctctgtgcttggcttattccactgaacataatgttctccagttctatccatggtattgcaaatgacagtatctcattcttttttagtggatgactagtattccattgtgtatatgtaaaacattttatttatccatttgtctattgatggacatttaagttgcttccaaatcttggctattgtgaatagtgctgcagtaaacatgagaatgcagatatctcattgttacactgatttcccttcttttgggtatatacctatcagtgtgtttgctgggtcatatagtagttctgtttttagctttctgaggatcctgcagacttttctccatagtggctgtactaacatgtatttctgccaacagtatacaagggttcccttttcttcacatccttgccagcattcattattgcctagtttttggataaaagccatttttactggagtgagatgatatcacacattttagttgtgatttgcatttttttaaatggactcttgctctgtctcccaggctggaatgcagttgcacaatctcagctcactgcaacccccgcctcctgggttcaaacgattctcctgcctcagcctcctgagtagctgggactacaggcatgtgccaccacacctggctaatctttttgtatttttagtagagacagggtttcatcattttggccaggctagtcttgaactcctgacctcagatgatccacctgcctaggcctcccaaagtgctgggattacaggcatgagccatgcccagccatgatttacacttctttgacgagcaatgatgttgagcaccttttcaaatacctatttgccatttgtgtgtcttcttttgagaaatgtgtattgagatcttttgcccatttttcaattgaattcttacatttctttcctattgagttatttgagctattgagtatatattctgtctcttaatcccttgtcaaatgggtagtttgcaaacattttatcccattctgtgggttttctcttcagtttgttgattgtttctttgctgtgcagaagctttgtaacttgatgtgatcctattttacatttttacattggttgcctgtgcttttgagatattactcaaaaaattattgcccagaccaatgacctagagagtttcctcaatgttttctttcagtagtttcatattttctggaattagtttgaagtctttcatccattttgaattgccttttgtatatagtaagagatagcatctagtttcattcttctttagatggatattcagttttcccaggactatttattaaagagactgtcctttccccaatgtatgttcttggtgcctttgtcaagaatgagttcactgtaggtatacaaatttatttctgggttttctattatgttccattggtctgtgtgtctgtttctatgccagtaatatgctgttttggttactatagctctgtagtataatttgaagtcaggcaatacgactcctccagttttgttctttttctcagaattgctttaaatattctgtatcttttgtgttttcacataaaatttttaagattgttttagctatttctgtgagaatgtcattggtattttgatagggatttcactgaatgtgtagattgctttgagaagtatggattaattaatagattaacaatattgattcttctaatccatgaacatggaatatctttagatgtttttgtgtcctcttcagtttctttcttcagtgttttgtagttttcattgtagagttaaattttatcaaatcttttttcagcatcaattaaaaggatcatatggtttttatccttcattcaattgatttgatgtatcacactgattgatttgcatatattgaagcatccttgtatccctgagatagatcccccttgatcacaacgagtgatctttttaatgtgttgttgaattcagttttctagtattttgttgagaatttttacatcaatattaattagaaatattagcctgtagttttctttctttctctttttttttttttgatgtgtctttttctggttttgacataaggataatactggcctcacagaatgcatttgaaaagattccctcctcttctctttttcagaatagtttcaataagactggtatcaattctttttcaaatatctggtaaaaatttagcagtgaagacatcacgtcctgggcttttccttgctgggagattttttattatggctaccatctcattacttcttattggtctgttcaggttttagggttttagatttctccatggttcaatctggataggttgtatctgtctaggaatttttgcatttcctccagattttccaatgtacttgcatatagatgctcatagtagtctctaattagactttgaacttcggtggtatcagttgtaatgtctcctttttcatttctgattttatttaattgaatctttttttcttagttggtctggctagaggtttgtcacttgtatcttatgaaaactaacttcttattttgtttatctattgtatttttgtttcaatttcatctatttctggtctgatctttattttattttactaatttggggtttggtttgctcttgcttttcttgttctttaagatgaatcactggttgtttatttgaagtttttctacttgtttaatgtaagagttattgctataaacattccttttagtattgccttcagtgtgttccacagatattggtatattctgtctccatttttattttttaagagattttaacatttcctttattgacacactaggcacattcaagagcatattatttaatttccatgtgtttgcatatttaatacttcccaaagttcctcttattattgatttttagttttatcccattgtggacagggaagatattttaaattattacaattttttaaaattttttaaggcttgtttcatggcccaacatatgggcaattcttaagaatgacccctgtgctaaggtgaagaacatgtactctgcagccaatgggggaactgttctgtaaacgtgtattaggtccatttggtctatggtgcagattgagtctgatttttcctttattttctgtctggatgatctgtttaatgctgaaagtggggtgttgaggtctccagctattactgtattgagatttttccctctctttggctttaataatatttgctttatatatctgggtgctccactgttaggtgcatatatattaacaattactatatcctcttgctgacttgaccccttatcattatataatgacgttctttgtctctttatatagtttttgtcttcaaaaccattttgtctgatacaagtatagtgactcctgctcttttttggtttccatttacattaaatatctttctccatctttttctttcaatccatgtgtgttttataggggaaacatgtttcctgtaggccacagatttttgggtcgtgtgtgtgtgtgcgtgtgtgtgtgtgtgtgtgtgtgtgtgtgtgtgtgtatctattcagctactctgtcttttaattgaagagttttgtccacttacattcaacattcgtagtgataagtgaaggcttattcctgtcaatttgttatttgttttttggttgttttgtagtcatcctttccttcctgccttcctgcctgcctttctgccttcctaactgcctgccttcctgccttcctgcattcccacatcccttcctcccttccttcctgtattccatttagtgaaggtgactttctctggtggtatgttttaatttctttcttttatattttgtgtatctgttgtaggtttttggatttgaggttactaatgaggtttgcaaataatgcctcgtaacatgttattttcaactgatgacaacacaattgcaaaaacaagcagaggagcaaaaagaaaactaatgaaaactcaacactttaacttcatccccccgatttttaactttttattgtttctatttatatcatattatactttctatgtctccaaaagttgttgtagttgtcatttttgatagctttgtcttttagtatttctactcatgatatgaatagtttgtataccataattacagtgttataatattctatacttgtctgtgtgcttactattaccagtgagttttgtaccttcagatgatttcttattgatcattaatgtccttttctttcaggctaaagaactctctttagcatttcttagaagacaaatctattgtatatgaaatccctcaccttttgtttgtctgggaaagtcttcatttctccttcatgtttgaaggatattttcactgtatatattattctaggataaaaagccttgtaaatatgtcgtgccattctcccagcctgtaaagattctaccgagaaatctgctgccagatgtattgaagctcctttgtatgttatttgtttcttttctcttgctgcttttaggatcctttctttatccttgacctttgggagtttgattattaaatgttgtgcagtagtcttctttgagttaaaatggcttggtgttctacaaccttcttggactttagtattgatatctttctctacatttgggaagttctctgttattatcccttcaaataaactttctaccccaaactctccatctacttcctctttaagaccaataactcttagatttggccttttgaggctattttctaggtcttgtaagcttgcttcatcattttttgtttttcttttgtctcctctggccatatattttcaaactgcctgtcttcaagctcactaattttttcttctgcttgatcagttccgctgttgagagactcttatgcattgttcaatatatcaattgaatttttcagctccagaatttatgcttaactgtttttaattatttcagtctctgttaatttttttttttttttttgagacagagtctcactctgttgtccaggctggagtgcagtggcatgatctcggctcaccgcaacctctacctcctgggttcaagtgattctccttcctcagcctcctgagtagctgggactacaggcatgtgccaccatgcccggctaattttttgtatttttggtagagatggggtttcaccatgttagccaggatggtcttgatcgcctgacctcatgatttgcccacctcacctcccaaagtgctgggattaccggcgtgagccatcgtgcccgatcttgttaagtttatctggtaggattctgaattccttttgtgttcttttgagtttcactgagcttcctcaaaacagctattttgaattctttgtctgaaaggtcacgtatctctgtcactgtgggattactctctggtacctgatttagtttatttggtgaggtcatgttttcgtagatggtcttaatgctagtggatgttggtcaatgtctggacattgaagagttaggtatttattgtagtctttacagcctgggcttatttgtacacatccttcttgggaaggttctccaatccaagtattcaaaggtaactgactattgtgatctaagtatttggtcactatagccgtatctgcactaggcgacaccccaaccccaagcccaagaacgctgtgagtcttgcagacctgtagaggtaacaccgtggtgttcttgagtgagatccaggagaattcctgagattaccaagtagaaactcctgctctcttcccttactttccctcaaacaaacaaaccctctctctctgtgctgagctgcctggagctatggagggatgacaaaaacaaccctctggctaccaccactgggactgtgctggatcagacctgaagccagcatggcactgggtctcgcccaagacccatgtcaatcactgactggttaccaccgatgttccctcaaggctcaagtgctttacctcccacagacagaaatccagctaggcttatggccttttctttagggcagcaagcttcccccagcctgccagcccagggcacgtccagaaatgccatgtgttagctatgctgcctgtggttgagaaagaggaaacacaagtgcttcttggccacccttgctggtgtatcactaggtaatgtgcatcccacgtccactgggatccaggatctaggtcatgtgcatccgacatctactgggatccaggatctggatttgggaacctgaagaagccacttggtgctctattcaactgcagctgagctggtaccttagccacaagacaaaacccttctcacttttccctcttctctcctcaagcagaaggagcttcgccctgtggctgcgagtgtctcactcaggcccatggcaagtactgtctggctacttccaatgttcactcaaggccggagggctcttcggtcagcttgtggtgaatgctgacagccctgtgcctctccgttaagggcagtatcctccctttggcccaggatgggaccaaacatttcatccaggaaccaaagtctagaatcagaaaccccaggggtccacttagtgctctacgtcactgtggccaagctggtacccaagctgcaaggcaaagttccctttattcttccctttcctttcttcaaacagaaggaatcccttctccatggccaccacagctggggatgctctgggtcacacctgaagccagcccagcaatgagtctcacccaaggcccatgacacatctggcaacaactgatgcttattcaaggctcaagagctcattagtcagcaggtgttgaattctgccaggactgtgttattcccttcaaggcagcaggttcctttatggcccaggatgtgtccagaaatctctttcaggagctagatcctgaaataggggcttcaggactctgcctagtgccctattatatagttctggagctggtatccaacttacaagacaaagtcctctttactctcccttctcctctcctcaagcagaaggaaggagcaactatagagctgtttgcttatgctgtctgtggttgagagagaggaaacacaagtgcttccttggccaccctagctggtgtatcactaggtcatgtgcatcccacgttcactggctccaagctcagcccagcaccaggacttaccaaggaatttcagttattgtggccttgactgcctttcaaatttatttagagccccagagccctttagcatgcaatggtggtgctagccggaactcaggttctggctgctgagatgaatgattcccctctggctagggctggtctaaattctccttatatgtgtgccagccaatttttgctctgtgttgctttccattattataggacagcactgatttccaatgccaagtccagccatcactttgctctccctctcccaagcacacagattctatgtgccatgcggccagtcgctgccattgccaggggatgggtgagggatgatgttggcaattcaagatgtctttgcttccttctttagtgtctccttccttgataggatttaaaaaccaggtactgtaattgcttacctgatttttggttcttatgagggtgcattcttgtgtggatagttggtcaatgtgttgttccttctggcaggggtagggggcgatcactggagggttctatttggccatcttgcaccactgcctcttcccaatagatctttgacccacagtctctgcagtaactggctcaaaatggtgatgacttggtcaatgactgccagcttccctaatttttgctcatagtaccaacatagaaccagagaagaacaaatattatctgcaaactaatcacataggatgtcccacttatagttaggctgcctccaaattcctccatgccaacaacctccaatctcaacagactagaagccttcccccaccacaccccttgctatgatgctttcctacacccttacccacttttgagtctgccaaatccaagtgatggtggctgactcctttgctatatagaaatttctgaataaatagcctctgcttgttcatatttgagtggtcttcatttacttccacaaatatttgcagaaagtggagattaattttatttaggataagcattattctcaatttaccagggttagttctgggttttgcccattctctctgtgtaattaatagtatgctcttttactctcataagtgtccttggttgaacaataaattacataggtactatgattttaggcaatttattcattagacaatgggagtaacaggcaaactgttattaaataacttgtcctagagcaatgataggtaacaaagagaagtgtactgggccgttaggtagctaacttcctctctgatcataaaatcaattgtcaggttagaaggagagaagtattctaccttttgtatcagagtttttctgatggaatttctagctttagtaaacaggagataggattttaagaggtgtcctcttttccccttgaggcattcctgccacccctgcaggatgatgcaatagttgccatggcaaatacttctcccacgctgctggaaggccttcccatagcagactaacttctgttctgttctgtttctattttcctttttctctctctgttacattgtaagttactcttgagtttagattcagactataaccttctctctagcttctttttttttgaaagcaatttgctgtctgtctgcttttctgcaacctactgtgcatatccagagataagccctgatggcagtcatgtggaaaagtgtggcagacagaagacatgaccaaagaaagcaagggcaggactggaatgagtcaactgaaagcagggattcttcaatttgctaatctcaagtgctctgttttccaatgaaaatacgaaattttgtcatctaaatgcccagtttatgcaaatgcatggattttccctgaagaacagcacattttatcatacagtaatatagattcaagggcttcaatgtcagaaacaccttgttttaaatccgtaaggttcaagatactggaaacaatttcttttttggccaccaatataaacctaacctggatcttgacaggtacaaaatacatatttgttccctgcatgtctgattgatttgtgatccaccacatataagtaccatgaccttggtaagttacatcatttctctgagcctcaatgtttccatgtgtaaaataagaaaaataaagccatcttataggattgctgcacaatttaaatgagacagagtatgagaaattcctagcagatccctgccatgcagtacatatttgacagttactgcgttcattatttctgttgttattgaaaagatcagtttaggagggtcctactgaaaaacatttcagtaaatacttttcggaggacccgccccgaaaatcacgtaggttcttttctattttcctaagcgtcggctggcttgagaaataaagggacagagtacaaaagagagaaattttaaagctgggcatccgggggagacatcacacattggtaggatccgtgatggcccacaagccacaaaaaccagcaagtttttattagggattttcaaaaggggagggagtgtgcgaataggtgtgggtgacagacatcaagtacttaacagggtaatagaatatcacaaggcaagtggaggcagggcgagatcacaggaccacaggaccacaggaccacaggaccgaggtgaaattaaaattgctaatgaagttgagacagggatttgagatcaaccagtctgaccaaaatttattaggcgggaatttcctcttcctaataagcctgggagcgctatgggagactggagtttatttcatccctgcagtctcaaccataagagacaggtacaccctggcgggcggggggtgggcagttcagagacctacccctaggtgcgcattctcttcctcagggatatcccatgctgagaaaaagaattcagcaatatttctcccatttgcttttgaaagaagagaaatatggctctgttctgcctggctcaccggcagtcagagtttaaggttatctctcttattctctgaacaattgctgttatcctgttcatttttcagggtgcccacatttcatattgctcaaacacacatgctgtacaatttgtgtagttaacgcaattattacagggttctgagacaatatacatcctcctcaaccgacaggattaagagattaaattaaagacaggcataggaaatcacaagggtattgactggggaagtgataagtgtccatgaaatctttacaatttatgtttagagactgcagtaaagacgggcataagaaattacaaaactattaatttggggaactaataaatatccataaaatcttcacaatccacgttcttctgccatggcttcagccggaccctccgtttggggtccctgacttcccacaacaaatacgtccaactaatatattctgattatttacacttagttgaatctcaaattagagtacatcatgcttaactgtcactcatatttgtacatttttaaagtttggagcatctgcactgtgctaagaatattcctgatttctggtagatttcatactgctttttcaatgttctaacaactcctaattatgagaagattaataaaaaaaaatctatggctgtctgtgggtgttatctaattccaagccctagtcagagcaaatatggctattttagtctcattactagaaaagtaaaataaagatcttttgaaaatagatataacacagatctattcctcctaacttatacagtgacaaaaattctgaatgacaaatagacttcctgaaagtagaaggctattttaatatatttatgcacatatgcagctacactttaaatatatataaatctatatacattcattaacaaagatttattgagctcctaaaaatgctgtttgttccagacactatagtaggtattgattatatagggtgaataaaacagataacttccttcttgtgtggagtcagtttctttgctcttgctccttttctcttgttcccttgcatatagtcataagcacacacacgcacgtgcatacacacacacacacacgcacccctcccacaagcctacatgcctatctgcggatatctgtgagtatatatgtacacatataaccccaaagcttggtctacataatatgaattccaaggaaaatttggctagaaaaaaaaactaaactgcatattactaaaagaaacaatggagttagtaaccatgagacattacttctttacatatttaattatttactttaaatctatttttactttggtttgtttcacatggtatttaaagtagactctaccagataaaatgaactcttcatttccattaggacagtaaagcctaagggacagctgagcaatgaatatggctttctgttcagtttagttttgccagaagcacatctgcattgaaacttgcatatgctgagagggaatgactgacactttaaaaactgtgcttctagttacactgcaagtacccataccatttagaatgtctcataatatgctagaaatcatgccaagagatttttaaagcattattctaatctttacaagcatcctatatggcaagatcttcatcttaaagatgagacatgaagtttttataaactcatgatacattgtattaaaaatatgaacttcacaattgagagagcatgcttaagtttaggataatagcaactactttatagtgctttgtaaggagtaaattaaatggcaaacacttggtatatgtttgtaattagggtaggacctaattattaagaccagagcataaacagaaataaaatgtttgatttgtcattcttctcttttataaataccgacgagcattaaaattttaactacaataagtcctcatatgtacatggctttaatacatacatatatatatacacatatatatacacatatatatgcattctatatatatatacacatatatatgcattctatatatatatacacacacatatatatgcattctatatatatatacacacacgtatatatataatatttatagtgttttgtgattattttagtttgcatatccagggccacatacaagatatgcaaaaatatatgtggttcattttaaagaatgtataaacatatgcagatcattctgaaatatatataggcattaaattaatatacactaaaattcactcttattcttactgcatttaaaatcttaagagttaatactattgctctgtgttttgaaaatgcttgacttactgggaaaccagtcattgaatatgtggatttagaaactgcataattataaattttctccagagtggtcctcactcacaggtggtaaccttaaaaagcttataatgtgtccttttctaataaacaatgtaacaattaaatgctttttcttatctctcagggtacaaatccaattatgcttacttcttcctgattgtactttgtatcagccattaaatatacaaaagaaatctaagacgtaaagtaactcactgcctctaatgtgcccctccattagcatgacctttttctcagtgcttaagaataaaaccagaactggccgggcgcggtggctcacgcctgtaatcccagcactttgggaggccgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactcccgcctgggcgacagaacgagactccgtctcaaaaagaaaaagaataaaaccagaacttcatttaattctaaacttcaacaagagtgaggtgctgcagtttaatattaaaaaaaaaaaaaagactggacacatgcaggaattgtggctaggcctctatctttaatgtgctcacatgtaaagtaaatagtgagggttgagaatagagattttaaaaaaagaatgtaatatttaaggtcattatgaagcacatgattttatgtttatgtgttaacagtcccagaactacattgctgaaagggtacattgagggttgtaaaatctgttcctacaacccaataccaattcagacctaaagatgatttttccatttgtctttacaaccaattccaaacttaaagtcactagtctccaaggttttccgtgagctgaaacttcttagccttttcaactttattttctaccagtttctcaaagtgctttcagcttgttcattccactttgtaaattaggtttcatgaaatctttcccaccttttcatttctcctgccactaccctagcttagatcttcattttttaaaacctggtccattataataatatcacaattatcatcctggctgtagtctcacacccatctttacattgcctctacaattacctctttgaacaaacaaatcggttcatgtcattttctgaggtggaattgggggtgtttcctatagttcctggtcatctgttggataatatccaaatgcttactgggtcttggattatttcattccaacattatttctccagccatatcttctgctaaaacacaatgacacagtcaagtctgaagttccccggatgtgcaattgattctcatatttctattttttcatagtaattgtctcagcctataatactgttccccctgcctttacctggccagctacttcccatccattccccactgtgccatactgcaggagaaattaggggtaagccatagctattcatcttgagaaacttaattttaattcagctcatccattttttagctttgtaactatggacagtttacttaatctatcaaaatcttattccccttatcaataaaataaaaatacttatctctaatttgcagggtagttgcaaatattaagtgggataatataagtttagcacccggcatatggtattcttcttttaatcatgttccatcctactttattttccatattgcatacaatatgatgtctctagaatgcaaaactaatcatatcatttctttgcttcaagtccttcaatgcattcctatttctacagcctacaagtctccccttgttatccaatacagccttatttctcaccaccgcccttcttcaatgctttgttccaggcagttgaaatgcttcaagttcctcaactgtaccaaattttccctcacctctgggccttagtatgctaaggtgtgccttagtatatacattgttccctcttccatgaacaccattttctatcatgcctctctttacacgtatcctgtatgaaccattatcacatttacctttccgcttgattttattgctcttcccctcactattaggattgggatttatgtcagtcttggtcacggtgactctttagtgccctacatagcttttatttgcaaatctctatctactttaagcctacccttactataagaaaaagtttaagtctcacctggacctctgcattggactctcctctttctactgtctaggtgctttcaccaactgagtcacaacacagtatctctctgtgataaaatagcaatatgagtttcaagaatggggagatcaaggagcaatagtcaagggaggcatcttaaaggataaaaaaaaaaaaaaaaccctcacgtcgacattaaagaatgtatagaatcaaggaaagtagtgaggaatttccagccacagctaataatataatggatcacgttccttttattcattcagtgaatctttagtaagcacttactttgggcaagaagactatgttagcagcctattacacactaaggttggtaaatggataggctttattgagcagaggttataagcaggaattcatattgaatagattttggtggaacctaattacaaatggccgcaatcccatcagacattggtgtagtcatactccaaacactggggtgcctccttgacctttgtgacgctttactcattttctcaggtattgtctagacagtcccctattaggcttctaattccataaggattgagatttttcttgtctgttttattcactaataaatcttcacttcgactgtaatcaagcacaggacacacaattaataagtatacgctaggcaccgtgctaagcctatgtaccatactgcataaaaatgtattagtttatatgtctcttctgtactacacgagggttggcaaccattttctgtaaaggccagttagtaaatatttctggttttgtgagccagataacctctatcacaattaccctactctacccttgaagcatgacaacaatcacagataatatgtaaatgatacaaattactgtgtttcaataaaactttgtttacaaaaacaaatggcaagctagatttggcctatggactgtagcttgcagacctctgttctagattatactccttgagggaagaatattacttgttttacattgcagtattttacccaaagcctggtccataacagtgctcaatagtaaaagctctaagtttttattctgtaccagtcattcttttaaataattgacacgtaatagcatatttaatcttcataacaaacctatgcagctgactttattgtcctcatttacagatgagaagactttggccaagatagattaagtaactggcccaagattacatggccagcaagtggcagagctggaaacctcagagttggacctcagaatttgtgctcttaatcatattttatagcctcacaataaattagaataaattaaccgttccaagcagaggattttagacttcatgcaacatgacagtacttctcaaagttgttcagggaataaaacactcagagaactcttattaatatgtttaatttcatcaaccagattcagcaaaatcaccaacagaaaacaagactatgatacatgtggacaaaaagaatcacagatataaatatcctgtgctttctcaataaatgatgctgccttactgaacttgattgtctctggaatttgtaaatattttctacttctgtatttgtttggtcatcttccagcactctactagctcatagagataacagatgccaaatattcttaaaatactgatgaggaaataacttacaaatgggtacattatatccattaatttatttttggtttgacaattggtaaaagacatattatttgacctttgtggaagtacacattggaacaacacctgaaattaaattctgaggttccaaaacagcacaatattagaaggcttagcagataatgggaagcactgcatgtttccagcagaataagggccggcaaggaaagccctgactacccagccaggtatcatcagcctgtggtttatgatttcagatatctctaaatcccgcctgtctccatttatcagcatagttcttcctgttctaactgataaataattttacaatcccagacacttaagttgaggtctctttaactctggcaataactcaagcaaagcaaaaagctgaacaatatttctaaaaatcaacattgggggaatgtttgtatgaaagctcaaagagagaagcaataccaaattaaaaagaaagaaaagaagaaggaagcccatacttggagacgatctatcctaaacattacattggtattgtcagcctgtttacatttagtatgtgtaaattattcacagtcctgccacaagagaagtaaacagttcagatttgaaccaggtcatatttgagcctaagtcggctacatatgaatacccattatcatttccctacaacacagtaggtcttggccaagatcacatgctaagcctaggtcataatcttgcatctgtcttcaacttcctaggatataatttggcttttctgcctgtgtttttagttctttatttgtaaaatgagaatagtagccttggccctctgctccggaaggcactacatacatttgaaaggaagaaatgtaactcagagaatcacaaaacctcagcctaaaagttaaattatagaacaatttctccaaccaatagattaaaaaatgagggttagataggttatgtgactcaccctaggtcacagaaaacatgctaccatgtgaagtatatgattctaaaataattaaacttcagaagagttggtttatttccctgcaagtttaaaagacagtagtcttcagagaggtaaatctataaaatcagttgcattttcaagtcagtggctcaaggaaataagaaatattttcatatatctttgtagtgaagttcatatattaattgtgctttcaaatgcattgtaattcaacattagttgaatgtctattttgtgccaaaactgtcctaagaactatgaattaactaattttacccttacaacaaccttaggggagagatacaactatgattttcatttgacagatgatgaacttaaagataaaatggttaagtacctgcccaagatcacatgggacaggactcaaacctagacttgctggctccagaatctgtcctcttatccattacactatattacctcaatactataacacactgtctcagtatattttgctgtatcattacatgattgttatttatcacttcatggttataaattgctttcattttcttacctcattaattttattagcatctatttataatttagtccacattatatgtgatatttaaagataaagtagggttttagaaaacaaaagaacactttaatggttcagccttcagtaatttatatagggccacctcacatatctttactctgagtgtattctctctgcctagaaggcagaggccagttcttttgaggcctaactcaaatgccacctcctctttgaagttttcctcaccctctcaggcaaaatgggttactccctcctctgtactctcgaagtgttttatccatttattacattgagttgtttacaaatacatctgcctgcatcagaagagtcccttgcatctagcaccaggactggcagaaaattggcgttctctacctcagtgagtgaatgtgtatatttttcaaaaaaagagagcaaagattagcaattaagactcacgtgtatcatctctcaccattgtcatggtatgattgctgtgtctgtgcaattctggaaagccacatgctaacaaaagataccatattcattggtttggtgccttagtttcctaagtggaggcataaattggaacaatacacttgtgcataaggagactgagggtattaagctttgaaatgagacagatcagtgtttgagtcccatttggctacctagtagatgtctgatggtgggatactaataccatccttatttctggggtgttataaaaataaatgaaaaaaaggtagaatttgtttaatattatgtttgaagcatagaatgcacccaatatgttagtagttattaatattaggactgttctttggaaagattgtgcatttggtacatgccatatccttcttactggccctttattcatatatatttcctgccccaccctggcaaattccagttctctattcccaagcccaagttttttagccaaaggaccaaattctacggagaaagagtagttggaaagtcctcaaattacgttctattggaaagcatttctattgcttacatggaagaccagctctgtgattatgtaacagcatttgctgactgtagcatcccatatgaacccacagtatttatttagctccttggtcaaaaactctttcttggaacatagggcttccaaatttgcctctgggttgtttgtgcttggctccagtaaaaggctaagtaaacattaagctaataagctgtgatctttcaatcaccattatttccagtccccaaagttagctcagtatacagccagaaagacacagacgtgtcttaggggaagtaggaattccacatcaataaaacaccagagtcatatgacagagtaaactctggtgggagtactcttttgggagttctgctcgctgtccaatccaagcatcattaaatggccctgccttgcctacagaatttcagtggccaatatttaggtctctataaaataaaatattcttaactacagaaacatactacttgccagctacaaaccctgacaattcctaaaagacatctatgttctctataactgaccacagacccaagcttcaagcactggtctccaaaagaactttgcctgacaataaacataggttgaatttcagtttgaccataacacacttcttagacttgattttaatatttggcatctgggtcctttggacagcgctacaggtaggcacctgcttatacgtggcttttgctgctgaggctggctcattagagacgcttcccaccagagacaaaattatatatagcctgactttgctttaatgctcaggaacttctgcttcacaaatgcaaatgatggattctaaatgaatcaagggtccatttctatttctaggatttccatgggcttggaggcttcacacggaatcttaatggtgattgcttttgggtaatatttccattcagacatctaaaaatgctatataacattaaaattctccacagaatgattcaaggcaatgaatgtataataattacttaatgctcaactctatgatgaatgttctaggggctcaggaggtttacagcaggaaaatataaaacagagccccttccttgttttaattgggtgaaagggcatgcatctacagtacttggcaaacaccttctagagtatttacacttgtttgtaattacgcctttgtatctgcttcttcaagagtgctatgacttattggatacaagacctcagtcttttacttctgcagatccctaaagcttagcacagtgcctactaccatgttagtttcttaaaaaaataaaataattgtaatatctgtagtaaggtggtgtaaataagaggtaaacataatatatcacattgatgttcagaggaggaagattataatattaatcacttatttaattgcgactataatgttaattagtcacaaaggatcacagaaaaggtgaacttgatttacttgtgaaagaaaaggtcaaccttgtgtatatagaaagatatgagttggatgttctcttgggcgtgggagaactacaggacaaaagaaaaggtagaaatgtatatagacaatgaggaaaaaaaaactggttaagtaaaggcttagaaattagtgactttaaagattggttctgtgggagtggtaattctgaaatattttcaaggggaaagaataagaattagcatataataaatatctactatgttccaggtctttgcaaggtattttgcacataccatctcattttaaagaaaaatattattgtacatacttaacagatgaagacactaaacttagagaaaatagcttgtctaaggacatggtgagtgagtggcaaagtggggatttgaacctacttctactgaactcatgttctttttattcctcatagtgtcttttattcgcccataaaggtgaaaagtcttccccttgggtcttacactattacgaatcatcctggtatactccaaatcctctatctgccgtaaatgaaataaaggaatatttaatgtcagtttttctcctccacacagaaataaacaattttccctaaattccaactcctcttatatttgaatataattctctcacttatttctataacaaaatgtaaattcttttaacttttttttttttttgagatagagtctggctctgtcacccaggctggagtgcactggcgcaatctcggctcactgcaacctccgcctcctgggttcaagctgttctcctgcctcagcctcccgagtagctgggactacaggcacacaccaccatgcctggctaatttcttttgtatttttaggagagatggggtatcaccgtattgcccaggttggtctcaaactcctgagctcaggcaatccacccgccttggcttcccaattaaaatttctttaaaggacataagctttatttcttcatccattatcttttcttttcactccgagaaaagaagttcttatagtaaatactgatttttgatgatgatgatgatggtgatgatgacaatgacaatagttaaataggacaatgaaaacaatttcaagtttttcattgttcaccaaactttgcacagcccctgatgcataatacactggagctctgggctgataaatacagtcctctaacaagttgaggttcttctcaggtcagatataactagcacattcaatatttataaagcaatgtttcccctgttgagaatctgctctgtagttatatattgaaatgtaaatatattgaaatggaactttgcacaacagtgtggggagtaggctcacgctccatgcttccttaattgactggagatgagtaaagcctttatataggacttcagtggtcttctgcttggttggtgcccatcacgtgatctacacaagctcagaattttcagcatgggtctttgaactgaatgtataattgatagtagaagtgggtaaaaattccaacacagggtatcataccagtgtagctcatgcctgacctaccccactacctccctatgttattatgaaagctatttgtagcaaaaatacatggtgtaaatacaaagcagagtgatcaacccagctcaatgcctgagtctcagcatgcaaccatgatcctacatacaggcccaacctttctcctgtatccaattcatttttaatcctggattttgcttagctattgtccctacctccaagttatatcctaagaattgtatctttgtgtgtgtgtgtgtgtgtgtgtgtgtgtgtgtgtgtgtgtatgtgtatgcatgcactaagatgctttgtaagcacttgtttgttcattagttcattcatccattcaccatcatttatgaaactcctgtcatgtgccaaaaatactgtgaaatgataaggacataaatgttaataaaacaaaactgtaaaatctctaaatatgctcctccacccaagcaactttcacttaaaggcagtttttcaagcactacgcaaatgaatgcataagtataatgacagacaaaactaaaaggtctgtagctgaaactgaagaaaggagtcctgcccatgcccacttcatgcccagtctactttccaatcacatcctcctaaaacacttttgtccaactaatccctccttagccccaccccagccccactcccactgccatctctgctctaacagcccctgccactgacagggtgctataagctttagatggaggaaacaaatgaagagacaaattgagaacaacaagaatttacatttcccacttagattattaaccctcacaatggcaatggcaacggcccaggccccacaatgtgctaagcacatacacggtgctttacaatcatcctctcacacaatccttaactaccatttacagatagcatattattgtcttgatctcatagaaaagaaaactgaaacttcacgagggagagtaacttgctccagattaaacacgtagtagagatagagccagacttgaacccaagctgctggactcttctattgccatgagcaaactaggggtaaagaactctgtgatatagtgaaacactatcggacagattgtgattccaatttctattccaccttttattaggtgggtaaccatataccaattacttagctttcctcaccctcagtttcctaatattaaaaaaataaagatactaaaatatcaaatttatatatttactatgaagatcacctgaaatcttatgtgaggcttattaactgcaggggccttgtcttttcactgatgtgttcatgtccctagcacaatgccaggcatgcatttcaataaatatttgacaagaaataccatactgcttagcccactgcaaggcacacaggatgtgctcactaaatattctctcctctaatccacagaatttcctttacaaaaatatcttagagtcatctgtttcaacactccttatcatatggcaaaagaaatagcagtagtagtgataagttgaaagaatgtgggaaagctagctaaagatacttctatttctttctttaatgctgcgtattcaaagctaagtattctggcagctgataacttatttcccccaaaatgcaaaaagcagaggtaaaaataatgtatttcaactaaaattgccttatcaagttctcatctttaacaaacccataggactatcttgaagtagttagagagactcattatctcttatcccttaccttctaaatattctctatagtaaattgcagtggctcccataataacttgccacaagactctagaagagcattgcaggaccaattctcagcaaaaaaggtcaaatgtctaattacctttcacaactaaataatttcaggatctcataaaatacaactttttgagagcctttaggtaaagtgctgctgacataatgtaccgctgacatacttaaaggatgtgtctatggtaacatatgcctattattggaaacttctaactcccacattaattcttgagcattcagtcacagaatcaaatcggagggaaaaatatctgcactatattgtaatttcagaacaaagacaaacatgaagcattttgcccaaggcctcatcagagagagagctgcaagggaacaaattcctgagaataacccatttgcccactctatagactgcctcctggctgtttcaataaggtatctgcagaggaactctgataccattattcattaactgttccagagacagcctacattattataatcctcttttcatttagattaaaaacacatttatagtgaaaggggaaatgtgaatttttagaaagacaggaggatggctatagttaacagcttaatttcaggatctccttggagatatatattcagatgattcatatgaaggcatgctgcacacatgtctacacttaacacaatttatagcacaaaataagtgctcaataaaaggcattcattgtcatgctcgtgattatcatcatcattacaatctttcctacatctgagttgcttactctgcaggtaacttggcatcagagaatatctgaactgaaagaaaacttaaaactcacctggcacaagtccttgactttacacaggggaaacgggaggatgtctttgtgaaggttacccagtaaagtaatggaaacttttagaactaggacctctgttctcttcatacctctaaggtgcattaattaaaatatatctattttgtaaaatatatttccacttaatgaagctaaccgtattaccagtcaaagctttctggaatcactcttaggaaacatggctataaaaataagaaaaaacattaaggcagcctaacttcattattaatttacgattcaaagaaaagatcagtgtataatatatttgttcattttcccttctctggcatatatcagaaaaaaaacagaaaagtatttgattggaaatcatctttgtgacctctttggtttgcccattaaaatgaaattcatatacaaccttcaggtcaatttccagataatatctgatccttggcatttttactgaatttctgctgctaaggagcattagtaattaggttaactgatttttgaaatttaattctgccactactcataaacaatattaccaccattaaattttaattaataaatacattgacaataatgaaaaagctataatgtagccactaagtccaattccattttcatctattctatgccccaaaatattcatttctaactcttaaatgaaatgaagatcctataatattgtttgctttgctatacatggagaaaataaagtacaagacaacatccctctgccgttaatatgtcagagtttgttttttcattcaatgagcattaaatgaatattaaatgtgcaggcactgatgtaaaaatattcatgcactaagtttattgcacttagtctttacacagtttatgtggggtaagcaaaattacacctattgcagatgtgaaaacagaggcttaggttaatagcagctacaggagcctaccccaggtctttctaattttaaaattaatgtagagatagacatttaaaccaaaaatgaaatataatacaaccaacagtatgatagatatgtgaataaaatacacaagaatacacagaaacacatatacgaagtgtgattaattatcaaatggttagaaaattattttcatatccatgtcctcagctggccaaaataattcataattatctttggaaggaaactttgccgtgtatattttaatattatttatacagtaaattttgagcactctatacattgtataaatagatcataagatatctaaatgtttcataaattgcagtactgcacctactactgtaggacaaactgcaagttttcccagtatgttctgtatcacagcatcttgggaaaatattaagccaaattttatccaacacagcagtaaatgtgttcagtgagacctaaggtcagacttcttgatctcccagtggctgggtttttgtgtgtgtgtgtgtgtgcacggttttaaactttagaaaaaaattatgatatcaaatgttctctttagattgcaccctccacttgggaagaggtgccatcacagaagtaaggacacaatatccttactgaagtgaagaaatacagccttggtgaacaccaaacacaagagactaatatctgaagatagaaactgtgcgggacttaaatgatccaattcagaggcattcaagtgctatggatgaggggtcatcaagactaaaagaatttataaaattaactatttttaatttctccattttgttcatgtgttaacttctatttcttctcagtaatcagcaacaaaaccttaaaaggaaatgggcctacggaaagtgaggagtcagaaaaactgcattccattccacagacagccttgtgaggagatgcatttcaattactagaggtagtctctccagctactaaaggtaaggaaaatatgctaagaatctgagatctgcagtcaaattaaataggagaacacggggagatcggcgcctaaaaaagggcctcttatctaaaatctggaaagaaacataggaagcttcctatactgttatcctctgcctccattaacctggcccaggaaagatacgagtcttctaaataaggcagaactcagtttaaattcactttttaaagtttctgtacatacttccaaactgggataatatatcttcttcgaaggacttggagaaagattagtttgctcattcaatatgtgtttaatgaataaagcacatgtttggtatttattggtgaggcagataataggtgtatgttgtatactatctagtagcaagagtaaaggttactcttctttcatcataattagcttaaagctggaaatggtagtagatctatctatctatctaccatgtatctcgctgtctatctatctatctgtctgtctgtttgtatatctatatcacagtgtgtgcattaccaacataccccagttagtattacagttcacataaaaatgaagccattctgattgcagcaggaactgggccagaacccagtagcttaaccatctttctcacataatatgtttcctgaggcaccacaacagaaccctagaactcataggtccatgattcaaaaccatcacagaaaacaatagttattattcctgagagggaaaaacatgacttgaatagtcctatcaaatgaatagttggaaagtattataaaggaaggattggaagacgaatctactggtggcaagaagaccatctgggaggctctggcatagtcttggcatgtgacgaggaaagacagcattgagaattgaaattgaaagatatttttagaaaggcaactttggtgacagacactatgtatggttaattataattttatcttaaccaaaaattgggatcatacatggtctttccgaagatttatgtgcccatgtataagtgaaggatataaaatcagaaattggaaagaacatcacatttctggcatttctgagactttctacagtacacgggaaaacagaaataattttaaagattctgaaagtatggggcgttggatcatcaaacacatagagataaaagagaagctaaggtttttagtctaagagactggaaatccagtaattaaactgagggaaatagaaaaatagaagcgagaaatggtttgccctccattggtctgggatgcaataactctgaggtgatggctggacctactgagccaaaatgcctataggcaactagaattacacattggtaaaacaaaataaaaacatcattttaaataacttccaaagaaatcaacagattataaaccaactgcttgtaattccagctcaatgtttttaagaaggcaagccatactttcttactgtagtatagaaattacaaaatcttgagccatacttggttttttgaagaatgaggcaactatcgggaacacatctttaaaactttaaaaaacaggaattggaaaggtcatttcataaatgaaatatgctggttgccagtgaaaaattactcactaagaaatggataatccacaagccctagaaaggtcaaaaaggctgccaaggtagccctgatagaagagactacaaaacaaacacaaaatgaatgcaagctgttctttggggcaggggctgacaaatattctcaagcaggatgctcaccaaaagtaattttctcttataccaagagaaatgtggcagatagaaaatgtgttgatgtattgtgatttaatttcaattttgtttcatagaagagatagagaaaaagttggacctttatttcagtattattttttaaactcatgatgtggcaaatgacccctttagtgaatcttacttgaagaacatgatatacctgcagataattaagataaaaaactgaggagtcagatcattttaacttccttctaatgttatatttccatgattggaaaaatcctcaaagcaattctcaaagactgaaaattgcataacctggaaaaatcacacaatgagtacatttttgcaatcattaaacctttgttgtttcagtaaacaacatataaactgatcagctatgttcattttcaatatattttctaagaaaataagcttctaaaaggtcctgttcttcagaataagcaatctgtatttcagtggaataacctagaaaagccaataaatggaaaccatattgttagaaataatcaaagaagcaacttttagacaatcatgttaaagaactaaaaagaagtatatgcaaacatttatatgaatagaagtttataaaactttatttataataaccaaatgtaaatattctaaatgttcaaaaaagggaagcaattaaatagccataagacatccatgtagttaaatacaaagcagtcattaaaatcatttttagaataaaattatatatgacaaaattcataacatctaacatatataatagatttagcacaatgcatattttgtaataaatatttgtgtatatgtacatgtacctgtgtgcactgaagagaatggaggagaatataacagaataataacagaggtaacttctgtgtggggagtggttcttaacttttggggagtcagatgctcccttgagtgcctaatgaaagctgtgaactcttgcaaggtcaatacacctaaaacttacctaaagaataaaagtcattacgtatcccttagagtctgtccatgaactccaatccagaatgagccttttgagggtaatggtattataaaaatttttattttagtttctgtacttctgtatgttaagaacaattatactgaaatgtatgttactttcttatggaaattaaccaaaaatgatttttgaagactatggtagaattttatacatgttaaaatgtttgaaagtaatgttctcagctatttctcagtgcaagtcagcaaattattataacttttgttttatacgtgggaaaattaagggagagggcaattttgtgatttattatggctacccaacatgttagtggcagaactgagattacaacacactccttctaggctctgattagcctatagagttacaataactacaaaatgtcataattttaaatgcaatttaacatttttaaaaacacgttttacccttcatctttagttctttcggaaaaatagttctctgctggagcaagactctaacgtgtgtagagcagtatatatacaataattgcttcagttgaaagcctctctacttaaagcctagaaatcaaaaactcaaaggaaactttattcttcacttgcaaaaaaaaaaaaaaaagtacagaactgtcttccctcctttgttctaatctgaaacaagttagattacccataataccttaataacattttggctcatgaaccaaagttatttaagattccttagggagcaccgtcaagaaacaactggaattcagtggcctttgctgctcagcctctgatgcagtatctaaagtgaccatagtgatgtcacctccagccagggccaggaatgtctggagctagtggctgggagtgctgtgtctgagactgctacttacgtctgcttcctaccactgaatcctggcttatctcctcaccaaaaccacagtggctctcattctcttctctatatcttctagaactttatatgaggaatgcattataagcaaaattccagagaaaaatcttttttggaaaatctccatcaatgataaaagcttccaatctgggactccatgtggggagttccgtttatttttccttgttccccaaagaacacaaaagaaactgtcattttggaaaatatcatttctttttctttgagagactagaaaaataagttgtctctagaggaatatatcttatgtcatgctgaaatctatagttaatcagattcagatgtaccaacaagaaaagacacatgcacatgtttactgcagcagtgttcacaatatcaaagacttggaaccaacccaaatacccatcaatgacagactggataaagaaaatgtggcacacatacaccatggaatactatgcagccataaaaaagatgagttcatgtcctttgcagggacatggatgaaggtggaaaccatcattctcagcaaactaacacaggaacagaaaaccaaacaccgcatgttttcactcgtaagtgggagttgaacgatgagaacgcatggacagagagaagggaacatcacataacggggccttttgtggggtggggggctaggagagggatagtgttgggagaaatacctaatgtagatgatagcttgatgggtgcagcaaaccaccatggcacgtgtatacccatgtaacaaacctgcacgttctgcacatgtatcccagaacttacagtataatttaaaaaaaaggaaaaaagaaatataccttctttccattccctctgaccaatactaagccaaattttaaagtagttgaagacaatctcaccagtttatctttcagaacttcccccatcccatctgaacactgtctctactcctcttccttttctccctaccctaaagactgatacatctacagatgctcaaggattccatctgccattcattcattcagtacatttttattgggtgtccctgtcttagtccatttgggctgccataacaaaataccataaaccgcgttgcttataatcaacaaccatttatttcccacagttctggaggctgccaagtctaagatgaagactccagcagatgtgatgactgctgagggctctcttccttataaatggctgtcttcccactgtaacctcacatagcagaagaggtgaaacacccctcaaagcctccatttcctaatagcaaccctttaggggttaggacttcgacatatgaattttggaaggacacaagcattcagatcatagcagcttcctatgtgccaggtactgacattgagaaacacctaatggcttccaccaaaatactcctctttattttcacatttatttttttaactaatgctttaagaaaaatatcctatttagcaaaatattaactatcaatggtggtatattaaccatagcagggaagctttattagaggatagagaatagagaccttcaggctttctggaggagtctaccaactctgccataatctattttcaatacttattgaatatctaagatgcatgagaattgtaattcactagattttaaattacttggggtataaggaagttttccttttagggattaactgtcagagtatctgatgctatggtgatccaagacctgaaagatgaactgatgatgaattgaaagcatcccactgaataacatgagaggtacaaagacggcagtattttaaataaatttaccgttcattcccaatgtttgccacttttacatacaataaacatagcgaaaaaatgtgtcctttgttgactttaaaaggaaaaagaaaatgaaaagcacagaggcaagaaaattttagctatgcttagcaaacagtatgcaatcaagctagacatgtaacgtttctcataaaggagatatagacataaggatgaaaaagtaagatgatgtgttaaaaatctgctctaaaatttatgtaacatttatgaatacattgtgagttatgctgataaaagttgagattagattttacgcacttaagataaaaaaactattctggagaaacgagaattgtagaaacagaagcttatggaagataggagaaaatgagtccttttcctctcaatttcaattgcaggcaaataagattttttacataagaataactgttgagattttaaaatgtcaaatatagatttatttgcagatagagagaaataaaaattagaatgactcctggataacttttttttcaatgtgctaattagtttaaaagggtaattctttgatggtatcaaaagccctacagtcatgttaaatgacctagagaaaacttcaaaatcagcccaatactatatattataatttccactgttaaatttttttctgttgtactgaataaattaaggaagtcaaaaaagcttttggctttgtgataaaatgtaggcgagacactaaaggaagaatgtaggagggaatgtctactagagagaaaataaaatccccaaagaaccaagggagaatttatatttctaaggcactttgcttcttgctgtatagtagctcagacaaacactaaaaataaacctatgtttaagaggaaaaaaaggctttcttgctcagtggtacttacttatgactcagagggggggaaaacataaaattttagatgccacacaacacacacacactgttttaaattcttatcaccctctaatcaatcattttctaaaagacctctttacctgtgcttcttatacaatgaacccttatgttattaagtgaacagaatagagcctcactaaagaccacaagatttatgaggcctcatggtcattgggcttgtgtttccaataggctctgaaggaattgttttacatttgcatacacagtctttcctataaaaaaaaactgagtcttttaatctacttttcccaacactctgattaagttagagatcaagcagttgagctaaaacagcaatacatgctgatgtcagttttgaagggagctggttttgtctattacaagttgtttctaagtttcctttcttgatgaatccttctttgctttgtggtaatttatattaattcaccaaagagctaaaaggactccttgggtgattcaaacaagaaacttttaaagcgaaatggtgcaacttcccaaaccaaaatatgcaaatatggcatctactctcttggttaaacgcttaacactaacagaaggtgctacctgcctcagaagacaacctattgcttttaatgggccgctctgtcaagtgttctcccgaatattaaattaaaagctgacttcctaaaacttcctgctccagatttcttaaatttacatcactcactttccctcatgccatccctcaaacatttaaaaacagctcccctggaccctcttaaatgtttctctcttccagcttgttgagactgcagacttagcaggcagactgcctgggttcaatttttagtcccactgtccattgtattctagctgtgacctttggccaatctaagcctcagttttttgggtttttttttttttcttttttttttgagacagagttttgctctttttgcccaggctggagggcagtggcgcgatctcagctcactgcaatctcctcctcccaggtttaagtgattctcctgcctcagcttccctggtagctgggattacaggtgcatcccaccacacccacctaattttttgtatttttagtagagacggggtttcgccatgttggccaggctggtctcgaactcctaacctcaggtgatctgcctgcctcagcctcccaaagtgctgggattacaggtgtgagccaccacgcctggcctaagcctcagttttaaatttttaatcatagtgacatgagaatatctttttaataatattgtcaggagaactgagaattaaatcagatagtgcaggaggcgtctgtattgtagtaatcatgcagcaaatggcttcttatgttcctcgtgaaatgtaccttctggagccctggccagcaggtatttcgttgtccagatgcactcatgtctgtcaatctctctctcttaattcatggggtcaagaattgaagaagggaaaggtcagcaaaaggtaatccgagttacaatttaaaattaaagtgcattattaatttcattatcactgaggattcacattgatacaaaatgatttgaggaaaatgtcttatacttctttgcatttctagcttagattatgaaaaaatagttatcaataaatgggatcagaaaacttttctaaaaagggctggatagtaaatattctaggctttgcaagctatatggtctccattgccaatactcaactctgctattgtagtacaaagtggccatacataataggtaaatggattcttagggttgtattccatgaatacttaatttatagatactgaaatttgaattatgtataattttcatgtgtcatgaaatatcctattttgtgttttttcccaaccatttaaaccataaaagccattcttagcttgcagatttatagaagttcagcaagctgtatttggcccactagccaccatttatttacttatttaagatgaaagtagatagtcccatttatcatctgcattaaactagagaaattatacagatactgttctcccaaacagaccaaaggaagtaggagagggaaagccaagggtgcaggttggtccaaggcaggacttgactagacagttagaaatgaaaaatttccttgaaagggagaagaaaatgtgattcacacaagattatccttgtataggtgttccttttctgttctgcttcatttgtttgcttcagttgttgatcttttccagaggtgaaattgcttctttgccatcaaacttactggcatatggtggtattaacagttaagaattgggaaactagaatcttcaagccttttgaatcccagttcagccagttactattaatgtgatcttaggtaatttagttaactttctaaatgtcctcacctgtagaatggccataattatagagcctaccactgggttgcaaaataaataattaagataaaacatctggaatggttagcatactgtaagtcctacagtgaggccttcagaagtgttaactgtgtgaagggaataaatggaagagaaaactttgcatgaacaagacacgtcttcagttgattttattgttaaggaatccagaattatgtcttcaaagagtgctactgcatctctaccccactgtgtctagttcttcaagtgcattaaatagcagtatgtgagaacttgttagaaatacactctccagtcccatcccagatttagtgaatcagaaactatggggttaggacccaggaatttgtattttagcaagccccccagataactgtgatgcatgctagagtttgagaatcaaaggtctatgtgaaatttggttaaaataaacaagggcaaccttgaagttataaataggtatagacttcttgataaataaaatgatttaatttgatctccaaaaacctagtgtgagaggtgtgtcagatattattctcagattttatacaaggacattgtaactcaataagagtcagtgatttttgcaggtgtcatagtaagtagccaagtctcacattctacttctgggcactttcaactttacttgatgttaacagtgagaatgggtaaggaggaggggtggggatgaatagggattactgttacaggggtatcaacctaaatgccttaagtggcagactactatttatctatccattatccattttcccttcttctttactaagagaatctaaatttggttcacaaaagcaatgggctcagctaataatatacactttcaagattcctttgcataggtggggtgatgatgctataagttctaagcagtgagataaaaatggaagtcatagtatcagccttctttgaaagttccttcaaaaaagaatggggaaaacttagccgatacatatcttttgcattttccttttactttttaacctggcactggaatgcaatgcccagtacttcaagacacattttgtgatcatgagaaatacaacaaagtgataagcttagcagaattagaaatattcaaggagaatgagttacaatgacatttttgagttgccacatctgccccaaactgtcttatgtgaggggaaaaaatcaatttacttaagccactatttattcagaatttttttgttattcatcaacacaatcttaactgctactccctattaagaagaggggataattgacttcccagacattttcaaaccaaaataaagttactctgaaaatatacaaagtttctgggcttgggacaaattcaaactgtcttcctctcctggtcctccagcttctgcatctggttgatctgcacctcactccccagatttcgttgttttccgccagtcttcatgtttagcacttccattctctcatcttattcttcagctctaccaaactacttggaatctccattctctccacctaaaatgtcatccctttcattcctcactttcttggcaccttgcaaactctttcttattcttcaagagtcagctcaaatatcctgtctccaacaaagctttctgtgactacatctggctgacttagccacatctttctctatcctccctccttgaatgtggctctattataagaatggtgacattatatggcattatgtcttatgactcctttctacactttaaacttgctgaagactggaatttttttgtgtgtatcttcaaaacttaatatattacatggtatacaatgggaagttgatacatgttttctgcaagaataaacagattggggatagatgcaaagagatagtaaagttatttaataccaattgaactaattaaacagttgccagggggtatgctgtacccacgactgtaagactgagtatatcagctctagaaagatgactactaggtcacacataacagagaacctatgtacttgtgataataaatcatattccttgggtggtttcatctatggccttttatagtatatgtgtatatataattagatacataatgcaagaaatatatttaatatttttaaattttcttatcttccttttatcaagtgccagagtaaatgagtggtttcctccagccaaagtcaagggtttctagacttctatttattattttaaagttgttttatgtatttgcttcctttacaataaaaatacactataggaaatatgctggtatgttgccagctgacaaatttattgagctactcctgaccttttaagatacaattttacttatttttagacaggtgcctcaaagacttaaaacacaaatgcattatgaattctactactaacagcaatactcttacaatttttctatattttaatcgattctaaggtctaagtctgaacctctgtaaataaggaaagaaatctgtgctttggaacacatatctcctgttttacattcattagtatttgggttttccatccagtctataagaattccaagaagtgaaactacccaattcctctacaaaccggttacaatgtagctatatagaatatgctattgcttgcttacccatcacctgtgcctctttttttttctgacagaatcgtaattctgttcaagtgtttacttgtctttgaagtaacttaggagaagttgatcccagtcactccaaggggtgtatgctgattagtctgcctattgacacatggcattcccctagtaacaatggctgatctgagaatgggcagatctaagaagggttcaatccttctgaaggaatggctctagttctaactctttctctttctatctctttttctctctcccactctatgtgagtaggcaacatcttgcctgaattactacaggcagtttttataagaacatgcagaatcaaagagacggcaagtcatccttcatgacccctttgagcttctgactcaactagtgcaggaatccaagctacctgtaggctcttgttgtgagatgaagatttttcttatttttaaagccaatcacttttccattacagaaagcatctaactgatacccttatgccctgaccccttagaaattctgatattcattaactcatgttcatctagaccttttgttctaagtgatgaaaaactaaaataaatagaaaaaccaaacgctacccttttctcatgcacatatggataggagtctgtaaaatagcatcaattgtgtccttaagtgtttatagatcacaatcagtgacccacttctcctcatttcctatattttcctattaacacaggttttgtaaaggctatgccttaatgcatatatttaacagggaattcctgataaatattttgtacctggggggtgccatgatggagatttgtatcatttactctgtcaagtatcattaagagtttaatctcatcttaaatttcaatgtctgaaggccaagacccatttgaatactcttccataggtactggagaattatgaagtaactgttcatccaaaccttgagtctggccttgaggagagaagaaatttatctgtattctttttattctaaactttgagttggtaaaaattcccaagatatttagatgtctaaatgtcttgaaggggaaggggaaaatattgtttatatttgttaaggtacactgaaaatgtacttcaaaattgcctacttcctaaaggacttccagagaaatcatttagaaagatttccagagaaaactccgtcagaaagctaaaggagttttctagtcaaagaaacactgaaggagacgtttaaaaactaggcttttcatccccatcaagctaccaatgactttcttcacagaattggaaaaaactattttaaagttcatatggaaccaaaaaagagcccgcattgccaagacaatcctaagccaaaagaacaaagccggaggcatcacgctacctgacttcaaactatactacaaggctacagtaaccaaaacagcatggtactggtaccaaaacagagacatagaccaatggaacagaacagagccctcagaaatggaacacaacagagccctctacaaccatctgatctttgacaaacctgacaaaaacaagaaatggggaaaggattccctatttaataaatggtgctgggaaaactggctagccatatgtagaaagctgaaactggatcccttccttacacgttatacaaaaattaattcaagatggattaaagatttaaatttagacctaaaaccataaaaaccctagaagaaaacctaggcaatacctttcaggacacaggcatgggcaaggacgtcatgtctaaaacaccaaaagcaatggcaacaaaagccaaaattgacaaatgggatctaattaaactaaagagcgtctgcacagcaaaagaaactaccatcagagtgaacaggcaacctacagaatgggggaaaatttttgcaatctactcatctgacaaagggctaatatccagaatctaccaagaacccaaacaaatttacaagaaaaaaacaaccccatcaacaagtgggcaaagatatgaacagacacttctcaaaataagacatttatgcagccaacagacacatgaaaaaatgctcatcatcactgggtatcagagaaatgcaaatcaaaaccacagtgagataccatctcacaccagttagaatggccatcattaaaatgtcaggaaacaacaggtgctggagaggatgtagaaaaataggaactagtttacagtcacacacctgtaaactagttcaaccattgtggtaggcagtgtggcaattcctcagggatctggaactagaaataccatttgacccagccatcccattactgggtatatacccaaaggattataagtcatgctgctataaagacacatgcacatgtatgtttattgcagcactattcacaacagcaaagacttggaaccaacccaaatgtccatcaatgatagactggattaagaaaatgtggcacatatacaccatggaatactatgcagccataaaaaaggatgagttcatgttctttgtagggacatggataaagctggaaaccatcattctcagcaaactatcgcaaggacaaaaaccaaacaccgcatgttctcactcataggtgggaactgaacaatgagaacacttggacacaggaaggggaacgtcacacaccagggcctgttgtggggtgggggagggcggagggatagcattatgagatatacctaatattaaatgacaagttaacgggtgcagcacaccaacatggcacatgtatacatatgtaacaaacctgcatgttgtgcacatgtaccctagaacttaaagtataatcattaacaaaaaaatcctccttcaaaaaaaaaacaaaaaaactaggctttgttattgggtgcacatacaagtatgtgtttacttgtgcagccttcagagatcctcattcccaatccctgcctatgtttccctatctagcaatgcctcttggcatacagacatgctttattatttaggaaccagaaacctgctattaatggcctataaggttttcaagggtttcaaaaatttttggaaaccttagtatcattttcaaaatgcaaaaagatacacttaaaattggaaaactctaaatatttaactaaatagctataaagcataccatcgtgtcaagtagtcagttgtaatacttaaagccaaaatgaataatgtattcctaaaaattaagaaagttattaaaattatttctaattttacttaacagaagtacctctcatatggagtattaatacaataagatgtaggctagaacctgcaaaaataagtctctatcacctacccagcatttaaaatggtcctggtggcagttctcaccaagaataaggcctatcttctactcttaaaacttttagtaactcttgcctgtatgagggtactttctgaagcttaaaacattggaacattcctccccctatacaggccaatcaacactgtatcctaaaaaggctcatcactgccattcacttacccagaataagaaagctttcatcacatcagataagacccttcatgtccccctggaactaggaccttcctagatgcccagaacccaataagaaaccccaaacagggttcttgatacctttcagccaattccagcaccaaaacattataggtaaaagttagaatacctaaggttagtagcttctgaccatgattatcaactttcttttaaccacagtgagccccaagtttctggagataaaagcatccaaatttctttacaacttggcccttgattacctatccagctatgtttcctatgattccgtgtgtattaatttttattctagttatttgcatataatgccttgaagtgctcatgtcacttggtgtgttcctcactttggtacatagctatctctgactctcctggcttggcctgttgagctttcccagagctggttatattggggcatatgcctttcttttgtgctctcatagactctgggcatagctctatcacagcgttcaccacacagttttataagggtctcttcttctggcttatgagcttttaaagagcatagcctcggtctaatgcatctatattactggtatttaataaagtgcctggatatatgcatttaaaatatattggttgaattagtgagtcatggactctatatgctctattaaattattatgaaaatgaactaaactaagaactttgaaaaatataatttttctctagaataaatatattttgagaaaaaatcaatataagttctattactatctgtgcagaaagaaatagcatttatatagcataactgagaaacctttcataagacctggcactcatttccttgaggctgagagttatgaggaagggtcgtgaccgtaggccaaatccaaataatactgaggggctataggaagcagtgttgagtaactctaagcagatctggcactgtaactgtgtatgtctgacagctgctgcaccaaacccagctcagaagagcccattcttgtgttttgagctctgattggaggtctataggctcccatttcccaagttatgtgggatgactcatttttttctgttttgcttataaaacaatagacagcattcctaaagtcgagaaatacttccataaatgaaaacttattaagaagcccaatatagcaccattttaacatgtataagcctttctacctaaaaaaaataaataaataaaagatgctctcatgactattacatcctcacccagttactgccctgcctctctcctccctttcacagccaaaactttgaaatggttgtcaatattcactgtttctacttcctcacctcccactcatctttcactccattcaggcatctaccccctcactccacgcaaagagctctcattaagtttaccagtggctttcctgtcacaaaatccaatgaaaggtttagtcctcattttacctctcctttcagcaccattttataacaactccttttctttttggcaataagaaactccttttcttttggcaatactttctacatttttaccctttaccttccacagtatcatgctttcttggctttaatcctatttctctggctgctaaagtctctctactttgtaggctcttccgcctgtagccacctatttagtccaccaagctcttcttactctatatttgctctactaacaatttcataaatctatataattctaatagctacctcaaattacttcaaacatagtccccttctctgagtacccaactgcctgtgtaacatctctacttagctatcttaaaggtacatcacatacatcatgcctaatactaaactcatgatccatcctttccacccagaacctgacattcctctaaagtctcttacaaagcggatgatatctctatccatcagtgtataaaccaaaaacctatgagtcatttttcacatgttctcctccttaaaaccccatgccccatacatcaacagtttatatatattttcttatattcttaagttaatcagtattctccatctcctcattgattgtcccaactaccttttagtacaaactaccacctataactcatgtgaaccaccccagtagccttgttgttagatctgttatccaacctggaaacacagccagaaaatatatttttatgatactactctgggtagatgcaaaaatccttaaacaaaatatcctcaaatagaattaagcaatatataaaaataattatataccaagatgaagtgaggtttattccagaagtgccagactgattcaatattcaaaaaaaaaatcaatatggtacatcatattaccaggctaaagaacaacaaacacatgatcagatcaatttatgcagaaaaaaagtaacaaaattttacacccactcgtgataataattcttgaaaagtaagaatacaggggaacctcttcaatgaagaaatctaaggaaaacctacagataacattatatctgatggtgaaagactgaatggttttcccctaaggttgactacaggcaaggatgtccaccctcatcctttttattcaatataatgccagaagtcttatccagtgcaacaaggctggacagtaatgcaaattaaaagaatacagatcacggatggacagagcagtgtgtggaggcttgcattgtgaacttttgttccaaaatgactgcaggaatacactaggaaagccaagagaacccacaggccctctgaaggaagcggattgctcctgaaggacccaggagacgccccaaatactgtgctggtatccatggctgagagacccacagacggttcacatcacaggactctatgtagacaacccgcattatcagcccagagcctggtagacttgctgggtggctagatccagaagagagatagcaatcactacagttcggctctcaggaagccacatcctaggaaaagggggagagtactaatacatcaaggaaacacctcatgggagaaaaaaaaatctgaacagcagccttgagccctacactgtccctctgacagagcctacctaaattgagaaggaaccaggaaaacaactctggtgatatgaaaaaacaaggttctttaacactccccaaaaaatcacacaagctaaccagccatgaatccataccaagaattgctgatttttctgaaaaagaattcagaaggttagttattaagctaatcagggaggcaccagagaaaggcaaagcctaatttaaggaaattttttaaaaaataatacaagaagtgaaggaagaaatattcagtgaaatagacagcataaagaaaaaacagtcaaaacttcaggaaataatggatgcatttatagaaatgcaaaatgctctggaaagtctcagcaacagaatcgaagaagcagaagaaagaacttcagagctcaaagacaaggtttttgaattaacccaatccaacaaagacaaagaaaaaagaaaattgaacaaagcctccaagaagtctaggattatgttaagtctaggattatgttaaacaaccaaacttaagaataattggcattcctgagtaaaaagagaaatctgaaagtttggaaaatatatttgggggaataattaagtaaaacttccctggccttgctagagacctagacatctaaatacaagaagctcaaagaacacctgggatattcatcccaaaaagatcatcacctaggcacattgccatcaggttatctaaagttaagatgaaggaaagaatcttaagagctgtaaggcaaaaacaccaggtaacccagatttctatgcagaaactctagaagctagaagggattgggactctatattcagcctccttaaataaaacaattatcagccaagaattttgtatccagtgaaactaagtttcataaatgaaggaaacatacagtctttttcagacaaacaaatgctgagagaatttaccactaccaagccagcactacaagaactgctaaaaggagctctaaatcttgaaacaaatcctggaaacacatcaaaacagaacctctttaaagcataaatctcacaggaccaataaaacaaaaatacaattgaaaaaaaaaaaaaccttccaaggtatacaggcaacaaatagcacaatgaatggaatggtacctcgcatcttaatactaacattgaatgtaaatggcctaaatgctccacttaaaagatacagaattgcagaatggataagaattcattctctgctgccttcaagagacacacctaacataaggactcacataaacttaaggtaaagggatggaaaaagacattccatgcaaattgacaccaaaagcgggcaggagtagctagtcctacatcagacaaaacaaaatttaaagcaacagcagttaaaaaagacatagagggacattatataatgataacaggccttgtccaacaggaaaatatcacactcctaaatatatgcagctaacactggagctcccaaatttgtaaaacaattactcatagatcaaagaaatgagatagacagcaacacaacaatattggaggactttactactacaccactagacagatcatcaagacagaaagttaacgaagaaacaatggacttaaactataccctggaacaaattgacttaacatatttacagaacattttacccaataactgcagaatatccattctattcaatggcacatggaactttctctcaggtagaccatatgataggacacaaactgagcctcaataaatttaagaaaattgaaattatatcaagcatggtctcagaccacagtgcgttaaaactggaaattaactaccaaaggaaccctcaaaaccatgcgaatacatggaaattaaataacctgctcccaaatgatcattggatcaaaaatgaaatcaagatggcaattaaaaaattcttcacactgaacaacaatagtgacacaacctatcaaaacttctgggatacagcaaaggtggtgctaagaggaaaattcatagccctaaacgactacatcaaaaagtctgaaagagcacagacagacaatctaaggtcacacctcaagaaaaaaagacaaacatgaacaaaccaaacacaaacccagcagaagaaaggaaataaccaagatccgagcagaactaaatgaaactgaaacaaaattaaagcaaaagataaatgaaacaaaaagcaggttctttgaaaagataaataggcccatcaaggtggctcatgcctgtaatcccagcacttgggaggccaagttgggcggatcacttgaggtcaggatttcaagaccagcctggccaacatgatgaaacccgatctctacaaaaatacaaaaattagcagggcatgatggcgggtgcctgtaaccccagctgctcaggagggtggggcaggagaatcacttgaatccgggacacgaaggctgcagtgtgccacgattgcaccattgcactccagcctgggcaacggagcaagactccgtctcaaaaaaaaaaaaaaaaaaaaaaaaaaagatgaagagaagataactaaaattgatagaccattagcaagattaaccaagaaaagaagagataaaaatcctaataagcccaattacaaatgaaatgagagatattacaactgacaccacagagttacaaaagatcattcaaggcccctacgaacacctttaggcacataaactagaaaacctagagatggataaattcctggaaacatacaaccttcctagcttaaatcgggaagaactagataccctgaacagaaaaacaacaagcagcgagattgaaatggtaatttaaaaaactccaggaccagatggattcacagcagaatcctgacagacaatcaaagaagaattggtaccaaccctattgacactattccacaagatagagaaagaggggatcctctatgaagccagtatcaccctaataccaaaaccaggaaaggacataaccaaaaaagaagactacagaccaatatccctgatgaacatagatgctaaaatccttaacacaatactagctaatcgaatccaacaacacatcaaaaagataatccaccatgatcaagtgggtttcataccagggatccagggatggttacgtccaatgtgatacaccacataaaaagaattaaaaacaaaaatcacatgatcatctcaatagatgcggaaaaagcatttgacaaaattcagcgtatttttataattaaaactctcagcaaaatcagcatacaagggacatatctcagtgtaataaaagccatctatgacaaacccatggccaacataatactgaatggagaaaagttgaaagcatttcctctgagaactagaacaagacaaggatgcctgctctaatcactcctcttcaacacagtactggaagtcctagccagagcaatcagaaaagagaaagaaatacagagcatccaaattagtaaagaggaagtcaaactgttgctgtttgctgatgatatgattatttacttagaaaaccttaaggcctcctccagaaagctcctagaactgataaaagatttcagcaaagtttctggacacaaaattaatttacacatatcagtagcacttctgtacaccaacagcgaccaagtggagaatcaaatcaagaactcaaccccctttacaatagctgcgaaaaattaaaatacttaggaatatacctaaccaaggaggtgaaagacctctagcaagataaactacaaaacactgctgaaagaaatcacagacaacaccaacaaatggaaacacatcccatgctcatgattaggtagaatcaatattgtgaaaatgacaaatgaccatactgtcaaaagtaatctacaaattcaacaaaattaccatcaaaataacatcatcattcctcacagaattagaaaaaaaaatttaaaattaatatggaagcaaaaaagagcctgcatagccaaagcaagactaagcaaaaagaacaaatctggaggcatcacattacctgatttcaaactatactttaaggccatagtcaccaaaacagcatggttctggtataaaaataggcacatagacgaatggaacagaatacagaactcaaaaataaactcaaatacttacaaccaactgatctttgacaaagcaaacaaaaacataaagtggggaaaagacaccctattcaacaaacagtgctgggataattggcaagccacatgtaagagaatgaaactggatcctcatatctcaccttatagaaaaatcaactcaagatggatcaaggacttaaatgtgagacctgaaactataaaaattctcgatgataacattggaaaatcccttctgggcattggcttatgcaaggatttcatgaccaagaacccaaaagcaaatgcaataaaaacaaagataaatagctgggacttaattaaacaaagagtttttgcatggcaaaaggaatggtcagcagagtaaacatataactcacagagtggcagaaaaatcttcacaatctatacatctggcaaaggactaatatccagaatctacaatgaactcaaacaaatgagcaagaaaaaacaaacatgaatagacaattctcaaaagaagatataaaaatggccaagaaacgtaggaaaaaatgctcaacgtcactaatgatcagggaaatgcacaccaaaaacacaatttgataccaccttactcctgcaagaatggccataatcaaaaaataaaaacagatgttggtgtggatgcagtgaacagggaacacttctacacttctagtgggaatgtaaactaacactacactatggagaactaaatgcagaactaccatttgatccagcgatcccactactggctatctacccagaggaaaagaagtcgttatatgaaaaagatacttgcatatgcatatttatagcagcaaaatttgcaattgcaaaaatgtggaaccaatgtatatgcccataaatcaatgagtgcctaaagaaactgatattatatatattacatatatgatggaatgctactcagccataaaaagaaatgaattaatggctttcgcagcaacctggatgagattggagactatttttctaagtgaagtaactcaggaatggaaaaccaaacatcgtatgctcgctcataagtgggacctaagctatgaggatgcaaaggcataagaatgacacaatgaactttgagaactcagtggggaaaggatgggaagggagtgagggataaaagattacaaattgggtgtaatatatacttctcaggtgatgggtgcaccaaaatctcacaaatcaccactacagaacttactcacgtaaccagacatcaccttttccccaacaacctatggaaacaaaaataataataaagaatacagatcagaaagaaagaaagaaaattctccttatttgtagatgacatcaatttctacataggaaaatcctagtgtataaaaactcctagaactaatgagttcggcaaggtcagaggatacaagataaacataaaaaaaattagaactccacatattagcaatgaacatgcagacacaaaaattaaaaatacactatttacaactgctcaaaaaaatgaaatagtataacaaaacatatacaggacttgtattctaaagactacacacacaaatgaaataaataaaagaagttctttttttgagatggagtttcgctcttttgcccaagctggagtggagtggtgtaatctcagctcactgcaacctctgacccccaggttcaagcaattctcctgtctcagcctcctgagtagctgggattataggcatctgccaccacgcccggctaatttttatatttttagtagagatggggtttcaccatgttggccggggtggtctcaaactcttgacctcaggcgatccacccaccttggcctcccaaagtgccgggattacaggcatgagccaccatgactggccataagttctaaataaatggaaaggtataccattccatggattggaaaactcaacatagcacatctccccaaactgataaagatttaatacaattactatcaaaatctcagcaagactttttggctttgtggatacagacaaggttattttttaaattatatggaaaggcaaaggagctagaatatctaaaacaaattgaaaaaagaatgtaggaagactcattctaccctgagttcattcaagatttactacatagctagagtaatcaagactgtgtgatgttggtacagggacagatacatagattaattgaacagaatggaaaccccttatagaaatagacttacatgaataagtataattgatttttgacaaaggtaaaaaacgatccagtgaaggaagcaattcaaagaagaaagataagacttttctacaaatggtgctggagcaattggacatctaaacctagcattaggcaaaaaattcttagacttaaaaccaaaattacaatccataaaaagaaaaattaacaaattagacttcttaaaaactagaaaattttgctccttgaaagacccgattaagaagatgaaagctacaggacaagagtacgaattatatatccaacaaaggacttgtatccacgatatgtgaagaactccacaactcaacagcaatgaaaaagcccaatttaaaaataggccagtgacttcaacaggtattttatcaaaaagagaatgtaatgatgaaatatcagcacataaagacgttcatcatctgctatgctttgaatgtttgtagccctcttaaattcattttgaaacttaatccccagtgcaatgcattaagaggtagggcctttagaggtgattacatcacaaaggcaaagccctcatgaatgagattagtgcccctataaaagggcttaagggagtctgtttggcccctttttgcttttctgccatgcaagaatgcagcaaatcaccataaaacagaaaatgagccttcatcggacaccaaatctgctgataccatgctcttggaattcccagcttcaaaactacgagaaataaatgtgtattatatagacattatccagcctaaagcattttgttatagcagcaggaatggactaagacatcagcccttagagaaatgcaaattaaaaccatgatgagataccaccacatacctattaaaattcataaaataagaagtagcgacagcactaaatgctggaaagaatgcagagaaactagatcacttaacattgctaatgagaatctaaaaagaaaactggaaagttccatgaagaactaaagttttagtttcgctgctgtttctttgacaactaaacatgcaatgaccatacaacccagaaattgcactcctggttatttatcccaggtaaatgaaaacctatattcacacagaaacctgtatatgactactgatagtagatttattctgaatagccagaactagaaacaacccagatgtttttcaatgggtgaatgttaaactacagtatatccacaccatgggatgctactcagcaataaaaaagaatggactatcagtacaatcaacaaattaccagataaatacacagaatgaaaaaatatataccaaaaggttacatgcatgatttaatttatattgcaaatttgaaaaacaaaattacagaaatggggattcgatcggtggttgccagagattaagtataagatgaagaaaagaagaaagtggggatgttgggcatagtggccagtgcctgtaatcccagcaatttgggggactgaggcgggaggatcgcttgagcccaggagtttgagatggcctgggcaaaattgcaaaaccccgtctctacaaacaatataaaaatgagctgagcagggtggcactcgcctcttgtcccagctactcagaaggctgaagtgggaggatcgatttaccccagaaggaggaggttgcagtgagccatgatcacaccactacatttcagcctgggcaacagagtgagacaccttctcaaaaaaaaaaaaaaaaaagaaagaaagaaaggaagaaagaaaaataaagaaaaggaggaggaggaggagaaaaacaagaagagggaacagaggaaagtgggtattgctataaaaggacaacatgactgagatcatttaggtgatgaaaatgttctgtatctttactgtatcactgtcagtatcctggtgctgatattgtactacagttttacatgatgttactattgcgaaaaactgggtggagggtatggcagatcgtcccatattacttcttacaattgcatgtgaatctacaattatttcaaaataatttttaattaaagctgttatatgtatcatctcttcttatgtttggaatctttcaatagctttacattattcttagaataaagacaaaataactaacttgatatgcaaattctttttggtctaaatttatctctccagcctaatatcatacctttctttcccttattcttttgtattccaatcatgaaggcatctaagttttaaatccatttttctttctaccaatggcctttccacatgctgctctctctctctctggagtgtttctttctctccttcattcatccctcctaaccatcacttcatgtagttaagttctcatgttttctgaacttactcatgcgtctttttcttggggaagtcttctctgaaccacaggtctagttaaattacttcaatattttttaaagaattgtatgccttcctccaaagggcttatctaggtaagtaatatgcattggattgtgtggttatttatgtttgtctcctccattagaccataagctccatgaaccaacccttattgacaaatatgttcccagatcctagactgatatcctgtaactgtttaaaaaatatttttaagtaaatatatcagtaaaataagaagttgttatgcttaaagaagatacttaattccttccatccttctctttagcatctcctgaggcaccttatttaaaccatagggctccatggaacacagtttatttgaaaagtggcacttcatcagcatctgttgtttcctgactttttaataatagccattctaactggtgtgagatggtatctcactgcggttttgatttgcatttatctaatgaccagtgatgatgagctttttttcatatgtttgttggccacataaatgtcttcttttgagaagtgtctgttcatatcatttgcccactttttgatggggttgtttttttctttttgtagatttaagttccttgtagattctggatgttagacctttgtcagatgggtagcttgcaaaaattttctcccattctgtaggttgtctgtcattgtggaagacagtgttgcaaatcctcaaggatctagaaccagaaataccatttgactcagcaatcccattactaggtatatacctaaaggattataaatcattccactgtacagacacctgcacacatatatttattgcagcactacatacaatagcaaagacttggaaccaacccaaatgcccatcaatgatagactggataaagcaaatgtggcacatatataccatggaatactatgcaaccataaaaaagaatgagttcacgtcctttgcagggacatggatgaagctggaagctaactaacagaggaacagaaaaccaaataccacacattctcactcataagtgggagctgaacaatgagaacacatggagacagggaggggaacatcacacactggggcctgtcggagggtggggggcaaggagagggagagtgttagaacactacctaatgcatgcaggccttaaaaccgagatgacaggttgataggtgctggggttcaatcaggctggtgggaaaaatattaaagataggtatagtaatagccaaaaactatcttggaaggcctgagagtttgcatagcttcagatttcttggctgaatgcagccagagtgtctttgcaggagcaagaaagattagggtgcaagtgtaaaggaatgtgggaagtttatcttactaacctgtttacttatatgggcttaagactgtcctttgtcctaccgtgggtactttactgcctcgccactgcctcctactgtcggggaggagggtcagcagaagtttattacctgtaaatggtgtttgctttaggcctaggaacctggcctttaatctttacctctaatggtgtttactcacaacttttgttaattagtcttacagaataaatgcgagcctcactagctaatcagggccaagtcccaactgtttacaggactcagcaggaagcctataagcagcttggactgtcagctggactggcagagcagaatatctatcagtgtacgtttattcatccatctccaaatcaggggtctgcaggaacagaccccgcaccagcagctagtgcccccatgaaaggagcgctccctcagacaggtgcagcaaaccaccgtggcacatgtaaacctaggtaacaaacctgcatgttctgcacttgtatcccagaacttaaagtaaaattagaaaaagaaattaaaaaaataatttaaaaaagtgacactttggagtcccatctattgtagtaaaatctgatggtaaaaactgtggctctttctgtcaacatttgggattggtttgggaccaaacaatatgtagtccaggtttagctactcttagccctaatacaaacgtgagcctcagtctctctctccagctctactcatctctactgtttcctcatgtagccactattttaaattttctgaagcaaagtttgtcatttcatcaaaacagaattggtacttcaagtgggatcattcctgtaacaccagaattatggctatatattaaatgtaagggaaaatggtgctacatacaccacatctaaatacactgcatctaaaatttggagagcagccaactagccactgaagttaaggtggttacttctctgtgctgatgacttacactgttcctctagacatggactaccaccgtcaccaccactcttatgtaccagtatatgaaaacatcacactgtataccacaaatgtatacaatttttgtcatttaaaataaatgaaaaagtaaaaacaaacagagcacagggagctttgggggagattatcacagtgttgtgttttggggggagattatcacagagtgttgtgtttagagaagttattgccaattctcactctaggggagagaggagagcattttcatctccccaaagccaaaaagggaggcatccatagaataatttacagataatgggggttattgaagaaacaaccagccttgtgtttcctggaaacaagcttgttgaaattcagaacatagggcctctctcatgatatcactggagacatcattgatgaaaaaattcttaaggaacttaatatgtgtcctctggagtcttggggtgtgtgtaagcacacagatagattcttctcatctggagacttctgaatgcaagaaatctcctaggagacccatgctaagaaatgctgaaagacctgtggtaccatgtatttgagaagaggagtgcaaccttcacttattccagtttgaatagtgctttcaccatttactagctggataatcctagtcaatttatttaaggatgataaactttattttcttcttttataaatagagtaagtaaggccagtatcttacggtaaagatgaaacatgatgacatttgtaaaactactgagtacctggcaataatttgttgatatttttattagtattagggaggatacctctgtgggctctggagttgtatgttagaatcccagctccaccacttactaagatacatgatcttggagaagtcacttcagctctctacccctcagctgttgctctgaggattagtaaatcaattaacagtgctcatcatagctcttataatcttgttaagcattaaagtcagttatgtacatatttgtctctctccacaggattataaactacttaaacacatgccgtggccttgcatgtcttcttgttgccacttcaactccatcacaatcacaactagcaacactttgaaatatatacacttacatataaataagcattcaataaatactgaatgaatttgaatttttaattcttggaacatttgagagattgtcttattcatattatggttagaaataatagagcccaacttaaagtaacttaagcaatttttttttaaaaaaaaagaggaatggattttattggaatattataaattattatggaagcctaggacaggtgggtctctcaaggggctgaagccaggtcctgggaaatcgttagcaatacagactattctccctgcccatctgtcccttttcttttccacagagatacctgcttcattcattctctctgcttagtggcttgcacatgacaggaagaaaataagtttatttttactctaacatttaatctcctttctattgaccagctcagctgactgatcatctcttcgcatcttctatttctgtcaggaggtctgcttgctgttcctttgtggacaattttttttttctttctggtagcctttaagatcttatttatattatgttgacacaaaagtaatcatgacaacataatataaataacttaatactttatgttgtgtattttcattatgatgtacctaagtgtgagtttgtttttatttatttatcttggaatttgtactttttaatccaaagattaaatcatatatttcttccagaaagttctcagccactatctcctccaaaattccactgatttttcctcttttttcctctctcccttatttaaactcaggccactctttttcctgtcatctatgtctcttaacttctcccttatattttatttatcttaatctctcgtagtatatttcaaatgattcaaatctatctttcaattcagatctgtgtactacttaagtcaccagtggtaattcagtaattaagatctgtctactatttaagtcacctgtagaggctatgtttacttgtttatttgtttcagagactgtatttttttgctaggccaaggtggcctacttatctttttataatgtcctatagcagtgacaaatatcattacaaaatccaattttagaaaaatactaatctaatgtggggtagtttttttggcaaaatacattaaatggcactaattacacagtaaatatgaggtaacatgaaatcacaccactatctgatttacagcaacatggacttggttgtacctttcaggatgagcacatttccaaaaaatgagattaccagtgaaatctaattaggaagaaagctttaaaataatactacatcagagcgtcttgcagctgatatgtgacagataggacatgttatttataaagtagttccagccttattcattaaagttaccagcctttcttctttctaaaaaggagcaagaagttaagaaatgccttgaattggtgtctggtcatgcagtagtgctgagaaggggtagtgagagtagtaaaacaaccctggtggggcagaggggttggatgtaaacgtcattaataatcatggtttgcttctaaatacagtagcaatatgacttctgatttgtaatcttaggtaaagtataaattgaaaaggccagtaatagtacactaagattaataaactgcacatcaaaaattacacgagggctctgtttgcagtgaggtttcacaaaacaagttacctgtatttttctttttacatctggcttgcaaagccactcttgcagacatttcaaaaaattctctccattttcagttttgctgaatcctccaggcacacaaaagtgccaacctggattgttatatctctaggcacccatcaagttttaccaactcttgcttcgtcttggtgagatcctgtcttatgtgcccatccttcagaagatgcatcttgttcccaactagaatgctgtacacattggggcagaaacgcttactctctaaggttctttgtcctgggaggttttctaaactccaaagctattgatgaaggaacacctcaatataacattggtgtctgggtaggaaagagtcctcaggtgatcttgaccttcctgcccaactgtgtcccatatagccaaccccatatactttcctttcacttcaatgtcatctatgttgttctcttgtgtttgtccctgtgaagaccatgagcaagcaggtcttgacataggctctttcacaataatcaccagcctctttagcatggcagggacattgtagagagcaccttctgtgtgcccaatattacgctacgtgatgcagcaggcatcattcaccgagttctgtgagacatggtcagcatgatagagaggtttcacaaagtacattaaacttatcagaaaacaggcaatcaggcagaagtccaaatccagttgctgctctaccagtcatgagtttaaagacacctgtgggttggtacagtgaagagtgcaagcacactttaaaatattaaagataattattttaaaattgtttttagataattttattatttctttttcttcgcatatggtacctcatatttgctgcttagtctaatttcttcctatcatattaggttggtgcaaaagtaattgtttttgcaccaacctaatagattgacatatgtattaatagggtttggctctgtttcctcacccaaatctcaccttgaattgtaatccccataatccccaggtgtcaagggcaggaccaggtggaggtaatcggattatggtggcaatttcccccatcctgtcctcatgatagtcttacaagatctgatgatcttataagcatccgacatttcccatttgcattcattctctctcctgctgctctgtgaagaagtaccttccaccatgattctaagtttcctgaggcctccaagacatgcagaactgtgagtcaattaaacttctctcctttataaattaccatcttgggtatttcttcatagcagtgtgagaatggactaatacacatatataatttttatctctgaatgtatctttagaaagaaatatgttctaaggttctgcatttctaagtggtggtatcatggttgttgatggtacacagtaatttggcaccaagaaaatctgagcaggtacgtaaagtatgtccttttataccttccaagacctggaattattagcctgaaattattataattttcatgttgcctcccaagaccataagcggatttttttttgtcttgtgcatagggtccaattccaactgcccaccatgtatggaacttttggcctcaagtatcatgcctatgaggcataaagccccagttcttgggtatataccagacatgctattcctaaaagtagccctgcttcgccttctacttacagtgaggattctctctgttttcaacatttaaggatttcatttttgtcccttttaacttattattacaattatatatatatatatattttatttctaagtgtttggagtgagagtgcagagttcttgcatcagcttagtctaccatttagatcagaatcttggattcactataccttggtcccaattccaaatatcaggaggggagaatgattggctcagattatatctgaccactcttggatgaatcaattatagtggtgcaacattatgtaatagaaacatgtctgttaggggccacctatgtgtgtgaaagggcatcctacattacaaggttgctaggcagatactcctataaatatttaccatagaaatcctaagaaatatttttactcattttttattctctgcttagatttcctcatctaaaaaatcaagatggcaaattttctgcttattacatgttttaaagttgacttgtttaaaaccatcatgttcaaagagagatatatctggccttatataaattttagatatccttcacaaaaatgaaggaaataatcatcacttgacgtatgatttgggttttctgtagacatccatggaataaaaatgagcaataggctcttattcctaccaaatgataagtgaaaatatgaaaataacaatatataaaatatttccgttaataaggttcactgtgggttgtggtttcagttgttgttgtctgtttttgtggtttttaaaagcttcaaagcagcctgagtgattggttaatgaaagaggtggagcctttatattatgaaatgttcgcatcatcaaattgattactggcaggaatagggtttcaatttagcattccagggttcacacaattggatactctcatgtctataaaaagaaaactcttgcctggggctgaaaattagtgtttgcctaagcttaggtaagggggaaataaaccttgcatacatgtagagataaacaaaatgccttaagaaacatggcagatctgcatcctattccaaagaaaattcaagaatttattcacattggcaagttttttgtaaagagtctttacaaaagatcttaaatatatttcagatcttcccttcagctcttattcctgttaactgagcattatgtctcttatctctaacatacccgtgcattcctttaaaattaccaagtggattttgtccgtttaccttcctttctagtgcacttcaaggactatactgttagaaacaagtcagcaatgtatgtcaggtaaagagtgtgtgctcattataagcctgccaataactcatatttgtacagtatttttttccaaaatatgtttgctacattgctcattcgatcttcaagacagcactgtaagagttaaattttataactaggtccagaaaagcttagaggtctttctggtatttaatccactaacgtaattctccaaaaacatatttgccgaatgaatgaagcagtaggaatactgagttggagttttaaggccttatttttttaaatcctagccttccaatttggtagtttggacaatattgggaaagtcagttaatatttctgaatctctgtttcctcatctatacacacaaaacaataatacttgatttacatgtttcttgtatggatttggtgaattagggaatgtgaataccattttttaggatctggcctatactacatgcttaatatgtatttgtggaataactgaacttacatcaaagtgttgcttgagaattgtctgcttcagaattagcttcaggttaatttgaagatttttaactttcttttacgtatttcatcattaaccatatttatatcctagctctgctctcctctgtggggagcaagggcattgcttcaccaatatggctctgagaaggattaaatattttgaagaataaattacacgtgcaattttaatctcatctgagaacacagcctcatcattgttacaaagactatattaagttatgtaatataagtagatgcatttcataacccaactcctctctgctactattagctgtctggaacactgtattgagaatagttccaaggccaatctggtttaatagaaaagaaccccatgcatttttagcaataattacccttaatacaagacagcaagaagaacccttttgccccacccataataccccctcagttatagaaagaactttttttttgagacagtatctcactctggcaccgagactagagggcagtggcatgattaccgcttcctgcagcctcgatctcccacgttcaagttatcctcctacctcagcctcttgagtaactgggaccacaggtgcacactaccatgcccagcttattattattattatttgttgtagagacagggtctcactatgttgcccacactggttttgaacttctgttcaaagaacttttaagagcttgaataaaccacattaacagatatattatcttagagaggtaacccagcaaagaaatgttgagacatgatgagaatgaggtaagcaattgttaggtcttagaagtctttacagaccatgctatggagcttagatacaactctcagatgctggatgtcatcagagagtatgtaaaaatatgagtgacatggatggttttctttcagttatcagtgattcttaagcctgattgacaattagctttaactgaagagcttttaaaaattactgataaatgggaagagcacagaggattttttaaggcagtgaaagtactgcttatgaaactataatgatggacacatgctactacaaatttgtataaactcatcaaatgtataataccaagagtaaaccctaatgtaaactattgactttgggtgataacgatgtgtcaatataggttcattaactacaacaaatgtaccactcaggtgagggatgttaatcatgcatgtgtggggacaaggagtatatgggaaatctctatatcttctgctcaatatggggtatatgggaaatctattttctgctcaatttggctataaacccaaatctcctctaaaaacaacttccctaaaaaataaattctcttaaaaaatgctgatatcctttgccccacctgagaccaagtaatcataagccctgggtgttgcccaagcaacagtgctttattaaggtgattccaatagatagtcagtgttgaaaactactgagcttgatcaatctttgttttaattatatctacttgcttcatcctgggatacacaggtgtgatttttttttctcaaacccccaaatacatgcagtctccttttgagaagctataatttcctacctctaaaaatatcacatcataaaaataatgccctgatttggctagttgctagtctgtgggaaagaaacttgggattgccttaaaaagaaaggtattacaaaaatgtcaatggctacaacagtctcctatttagaagaaatgaggaaccaagcttagccagttgaaagagaaaatggaaacaatgataatgctttaaagatgatatgctagtctagtgtttctcaaagtagggcccttggactatcagaagtctgtggaggtctacaatctctccatgataattgatctttaatttggccttttccttttttatcatcatctaaaagtactggtagaaccatgtgctggtttacctggatgaccaacttttaagtgaatgtggccttgagattttagtgtccacattggtatttgtgtttacaaccagatgggtgccaaatagtactacagtcgacccttgaacaacatggatttgacctgcagaggtccacttacatggggattttgttttaataaaagttacactgagtgtgccgcttctcctgcctcccctttcacctcctctatctcttctgcttggccacctctgagatagcaagaccgaccttccttttcttctcctcagctcaaaacaatgtgaatatgacagggatgaagacctttatgatatattttctctttcttattatagtctcaataataacattttctattctccagcttaatttattgtaagaatatggtatatgatatgtataacttacaaaatattgttaatatagtatttatattattgagaaggcttccagtcaaatactaacaggctgcttaagtttttaaggaatcaagagttatacacaaattttacatggcatgggggattggcatccttaatctccacatttttcaagggtcaagtatattttaattgttctgagctaataaaaaagaacaggggaaggcttaatatgtaatgatccattcaagccaagtgtatgaaagtgtcaagaaccacttgtttgaatacaacgtaaataacacaaaaaatttctgggagaattgaattgttatatggcacacaccgatgacatcccatgcatttcaaaaaaaatattcagaagtagttaataccacatggaaattgcaagaaggtgacataattacaataaaccgttggatatactaaaataatgattttttatttcgattgtatttgattgcagtttttattatatgtaagttgtaaatctcttttggtttaatatttgtataggaactattagcatatggaacttaagtcatttaatcttatgcatacgtaaataatacaaaaataatttaatttaaatgtaggagttctaggagaattatttttctttgttaagggtatattacttcagcttgagaaaaaaatgagaccttcttttgttcaacagatgatttttgccattgataacttctagtcctatagatagatggataattagtatatttagaatgtctatttttttcattatactttaagttctgggatacatatgcagaacatgcaggtttgttacataggtatatatgtgtcatggtggtttgctgcacccatcaacctgtcatctacatttggtttttctcttaatgctatccctccctctaggactcacccctgacaggctctgatgtgtgatgttctccttactgtgtccatgtgttctcattgttcaactcccacttatgagtgagaacatgcggtatttggttttctgttcctgtgttagtttgctgaaaatgatggtttccagcttcatccatgtccctgcaaaggacatgaactcatccttttttatggctgcatactattccatggtctatatgtgccacattttctttatccagtctatcattgatgggcatttgggttggttccaagtctttgctattacgaacactgggcaataaacatacatgtgcacgtgtctttataatagaatgatttataatcctttgggtatatacccagtaatgggattgctgaggcaaatggtatttctggttctccatctttgaagaatcgccaaactgccttccacaacggttgaactaatttacactcccaccaacagcataaaagcattcctatttctccacgtcctctccagcatctgttgtttcctgactttttaatgatcgccattctagctggtgtgagatggtgtctcattgtggttttgatttgcatttctctaatggccagtgatgatgggctttttttcgtatgtttgttggccacatcagtgtattcttctgagaagtgtctgttcatgtcctttgcctacgttttgatgcggttgattttttcttgtaaatttgtttatattatttgtagattctggatattagccctttgtcagatcgatagattgcaaaacttttctcccattctgtagactgcctgttcactctgataatagttttttttaattattttgctatgcagaagctctttagtttaattagatcctatttgtccattttggcttttattgccattgcttgtggtgcttcagtcatgaaatctttgcccatgcctatgtcctgaatggtattgccaaggttttcttctagggtttttatggttttaggtcttaggtttaagtctttgatccatcttgagctaatttttgtataaggtgaaagggagaggtccagttgcagttctctgcatatggctagctagttttcccaacaccatttattaaatagggaatcctttccccattgcttgttttttgtcaggtttgtctaagatcagatggttgtagatgtgtggtgttatttctgaggcctctgttctgttccattggtctatatatctattttggtaccaataacatgctgttttggttactgtagccttgtagtatagtttgaagtcaaatagcgtgatgactgcagctttgttctttttgcttaggattgttttggctatacaggctgttgtttggttccttatgaaatttaaagtagctttttctaattctgtgaagaaagtcggtgatagcttgatggggatagcatcaaatctataaattactttgggcagtatggccattttcacaatactgattcttcctatccatgagcatggaatgtgtttccatttgtttgtgtcctctcttatttccttgagcagtggtatgtagttctccttgaagagctccttcacatcccttgtaagttggattcctaggtatttaattctctttgtagcaattctgaatgggagttcactcatgatttggctctctgtttgtctattattggtgtataggaatgcttgtgatttttgctcattgattttctatccttagactttgcagaagttgcttattggcttaaagagattttagactgaggtgacggggttttctaaatatataatcatgtcatctgcaaacagagacaatttacttcctctcttcctatttgaataccttttatttctgtctcttgcctgattgccctggccagaacttccaatactatgttgaataggagtggtgagagtgggcattccttgtcttgtgccggatttcaaaggaatgcttccagtttttgcccattcagtatgatattggctatgggtctgtcatacatagctattattttgagatacaatccatcaatacctagttcattgagagtttttagcatgaaggactgttgaattttatcgaaggccttttctgcatctattgagataatcatgtggtttttgtcattggttctgtttatgtgatggactacatttattgatttgcttatgttgaaccagccttgcatcccagggatgaagccaacttgatcttggtggataagcttttttatgtgctgctggattcagtttgcccatagtttattgaggatttttgcattgaagttcatcagggatattggcctgaaattttcgttttttgttgttgtgtctctgccaggttttgctatcaggatgatgctgtcctcataaaattagttagagagaagtccttctttttctattgtttggaatagtttcagaaggaatattaccagctcctctttgtacctctggtagaattcagctgtgaatccatctggtcctgggctttttttggttggcaggctattaattactgcctgaatttcagaacttgttattggcctattcagggacacaacttcttcctggttaattttgggaaggtatatgtgtccagcaatttgtccatttcttctacattttctagtttatttgtgtagaggtgtttctagtattctctgatggtagtttgcatttctgtgagatcagtggtgatgtccccattgtcattttttattgtgtcatttatttcttctctcttttcttctttattagtctggctagcggtctatctattatgttgatctttttcaaaaaaaacagttcctggcttcactgatttttttgaagggtttttcttgtctctatctccttcagttctgctctgatcttagtcatttcttgtcttctgctagcttttgagtttgtttacccttgcttctgtagttctttttaattgtgatgttagggtgtcgactttagatctttcctgctttcctctgtgggcatgtagtgctacaaatttccctctaaatatatttctattttcatacaataagtatagaatcttagcaaataatctttaaaccctagaattttaattaaaaagcccatctccataatattttaagtttctttctactttttgagaacttgatttattttcaataattaaagaatttatagttcataaatcattttaggcaatcatatgatgattttattcttatgaaactccgtgaattagaagtcatggttgcaaatatagtttttagggccagattttcctaagtacaaattcctcatgtgctatttatacttgagtgactttgagctaagtacataactctcaaagaaccttacccatatgaagataatattggtacctttgtcaggcaattgtgaagattaccaagataatctatgtgaaatgacctagataaaagagaaaagtatgatatacattaatatcttttctgtgtgtgacttgatcaaaagttttatggatcagagtaagagatatggccgggcgcagtggctcacgcctgtaatcccagcactttgggaagctaaggcgggtggatcacgaggtcaggagatcgagaccatcctggctaacacggtgaaaccccatctctactaaaaaaaaacacaaaaaaaattagccgggcatggtggcaggtgcctgtagtcccagctactcgggaagctgaggcaggagaatggcgtgaatctgggaggcagagattgcagtgagccgtgattggccactgcactccagcctgggtgacagagcaagactccgtctcaaaaaaaaaaaaaaaaaaaaaaaaaagaaaagaaaagaaaaagaaaaagaagaaaagaaagagtaagagaggagaaaactctctggttttctacttgattttatgtaatacaatctcctagttttctcatctgcaatataagattgttagaccaccctcttttgtgacttcactgatcttaatctcctaattcctcaatgaaaggacatgtgattgaaattatgtctaccctaccttacctgaaatccttagggtcagttgtgtttcaaaattcagaaatatttggattttacaaaggttacacattgtgtgtaccaagtattacagaacagtccccagcaggatctggggcagaactccataatcaaatgttttagtatttctaccataaaatatatgaatagtcacactaagcagagaacacgaaaactattatataaatagcattacattattttatgttaggtttctgccatgaaatgagttttgatatcaagagtatataaaacttttcattttatgaaagttttaaattttagggttaaagataagcatttatgcatctgtgtaaactactccatggattgcttccaccactagaagcatgctgtaataaaaatatgatataataaaactcaaaattctggattcagaaaatctaattccatccttgattcttactgtctagctttgtgaaatcaagtaactatatttctctgaatcgtagtttctgtatttgtaaaatcaaagtttgaataagaaattttacagggttccttgtaagattaatagtatatttcttttagggagaagtgaagggggaaaaagaatataaatgtgtttattatcactgaactgtacattttaaaatggtaaagacagtaaattttatatgtatattttaactcaattaaaaagtgcacaaaaattttaagtagtccatttatcttaaatgaatgaaactatggacactattagtttaactatatataacctaactaattcattcaatgcataaatatttattaagtcttactatatgccagcacttttcaaagtcttgtagacactgtgatgagcaattctgctgtcattaaacttatattccagtggaatggagactaacaaaaaaaacccagcagataaacaaataaacaagaacatttcatatactgattgatgctataatgaaatataaaaagaaaataattatagagagtaacatgggacagatatttcaagttcagtggtagaaaatacttctctgtggagcagagatttgagtttgaatcacaaggatgaggttagttccatgaaaatataggggtagagcattccagaaagaaaagatgacaaatacaaaagtcctaaggcgggaaataggcctgtagaactgaaatatagaaattaataagagagttacaggagatgaaactagaggaaaaggtaaggtcaagattgtgttgggttttgcaagccatagtaagaaaggaatgattgaaaccaaccttttgccttaagaatgcttgtataagacctattaatctccagagacctattataaccagcccaaaggaataaagcctctatttgtctcaaggaaatgttaaaatgaaaataaaattcagtgataccaaataaaagttccagtgaaatatcaaatcaagagctataagaaataaaataaatggaatcatttgattgagctgctaaaacaaattgcttccaatggtttctagaacctttgtacagaaacaagccataaataagtttatcagcaacagttttagaataattatctgacagtacatctttaggtattgtaggccaagtgcaaaatcagacaaataagagaaaaagccagacgctatataaactggaaagatatgaattgtaaatatcaaaagatactcctcaaattcatttaatgtagaaactttttttctgttcttaacaacacagaactattaattattgaaacattttattgtatattactaatacttattggatgtatatcaattccagttatacaaacgccaagaagcttattttaaacgcaaaacccatttttaaacggtcagaactccaaagatggtggctattgctatcgatttctataaatgcagcaattagagtttacatagtttaaaagagaaactgacatattaatacatattgcttaccagattctgtcttccttagggccacataaaaagtccctaaaccagcatatgtaaatgcatctatgctttgccatggttcctgaagacatcctttgtacacatgtaggttgcccaagaatcccagcaatttttaaaataaattcaacttaaagtaatcacactatgaacctagccattgttttcaggtgtgtaggcaataagtacaagctggggtacctatagtcaaaaaaattcaacctttggaggaacggagccaaaacatatagtacaaagatcaatgcaatctgaaatatatctgaatacttagaaatgtgattatcagtaaagtgaaatttatactctgctttctatactataatagcaactagtaaaatcatcgtatgcctttgcttgacacaagataatgtctttccctctttaaaggaaaccgtaaaaacattctttccagtctgcatccaataagataaagacactctgatgacacattttaagttctagtaataaaagaatgtgtcagcatccttaccacctaaagaccataaatagcacagtttgttcagtctcctgaaagatgttctcagagttcagacccaattctattaagcactagtcccaacccaatttatatatgattagaagatacacatgtccttggattgtcctctctataaaacgttctagtgggcgggtaaagatagctctaaactgtaccttttcttctagtattatttctgtttctcttccacctgcattgtccaaagggacagtgatttaggttacatgtatgatgaattctctgaagatctaacattgactcaagtggatgctccagaattcatcctagaacttgacctagagatctgttttgcttggtatttcacttatgggcttccttaaagtccaaactcttacaaaataatttaaagttgcattgaaagaaaaaaaagatgctaattgcttttggtttccaccgcaaaacaaaaaccatccactcaccttttattgacaagtggcatattgagaataagagacattttctcaagcagtttgtcttataaagaaattttagaattagaaaacttagttttagaattataaaaagattttacttaccctcagcaggggcactgctggcatttcagacaagaaagagattcattatataaatctgtcccacccatttgaagactgtttatttttcctggaactttttcactaattgccaatatgcctcagtcatgtgacaaacaaaaaattcccaccaacacttacaaacaagccttgagcattttaacacccttgagttgagaaccacaaaaactacttcattctgcaatgaatagacttggaaacaaaatgctttgctagaggatagaaagacagtaaatgccagaattgtgactatttagtgctttttccataataacagacctgcctctgagaaaaacatacagtaaaaatgagacccattttcctcattttctccatggaaagctagttgataacatcatcaaatatttggcgtgggatgatgtaatctatctaagtcattggcactacatagaaatatactgcaaataagaaacaatcttccaaaactgacaaaaatatttgactgcttctagaaacctatttaacacttagtcaagagtgcattgaaaagagcaaaagagtaagtaaatatagataaaaatactttctttgacttcgactgactgtatgaccttaaattacactatttatatactctctccaggcctcagtttctccatatgttaaataacgcagttgagttaaattattcttaatgatttcctctataagaaatttttcacttcatggttttcaaacagatttcacttaatgcagttcaagtttattttatattatgcaaagataggtaagagaattccagtctcttataagactcctccatctatacagttttatcctactatggacagggagtggagttttctgggtaatcaaataagctggcaaacaaaagaatatatcatgtattaccaatagtataatttattccttcagcaaacatttactattgagtatgctttttactattctaggttctagaggcacatatgaattactcattttccctgatttcaaggaaaccatagactggtcaacaagttaggtatataaacagatcattaaaatacaatgtgggccaggtgcagtggctcatgcctgtaatcccagcactttgagagggcgaggcaggcggatcacctgaggttgggagttcgagaccagcctgaccaacataatctatgtgaaatgacctagataaaagagaaaagtatgatatacattaatatcttttctgtgtgtgacttgatcaaaagttttatggatcagagtaagagatatggccgggcgcagtggctcacgcctgtaatcccagcactttgggaagctaaggcgggtggatcacgaggtcaggagatcgagaccatcctggctaacacggtgaaaccccatttctactaaaaatacaaaattcgctgggtgtggtggtacatgcctgtagtcccagctacttgggaggctgaggcaggagaatcgcttgaacctgggaggtagaggttgcagtgagctgagatcgcgccattgcactacagcctaggcaataagagcaaaactctgtctcaagaaaaaaaaaatacaatgtgataggcattataattacaaatataattattatgctaagcaatgaattgtacttaccattacagtggtaatacaaataatgaaaaaaattatttgctgattaaacaaatagataaatcattgcttttggggttactgttatggatataaaatattaaaataccatagaaagaaggatattctgattaatataggactccatttactaaaatatcaaatgagtattttttcccgaccatttttgctaaagtgattttaagaaaatgaatggattttggagtataaaaaacttgatttgaattccagcactgacacttagatgttaggtgacttttagacaaattttatcaccccttagagcctgtgtcatcatttgtaaaattaagagagttgttgtaagcaataaataaggtaatgcatataaagtggcaagttcatagaaggtcttttatcaatattaaatatcttctcattttcagtgtggaaaaatttaatgtcatgtacctgccttcagagatagtatttaatatcaaattgaattttccagaaatggttgcaatactttttgttccacatgctcttgctaacgtttatcatccctattgagatgcagagtctatgaatccttcccttgaaccttttatagcacttgtagtatagtagcctttgtgactgcttgcctcaattaatagagtatggcagaagttatgttatatttctttcaagatagtctcaaaaggagatgtagcttctgtctgactccctctttcctgaaccatgtatctttggatcctcagataacattaagacttctggttgctctgaagtagccatggtggaagaattgcatggagaaaccacacaaagatagagcaaagatgccccagctagaaagataaataacgattttgtgattcttggctaaaaagtacattcaaaaccctaagtgtcctcattgttactaatgtcctaaatcagagcatatgataaaaacaggagaaaacaaattatcagctcctgttctctgatgatttgaaaagtatgagtgcaattgttctaaataataaataacaggcacaagtaaatatctagctcatgaaatcaaaatcttcaaatatagaaggaaagaaatgcccataagagaagataaaatttttgaaaataagttaagttactaagtatattctttataactattttgtcaagttgcatgtaaaattcttttagaaatctagtgaaaaaaatctatcctaatgtgaaatactggcagatgacgttcatgtgagcagcagttagggtttatagcaaaatggttatttttttaaggtgcatgctattatgctatcaaaagcttaaaatattagaatgagtgatttttctttaaaagactttttttggtaagaatacatagtaagtttctttatttgtatgtcatgttagcactttattactaaattaatttgtatatcaaaatctggattctcctcaaaagagaggactccaatatcaagaaatctagattcttacagtaaaacaaacaaggatatcaacaataaaaatagactggtactgtaaattataagcttaagagttaggcttggtttatactatggcttcactcaaatccagctgcatagccttgggcaaactgcttaacttttctgagccttaatttctacttgtgtaaaagcagtgaaataatacatttacccagtgggttgctgtaaagaataagtgcaacaagatatgcaaagttcttatcacaggacatagtacatatttggtgctcaatatgttttagttccttgtaattcttccttatatatgcagtttttaatttaggaaagagtaggtattacttaaggatgacttgctttcatcagaaactataccagtgcactaaacagatggaaagaaaaagcatctttatagcttcaccccttaatatctcacttcaagccctctcctcagctctttactatagagggagggttacatgcatccctttctcctccatatttctggctctgcccatggtaaggtagctatttctacccagcaagtaaaagtacagtattgatttacttcttttctttggttttaaccctccagaagaagagaactggtaagtaaaatgattcatacttcaaagccccacccggacctaacacacatcagctccacatacctcctttggtacaccccaaacctgtattggttctacaaatggtcctttctacctgtccagggtacctgtcttgggcaccttatgcctctggagaaaatcaaattactttaggaattggtaattgcaccagatttatgatctccaagctctgtgagggcctcactactgccgagttatcccgagtctcctatcgccactcttctgtgtctcttagcagattatgcctcttgaagttatcagacagctttcaacttccatactacctatagaactatttatacctgtacttgtattttaagcctcccctcttgactcagaataatggtgtctcttgtgttcattgaaggcagctaagtcaccaagagcactgaaatgaatgcttgccaatttacagaagaagtagatgccaaaattgtgtgcaattgatgtggcttttcaaactgagtatctccctttgtaacatgttttatttggtctttggaaaattcttaatcatatgctgcacatacattcatttgctatgttttaggttaagtttatacttctaaacacactgtctatttgcagtctaaaatttaacacattagtttatgttctagtccaacattttattctttaattataagagacaacctaatgaaaatacatttctttcagtaggagattagccagtgttatttaaaaaaaaaaaaaaaaacttggcaaaacagaaaaaaaagccaactagctttcctagctgtgacaagtttctgtttttaaaaaagtaatcttaaataaactaccagtccttcataactgagtgcattaattacttcaccttaaaatatgtataagatgatgccttaaattcacagggcaaaaagagcaaaagcttgaaaaagatgaaaagaacacaatttacagatattggcaaacacttaaaactccagcctctatgaactttcccaaataaatctataaagctcatcataccgtgcctgttacttagaaagtatatactcagtaaaccgtagctatttatcttctgtgtcaagaattgtttccacaattcgaatcaagtgttatatggaacttcgtgccatgatttcatctcttaataatcttaaattcaaactcttataatactttatggtaacttatctcatagaaattacagaatggaaatcaatgttatctctgattctatgaaatgaactagatttatgaattgggagcagcacaaaaacaacataatgtctactacaaaaaagtcaatatttgaaaactagttttattacaaatgaagtaattttcaaaagtttaaaaacgttaaaatagaaattaaaaaaaaactataggtaaaaacgtcattgtcaaatccccatgttgctcctactgaaattaagtaagggtaatttcatataataatattgtcattgatgttttaataatcaaaactctaacagttgagaaaataaattgtgtatgtttctcttttgcacctatgttattatcagcctcaggtagtaagctttactcaggatagcaatctatcaaaaatgcatgctgaatatttactaaattactatactttttgacctcaatctcctatcttaatggttattcactcctttttcaactcctatcctttaacctcacagtgatatccatcactttaatcttttcattttttcctcagtttactggtcctttatcatcttgttctttagccagcttgaaactaatgactgttcatttgaactattttctcaccaatacctttgatttcttttactgtgattcttcaggtgcaactcttcagcaaaatccaaatcccagataaatactgcatctggtctctctcaactcacacctaggaaatgaagctctgtgggaaaggaactcacacacacactaagagcaatttctatgtagtcagtttccacactcagctacgcactgtcctttaatcaacttcccctctcatttccctcaaaaaacttctcaatcatccccatctgcctccaagtccttagttgcctttagctcctcattttgacaggttagatagccctcagtctcctaataaaattgaggttattaggtgtgttctccctgcacaggtacaccacagccagacccagaaagctaacccacagccacagccatcctcaccctaggccttttcctactctcttctgttctgctctcccatctatagcagaggttggcaaacctgttggtcaaatctggcttgctacatgttgttataaataaattcttatcgaaaacagccatgcccatttgtttatatattttctgcagctgcttcaatgctacaagggcagagttgggtagttgctacagatatcttatggtcctcaaagcctaaaatatttactctctagccctttactggaaaagtgtcctgatctctgatttatatcattgacatcttcctctttcctaaatcttttccttcagcctgtaaatatggtcaactatgttctagtctaaaaatgttagtttaggtgttttggttttttgttttgttttgctcaaactctctccagttgtataccaatttctgtcttgccctcctcataaaacttgtccagggagtatgtcatattctctttctccacttttttttttattcctttcttcctgtaacctgatttttgcccctactactttgttgaaatttgctcctattaaaattaatgatgaccttctctctgtcaaagttaaattttaaatgcctaatcctaaactaattgactcatctttaggcacactccccttaaaactgtaatccaatattcttagcaaagagcacacaacaggatcatttctagaggcttccgcctttatgctatcactaaccggaattactcttaattattacaagttgttgcttcagagataagggattaattttactattccagtatgagaaaagtaatcaagtcaccacaatattgtggtaaatgggagaagaaaagctactggagatatcagtcaatacacaacctccaccctcaccatataggatgcaaacaaacacttgcccttgaagaacacatttgccccaattacccttccttctctctctcctagggtcatcaccgtcatctgttcactagcgaaaactgaccaaaagatgtccaagacacgttggagtgcaaggctttctcagttatctcttaaagtgaagaaaaaaccacataaggaacacggggccttcatttctcttggaaaactgatatccctatggactaatgatataagtgtgtctggaaaatatgtgagatacccttttagagatgcagatgattaatcacaattttaacttcttataatgatgcttggcacaggataagcaaatagaaattaaatgtagaaaccaacaacacatgttcacttatttaatatggaactcccatattcttgaatataaactaccacattaatgagcaaaagtataacaaaattgaaagaacataatcagctttcttttagggtaggaagacagctatttaggattcttcctcacttatcaattaaaagaaccatgaaactaacaaggagacacaaatatgcaaaatcactgataatcgcagtcaacactttatatgtacctggaagggggaaaaaacctttttagttctgttgtggtagggataaattaactgtctctgtctgacatatgttttgaattttaaaactaaataaaatcagttagaaagctaatggaaagatacatatgtcaacttctactctgtatccctatcaaagattcgtgtgatctttgcctctaagtaaagcagcatagcagccacggatctcacatgggaaagttctttcagattagaacagagatatccctttctcatacctctacctcacactctctcatcccacaaaatcttaactttgggagggactttaacatgaatattcatgctctgatggcccaagtaagtacgattaatatgtaaagattgtaatcatacaattaataaggtagatgtaataaacgtgaatgaaaaattttattccatagaaaacatgccttctttttttttttttttgtccaaattcctggcttaataaggacttgtttattttgaggaaaaaaggtctgaaacatcaggctgttcaaaaaataacccacagtatcaactttagaaaacaaatcttaagactataacactttttctagaggatgcatttgacatgccaactctcattcacagaaatacattgtaacatttgtgttgaactgccccacacagcatactaatgtaggggtgtaacacacatacttgtaactcaaagctgctttaaggagccactcaactaaatgagattgcctttgcagttagggaagaaactactgaacttatgtatgaatgaaaagaaatgtactccctgcataacaagagattactttggagacagttgatgaaaaccatacatcctttttattgttaagtcataaagaggtatcaaaattaaaagcaaaaattacagggtaagacttaacaaaactactaggagtgtcaaaggaagtgaaaatgggactaggcgcagaccaatatgaattaatgaacatgggaaggacaaggataggggaacactgagcatgtgctgaagatactaggggagaggatctggtgaaaaatttcaacttagacaagtgcctaggtaaagaaataatgggataagatttcttttttattattattttattatttatttatttttcattatactttaagttctggggtacttgtgcacaatgtgcaggtttgttacatatgtatatatgtgccatgttggtgtgctgcacccactaactcgtcatttacattaggtatttctcctaatgctatacctcccctctccacccaccccacaacaggcccagtgtgtgatgttccccaccctgtgtccaagtgttgtcattgttcaattcccacctatgagtgagaacatgcggtgtttggttttctgtctttgtgacagtttgcagagaatgatggtttccagcttcatccatgtccctacaaaggacatgaactcatcttttttatagctgcatagtactccatggtgtatatgtgccacattgtcttaatccagtctctcattgatggacatttgggttggttccagttctttgctatcgtgaatagtgccgcagtaaacatacgtgtgcatgtgtctttatagcagcatgatttataatcctttggctatatacccagtaatgggatggctgggtcaaatggtatttctacttctagatccttggggaatcgccacgctgtcttccacaatgtttgaactagtttacagccccaccaacagtgtaaaagtgttcctatttctccacatcctctccagcacctgttgtttcctgactttttaatgattgccattctaactggtgtgagatgggatctcattgtgatttggatttgcatttctctgatggccagtaatgatgagcattttttcatgtgttgttggctgcataaatgtcttcttttgagaagtgtctgttcatgtcctttgcccactttttgatggggttgattttttcttgtaaatttgtttaagttctttgtagattctcgatattagccctttgtcagatgggtagactgcaaaaattttctcccattctgtaggtcgcctgttcactctaatggtggtttcttttgctctacagctctttagtttagttagatcccatttgtctattttggcttttgttcccattgcttttggtgttttagtcatgaagtccttgcccatgcctatgtcctgaatggtactgcctagattttcttccaggatttttatggttttaggtctaacatttaagtctttaatccatcttgaatttttatactgatctttgacaaacctgatacaaacaagaaatggggaaaggattccctatttaataaatggtgctgggaaaactggctagccatatgtggaaagctgaaactggataatgggataagatttctaaaccctgctatgtgcttcaaagtcatcctctccttcctcagcctctttttcatcatccttgatcagctccagctggccatcccccaatcttcattgtcatcatccagtaggtccccctcctcagcagagtcatgtgcatccccctcctcagcagggtcatctgcaccgccctcagactccaacttcacattagtctcatctttcttcacggagctgctgctctgctcctcttctgacttattattcatatctactgcttgtttgttctgttccttttcaatttcttccaggtttcccaggagagaatccactttttgttttatcttggtcaactccttcttaattgcctgaagagtcatctgctttcaactttccagacttagaagatccccgctgcccattcttagaattgaagccagctttttcccttcgtgagttgtttcctgatacacactgacgtttcgagggcactacagcccgagcaataggaggaggaggaggaggtacacgtgctgggtgactgtacatcctatcataataatcccactgaaagtcatagtctaagtcgaaagaagagccatacatctgtgctgcagatcgtttcacacctgcttttcctcggttcacttttggcactggagccaggttaatatctaaaacctggtcagcaatcattctgccatcctctcctgctacagcagcccgggcatttctctcattaacatactgaaagaaggcaaagccgttatgaacagaggagtccacaattttgccatacttcgaaaagattgcctccacatcagatttcttgaccacaagagtgttgagattcccagtgaacacacgggagttcatggagcgaggatctgtcttgttggtaacgttgctagccattgtgtttgatgataaggtttctcacacagctgaaaatgtggctgaagatcaaaaaaaatcccataggagtgaggagggagaagagattcgattctgagtctcctactcctgggttctacgtggagaacctgactgctgctcgaggtgggtaatgcagccacaactgctcagtctttttctcttcacaaaaagaaaatttgccttcttttcacacgtcatggaactatacaaaattttatcatttattatgtcacaaaaaattagtatatattaaaatgcaaaactcataaaggcaaaattctctgaacacagtaatttaaagctagaaactaaaactagctttaaactaatgttttggaataaaactaaatacatcctagcctttcaaaaaattgcataaaaaggaaataaaattaaacacttagtcataaaataggaatgtaatatattatatttatgggacactttcaaacatatttagagactaattaatagacttaaggcactatggttatttctaaaagaatgaaaataaggtgagtctatatatcaagatattagaaaaaatgcaatcagaataaaaataaaacagaaagaatgaaacactaaaaagaaaattagaaaattacttagagcacaaaaaactggtaagaaatagaacacttggttcttaaaatagaaaatgaaatcgataaacttctcacagatctaatgaagacaaaaataatatatactttgcgactaaggaaaataatataaccacaaatacaaagaaagtattttaaaatggtaagggaattatatatatgttactctggattacctataaacataaactaggaactataaaacataaggaggatactatgtcacaaaagcaaagaacacggtttggatgcaagctatactgtgtactagttatagataagttactcaactgctttgagccacgttttgtctgtaaaaaaagaatttaaaatatctttaataatagtgttttcagaagtattgcttatgtcattgtcatctttgttgtaattctcttttcttcctcctcattattaatattcactacctttgaggaaaacttgatatgtacccgaacaagttgaaacttaaaagttatttttccaatcaatactttaatccatccataagaaccaggtgcaatgcataccatttaccttattacttattttttccccaaatgcaagtattagcaacattcactgcatctgagaatataaaaccttaatgacatatcctccaagggaaaaaaatcttacccaacttagaagacctgcaaggattgattgcacttaatgaatgtagtgctcttagagttatataactgtcattaaacaaatacataggcatcaaatttaaagaaaaccaagaagcagagctaaacaacatcgatactaaaaaaatgaaaagttaggagtttttttctctcacttatcagtaaacctgaaggcttaatataagcctataagattctaaaaacaagaagggtgctttatttgtattagtccctaaaaatcttagaatgaggtaaaaataaaaaataaaaaacagtaacactggagctctcagatttatgtatgtccttaggctttttcttacagtttcaatgtggattattattgtcagagtaaagtgaaatgggaaagtaaaatgtaaaattcgatttgcaacccctaacattttcttattttagacctaaataacagttattaccaacttaaaatttgtgtaacagaatctatccagggaaagaaaaacaagtcattttggtgcacaattgcaaaatgccaaaaaattaataactttgtctacttatctccttgtattaagattttgacccattttgaattaatataaatatttagagcacaagataatagagattaaataaatacacaaacaaaatagttttctactctcaagaaacacacagaagacttcagcagaaaagaaaaaatcaattataaaactgtgtaatagaagtatattgtacctatatatctatgtactatatctcgataactattctaaataggatatcagagaatattctatataagatatcataggatagagatatatttaaaaatactagtaacttattgagcatcaaaatatagattgctaagtgcttcatttatattatttcatatcctcattaaattcttgcatgttaagaattattatgcccattttacaaacataaaattgaagtttatggagtttagattggtaaacaaataaagccaaaattaaggtacatttttgtagcttcgccactcatacccttttggccaccccactgttttcattaaattaagataatccgagaatttgtcaaatcgtgaggtgacaaaatatgtatatatacactgttctaagattctggatcttaccatgtcttcgtttcttcatctaaaagtggattataattaaactgtccccattaatttcagggggttgatgggaagatcaaatataatatatgagacagttattgaaaagttaaggcatttgtaaaatgagatgcaggattacagtaatgaagctcttcctcagcattagaaactaggccaagcaacccaagaaccaggagctagttacaggatgggaaatgtatctgacgcacattttacttatttaaaatatttaaacatgacaacctttgttaaacaacctcaaggtaaacggcaccaaaactgtgtttttgtatctaattactgctagagtaacaattaaaacacagaccaagtagaaaactgtgtgacttttttcctcagaattcagtcagcaaagactagaaatttgcataaatgcaggcccccaaagcaactttttgcctctgcagcacattcctgaagcccaaaagaaacgaataattgtctcgactcttcattgcatgttgtctatatagccaccatcgtactttaaatgtgcagaaaaaatagtgccagttgttagcagagaaaatcatctaagccatttgtaagcactctgttgtctctgttcctaccataaccctctccatactggcttaagtttcatgaacgtactccccttggaattctgtcctttctgcaaacactttttttccaagttttgttttaggctttcctaacatattttcaggtctctcagttaacataaattcaggtttctcaaaatgtctgcagagggactaaagttattccttccaaggtggaagtgcgttctgtcaaaataaatcaaacatcagtaagtagataaataaggaaagttagaaagtagaatattccattgattggcaaaataatcctcattcagctctattaatttattattttaaaaatcaccaccatatttacgtctgtgcaatattacatgtaattctgtctcaggaggattaggtgcatgcttagttgtgaatgaatgaccatggagaagcatttttaaattaaacgtattctataattgtagataaattttccattgtatctcgcaagaacacagatacatacactcatcataccatgatagcactgcatttatgtatatttgagtacatagggaatgctagcaaatttatttaacacagaggacaataaacaaatttcctcatattgatgcttcaattcagaatgcgcaatactgttgacatctggcctcaggctctgaccagaactgttaccataaagaagtgttgttggagtctgactttcctcgatgaaatgttagacactatagccaagtgcagcttcatatattaatagatgctaatggttgtaatttagaccaaaccactttgatacaatttgggaaatttagttcttctaaacaaatgatacaactttattgaaagacacaaaagatgtcagcatatatcatgttcttgtataggattacttaatataattaaaatgcctatcatcccaatttaatatatacagttaatgaaattttaattagaattgcaaaaaatgttggagaaaatcattctaaaattcactagaagaataacagtctggtaattgcagagatattctgtaaaagttggctaataagaaggttttgtctattcaaatattaaatcttacttaaacactatcttaattaaactagtatggtaaaagagtatatcagtggaacaaagattaaaaatagatttgaatatgtattagaactcagtatatgataaacataacattctactttagagtgcaaaagataatcaataaatgttttagatacacatgattatctatttgttagtacataaagttagagaccctcttgacattatattcaaaataaatttcaagtagcttagtggtctaaatgtacataagacaataaagattttcaaaaaaattttgaagttatttttataaacttgatggtgcagaagatcttctgaaacataatttaaatatcagaagccaaaaagaaataaaatttacatatttgaacataagaaagttaaaattttcaaacaaaaggcagcaaaaaacaagccaaaatacaaacaataaactggaagaaaatatttatcaaagttatagtagccaaaaggttcttaaatatgaagagttctgcaaactaaaaagtaaagaacatattagaaaatggtaatttaaaaaagcaaagaacatgaaaagaaatttggtagtaacggaattgcaaatcccaacctcagttataaggaagatacgtaaattaaaatatgaagactttttcatacaacagcaatactaaaagcatgttaatactatctagtgttctgagaaatgtgtagaaataacaactttcacagaattttgttgggaatatatattgttaaagctttattgaagggcaatctatgaaatattttaatatttaaaataagcatattctttcggccgggcgcggtagctcacacctataatcccagcactttaggaggccgaggcaggaggatcacaaggtcaggagatcgagaccatcctggctaacacggtgaaaccccatctctactaaaaacacaacaaattagccgggcgtggtggcgggcgcctgtagtcccagctactcaggaggctgaggcagaagaatggcgtgaactggggaggcagagcttacagtgagttgagatcatgccactgcactccagcctgggtgagagagcaagactctgtctcaaaaaaataaaaataaataaataaataaataaaataagcgtattctttcatcttacaatttcactcttacaaatttgttttactgaaatatttgcctatgagtacagagctgtaagtctaaggatgaccaatacaataccgtttctaataacaaaggattataaataatacaaatacttattaatagataaatggttgagcaaattacagtttgtccacattataaaataataggtgtcagtcgctaaaagaaagcagaactactgagttagacagaagctcattatatatttaaaagaagtgaaaagttgtaaagcagcatatacagtgtggtctctttttttttttttttttttttttttttttgctgaaagtgcatttagcaaagaactaagatataaaactgttaaatacacatatgatatacacatacatcagaaagaatttggcaataagttaacaccagcaatgtctggaggttgggttattcgattttttttgtttcccttttctttactctatccagaagcaggggctataattgtcacgggacccttgggatgtcgatttgccagccagaaacctctgtggcaggcagcgccttctgcctgagtattgctcgcgcccacagggctcgttccacccacttggcctggcaggctgcgcttggctcacactactggcctcgatctcacacctgccaagggggagccaggcacggagtggcaaagagtgtatgagcgaatgagcatggggtccagccactgtgcacagccacgcatgctagctgctgtggcaaggcagacagctccaggcaccagcacaagtgccagcttcatgcaaggctgtggctggaccaaatgtaccacacatggcttcagctataggcacctgcatctggataaggggaacacagtggcactgggaagcttggagacaccaggaaccaaagagccccaaagagggtgtcacagccctggcttggggagcccctaggtctgggatccctgaagggctgcagctcttctctccttctcatcacccataatgtggtaagcgggggaggggggtgtttcagccctgtttgtgttgcagctctttcagtcccaccatttggcaggtcctaagttcttgtccacatccaggtagaatgaggtacatggataatttgagggtgaccaaggcggagaggagacagaacagcttcatcaagaggcagaagagccgaagtgggtagctcctttctgcaggcaggttgtcctgagaagtatccagctgtcaatgaagagggatctgcagtgggtggctcctttctgcaggcaggttgtcctgacaagacaacagcaaccgaattgggtagttctttcccacagctcatctccaaggtctctgtgagtctggctgagtctggggttttcatgggcttcagatgggaggaagtgtgtgcggattggtccatgggcagccaagagtaggtcgggaaaaagcaccataagttctcactgtaagccacggactctatgcacagttgacagcctggcccccatgcttcaggccgttcttggcttgaaggtgaggcttcaccgggaacctacccctttctgcccaggagcctgtctgcttcctgccaccattgatcatgtcgtccacagagcctgcaggcccacatcgagctgcctcagtgccccctcagcctccctcccatgctcacgggcacccaaagtccagagggggggctgagggggcagagggctggcctgtcagccctgccgtaagtgcatgcagctgggtcgcgacagtgcctaggctcagcctcaactttgctctaaaatcagagtggacaccgggaacagggagaggccagacagtgggggcaggcacttctgagcctgtgggggccagggctggagagggacacttcccagcccctgaaagcacagggaaatccaggtcactgctgggtggctgcacagttgcacccaggagggggaggcccccacccctccaactctgaaaagggctgggctcctgcctgttcctggctccaactggctctgtggagcgcgcagccccagctgtgcctaccccgctgcagttggcgtcttctcagtggccgctccacacaggctgcagctgccctcataatgtaatatgaaagtatcaatatttatccttttaacttatgaaggggaagcaaatacattagtatttgctaaaagctttcaaaattcttggggtggggatggtatatgaaagcacaaagcagttagttgcaataagttctgatttattagagaaataaacatttactaggcaaagaaccttagaataactggaattcatcaagttaccactcttttttttttttgaaaagaccaaacaattttggaataactccacatagatgaaacaacgtaaactgccatggctaaagccagaactcttgtaatgtctgttaaagtgacaggtaatttgaaagctgaatgaaccagtgcccattcactgatgtaggtgacaatacaggactctccatgtgtccacatgtcttcactgatgattaggaggtacaacatggagaagagtgttccaacccctaaggtgttatctgggtgctaagataacagttgtctattaaaatcattagggaaatttttaaacaaaataaagttgcctaaatatataattgagaattctcagtgctagcaaatatcagaaaagagagtaaagctatcagtatcaggcccctccaatgtgtggggaacagtgcaggtgacatagactgttaaaccaagtttagcctaaagctgcctccttacctatcttaaattcagcccaaagatttttctgtacattatgaactataacaagtggagctgtaaacagaccatagcctacacttctgccaatcactgagttttggccaattaaatgtagccaactctgaactgaaagtctcctttactccttcaagtgattctcctgcctcagcctcccatgtaggtgggcttacaggcctgtgcccctatgactggcttgtgtgtgtgtgtgtatgtgtgtatttttagtagagatgtggtttcaccatgttaaccaggctggtcttgaattcctgacctcaaataaggcaaagagcgagctgtaaccaatccagttgtttctgtacctcacttctgttttatatatgtcactttccttcttctgtccataaatcttcttccaccaattgactgcactggagtctaccctagcggggaaggctgcccacttcgcaaatacttcattgctcaattaaactcctttaaatttaattcagctaaagttttacttttgtcaatatttatcttttcagttgatcctttttaaagatgcactcatgggtgactcagagaggttaaaaggttttgttttgtgggttttggttgttgcttcacataggttcgctaagtcagtaaatggagtatattgaatttccactgactattgactcttttatccagctgactcactaatttcttagagtattactttgctcttcttggaattgctttttctatagtgtcacctacatataatgctaaattttctactgttttattaaaaagttatactgcttatgctattatgtcttgcattattagaatcttcaaaacagtaagagtacaagcagtgatcaaattatgttttctgattttgttattcatgctttaaaagttgtactgttattgtttactgttgcattcaagtaaatagcctttatcataggaagaaagttccctttactcctattttacaataaattaaaaaaattggaaatcgctgccaactttcgtcaaatgttttatctttataatccatatgtaatcatgaaatttttggtattatttatactttaaaatgtacttggtgactttattttctcttacattaatcccacctcatattgatacttaatttccctctagtgtcttttgattcattttattgttccttttttattttcttcagtttaagacaattttattttcgatttttatttttgataataaaagcattacatctgcaatttcctctgaatgaacttttagctgtacccataagtttcttttttaaaatcttttaaattttattttattttagattcaggaagtacatgtgcaggtttgttacatgagtatatcgcataagtttctagatgaaatgttctattttatattgatttcagagtaatctatgatttcagcttttttttatatataggttctattttaaaaagaagtgtcatttcattttcaatggctaaggctttttgtttctttggggctcttcattattttgttttgttttgcttctgtgagtttttcctttgaccttgaaatcaaattaaccagatagtaatagtccattctcttctttcaattagtttgctatttcctgatatgttattcacctacacttttgtttaaaaataatctgtcattggttttaggtatatttatttctaagcagtgtacagctgatatttatttttagactaatttgagagcctatctttttataatagtcatcccactcatattaattttgacaacatatatgatggttttatttttctcatactatacttacttttatatgtttggtttggtcctttcttttttctacttctttgcttttgttatattcttcttaaatattactttccttcttcataatagtgtaggaatcccaccacatatctcaattaactgtagaccatctttcctttttttaataatcatatttaaatcagtggtcttcaaaaattaaataagaccacactcctctatcaactgtttactattatttcactccctttacaatccaatgtttgtttcactaaaataatgtagaattggagtctctgtgttaacttccgagagctacttgaagcaaaccttgtagtcataaatatttatttatttattttgagatggagacttgctttgtcacctgagtggagtgcagtagcagtatcttggctcactgaagcctcagcctcctgggttcaagcaattctcctgccttagcttcctgagaggctggggctacaagtgtgtaccctgacaactggcttttttttttttttttttttttttttgtattttcagtagaggtggtgtttcactatgttggccacggctggtcttgaacacctaacctaaagtgatctgcccaccccagtctcccaaagtgctgggattataggcatgaaccaccatgcctgaccaccatacatatttcaaaaaataaaatgcaatttctgtaacttccctcaagtttatcaatgttgaagtagagcttttcataccatatttattcattattgtcccaacaataatccaggtgattgtacagaagaatctttcaatttcattttaaagttttcaatccatcagttgttttctttcaaacattgattgccttccatgttttatgaagttgaatatttacccttgcctatccagagagaagcattataaacagtttttacaaatgagtgtcctatcctccaaattataagttctaaaaaatgaaaattcatttgaaatatcctgtttgagaatgaatatatggcaaataacaatgtaattttaaagcaatctttaatgagtctctattggatggtcaggtaatatattaatcagtgtagcaggatctattttttcctctttgtaatttgataagtgaaaggtggtctgctctaaagtacaaatatatttttacaaaggcatgaaattctaatactcatttcgtcagaatcattattattggttatccattcagtgataagaagtaaattatagcctatcacttctagtttttaccacctaattggataggtttaaaagtgtgtttagagaaaacaaagaaaaaaaagaaaaactggatgaagactacacaatgtgcaacttactaagtgaaagtcagaggaaggaagcctctgttaatgaactgtaccaagaaatgacttggattcagagagcaatggtagagatgcctcaaaagcctactcttgttcaaactccttacaggctatttctaatgcattaaaagcatctgttaccacatgtcctaccaaacatgccaataagtgagacaagaaaacgtcctaaactttatacattgcatgccaagtgaaaagcaaatcatactcagtcttgcaaaatgcaaagccaacaaaatgaatgaaatattatttatatgtgctttggtgcaaaaagttcccaacagataaaaaaataactgttttttgtctgtggttctgaactgtgaataagattataaaataaagagttgaagctagtaattttattactataaaaatccagcttatttaaatattaatcttttcaaatgaggaaggcaagcattccattaaaagatgttatttgaagactgtgctcaaactatagagaatatcccctggaaattattcctagtcagggacttgtgccccagaaataaaggctagcatgtgctccttactgcatttcaaacaatatatcctagcaaaaaaaaaaaaaaaaaaaaaattcatacaagcatctggtaaggataaaaaaatagaaagcaacttcataaaaatttgaacttaatttcaaaaagattttatatggttcaagcaaggcattttgagatttatctcatcgccaactggcaatagtattgcttgtatttttgtgctgtcctcaaacccagtggcaaatggaaagtcaccctttgagggattcacagcacagtagagtagaaaagtcctccagtgagctctactcagattcataattgtttgaccttggcaatgtcatttaatcactctgagttccagttcttaaatatctaatacacaaatagaggggaaaactatttgaaatattttgcttgaaggatgaatacatggcaaataagaatgtaagtttaaagcaatcctccatgattatctgatattcagatgatgtattaattccactggaatattatgatctatttttttcttctttatcgttagatatgtgaaagaatttttgttaaaaaaaataaaactttttgcagtggcgtacaattggaatactaatttcatgagagatttggtctttacaggtattagcctaattgatgtgaaggactttgggggttcactgttctttctccaggaaaatgcaagaaccatggggtccagctagtattgtcctgagatatattagatttttttttttttttttgagatggagtcttactctgttacccaggctagagtgcagtggcgcaatttcggctcactgcaagctccacctcccaggttcacgccattctcctgcctcagcctcccgagtagctgggaccacaggcgcctgccaccatgcccggctaatttttttgtatttttagtagagacggagtttcaccatgttagccgggatggtctctctcctgacctcgtgatccgcctgcctcggcctccaaagtgctgggattacaagcttgagccacagcatctggcctagatgttcttggttgtaggcgtagagctggaaatgatatccaaagcaaaatcttctacagttttcagatcctatgtcagcatagagcctgactaccaaataaaaatagagtcaatgagaatggtaagccaacgtgaagtaacaggagaaataagagtcaaagtatgccaaggagaaagaagtcgaggctggacagaattccttttttctccagcataagaactgagagtagtttttcaggaaaacttcagagtctaggcttgagcaagcagggaaacaatgaataaaaagacattaatatcttttctgagcatcctcacattctgtaccctatgcttcccctttgctgagactctagtttcagggcgatcctgtggtaaccttttgcccttacagtgcatggaggagtaatgtactcccatttcccagctatatcagaaataccaattttggtatccttgatgattctttttctgattatccattcattttcctgagtttcctgcttattatcattgggattctacatctattgaagcatctgcatttgaattaaggtaaaattctgggccatacgccaaaatctcaacctcaatgcaccagccactagataaataataacagaaggcactcttttgatatgatattttctttttatgtccctcacaaaatacagaggtcagtttgtaatattggaatttctatttcttcctgtaatcttgtccctgtggctttatctggtgtttcagccaatggccagcagtcagacaatcttttgacctaatctgtctagaatacttggccagcctgagtgatgttatttctatcaggttgaactcttacaaatgtgttcagattgaaacagcagatagaagatggaaatgggaaacttaacactcaccccttgaaatagcactatttcttgaaaaatggcactgtatttatgtgtttcacactgttataaagaatacctgagactaggtaatttagaaacaaaagaggtttaattgattcacagttccacatggctgaagaggcttcaggaaacttacaatcatggcagaaggtgaagggaaagcaaggcacgtcttacatggcggcaggcgagaggtgagagagaaggaaaaactcccacttttaaaaccatcagatctcatgacaactcccttgctatcatgaaaccacccccatgatccagtcaccttccaccaagtccctcttttgacacgtgggtattacggttcacaatgagattttgatgggatacagagccaaatcgtatcagatacaaactaaccagcccacccaaatactatctttagtaatttacatagattatctctagaaaattagtgaagacctgcaaatcccaaaatgatcaccatcatagaaactttggctgggcccgatgaggctactgcctttgttagctttgattaagctaaaaagaaacatgcttatcttgagttatgataacccccacccatccgtcatgcatatttggcttctgaatatgtttatttctaaatatgtgtgcagttaactatcttaaagcaggcttctcactctacttcagctttttcttgcttttgttgagaataaaaaaggtttcaaaataaaaagttaggtgcatagagcatgggtttaaatactatttctgtcattttctatttgtatacctgaagcaaattacttagtcttagcttccttatgcataaaatggaagaaaagcatagtgcctatctcaaaatgttatccctctgcctggaattttcttttccctgatatccacaagaatactctcttaccttcttcaggtttttgttgaaatgttaccttatgagaggcttttgattgattataccacttaaaattacctttccaagcacttcagatctctccctctttatttttctctttagcagtcacactacatattttctttatttgttttttgtttttccttctccccatctcccacccccactagaatgtaggcgggatttcatctgtctgttcactgccacatcttcaacattggattatgcctaacacgtggtctcaataaagagaagtacttaacatactatgtagcacagtgaatcaaatagaaactattgataattttaaaattatattatttcatcaagtaagactacatgtagaaataaaatgtttctatagagtccaatcatatagcataaacagagaaaaacaaatgcctataataaccagtaacaactttagttctataaatattaccatgcatttattattcattcattcatttattcaaagagtatgttatgcctactctgtgtacagcacaatatctttctttcttaaaaatttgttgaagtagcattctttgatctttacatggcttatataaaacagcagttctattttggcttgattttctgttctgactatctacaacagggatcagcaatctattaaaaggatgtatcaaggcacttcattttctggggaggagggagtgctgatcagttacaagtactgacatagcttgagagaaagactgcaataatgtaaactccacaaggatttttctctgtttgttctcagaagtacccccaggacttagattagtctgtggaatgtgataaacactcaataatttcttaatatattaatggctgaaggcacgtggtgcagcctgccagctcctctgaaggctgttggcatcactttacagctaggagaaaagatttgtggtacaatccatcaactcacctgagcaatagttttactatgcatccacatgttttcaactcctggtctttgccaccctgagttcactagataagcaattatatgtcccaaaacatcatatcgtcacagtctccagaatcttgatgtggtggaaaatgtataggctttgtagttaggcagacttggatttgaatcctggctccatcacttatttggctaccagcaaaacttcaaatttctctgagactaagtttcttcctttataagttgaggattataatgcctaacttaaagggttctaggtattaaataatggtatgaaaactgacttaaatttaatggagtagacattgttgaatgccatagcagtatttcagaaaagatatataaatatgagcatatcctcaggagagtataatgacagcaaagaattgttagtattaggcattattattacaaatattatctgaacactgcatctagaaaaaattaacctgagtgttatcttaaaacgtaaaccctctctttatagttaaagttaaaatgtggtgggtttttttgcacttacttgaagttcatctattccttacaaaagcagaaaagcagtttagaaaagtaactttaattcagttcaaagaatatgagaatcttaaaattaacctaaatgtaggggtgggaagagacagtttctaaaataagacacatttaccttattttttattacagattgtacatctctgtatgaatacataatagatcttaaaatatcaaacaataatatgggtcatgtctgagtatgtggcatattggaaataatctggttaatgagtcaacccaggttctcagacagcaaacatacatgaaacaaaacctctgagctctgatttaaacccctccaaataggaatctgggtccccttacttgcctgtgaaagataaaaccaatgcatgtaaatattttgtgtagagcctgcatatgaatgacaaggaagtcaactcaaggacatgaatggttcatggggtatgatgattctagacctcatgattcagttcacattagaggagaataaagatctctctttctcacaaaaatcagaagtgatacatattgatcactcagaaagctacagatataatggatcttgtctttttctgaagttccttgagataatttttgtgaagtcacttaatcccattttttttcacagaaggaatacaacaacgttttgacagaaaaaaagttttacttaaatagcataatagtaattgctgacaattcatctctgaactaagtacctgcacccacacagatcatttctttcaagcctcacaacaaccttgtgagaaatactccgtttaaagatggggctactgaggttactgagatatttacacagaagtgacaattaggattcacatgtctttctccatatcgtgcttccacttatggatcattcttgcattatatcccgcctccaactaaaaaaattcaacaaattattgcttgaggacagtgttactttcaagtgttcctttaatcaacttaaaatagttttctaatacatcaagagggatgtcttcatgaagtaaaaatttaaagaaaacaaccatgtgaagaatttctataaagtggccactgatgtccaataagttccaggttgaatgaaggctgtagcatctgcctggacaatgtacaattaaattagacaccacatatggttagaagacaaaattatggtccagtgtgttctgtaagttcaaacatcagagctttccaatgatacaatttttaaaatacctttttttctcagtatacctggaactcctggagattatatgaaatttgacaatatttgttacttccataaaattactgtaaaaaataagaataggtatatatttacataacgttttccccttttgtctgctttgtcattcttttaaaatcacttctaaagagattttaaattacatagtcattttagattctagtaagtagtcagacattgtttatcctaaatttttggaattgctgctttgcctccagtcagcttttggtttattcacacaaaggaccttagtaagaggaatttttcttcctgtaattggtcctactccccctccaactttagagacattcagtctctaaacaagttctacccaaatgtcataattccccaaagtttgccgtctctcaaaattcacccacgatatcttatatccagtctaggtagttgatcagtacacgccaaatgctgaaatacttcttcactagtgatatccaaatgtgaggcaatatagcatagttattatgaacaaggtctcaggctttcatttcttttcctaccattccctagttgtataagcttaagtaggttacttggcatttctgagccatggtttcctcatctgtacaaggaggatattaataacacctatctcatagttatatatgttaaataagtcatatacataataaagtcctaagcatggtttctgcaaaacagtactatattaatgttaaccatgatgttggggacaatgtttgaattagcacgagaaacaggttacctaagagaaagttcaaaaatggataaaaaaaaagtacaaatttgtgggcctcctcatcaccttactctctcattttattgatacactataagccccttgatggtatatatcacttcttatttgactttgtatctttaatatctagcacagtgtctgcaacttggtaagactctttaaattttggttgaatgaatgaatttccatagatactgtctaattcacattggcagtccttagtaattcacaacataagaactatacctttgtgaattctctcctttggaagatggagagaacaccatctgggggagagcctaacaaaggggagaagcaggtgaatccggattccatagcaaaatcgtgctatagatcccaaattcaaaaatgctctgtaacttattcaatgtgcactttccgagacagttccacaaaagatcataaattataaccctattgtagattaattctcaaaccctgggttgcattttcccctttaaacctaccaaggatgaaaagaattgctgaattctcctggaaaagtcaatgttaatataatttttaaccacttcttgtagcatgctcaatcaattcaaaacacaacgaagtaatccaaacaaatgcacatgactcaaaagcaacacaaatacttctttagttacccactgtaccgtgtaatgttatgttatgcttaccacaaaactgaaatacaagtcacatttgactatgtaaagataaaactagaatatctactcatggcatgatgataattctgcaacaaaatgaatgatcttgccaaaataccatttcagccagtgaccagagagtgaggttttctgtggaggaaaattttataatatgagtagcaactaacagatacttccagctataaggtttattcaacacatcccacaattactgctctgccttgtgaacttttataacctcactctgttacagacaccatcaatcttgtaactgataaatgtttagaagcaaacagcaaacatatggcctttctctctcagaaagtatagaagtactactgccagaagttgtatttacctatgttgatttgtttaatcctcatttttcattcttgattggatcattccttttagcatagaaattcaccaagaggaatgtataaagttctaaatacagcaactaaaacctagttagtaccataaagtaggaactagtattattcctattttatagatgaggaaactaagagaaaaacgattttttaaaaaattacacaccactttccagttagtaataggtggagctggtttgtgttcttaactattacattatattgcctctcaacttcatgacatacagtttggggtctttagggaataggcagggggaacaggggtccaattatgcaagaaattctggatccctaatttcatttttctttcaccagtatttcttaattgcttctaattaatattaccttgccaaaacgaaatatatctttacgaagaacttggagggtttaaatagccttcatgggtataatagcagtgcagtagcagtgatactataagatataaaaagagacagactcctttgggatgtggcaactgattagattttattgacactggtgagaagatacttatgaaaataagtgcctctttattgctggattttatattccaagtttctgcttcatcagcctatctgattcactgtcactaaagcaatatatcaagcatggtactttgactcttaaccttattttactcatctaaaaatacaaaggaaaaggcatgtcaatttcatagagttgttgtgaggattaaacagggcatcagagagatttgagcaggggagtggcataaaaaaggctttgtattttaaaagctcactatgggcttccacatagaaaatgttttagagagggataatacaggaaatgaagtcagatttggaaatacatggtttcaataagagatgatgctgattttgcagtacagtagtggtgattaagctggggtaaaatcaatggatattcagctgtacatttggatgcaaaaccaatgacatttagagataaactgagtacaaggagttagcgatagggaagagaaaggaagaactctctgtttttgacataagcatctgagtaaatggaggtaccattcactaacatggacaaaaatcaaagatgagcagctctctatgagcagaagcaaagcaggggcacacagagtggtataatgaacatcggagagtcagaagtgaggcagatgggaggggagaaatgaaaaattacctattgggtacaacgtacactattccagtgacaggtatactaaaagcccacacttcaccactctacaattcatccatgtaaccaaaatcacttttacccctaaatctatcaaaattggaaaaaaaataagttgggttaaaaaaggaatgcaattggagacacattagctttgagacaaccaagaggtgatgtcaagtaagacaatacatgaataggtttgaagcgcaaaagagatctatatgtcagctagatgtatacgtttgagaattgttggcatattcatagcactgaaaactataaaaataaataaggtatccaaaggcacagcttgaaatgagaaaacaggatgaagccctgggaacttcaaacttagttgttgttttaaaagttgctaatatttattcagaatttacttggtactaggcactacactaagtgtttttacatagattatcttaattcttgcaacatccaattttccattttagtgaaaactaagatttaaaatgggttaattaatctgcttaagatcacatggctagtaaatggaagaaaaggactttgctctctgacaaatgacctagtctaacagagtggaagttgacaaaggattaaataaggcatgtgaatctctaagaagaatgcttgacacaaaaaggtacttacaagtagtagctattgttattttcttaataaataagttggggagtaaataaagttagtggattgcccacactctcataagaaatctgtcatgtatgatatatttaaatacctttctgtatataaaggttttaccactccaattagattgccaaacaatttaaagataagctcaaagtcaattaaaattcatatgcttcaaataaaaatgtggtaaggtatttatggaagatattttagaaaataaaggaggaaaataaccaatcagagtctcactgcaaaattatatttttgtatctactgttgatagtacattttttctggttttcatattttgaacttctctatagaataatttgaaccatttcaggcatataattttatattttatttttaaaacctgacattacatcgtcagcctttgctatcttattatagtctttgcaacaacataatgactgccatccctacactaatagattttctagttcatgtaataattcctgtcttattgaacatttaggttatcacaattataggaccttacacaaagttctgttataaataactttattccccagccctttgtacttaaaattatttactgaagagagagttcccaagctgaaattactaggtcaaagatttctaatttgtaccagaatcttaatgtatcaaattttatactgagcttatttttattctccatagtacctaacataatgctgcacacagagtaggtattttataaatacatattgtttaaataaataataaaatagatgagaaagcttcaccaaaccattattatcacatagacttaacctatcattacattaaataaaattaacaaggaagccagcatcattataaatacataacaacagaagatcaacaaaaatatactttaaaagtaaaaggcactgtatgcatgcaaaatgcattatttaaatacatggatctctaatttccaatttagagaattttagcttaaaaagcaaatttacagacttccttagaattccttgccaacaacaaaaacaaacagaagaaatgacagaaaaattgtttttaatgaaatactttaaaataacttttaaaatctaactttctattagctctatttttaatagaaaattacatataaagtagtgattcaatacacaatgaaaatgaatattcagcttacccaaatatgtgctcaatcttttctctccctaatcctcataaccctattgccctgccaccagttccacactgtcataaaccaattttatatatacttattggtatgtaaggttgtaatctcaaattcaaagttcaataagacatttatatatacagaataactttaataaacactggccatattccaggcattctactaggaactaccctaaactatttacaagtttctgaatggcccctgatctttctcttctggacctccatgcacatgctgttactttgccccattcatcttgtttcacttagtaacttctttattttatttcaagtttccattagctataacctctactacagagtttccttttgtgctccaagaatgtgttagatgctgctcctgttgtgctactataagcctgtgcttatttcttatcatattatatcataattgcctattaactttttgtctcctccactatactatcactgcctagaggataaatgatttacctttcctataaattaagaggattcaagttacccttattacgtacactcttttgagtgtgttgtgtgtttataaatgttaactgtcttgagactagatggtatatatggcccaatttcataattataattggctctctagttttccatgcattatattcattcctctgattaactgaaaactttcaggggtcagggttttttgccttaaccttctcacgcaacctccagagtgttattacaaaatagtcattagttaactgttaatgagtagttactttggatacaatcatgatctaatataactaccactggagcccaggtcaggggcagttttaaatcactgcttaaacttgcctatatgaaccagggatttgacacaacgtaatctgtgtaacccatcagaaaagcaatttcttaacattttccagggagccaacaaacactcatattccaaattctcatttctcagaatctcttcaaaaataatttaaaagtcagagactactattttcatgaaaatgtttataggagtttcattttctctttaaaaatagatgaagcttaagtaaatgggaaataagttatctccacctgaaaaatttttcctcctatggcaggatactgatataacttctggcctttctctgcccgttaattcattttgcttttcatgagagctggaaataggaaagtaggatgaattatttgactgtcatttttggcaaaatataaaccaggcatgtgtcgcccacctgcacccttcttcctcttgggaacaagtaagccaaatggagcagctggtctccagtgctctccaagggtctgatcttcctcactgttgagagcaggcctagttcattactggttgcaattgagaaaaggggagggtggagaggtagtctgcctatgtccaaggtttagttagcagaccgatttggctttcataataagctatatgttccaacctaggcttaatgagtaatataggtaatattttggctccatctgccactcagttgttttattctcaagttattcaaagcctaggcagagaagaggaatggcttccctaagaaaccaacagatgggaatatgcaaaagtgaaaatagcttgcttttgtggtagttaaactataagtgattcttcctttctgttttcctaaattttcattactgtaatacaatatcttcattaaaagagagaggttgtaggagggctaaacaacaacaaaagacaaaataaacaaaaaaaatgtccttactaatattaggttaatcttttattattgcacctgcttgaaaataattaaactggatttcaaaagtaaaacaaaatattttaaaagaccaagttttcaacataaaataaaagtaaaaaacatatgcctacttgtaaagttcaagtgcatgagcttaggtgctgtaatttgaatagtctgagttttacagaagggaagaggaaatatgatgactcttttcaactattctagaaggcaaggcattttggaagagaagaataacttctctagcgatgtctgttattctctacaggattttaaacatcattatcactagttggcagaggaaggatccaatatgtcactgaaaaatacgtctctaaacgaatcaaatgatgccagtgaaaagcttcatctaaaactaggcctacaattttgcttctttgagtctcaggtttagtaggaagcaccaaactgcaacctcaaaactctgacagcaaccctgcttcctccatattattagctcccataaaccccctttctatttcttggaaacttgattgcttcagttcaaaggatcccgaacagaatttgcaaaagcgcaacctaattccctctatgataaagaaaataatttagtttctatctgagagctgtgttatctaccacagggcaggagctttgggtggagatccctcagcagtatatcaacagctaccacacagtactccttacttactaaatctcagcaatcttagtttgtattctgatacaggaagaaatacagttagataaatttgagcatagaaatggaattatgaggataggctagaaacttttcagatgaggcaaataattaaattaccttgaccagtgaagcaaaaccaattcattatgaaaatatatcataccctgattactgaattttatgtttttatctttctgcttcatttatctagtagactattcctaatgtaatccaccaggagggcactttgactccaaacatcagtttcataatctgtaaaatggggataatatttcagagtgaagcttaaactaggcaattattttagcaaagcctgttaccttcaacactaatttcacagaaggccaaaaatgacccttatttttcacaattgataggtgtctgtctttctgatcatcggattaacataaattacttccttaaatttcatgcagcctaactattgccaacttgcatttcaaacccctttgaatcctaactctttcttctgctccatcctgtatatgtaatacccaaacttgcacgtcatctccttttcttgaagagtcacaatgcgtcttggcatattagatgcactgagatgctctgcagtaaagagatatgttctttttatttgtttgtttgttgacaatttctaaaaagctttattttaatatttccttggctacttttccatagaacacagtgggaaataagatgctaaaatatagagatagttatctcttagtggcacaaatgtaggtgagttctattttcttctttcttcttctacacaatttccctccaaatctgaaatttccttattttatgatcagggaaattattcttcttataaacagcctagtgacactaagactatatttaccaagtgcttgctgttcctagattgttgtccctcgattttagtgcatatcttaatttcctcattaagtaccttgggcatttcattagtagagtgggcaaatcattaccataatacttctcatggcaaacattttgaaatctaaatacaatgaaatgctagcaaataagacaagaacatttcaattttaagactcctttaaaaattgaaatccaagagttcatatgtagagtcattgtactaaacaatgatcaatttgaccttttcaggttgaggcattctaattcagacttcatagcttttggagtgagaaggtttagcctcaatgaacatgtgggccatttcttagctgtgttatctagaatataatgtattacataatctccctgagtatctgttttctcatctgcaagatgggaacaaagtcactcatacctctgggctattaaaataactgggacaaatctctgtcaaagtacttggtaaatgaaaatataaaattatacagaaattattttaaaataaataaaaagtatcatttttaaaattcaagtaggaaaaaaactaaataaaaaatgaatgtctcatggtagtgctcacatttcttaaggacatatcctaaatacagttttgcaaaaaatcaccagtaaatgtcaaatagacatttcttctctaactaaaagacattctgatcattagtaggtaaaaatacaattctcactaagtgagagttttacctgttatctccacgagaattctactcctgttgcctgagagatcccttttctagctttcattcatagtaagtaaaatgtgcaaaagttgccttcctaatagtctactaatttattttactaaagataattttctcagctttgatagtatcttgttttatagagcaatacctttttttgaccttcaatacatgacacaaagcaattatttcatgatttttaaatataaaagcacctactgtcaaactgtcagactaaaaatgactagatttcaagattaatgaatgttaacaagaaaactaaccatctttctcctgttaattgtccttctatgcaatattagtttttgttataacatgtcaaaccacaggcttaaatcgcttagaaatggatatattccatatgcaacacaagaagtcctcaggaagtctatcaaattaaagacaggatggggaataaaagatcacttactatcgtggtactctacagccatgattaagataaggctgaccagagagagaccttaacaggaccccttgggaatctgcaatcatacattgtcttttccacctgtggagtccagagaaatgtgagaaataacctttagacttctttatattgattatgtatccattttaaaaccactggacactatcaattggacactatcaatttttaaaacattatcctattatttagttgagcgattcaatatctgtggcttcagttttgtcatctgtaaaaatagagtcgggacaatgtaaattagggtccatcaaaacaatgggattttgtgaagtcattaaaataataaatgtgaatacttcaacagaatagaaagcagatttttatgggagaaaatcaagattaaaaaattacttgcatacttaaattaaaactatgcataaatgcattaacatgaacaacaatctgagaacatggagaaatgaataatgtgttcttacgctctttgttatttttatattgcctaaagttcttccctttagccagcaaagttaaataaaggggttaagctactttgattagcattaaaattcaataaccctatacctccatgatatgaatacatatggttgctttgttcttcaagtactttgtatacattcgtcattctctatgagtatattgtgagattcctaaagaagaaaaccatgagttttaccctttcaatctgctgcacataaaaactcagcacgtatgtcaaagttcatagacttagggattcaggacttgcaaaatccatcctatagtgagttaaattatttccagtctcgtggtaccaattatatcgtatatcagaactcagctcataagcccccttggcaaaaggaattagtagattttaggagtatttaaaaaatttgtatcttcctaaatagactatttccgtgagggtaaagatctatctgctgtgttggtcatcctatctctagcacctagcactatgtctgcaatatggaagactggccacaagtatttgctatatcattagataaaaattcctcaatctgaacattattgacattttattttttgttggaggggctgtacactgtaggatgtttagcagaatctctggcctctacacactagatgccagtaattatctgcactaggttctcaataaacatgtgataatagctgaaattgctcaaaattatttttagttgtagtacataattggtagcagaaatgctgctgatactttctcatggcacagaatgttaggaaatataaaccgggacgtaagtgaatattctttacaagaactattaccatcagtaatgtaagaatctaccaaacacccagagtttaaagagttctaggaaagctttccagcatataaagagatgtaaggtttataaccaaaacttagggggtaaaatgatggggaaaatatagttagaagaaagctagttacatcaaaacaaaaagtcattaattcgctaatatctaatatattgccagatttctcattccctttccaataatttacctaatttgaacctatacatctatgatgggaatctctagctatcagaaattgttaggagaccctcttcaccttggctagatgtccagtctttccaattgtcagaacccacaatgcttacattctgaaggaactccaaccttcccaggaagagaactgacccactgtgtcatcacacacacacacacacacacacacacacacacacactgcacacatacatcttctgaactgagggtaaaaaggttcatgaagtctttagtgggaacaaagaaggaattaaaaatgtacactaaaaaattcctaataggctgctgtcctatgtctttgcttgccctcttactctaattacctcggctagaccacatagaagaaaatataaaaaagaatcctttctaaaagcagaaaacagtacttggcctaaagaacaagactttgtctttcgtttctttaggccttacctaggctttccaaagaaagcatcaccaagatcccaagaaaatatcacctccagcttgaagtttcactaccgtaaatgcaggaagaaaggaacaaacaggaagacaatggcatttccaatgccttctcattccactcctctcatgataggtttcaaaacttccctcaagaaagtggccagagttttgttcaatgttggacgagtacatgttagagatgtcttttctgagccctcctctcagagaaggctggtttaagacaagaaaaaatcaaagatatttaatgaacagaagatttatataaaacgatgtgatttgttatgcacttaatatattttatgtcaaacttgattaccactcaatttctatgtggatttcaaagtcagattctttcaatcatgtctcaatgtataaaacctactcatgcttttttaatctcaacaaatttgtgatttgctgggcactcagtctctgtttgctctgcattagcattattgtaaggcttaatagatttccctttttcgtctagctgggtctgagtacccagttaaagcctcaagccactagtggcatcattaatgccacaatgattaagcgagacagccaagcgccagtgcaccatgaagaacaacagatttcaaagtcatcaagtctgaagcattgtcatgcttcttaaacagggtaaaatgcattaagttcctattattttcacattcttcaggtaaatgaagagggttgtttctagcctgtcaatagtgcctcagaactttaactagatgttaggacacaatgatgtataatcatcacattcttaccagtttcagtccagcagtattgacttaactctactggaagaaatatatacttgcagtaaaagcaggcatgtttattctaactctgtaagaagatagaccattggcattcccccaaaatttgcttgattacttatcaaattattcaaatttgcagagatatatactatataaattccctccccaagaaatgaaatataaatttaaaatgtaagttctttcattaatttatcaattcactcattctacaagttgtattcaggtttaactacgtgccaagcactatgctaagggctgggaatatattaataaacaaaacagacacagtttctgctcttgtgctagcagagaaaacagatattgaaaaaaatattacatatgtgatgaatattagaaggaggcgtggaaaatgtttgaatacatttatagtgcggagttgtgaaaaactatgactaagaaattagaccttaatcccaaaatttagcagctgtataaccttggctagtcactcaaagtctcattttttctagtctttaaaatagagttaattatctaattatatcttcctcagagggtgtggtaaaagtaaagtataaattaaattgcatgcaaaagcacccaggatagacttggcacaaaacacgcacctagtaagtgataatagaccctcaagccatctgataagtcatgctttttgagtgtcgtttgaaaatgtagtagcttttgtgctgtaggtcttatcaatcaaagtgattagtaggtaatgtatttaaaattctaaataatgataaaatagctagaaagacacttctcagcaagataaatttttaaaagaatggctagaaaatttctcttttggatcaagaagaaaagactgagcatatttgctccaagaatgaaaatcaatatgcaagaaaagtgaagagaatgttctctaatgttgaaaatgtcattataaagggcaaggaggtataatgaaggttcctaggtgacaaaaatcagacgagcatgggaaagtttggataaatgaacaaacatcatcgttgggagttcatagtctatttctaaataagaaaattccattctgtaatatcaaactgaattcttactactcacgaagtggttgtctttgaaatcaaagtagtccctttgtttaaaacttaaaactcataaaatttaaatattaactgacaaaagaatttcaggagagaatagaggttttcataaagggccaaacattttgcattatataccttgaaaactgtgagccacatttgttctattttaacaacataagcaaaacagaaacttggtaatgaatttataagatatagcagtgaatgttttgatctacttataattacttcactgttgttaaaaggatttggcaatgtaatgactgatataagcactagagtcattaacatgtatttactggtatgcaaattggttgccaaaggaaacatctttgtatctttaccttgtgttgctatgcacaattttaaaaagaagagaaaaatatgcaagccttcccgttattttatcaatttgggaaggtctaagaatcacaacattggaagcatccttagaaatgcacttgcttttgttgcctgtgaactggcaggaaaatggaaattcttcagaccctcctcattgtatagttctgtgtttagtcatctttggagctcagaatcatttcactgttcctagctaaagcctttcttaaatcaatttatttactactctatacgctacttgccctattgtttccactacattacgctttttaaatttttttctacattgtcatatctgctctagtttggcttttattctatcacaagtaaaggaatgaatctggggcctgaactctggttccaatgcagtgacatcctagctaatcgactataaggaaggcacttcacctctatggcctcagttttctctctgtaaattgacaaaaattgaactaaattatcattgaattaccttccagccctgccattccatgatttccataaaggttgatgaggtgccatctgctttaggaggaaaaaaacactaaagaaaaagattcagaatgtagtgtggggtctgccaacttgggaaaccatgttacctctctgagactaatttgtgtcatctgtcaactaggcataattataccttccctgtctaccacataagatgactgatccagtgaggtgaagatacaggttagcatatagtataaactttatccttactaatctcttaaaacctggcagacaggaaaaaatatagtgagtacaggccgggcgtggtggctcacgcctgtaatcccagcactttgggaggcctaggtgggtggatcacaaggtcaggagatcgagaccatcctgcctaacacggtgaaaccccatctctactaaaaatacaaaaaaaaaaaaaaaaaaaattagcctggcgtggtggtgggcgcctgtagtcccagctactcgggaggctgagataggagaatggcgtgaacccaggaggcagagcttgaaccgagatggtgccactgcactccagcctgggcgacagagcaagactctgtctcaaaaaaaaaaaaaaaaaaaaaaaattcatggtgagtacaaaagtcctcatggcctaaagtgtagaacttagagaaaagtacaaaaatatgggtcaattaactaatgaaatagtgattcatttatcttcctagtaacgaacatatgaaaaaattctctacatcagtaatcatcagagaaatgccaatcaggccaggcacggtggctcaggcctgtaatcccagagctttgggaggctgaggcgggtggatcacaacgtcaggagatcgagaccagcctaaccaacatggtgaaaccacatctctaataaaaatacaaaatttagctgggtgtgctggtgcatgcctgtaaccccagatactggggaggctgaggcacgagaatcgcttaaacccaggtggcagagattgcagtgagccgagatcataccactgcactccagcctggcgacagaacgagattccacctaaaaaaaaaaaaaagaaagaaaagaaaaaaagaaatgcaaatcaaaatcacaatgaaatactatctcataccagtcagaatggctattattaaaaagtcaaaaaacaacagacactgacaaggttgcagcataaaggaaatgcttatacactgctcgtgagaatgtaaatgaattcagccactgtggaaagcagtgtggaaatttctcaaaaaactttaaacacaactaccatttaacccagcagtcccattacttggtgtatacccaaaagaaaacaaattgttctaccaaaatatgcacttgtacattcacagcagcactatttgtaacagcaggtgtgaaatcaacctagtgctcaccaacagtgggttggataaagacaatgtgctacatgcacaccatggaatactacacatccacagaaaaaaacaaaatcatgtcctttgcagcaacacggatgcagctagagaccattatcctaagtaaattaacacaggaacagaaaaacaaatactgcatattctcatttataagtgggagctaaagactgggcacttgtagacttaaaaatgccaataatagacactgaggactactagacagggagcaggggagataagggttgaaaaactaactgtttagtactaacctcagtactggggtgatggaatcattcatacccagtacgaacgcagcatcatgcaatatacccatgtaacaaacctgcatgtgtaaccctgaatctaaaataaaagattaaaaataaaaacaatctaaatttggcagcacaatatttagaataaagaacaatggactggattctaacactatttctgtcattaattagatgaatgagtgacttcagacaaatttgtcaaataaagatgctcaaatggacacaatcatataaaaaatttctgcattataacttttcttttggaatacagatttttaaaattaatgagagaagaacaaaccagacaaagagagagagagaaattgagggagagaaaatttccactttgactatgataaactaatttataacattctcttgctaagaacaactcaaaaggatggattataaaaaatatttgaagtcataaacaagtcacgaagtcagccaggacttatgggtccaagatccctgagagaagaaaattcatgaggaaaggtactcaacacatcttttcccctcagctcattttcctgttagaagctagtgctaagcaagagactgtgaagctgaacagagagctgacagagcttttggcagtctcaatggactggggaaacaaaaattagggttcagggttgaaaaggactctatgacttgataattcaagattttgcagtgacaaaaagtacaaagaaatgaatccaacactatgtgctgtttatttttctcaaagcaatagtcaattcattagcaaagtggggaaggagactatgaagttgggaagaaggaagtctctgagaagctaagaactttcaacaatcacacgatgctggagagtaaaaaaatgggttcagggcccaccaataaggaattaacttggtaaacatctaagggttaaggcagagatagggttagggttaaggttggggatagatataggggaacaaactaaaaatagaacttgctcataaaaactgaaacattgtgcttgatccagcccagcccatagttacattaaagtgatatccctgtactctagctgcacttaatttcttttcctctttttttaagtaaaacctctccaaagagagataacattcagattatctacaatttttcatatataataactgtcattcaataaaaatcagctatccaagaaataataaaagaaaaaacagaacagagttgccattgatacagatattagagttattagaaaagatctttgaaataaccataatcgacatggttcagaaaataaatggcatccctaagatatgggtacttttctgtatagatgttatccttcactaaaaagtttattcttaaattttaagatgtagaaagtagcaaatttctccagaaaactatatctttgaaaaagaatcaatgaaaattcaaaaactaaaaaattcaataagtgaaattcagaattcaataggggaatttaaaaatgaatatgtttcagcagaagagagtggcagtaaaccagaagaaatgttaattaatagatccaagcactaaaagattaaaaattattttacaatgccataaaagacatatacatcattatacaaataacgaagtgtgtgtcaatggactctgagtattgaaagagagagaatgtagcagaagcattatatgatgtataatgatcagtacattttcaaaactgacaagaaaaaaagctacagattcaagaagtgctgcaaatcccaagtagggaaagtacaaagaaaacacaccaaaacatacaataatcaaattgctgaaaaccaatgacagagactgactcttaaaagcagacattaattataaagaagcaaagataacactggcagcaataatgaaagccataggcatttttaatgtactgactgcctaacttgaattttatattcactgaaaatacaattcaaaaacgtaggcaaaataaaaacactttcatcaaacaaaaaacaatgaatacaccagcagatctatattttaaaaaatactaaagagagtacttcaggtagaaggaaaatgatactggaaggaagcagaaacatacagaaaggattggagggccaaaaatagggtcaatatatgggtaagtctaagtgaatattggctatgcagtccttagaagaaatttgtagctattatatagcttgtaatacatatatttttaaaaggagaatatctagaaatcaaagtttccatctcaggaagcagtaaaagtaaataaaataaagcccggatatagttgaaggaagaagataattaagatgaaaatcagtaacaaataatatataaatgtaaaattggaattgcttagctattagaaaaggctttaaaatgataaccatctattataaatgatcaagaagagaaatgggacaagttactaatattaggagtaaaaaataaaacatcacttcagatcttaccaaagacaatataaacaactttatgccaattaaagctaaaaatttagttgaaatggagaaagcctagctgcaaaataacttaccaaaaccaatacaagagtaaattttctaatctctgataaataaattgaattactaatttaaaacctttacagaaggaaatatcaagcccaaagacttcagaggtgaattattccaaatattaaaataataatgttaatctaaaacaaactcttccagagaacagcaaaagataaatcatttcccaatttcttttaaggccagcgtatttttgattttaaaaaacacaaaaacagtataggaaaggaaaattacaggccaatctttctcattagcatgaaagcaaaaaaaagtaaaacagctacatatgaaaagaataacaccacataatttaaactttcaaaaatcagccaacacaattcaccacattaagagacaaaaaggaaaaaaaatatggtaattttaatagatacagaaaatatactttataaagttcaacacttatttttaaaaatcatagcaaactaagaacaaaagggaatgactttaaactgaaaaacacttttgaaacattatattaatgtgaaatattagaatattcttgtttaatattagaatgccagctatcatcatgtctattcaatacaatactggagattttagccaggaaaataagaaaagaaaaaaattagaagagaccaaataaaactatcaatattctcaattaattcaaattatttacatagtaaatccaaaagaatctatagacgaagcattagaaatgtaagtgaatttagcaagttgtctacatacaatgtcaatatataaaaatcaattgcatttctttaaatatatcaccaacaattgaaaaataaaatttaaaaatgatacagtttttatcaacatatagcacctctgaacgagtaaatgtaatgagatgttcaagaattctacacagtgaattataaagtattgaaagaaattaaagaagacaaataaatatatgtacacatatatatcatgccattaaattataagctcaaagttttaagaacataaatccttctcaagttggcccacagattcaatgaattcacaaccaaaatcgcataaaggacatctgtggaaattgacaagttgattccgaaatgtatatggaaatgcaaatatacaagaattgctatgaaaattgtgtagaaatatcaaattgtaggacttacactaccagatattaaaaccttatgtacagtaattaagatagtgctcagtttgcataaggacaaatagaccaggtatttgaatagggtttaaaaataggcccactgatataaggttacttaatatacatcaaaggtatactataattaaatgggggaaaaggtgttcttatcaacaaataattaattatatatccatatgagggaaaatgaattgtgaccccttacctcatactatacacaaaatcaattccaagtcaatttagatctaaatgtgaaaaattctaagagagaacataaaaaatattttaacaaacttggagtctgcatagatttcctaaaaaggacacaaaaggcactttatcatttcataaagaaaaagaatgataaattggacaaaattaaaagtaataactttagttcaaaagtcgccgttagaaaaaggaaaatgcaagaaaaagagtgaaataaaatgtttggaatacatacatccaaaataggactcatattcagaatacatataaatcagtaaaataaataagataaaagaaaacccagaccgataaatatatagaaagatcctcaagcttcttaatgagagaaatacaaaattgaaattacaatatttctatggacctaacaaagtagctactgaaaaaaaaaatgtagagcagctggaagtaacatacattgctggtgggagtatagatttgtataatcactttggaaaactctataaaattttctactacagttaaacatatgcttattctaagatctagcaattgtactaccagttgaataaatgaaggcatatcacacccaaagtttacaaaaatgttcttaccagatttagtcataatagcctgaaactggaaagcaaactaatatccatcaacatcagagtgaacaaatagtgaggtgtattcgtacaatggatcaccatatgggaatgaaaagggataaagtgcaataacagtttccaaaagacaaactgcaacaacataaatgaatcttacaaatataattttgagtgaaataagcaaggggaaaaatagtctacgattctaggcatataagtttcacaggtgtaactaatttgtcatgataaaagtcagaggagtggttatttttgcagtgtaactgttagtgattgacaaagtccactagggatatcgatttctctacctgggaagttgtgttcactttgtgaaaattcatcaagctatgcaccctgtgagcttttctgcattgatattttatttcaattttaaaagatacacttgtataaatacgtaaatatactagagcatagtgttttttaattgtagtaaaataaaaataacataaaatctaccctcttaaatttttaagtgtacagtactacattattaactataagcacaatgctgtacagtagatctgtagaactttttcaccttgcatgacaaactttacatccattaaagaaaaactcaccatttccctctctctccagcccctggcaaccaccattttactttctgtttcagtgagtttggcgactttagacacttcacataactggaattatgcagtatttgtcccatcactggcttatttcacttagtataatgtcctaaaggtttatctttgttgtacatattgtagcatatgacaagattttcattttttaaaggctaagtatatgtatataatatataacataagcatattatatacatatatgtatatataatgttataaatgaatctcataatacatcacaagatgttatatatacataacattatatatgtgtgtgtatatatatgtgtatatatatacacgcatatgcatatgtgtgtgtgtgtatatatatgtgtatatatatatacacgcatatgtatatgtgtgtgtgtgtatacatgtatttatatatacacgcgtacatatatataacattttctttatcccaacacccccaatggacatttaggttgtttctacctcatagatattgtgaataatgctgcattgaatgcagaaatgcaaatatctctttaagatccacatttcaaattcttttggataaatacacagacgtgagattggtgggtcatatgaaaattaaattttttatttttttatgaactcaaaactgttttccgtggcaggttcactatcttacattcccagaaacagtgtataagggttctaatttctccacatccttctcaacacttgttatcttctgggtttttctttttttgttgtttttttttgtttgttttgtttttggttttgcttttttgttttgttttttaatggtcatcttaacaagtgtgaagtgatatctccttgtggttttgacttgcatttcgctgatggttagtgatgttgagcatcttttcatatacctgttggccatttgtatgccttctatggagaaatgtctactcaaatcctttgtccattttttaatttttttgcttttgagttatagaagttccttatatattccgaatattaactctttacaagtgatgtgatttgtagatattttctcccattccataggttgccttttcactctgttgtttcctttgctgtgcagaagctttatagtttgatatagtcccacttgtcaatttttgtttttgtagcctgtgctttatttttttaattgaaatttctatctgagttattctgacttcactctttctgcactggcatctttttttctacaaattatttcaagaatacatacacgatttgaactattctgctgttttttgcttagatattatttggcctagatgagttacagaaacaaaatttgcaacttgaatttctcagtcgctgcaacaaatgtgctgcttctgaaggcatatccctcaggaggcaagtatcatatagtttgaagggatgtgtcagtcaaggctcaaaaaaataatgctgtaaaaactgaggaaatttagtattatactaaagctgatggttaagatgtaaatattttatttttgtccttcccagaaacacatacataattttaaacttctctaaaatgaacactattggccaaatcctaagaaattgtgaacgacaaattccatcactaagttatcccatatatgtgtactgtatttttctcatttttattttagtgaatagaaatgttagaaagtctatcaaaataaccaaaatatacaaaataactaaggattgaccccattaactttgccaacagtcttgctctctgagtgttactgaagatcattctatcttgcacaattcaggcaagcactccaattcttcagtcactttactcctaacataccatgtgactctagaaatttcccccagcccattttacactcgcatggctcagttgaaaaatttgaggttaacacaaccagaagattgaagatgaacataatttataaaaagaggggtcactttggaagttatagtaaataggcaagggtttctcattattatactgataaaatctaaagctaggcctctttcattttggttatctgaaattgaacagagcttatattctatatacttataatgctctctgagcaattcagaaaaaaaggaggctcttttatgctatgaagaaaagtacagtttgacatttatgggtaaaaaattatatcaatgcaatagttgaaaaaatgtaggggaaagcttagatttaatttgtgtttgatcattgcattccaggtaaaaatttcatataaaaatattttatttgtaatagatagactttaaacacttatctgcaaatctgggctcatggttcctactttgcccaagagagagggttgttaagaagataataaatattacaggtaacatttattgaaaagtcattaaatgcaaacattgtgttaaatattttatctttataagataggtagtatcacagacaaatgaaaaaaaaaaactgacaggaaagataagtttttaccataggtcatacagcttgttagggcaaagaaagacttttaaataatgtttgttttatttgcaaattcatgttattaacttacctcacagagatctagtaagataatagaaatgagtgctttaaaagttatatgtcactaaacttcagttagtaaactaactgaagaggcagatctgaaactaaaatgggcattttgcatgtatctgcttttgaagcctctgaaaccagaagactaaaagagagttagtactcatcacaactaggttgtggtttttgaaatgaataatcaacataacagagaaataagcacactaagcagtatacaacatttttacaattgttaaaatgcctctgccagcagaggtggggatgactggtataacatcctgaaatgcatgtacatatagtatgtgcatattgtcaaaattctaaatgtagtgctaaagtactaagacggtgataacttaacaaaatcttatattaaagattttgtagtgggtactgagtttactgcacagattccccgcttcagggtcaaagcgctcattctcgcagctgttaggagtgttagccgctaaggcttaccatctcttggaagttgccttgaccaaaattacttcatttcttcactagggcaaactgcatccaatgatccccataggatcagctgaggcctctgttgagtgttctctaataagttcttgcatacaaatctcagagttttgagtctgttttctggggagcctggcctgcaacaatgattaatcccaaattctctcatagtccactgcatatggttcttgctattattacaaaagatgtacttttttctattttcccaatatcaagtaatggagcagtaaatcttctacacagaactgacattactttatggggctcctagaaattttatatagagtctgtacgtaacaaggcaatcacagtgaaaaacggtacaccttatgactaaaagacttttaaagacttatatggttattggcttaggagatttctttctacaaaacaaaagttttaagttataaagcatagacttaagtagaaatgtgctgtatttccctctaacttgcgtgcagctaaatgagttttttttcccattctttcttgaataaaatataaaatctaggctgtaaaatggaaataacccctgctgctttataaatctataaaaagtcatttgataagaagcaatgatttgtagtacttgtgggataatttatatcaaatggtaccagaaacttcacttcaacaaaaatttgacatttattaaccatctattatatgcaaggcactcatctgggttctgtggtgacaaataaggcgatattagactaaatacttgttgactcagttgccactattcctttccttcaggatcccataatttagttgagaaaaaagggaaaataaaaaataacacaaatacaaggcaagcagttattaaatccatgggtatgtttgttaaaaaacaaatacgaggacaaaactgaatgtctgtcatataattaatatgtttgtttgcatatatccaagaagcaggaatacatcataaccaagaaataataccaaatattttcagaggatctgtccagcctgaatgttaaaagtgaagaaaccatgctatcactgagcttatattataaaaacattttatcttttcaaaaatgttctaataaattctattcaattctaggtacaagaagctagagaggcttatgaatgaatacactgaaaggtcactataaaatgcacatttgcctatatataaaatcatcatattgcacatcagacctactccttgttctccttttcctctcagtacgtggcagcagtaattgttcaagctaaaaatctggaaatcaactctgacacttttctatacctcgccacttacatataaacaaatcaatctaatatacagtataacctattttatctcctaattatacattttcaaaagggattataccatcccctagggagtgaaaattgattatgtaggaaaggggtgcgatagttagttttatctcaacttggctaagctgtggtaccaagctgtttggtcaaacactatttgagatgttgctttgaaggtattttttacatatgattagcattcagaatcagttaactctaattaaaacagattacccttcataatatggatgggtcttatccaattaattaaaggccttaagagcaaagactgaggatccccaaagaagagagaattctatctcaagattataacatacaaattctgccttagtttccacccttccagcctctctctctttctctctctctctctttctctccttccccaccccacgtttgacaagcacaaaggtgaaaaatatttttatgtataaagtaccgatataggtactttacataaagagataagtagtatatctgtggtataaaaatttcaagaggggtggagtcaattagtacaaaagtttctaaaaagtctcctggtctctgggcagtggagaggggtgggaggagtagataataaaaaatggtgaagaaacactgttctaaacatttctttagtattagtatgtcctctactgtgtatcttttgaacactaccctagaatagtccactatttattattagaaatattgcttctaaaagggctctctgtggagctatcttaatcccccataaatgcatcttccacattgtctacctagtctatgtaaaatgcaaatttgactatgttactccttttttttaaaaccccttgatggctccaggtttgggaatctctcatttctcctccactagaaacccacaggcatggtaagagtcttcatcatttcacagaggaggatactaagatccagttaggtataatgatttccccaagttgcacaattaaataaaggcaaattccggatttaaaaccaggtttcacaatctacatatccagctttttttaaattttaattttattaaaaattttttttattatactttaagttctgggataaaataacatatcaggcattttattggaccacagtggaataaagctagaaattaataccaagaggaactctcaaaagtataaaaatacatggaaattaaacaatctgctcctgaataatctttgggtgaacaatgaaattaaggtggaaatttaaaaaatatatattaaagaaataaaaatagagataaaatatacccaaatctctggggtacagaaaaagcagtgctaagagaaaagtttatggtgttaaatgcctatgtaaaaaaaatagaaagatctcaaattaacgatttaacatcacacctcaaagaactaaaaaaaggaataaaccaaacccaaagctagcttaagaaagaataaagatcagagcagaactaaacaaaagtgagataataaatgcaatacaacttttcacaaaatgaaaagtgggttctttgaaaagataaacaaaatagccagattaactgagaaggaaacacagaattttcaaataagcaaaatcagaaatgataaaggtgacatcacaactaataactcagaaatagaaaagattatcagagactactatgagcatctctatgaacaaatactagtaaagccagaaaagatgaacaaattcctggaaacaaacaacctcccaagaatgaccaggaagaaatataaatcctaaggagatcaagagccagtagtgaaattaaattagcaataaaaaactcccctcccaaaaaagaccagtgacagagggattcatagctgaattttaccagatgtacaaaagacagtggtacaaacgctattgaaattgttccaaaaatcaagggggagagaatcctccctgactcattctacaaagccagtatcactctgatgacaaagacaggcaagaacacaacaacaacaaaaaattataggccaatatacctgaagatagaggcaaaaattctcaacaaaatactagcaaattgaatccaacagcaaattaaaaagataatacaccatgaccaattgggttttatccagggatgtaagggtagttcaacatacagaaatcaataaatgtgattcaccacataaacaaagttaataaaaaaaactatatgattatatcaacagacaccgaaaaagcattcaatagaattcaatatcctatcataataaaaatcatcaacaaacttagcatcaaaaaacgagcttcaagacaataaaagccatatacaacaaacctacagacaacatggggaaaagttgaaagcattctccctaagaactggaacaaaacaaggatgctcacttttaccacttctatttaacacagtattagaagtcctagttagagccatcaggcaagaagaagaaataaaagggatccaaattagaaaacgggaagtcaaatttttctgttcactgatgatatgtgcctatatctagaagacaatcccattactgagtatatatccaaagggaaagaaatcactacattaaaaagacctgcactccaggaattcatccatttcttctagattttctaatttatttgaggtgtttatagtattctctgatggtagtttgtatttctgtgggatcagtggtgatattccctttatcattttttattgcgtctatttgattcttctctcctttcttctttattagtcttgctagcagtctatcaattttgttgatctttccaaaaaaccagctcctggattcattgattttttgaagggttttttgtgtctctatctccttcagttctgctctcatcttagttatttcttgccttctgcaagcttttgaatgtgtttgcacttgcttctctagttcttttaattgtgatgttagggcgtcaattttagatctttcctgctttctcttgtgggtatttagtgctataaatttccctctacacactgctttaaatgtgtcccagagattctggtatgttgtgtctttgttctcattggtttcaccctcccaagactaaaccaggaagaagttgaatccctgaatagaccaataagaggctctgaaattgaggcaataattaatagccgaccaatcaaaaaaagtccaggaccagatggattcacagccgaattctaccagaggtacaaggaggagctggtacaaggaggaggaggagttttcctactgaaattattccaatcaatagaaaaagagggaatcctccctaactcattttatgaggccagcatcatcctgataccaaagcctgggagagacacaacaaaaaaagagaattttggaccaatatccctgatgaacatcgatgcaaaaatctccaataaaatactggcaaaccgaatatagcagcacatcaaaaagcttatccaccatgatcaagtgggcttcgtccctgggacgcaaggctgtttcaacatatgcaaatcaataaacgtaacccagcatataaacagaaccaaagacaaaaacctcatgattatctcaatagatgcagaaaaggcctttgacaaaattcaacagcccttcattctaaaaactctcaatcaattaggtattgatgagatgtatctcaaaataataagagctatttatgacaaacccacagccaatatcatactgaatggcaaaacctggaagcattccctttgaaaactggcacaagacagggatgccctctctcaccactcctattcaacattgtgttggaagttctggccagggcaatcaggcaggagaaggaaataaagggtattcaattaggaaaagatgaagtcaaagtgtccctgtttgcagatgacatgattatatatgtaggaaaccccatagtctcagcccaaaatctccttaagctgataggcaacttcagcaaagtctcaggatacaaaatcaatgtgcaaaaatcacaagcattcttatacaccaatagcagacaaacagagagccaaatcatgagtgaactcccattcacaactgcttcaaagagaataaaatacctaggaatccaacttacaagggacgtgaaggacctcttcaaggagaactacaaaccactgctcaaggaaataaaagaggatacaaagaaatggaagaacattccatgctcatgggtaggaagaatcagtactgtgaaaatggccatacagcccaaggaaatttacagattcaatgccatccccatcaagctaccaatgactttcttcacagaattggaaaaaactactttaaagttcatatggaaccaaaaaagagaccgcattgccaagaaaatcctaagccaaaagaacaaagctggaggcatcactctacctgacttcaaactatactacaaggctacagtaaccaaaacagcatggtactggtaccaaaacagagatacagagcaatggaacagaacagagccctcagaaataatgctgcatatctacaaccatctgatctctgacaaacctgacaaaaacaagaaatggggaaaggattccctatttaataaatggtgcttggaaaactggctagccatatggagaaagctgaaactggatcccctccttacactttatacaaaaattaattcaagatggattaaagacttaaatgttagacctaaaaccataaaaatcctagaagaaaacctaggcaataccattcaggacataggcatgggcaaggacttcatgtctaaaacaccaaaagcaatggcaacagaagccaaaattgacaaatgggatctgattaaactaaagagcttctgcacagcaaaagaaactaccatcagagtgaacaggcaacctacagaatgggagaaaatttttgcaagctacgcatctgacaaagggctaatatccagaatctaccaagaactcaaacaaacttacaagaaaaaaacaaacaaccccatcaaaaagtgggcgaaggatatgaacagacacttctcaaaggaagacatttatgcagccaaaagacacatgaaaaaatgctcatcatcactggccatcagagaaatgcaaatcaaaaccacaatgagataccatctcacaaccgttagaatggcaatcattaaaaattcaggaaataacagatgctagagaggatgtggagaaataggaacacttttacactgttggtgggactgtaaactagtttaaccattgtggaagtcagtgtggcgattcctcagggatctagaactagaaataccatttgacccagccatcccattactgggtacacacccaaaggattataaatcatgctgctataaagacacgtgcacacgtatgtttattgtggcactattcacaatagcaaagacttggaaccaacccaagtgtccatcaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccggggcctgtcgtggggtgggtggagaggggagggatagcattaggagatatacctaatgtaaatgacgagttaatgggtgcagcacaccaacatggcacatgtatacatatgtaacaaacctgcatgttgtgcacatgtaccctagaacttaaagtataataaaaaataaataaataaataaataaataaataaataaaaagacctacactcttatattgactgcagcactattcacaataccacagatatggaatcaacctaagtgtttatcagtagataattggagaaagaaaccgtgtggagaaagaaagaaaatatgaaaaacctactcggtacattcaggtgacaggtacttaaaagcctagacttaaccaatgcacaatatattcatgtaacaaaactgcacttgtatcccctaaatctataaaaatgttttaaaactttaagaagtataagcactaaaccaaaaagtaagtcccatagcctgtatctaggtactggaaattgaacccaggtctattttactacaaagactgtgcttcctcactacactctactgtgctatatataatcacttaccatccaccctctgaagaatgaatcctctcccacctttttcacagagcctgttctgactactctagcccaagccatcttctttgttctaaaatctcatagcattttcaaattttgctttgtgaaatgtctataatgttacaacttttaccttcatgttggtacgtaggtccttgtgaagttgttttcctactcaaaaccaggttggagaggagtacaaaatagcagtgaagagcttggacactggagtcagtctgtctgagctcaaatccaagcacaactgatttttaatctgtgtgaccttgggaaaactacctgatctctctacgcctctgtttcatcatttgtaaaatggacaatagcgtttaacacatagagttgttgggaggattaaatgaattcatctatataaagctatcagaacactgtctagcacattagtcatttaactactgtggacaggagtttgctatcttcattttttataatactctttccagactttgaaattaaaccttagcgttacgtccatggaagctcaaggtagatatgtaaaagaacttcccattaggatgacgcagtcactggggtggagattaccctggttgcataagttgactccaagccaacccagacaaaatgacctaaaagtaaagcagatttggctgtgaattattaatagtaagaaaggctattataatgaccaaatgtgatgtgtagaaaaactactttatagataataacataagtgaatgttgattattatttgaaagcgacaatatgataggcatctcaagaactggatgcatcttgttcatatggaatataaaccttactttctctggaaatatgcaagtgcttcattgatgacatctgtggacatgccaaatcattgttataaactttatgacagccaactccaaaagaatttatatgtttccactaaatgaaaaaaattcaaacataaactgatccttgtatcttgaaaaaaatcaggcactctagggaagaagcatgccttaaggtctaatttcaagagcaatttaaattctggcgattcatatgattagaataaactggaccaagccttgaagccaaagagttctttaagtatccttacatctctctcttgtgttcagaaatggaaaacatttctctaaaaatgcttttctaaaaagaagcaaaaatcatcctacccagtttttatgcaatctaccaaacaggtgaaaattaacttcttcatacaattcagtccatgccgcaacacaaatgaaatgagaacgcatttaatcttagcatccctatgtcactcaaaggtaaaaatgtgagcatttgtagattgcaataaaacatgaatacaaaatgatgtgtattccctcttcagttcattgtcctcattgttacaattgtacctgctacagaaacaagagcttattgttctcttacattctaatttttacaataggccatcttatttacttcccttgtgcctaaggcagtccttggcatatagcagtcactcgtaaatgtggctgaaccagggtatacagcatcaccaccacttcaattcttcctgtgtccatggttctcacacttaagcatgtataaattctttgagtcctactgtgaaaattttactacgctcactctcccctcaaagagattctgaatcaagaggtctggattagaacccagggatataaaactttaaacaaacattctaggtgatccaaatgcaggcattcagcaactatattttgagaaacactatcttttggttaatttcttaagtattgatgataatggctaacatatatttaacacaccctccttgccaagggctttaaatacatttcgtcatttaattatcatggcagtctataaaacagattactttcatcacattttgcaatgaggtaattaggacttggagaggttaagtaatttgtcctaggttacagcactaatggaagagaaagaatacaaacccaagtctatgggattccaaagcccataataaatacacttggttgcaaagagtaggctgcatgggctgccaacagttgtctttagcaacatatcggtaaatgccatctacaaatctggctatgaaaattgatcagtcattcagataaatgacatttcatcatttgatagcatcaacagatattttggatgatgggtcaaaaaggtctcacatcccatcaggctacaaaacaacaacctaatgcattcaaaatgaggccattcagtttttaatgtcaaaaataagagcttttatgtggaatgacaaggtatttattagatactagtatttgtattccattaactaaaatatgaagaacaaagatggccaaaacacattttatcatattaaacatatttcaaaattttaaaaatacatattttccctttgccatattaacatagcacagattaaaaactgatatattcatacagacagacccctaaacctcttctttctcaccctgtttgaggtcagagccttagaaagcacaaggaattcccttccaggtcactccagggtgtcctttgtctcctctgtgatggtgaaaacaaatggtggattttcagcttcactggaaatggcacagagaaagaaggcttgtgccatggtagtggctgaataaccttttaacaagttcttaacctttcttatcaataaaattgaaatacaaatatccatcttaaaagattattatcaggattgcgtaagtaaattcaggcaaaactcttaccagagttcctagtaataaatggtggtagtaagtattgtgttcttggtgtcttcttgcccactcatatccatttgctttcagcctttcactagtaccacctgtaaatctagttgaagttgtaccttcttactacattgtgatatacaaggtagcacatcagtgggattaaaactaaatattagattaagtctttctgtcaaagaatattctttctaaggtttcaagaagtaggatattgaattaccattcaacccagcaatcccactattgggcatatatccaaaggaatataaataattataccacgaagatacatgcatgaatatgtttactgcagcattagtcacaatagcaaagacatacaacctaaatacccatcaatggtagactggataaagaatctgtggtatatatacaccatggagtactatgcagccataaaaaagaacaagataatgtcctttgcagcaacctgaatgtatctgaaggccattatccaagtgaaccaacacaggaacagaaaacaaaatacttcaggttctcacaagtgggagctaaacattgagtatatatggacacaatgcaaagaacaacagacactggagcctacttgagtgtggagagtaggaggaaggtgaggatcaaaaaactacctatcaggtgctatgctcattaccaaggtgatgaaacaatctgtacaccaaacccctgcaacatgcaatttacctagataaaaagcctgaacatgtactgctgaacctaaaataatttttttaaggtagaatcttgagtccccttgggattgaatcttttctctaaaacttctcagacacactttcaccacttctaagcctttatacagcttctcatttctaccacttttttgccagtgaatcagcaggtgcttacaatcaggaagtaatgacctgccttatatataatgagcagggaggaaattaatcccatcaagacacaggctagaaggatgagataattatctacttttccttttattctgtagattcgcaatagctgggaacataccttctaaaaaaggattcatccttatatacatttatctgtaaaaacttgggccataaacaacagaagatcatttctgttaacagtagaagaatactggacatcaaatattctcttaaggaaaagagaatcaaaaacatcaataggtttgtaaaaggtagcaatgctgctctgggaaatgtcttcaagaatataggaggagacttgaggcactggcatatgtttccctctaacttcatgcttttgtgcggaggaaccatgactgttacctactctatccccagccctagtacatgcatgaaaaacagtatgtgctaaatttgaatttgattaataaatggaggaacaaatgaacaagtaaatctagagagagatgctctatggcaataggccctcactgaagttacattaagcctaatttagcctacttgagattaccatgctctcctttccattgtttactaaattagaactaaaaggggaggcaggcaatctaaggaagagaaaatagcaacaggcaataaatgcatgaggatgttcagccttacacatgaggagtaacacaggacattcaaaataaaactaaaatgggatgttattttatctaaaaagaccggtacaaattaaaaacttgtatagcataaaatcgtggtgcatatatgaggaaactgatattgttttacactgttagtgaaaatgtaaatttgtacagccactttgcaggttatctttggcaatatctcttaaaattttaagtatgtatactcagtgacctaataattataattctaggtataagaagacttacctacatactgaaggatgtgtgtctaaggatgttcattgcatcattcctaaaatctgtgaaaacttagaagcaatctaaatatttaaataggaaataggtagaaatgtggtatagccaaaccacttaataagcatgtattcagtcacatataatgtggtaaatccaaatatggccaaatagatcttgaaaacattttactgactgaaataagcaaatttcaaaaaaccccaaattacagagtataccactatttaaataagttactctatctctttctcacatacacatatactcacatatgcacacaactgcacaattatactatatattttctgagagtgtatatatatgcatatatgtgcatatactcccaaaaatatataattttatgtatataggtatgtgcatacactcttacactctcagaaaatatataatataattgtaatgtgcaaaaaccaaggtctggaagaacacatgccaactgatcacagtggtaacctctgggaataaaactgattaggtgttttaatcaagggcaacttgtctacaatgaatttaattattgtaagtagaatgtagtcatgtgttatttgtgaaataaaaattatacaagggggatacaggaacaggaacagcaacacgccttgccattttacttagcaattatatttagagctcccctactttgatgatctcaagtcatctggtaaatgaatttatttactcacacattaagcttgttggtcaatctttcatcaaagtaataatgaatttttaccatgtgtcagaaagtatgctattacagctagagatacacagatgaataaggtatgtcctggatgtcaaaaagcttatcagtcttgcaagagttttgaaattccattccacatatgaaggaatcacagtatttttcctcactctggtaagaagcaacatgtatttgggttagtctgaaaactgttgattaaatgtaccacatgagatcaaaaccatttaaattaagaattactgatacctaaaaaatgggtacatgctggcaaacacttcctgatgagttcaattttcaagtttcattcaggaaacagccaattaactttctaaactttattcatccacctggaggcaacaacccggaaatggtttgacaagtccttcaggcaccaaacctgtctcaaattttaagagtgatgccatgtgtcacagacataatcaaggtctgccagagaagtaactgccttgaagcatcagcttccaaatgtggtcctcctcactgacgctcagcaccctctgggagactagtcatactctggcacactcagctaatctatctagagcattcctctgctaattgctaggcaggcacatgtacataaaagggactacagagaagcagtaaaggcctcattcaaaccacagaagctcacagattctcctctctggtactttaacgttggcttgtcccacaaaccagagtgaaagatgaccccttgactggcattatttaccttccatttaatatctgctgagctttcattatgtgcctggtactgcatttagcactgaagacacagacatgaccttgtcctcagaaactcccactgtaatgaagacacccattaattcattctacatatatttatttagtgttgtgctaattaccaggcacataaagataagcacctcagttattgaacctcaaagaaatcacaatgtaatgaagggaaagagttgccaaaaccatgtctcaaatatctgtgtaaccacagactaggacaatgcttggcacaggctcagcagttcaaagatttttgactgcatgagtaaaaccacatatgaaaaatcatgtctgtacaaaaatataataacaatgatcaccataaaaatgatatgaaaaaaggtgttgtggttagggttagagtttggaaaaaaagaacacctgcgttaaggagcatgtgagttaaggtgataaggaagactcctcataggaggttaatgttcatctggtatatgatttcctattaagaggcccacataggaactaaaaggagtgataggaacaaatttagaccaagactgcttcaaaaagcctatgctagtggagttgtttggcaataaaatttccaagtgcctgcttcttaaatttttttatgttgtgtcttttcttccaacttatttgctggaacttgaaaaaaacagatataaagttaaaagcacaaaatttaaatgccagtgaatggaaagttgaacctcactcaatattaatgcaaatctataggttaaaaatacatttaacatcataattgtcaaaagttataaaaatgaaaaatgtgctactgcacatataatgtcatttttcaagttcaaagctgacactatttttatctctgtgtggggaatatgttcaaagaaaaagagaagaaaaaagaaaagtcaagttcttttttcctgcgttacatatgtagaccagttcttggcttacagtttccatttatatttagagggatagtctccattatatatgaccaagacatgccatctctgacttcaacaaaacagggttgtgctgtctataagaattattttgcatcattcaacaatcatgtagaatccaagaagctgtaaatgctaactaacatgttatagtcctgggctaatatatggaatattattttatttccatttcaactttaattcaggtattattaccttttttacatttccatttattcaacaaacattcatggaacacccactgtgagtcaggtattgttctatggccatagtaaaaaaccgtgcaaaacaatatatcaaatcactgtcctcataaagcctactctattgggggaaataaacaggtaagttaatatctagtatgtcaagtagtgataagtgcaatggagaaaaataaagcaagctgaaaatgacaggcagtgtgtgtggactagaggaagggtaatatataaggttattgaggaaggctctactaacaatgtttaatctgacctgaaggaagtgagcgaactagttatgtgaaaatctgaaagaacattccaggcagaagaaaaagcaagtgtaaaggctttgaggtaggagcaagtctgaaatgctcaaggaggactgcatgactggagtgaagtgaaggaaaagggaaagtagtaagacatatagaaggggtacatcttgagatgtgtaggcaacaataaagacttcagcatttcattttagtgagatggaaactcaggtgaggattcacagaggactgaaataacctttcctgtatttttacagcagattattagggtcaagagctaaaaagcagggaagacattttggtaggagaagaagaaacaggagagagaggaatggtcttgaaaccaaataaagaaatttttcaaagaggtaggaatattaaaccttcataggttaagatgagaactgagaattcatccactggatttgtcaacataaaaattattgttaacctagccaagagtgatttgtcatagtagtagaaacaagatcctaaataaaatgcgttcaagttttgtaaaccaaaagtatctaagacaggtcttaatcaatttagaagtttattttcccaaggttaaggacatgcctgtgacatggcctcaggaagtcctcagaacatgcacccaaggtagtacagcaaaagctttcttttatgtgttttagggggggggtctgagacatcaatcaatacatataagtggtacacttgttcagtctggaaaggcaagacaactggaagtggggagattgttgcagggtggctttcaagtcctaggtggattcaaagattttctgattggcaattgtttgaaagagtttatctaaagatctggcatcagtagaagggagtgtctaggataagataagggattgtggagaacaaggttttcattatgcagatgaagccaccaggtagcaagcttcagagagagtagattgtcttaaggtctctgttttaatgttgatgctggtcacttggtgcctgaattccaagaggaggaggatataatggggcatgtggacaacccattcccatcatggcctgaactcatgtttaaggttaactttggaatgcccttggccaagagaagggatcaattcagttggttgggggaggcttagaattttttttttttttttttttggtttaccttatccccctctggccaagatttgccagaggcaacatcaatggccaaacttttattctgtcccatagcatttccaaggcggcacagctgcctgctctgggtctatcctgtcccttggtgggaccgctatggccaagtgactttgagccaaaagacctatagctaatttaagtgttcaaagccagatgtgaatggaggtggacaggcattcatcaaaccttaagatagaaaagccaacaaattagccagcttaggtttacaggcatgtgccaccacgcctggctaattttttgtacttgtagtagagatggggtttcaccatgttagccaggatagtctcaatctcctgagcttgtgatccacctgtctcagcttcccaaagtgctgggattacagacatgagccaccacacctggcccactaggtatcttgatatcctctcagtaattttctttcagttagaaattccttatgattgagacggatggaaaggggccatgtaaaaacccaggaggcaaagtcccttattttgccagctatttaggcatctatgtgtctatccttgatttgaagaatttcaactaattgtatccctcaaaattggcccttacaatctcacatgcccacctgttctgtgatagtacctgaaccaagagggataggtgcttttatatttttagtagtggggtggggcattagcaatgaaaataaaccaggtccagtaagattttaaaaggttttaaattgggaggatatcagctagaaaggaaagaaggtaatcttttcttgtttgtttgtttgttttcactgattttgtaagctatatagaattagcaatgttttttaaaaaaaggacataagctttgtctagttttgataatgacaggtaaagaaaactcatgggtagctaaacatttaaatgatctaatattaactcatagaacaaattatattaatttagacagaggaaaaattattgaattagcattcacatctttatatagaggcttggctcagtgtcatatgagagcagtttattttagctgtcatcttctcccaggtctgaagatgaggcttcggttaacttgaatttcatgccagatattggtgatgttcaagattcagtagaagtcagtgctcctttctagatgaggtaggtgtatgcagagtcaaaacactgtaacttaataccacaaagggatagttaacaatattttatatagaccctttttaatggggcagagtggagtctctcaattgttgtccaatcatcaagctggaggtggtgtttactgtatcttagttggaaaccatagaagaattctgtaaccttggggtgattaatttttctatttgacaagcctccagcaataagtctaagtcagagagttaatttaggatttgaattgaggatgtttttcaaagatgttaaaaaggctcaaaacattttattaaaactacattatataataataatttgataaagaagttatgtgggtataaattcttaacccttttaaagtttagttgatttttttataattaaaaacctaataaaaacaaacaggaattattttgataaaacattaaagctttgtttctttgtctaattaccaaaaaggaaaaaataaagaccctctgcagtgacttcttttccttatgcggagcccatttatataacctgaaagtcaaacctgctgaaaagagcaattgagttaatcagacatgggaatagtgtgtccggcatcatgagtaaactctatattatagcagccttgagcagagaatacgtgagtcttagcaacagcatgggaagttgcctgattatattgaacacttaggatatatgttgggcctcaaaaacaataccgcaaagtgaaagcctcagaagtaaaagttttactttggccttcttttgcccttctatcttgcagtttctcaaggctggccataaaaactagaatcttgcttctcaaggtgggtcctagaaaccagaactccttttcctcaaagccagtcataaaacctaaaaatattactctaatttttctcaaagtagacgcttaatgtcctgcaggacacccagctaaggacattgaggcaagggtggagacaggtggtggctggtcttgcagtagactgcccaaggtccaattatgagctttttaactgcagcaactttaatgtaagctattggagttggaattactgtggctgctggcaccagaattgccctccaatattccattattcttagatgtgctatccaagcagctagggcctgctgtgaaatcttaatttttcctccatccttctgtatacagctgtctataaagaaatcatctgaccttacttgttgtttgtaaattatgagacccctgtatccaggaggaaggaaatgcatacttggggaggttaagaagaatctagacaaacaggccttgctgagtttccccacacaggctactggcaatgatttatacacttgtgtttcatcatatttttaatggctatccatagtttgttgaacttaaccatttaaaaaaaatgggcaatttctcctgtatcttaggtctttattctgataactcccagatatacatgccaaaaaaaatctatgccttctttttgatcaatttgtcttttatgagttgatacctttagagggctcctgctccctaaacacattaagaaaaaacaagaatacagaattaagttatactggaggaaaatactgctttttttaaaaaaccttcaaactaaagcatttcagcttcaggcaataacaacagacttagaactggaggagggaaagaaaaaaatgttacaggtgccaacaaaaatagaaggggagagttgccattccaggccttctcaaattttctcatagtaaaaggtgatctctggtgcctcccaaagccaacaaggttgggtaaggcaatacaagaaagcagagctttagacgtgagaagaatctccccatgactgtttaaactccaccaaaaaagcagaagaccctaaaaagaggtaagttgcacctttatatgagttctttaaggggtcagagtcattagaagccttctcttgattgttttttcacttggtaacaaagacagcaaaaagggaaggaggaaaaaagtggaagaaaagtaaattaaaaaaacaatttttttgagaaaggaaccaaacagagaaaccaagcacatggttttttcttttctttcttttttttttttttttttttcacctgaggaaaattttagccaactaagaggccttgttccccacaatttagaattcttattctgatttgaacaagtataattggtcaaatccaatgaaagaaagttcaaaacaaacaaacaacaacaaaacaatacaattactgagccattctctaatggtaaagagaaattaagacaagttggttgtttatcttaatttttagccattaaggaaaattttcaagataaaacctcaatttagccacttaccaaggaatggggcccagactcaagaccaagactactgtctaccatctcagtagcaggaagaaactcaaactcaccctccctgttggaagtgagctaaaactccagaaatgagttgcctgccctccataatcatggaagcaggaaaatttgtcttccttgttgggagggagtaaaactgcagaaaagcagttatacagcaaaagaaaccttagatctcaaccaaattttggaagaccagggtttctctgaatgggggagcctcctgggtatcagaacctgtcctattggtttgagcaataaagacagcccaagctggtaccaagcaccaataggagatttgtcaaaggtcagggcctcctccatgcagtgtcccttccattggtcaccaatttgtaaaccaaaagtatctgagactggtttcaatcgatttaaaagtttattgtgccaaggttaaggatattcccatgacatggcttcaggaggtcctgagaacatgtgcccaaggtggtcaggctccagcttggttttatatgttttaggggaacatgagacattaatcaatacatgtaggatgcacagtgacttggtatggaaggtaggacaactcaaagttcggcaggggggcttctaggtcataggtagattcaaagattttctggttagcaattggttttaagagtttatctaaagacctggaatcaacagaagagagtatgtgggttaagatgatgggttgtggaaaacaaggttttcattatgcagatgaagccttcaggtaacaggcctcagagagaatagattgttttaaggtctctgttttaatgttaatgctggtcagttgtgcctaaattctaaggggaggaaggtataatggggcatgttgaccacccattctcaacatggcctaaactcatgtttcagattaactttggaatgcctgtgatcaagaaaaagggtccattcagttggttgggagggggcttggagttttatttttggttgacaaaataaaatgggaagacaagaattatagacacagaattggagtacaggtacttatggattttgctctaaaaaggagcagataaatagagcaacagctgaaagagtatgtgggataaagtgatttttaaaataaaagatattccaagaaacacttaaaggatattatccatagaagaagaaaaattgattatggatgaaagagaagagaaagtagagaatttctggagcaatgttcttatgtaggaaagaggagatgaaacctagcacacgaggtatgggaagtgagctcaagtagggtactagaaggaaagtcagaatatgtggtacagatgcaggcatctaagaaaatatggaagtaggggctggtaaatgttcttttctggtttcttttacattcttagtaaaatagaaagcatgaatttctgttgagagcaagagtgtagttttgaggaaagtgaagatatgttatagtccatttatctgagttgagaatacataagctagaaatataaagtagcattaagggtgaccctcagagtccccctgatatgagtagtatcaactaaaagtgtaaccagtcagcatggttttgacagacaaagatgttactggctaatccaaggactcataactagtgagcagctctatatcggttgccatttttgtcatggtaaatccatatctcctcccattatccttcaacaatagatagacataacctaccattccacctgtgatcacaaatatatgagatcattcagaatagagactgattcacctggtgtttccggtgactggcacaatgcttagcacatagttgtactcaaaaatatctcaaattgagcaaaacacattttcattagagaaagcacgagtttctcaaaatggtataaattttgaatgtcgaagatagcctctcaaagctatgcaaatatagcttgagttgctgaaataacatgttctccataaactgttagtttggtccagagtttgaaggtctacctaccactcacactttgtatatctacctccaaaggaaattttgattctgattctgttggttattttttcacaatcatgcttatacacaatttcttaagacactgcaatagaaacagaataaaaattacaattttgtccactgtattactgagaaatatgaggtagcatttgcagtcttactctggtactgcactgtaccttacttggactgccatcaatccatactgttatcccaactcaacaaagcagtccatcatcctatacaagcctttttagttatgggcttctaaaattagtcttagatatatagaaactcctagatactatctcaaggacatctcatgatgctagaaactgctctttactcctctaaatatctgcagaaaaactgttcaattcccttcctttgtaacttaacatttgttgcctataattgttcattatctttgtgtgtttgtattttaccttcccaattagatcatgaatttatttgtaacacagtgaacatccataatatttataaatattatatttttaccaaatataacctacttattaaaataatgtttattttaaaagtaggaatgagaaaagaactagactaagactatcatttatcaaatacttatcctgtaccaggacctatgttgagagttttacacaatttaattacattaatatggagataacattttacttccatcttaactctttttgcaaggttaaagatttagcaacttgcccaaggtcacacagctaacaggtatttgaactgtgactccaaagtcagtgtccttaaacactcactacattgccttcctagaaaagtgctttttatataacagataataaatatttattggatgagtgaatagttttagcagcattattgtcaattctatgtggttaggttgtaattaaaacaagctctatgtctatcctaagtggttaggttgtaattaaaacaaatatatcatgagtattctctagttcataatgtctttatcccccaaaaaacttttgcagttgaccttaagtgccctagacaaatagaagatatacacttaatcagctattttttaaatcactcatatttttataatttctacctgcctggctttccataattctaatgttttttccatacttgagatctcatttaggctacagtgtaaatcagtagtgccaagggtctggaagccatccatcataatcaatttgatcttatttttagtataattgagtcaaagttacttatccaatttcttttagggtttccctccatgtctgacactatgcatagaatcttactcatcaaataaactcttctgaagaatccaaagtttatggaacatgggatgaaaaacaatagttatagaaagtgaaaaaacatagttatcttcagacacttggtatgagcactacactagctaatctgtaatatgaaatctgaaagtaaaataaaacctagaggaagaaaaaaataaacaattaaatgaagacagagcagccagaagacacaataatgttaccaaatattgcttggcatgaagacctagtagctcccaaaattcaactctgtctgaagataaacaattcagttaagctaaagcaacactccaaaatcaggaaggagaggcaaatcacacatatctataagccctatgcatcttcctagtatgcattactatgtgcatacatacataaatgcacaaatcatctaaaggtcacgggatttgactcttcttttatgaagcagtttgtttcaattaattgactacggcatatcaatcatagcaagagtggcaagtaaatctaaattgtgaaatgccataaattttcttatagcacaaaagcaaattgaaatatgaagcaatgaaacagttcagaatacagtaagtttaacataatacgaaagcttagtacatgtatatgtcttttgttttttaaatatctttgtgttcatttccatatgttattttctcaatagccttttaaggtcaagctgtctcattcctattgctctgttcattcatttgctcattgtgattcatttttggatgaattcatcattaaacaaatatttaatgaactctatgcctcaggcattatgctaggtactaggtatatagtgaacagaatagacaaattcctggccattacagagcttacaacctgtaatgtaatttaaaagctaagcaaataaaggtacaattacaaattgtgataagggtttagggaaataataagtaattaggagtatgagagagtgaaacagtgagagagagagagcccctaggaggaatcccatggatagagaagccatctctaaaatgattaacacttaagttaaaatgtaaagactaaaaggtgccagtctttcagtgtatgaagaatgctccaggcaaatgagacagtgatggccaaagcccttaggcaagaagcccttgagtcttccaaaactgaaagaaaaccatgtggctaaaccaaagggaaagactgtcatgccatgaactagaggagacatgcaaaaaccagatcatgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacagatcatggagggatttgaggacactgtgttaaggaatttaaaatgcattcttagtacaataaaaagacattaaaatgttttaagaaaggaaaaagggcaagattattagatttatatttttcaagttaagctagtaggttgatgtgtgaatagtgtattgttgtaaaataaagtgatcaagttaaaatgctattgtttgtagtccaggtaatagatagtggtaacttggactctggtagtattagtaaatatggagacaaatgaatttgagatatgccaaaaatgatgatgggttgaatgaagaaggtaagggaaaaaaagtcattaaaagaaatactcaggttctggctatagcaactaggtaaatggtgaaacaaagcgacctgagcaatgggaaaggtctttcccaagaaatgaaggtaatcgacagaatcaatatatatttctgttgtgtgagcctttcaaatttcatgcatttttattttaagagcctctactgagcatcttataaatgctaaatcctactctagcctctgagaaatggaagctaagtaagattcagcggctttgcactaggattcagactggggaagagaatcatataaacattcaaattttcttccatgtgattcatgttacaataatctggtaggactcaacagagaaactagaggtcaggagagacttcaaagagatgacatctgatcaagtcttcatgaataaaaagaaagcattattttatttgaataaggtgaggatagctacttctgtattttattatattaaacaagaaattttgtatttcccctgcgttcccagtatggaatgtctaatatttgatacatgcttaatatacccctttaagcttgttaaagaaaaatcaaaatagaagcccaagtttagaatacccctattttaagcactagaaccacacagtcaaaacttaagtcatcctaatttcctctaaacactacctctaataataaacaaaacaaaaagcaagctttatgtccttgtcagcatggttcagtaacattaaaccaatcagttatacaaaatcagcttaaatagctctgcttaccataaaataaggggtaatatagtagacaatcacaagaaaacctaaaaatatctcctcttttatgctttataaactatgctgtgagtgttgcgagcagagctccttaccacttgagggtccaaagtctcccagtttgagaactattcttttgtatactcagtaaacttctaattttttttttcaatttcaacttttattttctggacgtacatgtgcaggtatgttacatgcatatattgcatgatgctgatgtttgaggtgtgattcatcccgtcatccaggtagtgactgcagtactcaataggtagttttccaagcctattctcctccttctctccccaattctagtagaccctagtatttattgtccccagttttatgtcaatgtgcatccaatgtttagctcccacttataagtgggaacatggggtatttggttttctgttcctgcattaatttgcttatgataatagtcttcagatacatatgtttctgtaaaggaaatgatttagttcttttttatggctgcatagtattccatgctatatgtacctcattttctttattcagtccactgttgatggacacctaggtggattccgtgcctttgctattatgaatagtactgtaatgaacatacaaatgcatgtgtctttttggtagagcaatttgttttccttagactatatactcaataaagggattgctgggttaaatggtagttccaattttagttatttgagaaatctccaaactgctttccacagtggctgaactaattacattcacatcaacagtgaaaatgggcaaggacatgaacagctgcttctcaaaagaagatacacaagcggccaacaaaaatatgaaaaagtgttcaacatcactaatcaacagagaaatgcaaatcaaacccacaatgagatatcaactcacaccagtcaggatggctattattaaaaagtcaacaagtgacagatgtttgcaagactgcaaagaaaagggaacttctataatgtttaaatttgatctgattttatttctgacaagtttcataaacacttagtaacccctattttgggcataatattctattatgcattatggagctatgttctttgtccctgagttgtcctcttctgttgcagagattaggcacacatgtatataagagtcagagaataatgctaccatgagataaaccagtggggatgatgtgatggagactgcctctatataaaagctgaggggattcaaaacaaaaaacaaacaaacaaaaacactgtagagtgggcttggttagaatgcagtttccctaatgggtaaaactttcatttactctctgaaggaactctaggcagtctcacctcttttctctgtcatcttttcctgctattctctataatgatatttccaacatttgatccccatctctccacatccaatggtcagcaattgacctcccttacttcctatttcaaagagtaaatagaagacatcccactggacgtctctcaatttcccaccataaacatacacatgcactcatattttcacacatctgtacttagatacatgacactaaccatgacaaatactttttggatctcatccattcccatcttctggggaaacatttcttatttgttaggtcttctctcttaacttctcctcaacaatatctcattagcatttttcaatgaagggtaagcttgtattagtctacacatatataggcatacctcagagatacttcaggttcagttctagatcatcacaataaagcaattatcaccaaaaagtgagtcatatgaatttttttgtttcccagttgtcttagcccatttgtgttgttacaaagatacctgacactgagtaatttataaagaaaaaaaggcttattttgctcacaattttgctggtcagaaaactgggcatctgttgaaagcctcaggctgcttccatttatggcagaagacaaaggggagccagcatgcacagagatcatatggtgaaagaggaaacaaagagagacagggtggtgccatgttctctttaacaatcagctctcatgggaactaatagagcaagaactcactcattacagagaggactatgccaagccactcatgatagatttgcccctacaacccaaacacctcccatttggttccacctccaacactggggatcaaatttcaacatgaggtttgcgggagataaacattcaaactatgccaccagtgcatataaaagttacatttatactacactgcagtctattaagtgtgcaatagcattatatctcaaaaagcctttacttaaggtatacatttgaattaaaaaatattttattgctagaaaagtgctaaggatgatctgacccttcagtgagtcacgacctttttgctagtagaaggtctcacttcaatgctgatggctgctgattgatcaggatggtagatgatgaagactggggtggctgtggcaatttttaaaaataagacaacaatgatgtttgccacatttattggaatttcctttcatgaaaaatttctttgtagcacatgacgctgtttgatagcattctacccatagtaaaacttctttgggaattggagtcaatcctcttgaattctgccattattctatcaactaagtttatggaatattctaaagactttgttgtcgtgtctacaatgttcacatcgtcttctttagaagtaaattttgtctcaaaaaaacactttctttgctcatccgtaacaagcaactcttcatctactcaggttttatcatgagattgcagcaattcaatcacatctttaggcaccacttcttagtctagttctcttgctatttccatgtctgcagttacttcctccactaaagtattgatcctctcaaagtcattaatgaaggttggaatcaatttcttccaaacttctgttaatgttgatattttgacctcctccagtgaatcatgaatgttctcaatggcatctagaatggtgaatctttactagaatgttttcaatttactttgcaaagatccctcaaaggaattacaatctatggcagcaataggcttatggaatgcattttttaaataataagacttgaaaattaaaattactccttgatccatgggctgcagaacagatattgcgttagtaggcatgaaaacacattaatctccttgtattcttccatcagaatttttgagtgattaggtgctttatcaataagcagtaatattttgaaagagatctttttttctgagcagattacaaaagtgggcttaaaatattcagaaaaccaggttttggtcataatcccaaaagacacaatctcagatgccttagtcctgaatgttataatcccaaaagataaacatcctgaaagtctaatatcctgataaccacaatcctaacaaattaaaatctcaaaaatataattctgaaaaaataattttaaaatttatttaaaagacacttatttacatttttaaaagtggatttgagaaacatacaaaaacatgacagaacacttcataggaaacattacacaatgaaataggcaataatacatatatattttggcaaacatgaacacttagggatactaaagacagttgcctaggtaatttttgcaagtacatagcaagcgtatatatttattgagtacacgtgactttttttttttttttttcagacagagtttcactctgttgcccaggctggagtgcagtgacacgatctcggctcactacagcctctgcctcctgggttcaagcaattctcctgcctcagcctcccaagtagctgggactacaggcatgcgctgccacgactggctaatttttgtatttttagtagagatgaggttttaccatgttggccaggatggtcttgatctcctgacctcatgatccacctgtcttggcctcccaaagtgctgggattacaggcgtgcaccactacgcccagctacatgtgatgttttgatataggcatgcaatgtgaaataatcatatcatggaaaataggaatatccatcacctcaagcacttatcctttgtgtaacaaacaatccaattacactccttttagacattgattttcgactgtggggtgagttgtcacccctcgccccctcattgttcaagggtcaactgcaacgtgttttgttacactagaagaacttctatatcagcaagtgttattgattcagaaggttgccgggcttgttgaaatatatttattctctgacaaaaaacaattttgaaggcaagcactggcattatgtgtcaaggggcagaagtcatacacaattcaatcatttggcaagggagtttttgttttttttttgtattttttgtgtgcattttcacttctataatcttcaaaaacacttgaaacatcaagagcagatattccccacccagtacactcagactcacacactaatctcctctggaaatatcctcacagacacagcccaaatagtgctttaccagtgtattagtctgttttcacacttctaataaagacatacatgagactgggtaatttataaaggaaagaagtttaatgtactcatagctccacatggctggggaggcctcacaatcatggtggaaggtgaggaagagcaaaggcgtgtcttacctggtgacaggtgaaagaacgtgtgcgggggaactctcgattataaaaccatcagatgtcatgaggtttattcactatcacaagaacagcacaagaaaaacctgcccccatgttcagttacccccgactgggtccctcacatgacttgtgggaattatggtagctacaattcaagatgagatttgggtggggacacagccaaactattatcacccaggttttgaggtgtccattaatccagccaattgaagcctaacactaattccaccccttatcaacttgggatccattgcatctcaaaccatacttaatttccaaataaagacaataacaaggtataataatagttctgccaccatgatgcaactaatatgatgcagctatcctgcatacaactgaaaattcattaatccctttcccagaattaagctttcaagatttcaactttaggattttaatctttttggatttggatcttctgagatttcaacattggaattatggctttcagaactgggactttcaggattatgattggcactacagtaaaccatgctgtcatccaggctttgttcttccaattctagaaaataggcagagtagatttagcataattcttaagggcccacaattttcaatatggtaattaagcagtggcttaattttcagtatggtaattaggcagtggcttccacttaaagtgaccaggtccataagttcctaacaagagagtcagcctgtcctttgaagtgacttttcctctttatctatgaaagttctaggtagcaccttctttcattagaagactttttttcctacattgaaagtctgttgtttagtgtagccaccttcatcaatgatcttagctagatcttctggataacttgctatagcttctgtatccactcttgcttcttcaccttgcagttttatataatatggatggcttctttccttaaacctcatgaagcaacatctgctagcttgcaacttttcctcttggtcttcagagaattaaagaaacttagggccttgctctggattaggctttggtttaagggaatgttgtggctgttttgatctatctagacaattaaaactttctccatatcagcaataaggttgttccactttcttatcattcatgtgcttactggagtagcactattaatttccttcaagaacttttcctttgcattcacaacttggctgtttggtgcaagaggcctagttttcagcctatcttggctttcaacatgccttcctcactaagtttaatcatttctagcttttgattgaaagtgagagaagtgtgactcttcttttcacttgaacacttagaggccattgtaaggttattacctgacctaatttcaatattgttgtgtctcaaaaaacagagaagctcaaggggagatacagagacaggggaatggccacttggtggaggagacagaacacacacttttatcagtgaagttcttgatcctatatgggcacattttatgacaccccaaaccaaccataatagtaacattgaagatactgatcatgtatcaccgtaacagatataataataataataaagtgtgaaatactgcaagaattaccaatatgtgacagagagacatgaagtgagcatatgctgttggaaaaatgttgccaatagacttgctaaacacaagattgtcacaaatctttgatttgtagaaaacacagtatctgtgaaattcagtaaagtgaaggtgcaataaaatgagtcatttttgtattgtaaacattctcttatttgctcttcaatccctaccactttattgaaactactgtaacaatgactttcttgttaaataatctactgaacacttctcagtccttaattcagttgttttttcagtcctatgggctcttaaatatgctcatttttcactctgaaaaaaaaatactttccttgacctagcatttattagctggtaccagctcctatccctcttcacaggccaattgacatctctactttcatcttaaagactcttcaaacttaactttttcaaaatagatttcattatcctcccactaccatacctaaaatgaaccttttccagagttcccaaattcagtaaatgacacttctgcacacagtttcatgcacaccagggagctaggagtaatctctaatactgcccttcctcttacagcactcatataaaattcatctccatgccttggcatgttcactcccaaatatatcaaattaattcatttctcttcttcttcaccagcaccctcattcatgctgacaggtgaagccagctgagcttctgggtcaggtggggacttggagaaccttcgtgtctagctaaaggattgtaaatgcaccaatcagcactctgtaaaatagcaccaatcagcactctgtgtctagctaaatgattgtaaacgtaccaatcagcactctgtaaaatggaataagtcagcactctgtaaaatgggacaatcagcactctgtaaaatggacgaatcagtgctctgtaaagtggaccaatcagcaggatgtgggcggggccaaataagggaataaaagctggccacccgcgccagcagtggcaacctgctcgggtccccttccaggctgtggaagctttgttctttcgctcttcacaataaatcttgctgctgctcactctttgggtccacactacctttatgagctgtaacactcactgcaagggtctgtggcttcattcctgaagttagcaagaccacgaacccaccgggaggaacaaacaactccagacgcgccacctttaagagctgtaacactcactgcaaagggccgcggcttcattcctgaagtcaccgagaccacaaacccaccagaaggaagaaactccaggcacctctgaaggaacaaactctggacacaccatctttaagagctgtaacactcaccgcaaaggtctgtggcttcatttttgaagtcagcgagaccaagaacccaccagaaggaataaactctagtcacattttggcaacccagatgggacacattttggcgaccatgaagggacacattttggcgaccacgaagggactatcccctatcaccaagcgatgagtaccatcagacccttttcgcttgccattctgtcctatttttccttagaatttgggggttaaataccagacacctgtcgaccagttaaaagagattagcgtggccactggactaaagacacgggtgtcaggctatctgggaaagggctctctaacaacccctgatttggtttgcctggaactatcttccgcttttcctgtacttctgggctgagccaagggtcgacaaagaagaaagccattcaactccggggtcccaacaacaagttgattgaccctgcggccatgagcagaactctaaaagtcatgtggcccaaacaagactcacccatctatcctatctattctgagccttgcctcctgggtcctaacgcctgtcagacaaacttcctcttgcctctcttctctcatctcccagggtagttccacttctaaaaaccacttcctgtctctggtgcttttttagtttctcctataagaatgatttctagtataaacctcaagactctattcccttctttaggcacccgggctcaccaatcagaaagacataatttttgcccaaagccccgtcaggcaggggactatctggaattttaggatctctcctcagactagcaggcctaacaaaagttctccaagtccccacccgactcagaagctcagttggcttcacctctcagtaccatgcctgggacatagcaggcaccctgtaaatatatattgaattaataaaggagggaagatagatgtatacacagatttgaatgagcaaaatgaataatggtgatgagctatagaagactcaggctgtttaacaaaggttgcaatgaaaaactagctatgggcaacagaacagttctgaggacaagaaatttaagattttcctcttttccattgttttttcttcagacaattgtaaagagaagattttcctgtatcctacaaaaagctgtatttctgttgccaagggctctcctcagccacaggcttaccagatgtctggtcatgatgactgaagacacttttagtttattctgtatacatagtatgaggctccagaaggccaagaaagtccctagacctgggattttggaggaggaaagtggtgattttctctttgctctaaaattatgtgagttgtccttactctgcatgcaatattttgccctctttaggggtagagtagaattagttgcatcatttgtttgacttaatatgttatgtttgggcaacatacatgaaaggaaagccattctttaaaaataagctctcagaataagtactctaatcaatggataggaaatcaatgaatagcttcaaacaacactataaatcataagataaggactgaagagagtatgtgctggagttttacttttatcatctcattcaatcacagagatgactcaaagaggctaagacatttcctaaattaagtaagcagtggagataggattttaacccggtactgagtgacttcaaagtccatgctctttccagtgtacttcatatagtgcaacgaagaataaaacctaagtaccttgattctacagtttggtgacagagaggattgtattcccttccacagcccagtttctttccagattctgcgcactgtccaaatgcacagggactggattagatgagattctttttttggttttgtatagatcttcctatagacctcaagctttcagagagtcataaaacggccattccgtgtgtactctagaaaactgcttttggacaaagattttagatattaagttttagcccagaatgcatttttgcatcaaagttataaacagagtacaactttttaatgtaaatgccaatacaacttaaagaaaaatggtatatgaccaaatccattgcagaaacaaactgactctttcaacaaagtattagcatctttaaagagaggatatatttaaatgtgattacattatgcaaaaattttgcttctacaaaatgtaaattgaaatagccttcaagatcaattatcatgtttatttttttttaccataggttgataggtttagccaatccagacgtgaatgccattaattattttaattaggtgtttgttctgagttggatgaaaatatatggaccagccaatgaaatattcaaatgtttgtacatattttccctcactgctatcccttctccacctgctccagtcatgctcaggtttggggttttgattagatgcttcttgttgctgaagcaagggagtcagtacattaatctaggcttataattttataaggcaggcaaaggactatgctgcctgctgccaaacaggacctccttgaggagctacagcaactaatgttccattcttgtgtcaagtgctgttaaaagttttcttcgggccaaagtttgtccaaacattttgtacaaatctgcagagctcctgcgtagctggaggctgcttcatgaagtttggcactgagtcctgctttgtattggtagtaggaagctggctgtagctacagacatggccttgtggaacagctttcgctgcgtggactacctgaggctagatctaatgaggtgagtctgagcatagtatgagcacaatcagaaaagcagaacaaaaagtcagaacagtaagcagatgcaagcaagtcattgacaagaaagcctccatgtctcttttatatacttcaggcacattaacaacatctctttgttatttccttgaatttctagctttgatatagataatttataagtacaaaaaacataaagaataaacattttaaaaagtctgtaataattattactaagagtatactcctgttcatatgttgtatggccttctattttaacattaaattgtgtgaagtacccatctcctgaatgttgtaggaaaagctttcttaaagagacataagcagtatgaagttttcaagtgggattattcgcttggaagagctgtcattaatgtccccatatctgtagctggtctataaatagccaccaatacccaaattaagagcacttgatgatgtccgtgtttgttccgcagtggtctaacaataccagataaaagagaacatgatagatagggagagatgcccaggagagttcacaagacattcacctactttgtatctagaaaaaaatcattataattgcactggacctggcactccataaccaaaccaatcacttgcgcttctaaaggctccttcatcaccaaaggctagaacatattttccaaaaatacttttcaggaactcaagtagccaaaaccaaacgtaccaatggttctgagttaggaaatacctttcaaagatatagaaattgtaaaagaaatcaccatcagaaaaaaattaaattctatgctcttattaagtaaattaactcatataaacatctaaacttcatacatttcagttatatcttacactatctgaggtaagtggaagtaagtcaagctgtgagagagttcattgctcaagtgcctttgagaggcaacatagattttaaatgcaaccaccttcagagttctctagtgctgataataataatataataataacaataaaattaacatgaattgagcacctactatgcaacaggaactgatttaggcatatttatatgttgtctctaattctgaaaataatctttcaatgtaggtaattatttttatttcataaatgaggaaagtaaggcaaagagatattgaaaggtcatatggctggtgagaaaaagacgattttaacaaggtctgcttgactccaaaactcatgtccttacttcaatgcaatacgcccttaagtgatggccgaaaagatcaaaagaacaaagatttatctacactgaaaagcccaagtaatgctagtgcatgccaatgcactgttaataaccagtaacagtacaccacccaaggcaaatctccttgcacatattaccagggatctctgctttgccatcagtctctccttccttcaacaccaccccaccatctctaccacaaactcaagccaatgcctcagttacttaggttagagaagagaaaaatctgctactctgagagtttatataaactgaaacatgccagctacctggtcatctaagaactgtcaaagaaagagaggctcataaacgtgaatcatcctgagaattaaggttattggagcattatatagttttgtattttgaatgatttttaaatttgcaaatgtttttggtagctacagttaaaagacacaaaggtaattctgatgtcttctccaaaacagctttagaaataattttagttttttatgtgttgactcatgaccaacatttatgaatgtcagtcaagatataaggttgtaatattccagtgccccagaaccaaattatatcataaagcgtaagagcttgttattgcttttaacacttctttctttccaagctgtcagatgccatttctcttgactgccaatatagcaggcttcagcaatgtcctctcttgaatttccatacacctgctctcattacctggattttctaattggttaggtaataaaatgccatgattatacgagatatatctgaaaagtctctacaaggcattatgggtctctcatgttcaaacatgtatgcctaagaaatattaagaagacaatacagtaaaatcatagaataagttatcagtaaattagttgtgagcactgaaatactgatttagtacacttcaatgccatttttagtatttctcagtttatgctatataattaaggtttgtgggtattaaataagtaaaatattgagtacagcccaaactcctgtaagttgatgttagagagaataagtactctattcttccaggtactttttttgacacagaaacagaagtactgaattggaaaaactatgattccatcccattatggtattttgtactcctaatagcttacaaattattgaatcaccatattctattagtagctttgtacaaacctgtgaaaaaataatgctgtagcacacagctctgtcacgaaaccatctctgggagaacatttcgtattcaattactgcaacaaaggatgaaaccaagaagcagaaagatagagcttagcaaccccttaaagaaagcccattattaaaattccttcagttctgaatggtaggtcatgctgaatttctaaatagtcagtcttgtaaccctctttatacagtggctatatacatggtcttctccaaataaataagatgagattagcagttccaacagtactgtgaagaaagaccttcaaatgtgcttttgtggctgccaagatggtggttcaacactccaatactgtcaaactgcaatgcatagaatccatgtggcatcttccacgatacaaagcatagctaattaaaaaaaagcctcttctaaattcatcatttttacagctaactcaggagcatcaatttgcctatagagatagtaaacaatatcagaaacagagccaaattgggaatccaaaggagtcattctggctcccctacgtgctgatgatatgttgccaaaataagttattttacttctctgagtttcagtttcctcatctgtcaaacaaggtaagaatatgttccctattcaacccagagtaaatataaagtctgtgaaagtattttaaacacttgcaagaaataagcaactcagaatctttaatggtgctatgtcatagaaaaatagcccagagaaagtcaggcatggattatgagtaggtagattatgctctcaggaatcctagaaaagggcttcttaatattctcaatagaaagccaatacattattttagcaaatgaaagttttaagtattaaaaacaaacatcaaaagaaacaaacaaaaattcccctttcataataaaaacaaccaacattagtaattaagggaacttcctcagcttgataaaggacatctacaaaaattgcacagttaacatcatgttcagtgatgaaagactgaatactttccatctaaagtcaaggaggtctgctggtactaattctatttaacattgtactgaagattctagccacatcaattgggcaagaaaattaaataaaaggcatccagattaaaaaggaagaagtaaaactttctctatttgcacatcacatagtctcgtacagtatctagaaaatcctataaaattttctaaaaagctattagaactagtaagtttggtaaggttgctgatacaagattaacaaatgctgattttacttctatacactagaatgaccaatgtaaaagtggaattaagaaaacaactttgtttacaatagcattgaaaagaataaaatattttggaataaatttagcaaaagaagggcaaaacttgtattccaaaaactataaaacattgtagaaaaatttaaagaagactctaataaatggaaggacattcatggatcagaagatataatactgataaacagcaatattcctcaaattgatgtacagagtcaatgaaatctctatgaaaatcccagcaggcttctgtagaaattcataagctaatcctaaaatgcatgcaaaaatgcaatggacccagaatagccaaaacaatcttggaaaagaacagagttggcgtctcacactaccaaatttccaacttactacaaagctaccataatcaagacagtgtggcactggcaaaaggatacacataaagattattgaaacagagttgaaagtccataaatggacacttatacttacagtcagttgattttcaacagaagggaagggacaactcgatggaggaaagaatagatttttcaacaaatgatgctgcgacacttggatatccatatatactatatagaaagactaactcaaaactgatgatagacctaaatgcaagagctaaaactataaaacttttaaaagaaaatgtagaaggaaatctttgtgaccttgggttatgccaagcctttttagatataacatcaaaaatacaggtgaccaaaaaaagataaattagactttatcaaaatgtaaacattttatgcttcaaatgccattaccaaaaagtaaaaagataacccacagaacaggagaaaatatctgcagatcacatatctgataagggactaatatccagaacatgtaaagaactcttacaactcaataataaaaagacaaaagcattaaaaatcggtataggatcttaatagacattttaacaagaagataaacggtaataagtacatgaaaacacggtcacatcactaatcaatagataattcaaaatcaaaaccaaaatgagatactacctcacacctattaggattgttataatacaaaagataggtaataacgagtgtttgtgaaactgtagaaaaattaaaactttcatatattgctagaaggaatgtaaaatggtgcaaatgttatgggaaacagtttgacagggactcaaaaagttaaacatagagttagcatatgacccagaaatttcattcctaggcatatacccaagagaattgaaaatacatgtccacacaaaaacttgcacaaaaatattcatagtagcattattcataacatcaaaaagtggaaacaatccaaatgtctatcaactgatgaatggataaacaaaatatggtatactcatacaatgaaatattattcagcaaaataatgaagaaataatggatggtacaacatggacgaaccttggaaacatcaggctaagtgaaaaaagccggtcacaaaggctgcatattacatacttccgcttataggaaatatctagaaagggcaaatccatagaaacagaaagtagattagtggtttgtaagagctgggaggagaatgggaaattactgctaatggatgtagagtttcttttagggtcataaaaatgtcccagaaatgtcccaaaattgattggagtgatagttgtacaactctgtgaaagaactaacattcattgaattgtatactttaaatgggtgaattgtatggtatgtgaattatattccagagatactgttaaaggattgaaaaacaaaaaaactgatggaaaacaacaataagagcacaaacaaaaaatcccaaacactcataggaagaatgtcataaagttttatattcattctgtgttctattagatctttggctgaatggcaaaaaaaaaaaaaaaaaaaaaaaaaaaacagagagagaaaggagaaagaggtgggtgaatattgaggtccacaaatcagtcaagttgaataaagaggaaattctaaggaaaatattaaaaattacagaaagaggaagctggggacactgagcataaactttgatgacatcaattttaccgtgtgcctatccactattcctccacttagtttctcagatcttgccagcaaccttagggcttgcatcctccatttctttgctcagggcatgctgaatacatgtctatgtgttttctgttttatttcctgtgtaggttttatgtgtgcacactgggaatgccctttcatctttcccatgaaccaatgtccccctccataaatactgtgggttccctttctgggcatatttcaaagatcagtgtaacaaaattattttatatgagtattaccattcccagcagagtctttaaaactagataggaaactggtgtaagtctaaaatactgtaagggccagagcttagggaaaagagcaacatatctattctatcaatctcatcttctctatactttcattgattaagagcccatgactacagcaaaaatgaaattagaggcactctacagaactcacatttcttaaagtaaatcatgccttttctgagataatttcccctctggattcttttccagtcctgtggctaccacccgtatggccaaatgtactctaatcccactgcccaccaatttaaggtcctgtacgctgcaattttctgcaattttcctaaagctatgattatctgataatatcctggcttcgatttataagaggactgctgatagcatgaaaaccttgccctaaaaaataaaaattgtatgtagtctttcgaaagacaactcttcaaagccattctgggtctaatttcccagcagcagaattagtccagagggtgctgccttcatagaagctctggaaacacccagagagcagacacaacactattttataactgggttagatgcttctgagtgccatggtctgtgtatttatgtagggtgtataccaaattaggtcacacaatgcattctgggaaaaaaagggttgggaggaactaccaaaaaaagaaaaaaaaaaaaacctttaggactattgcagaatagcttatgcacactgtattaactggtttcaattagactgaatgatcctgaatgtgggtaatgtgaggcagtctgggagagcatgctggaacaattaacacttcaaaagaacatctcctctggtttctgtgagaagtgtctgtttttactgattcccataaaagagagaaattactttcatattctagagagacatagtaggaagatgttaaagtgtttttaaatgaaaaggaaaacctggccccactccttaaaaatggctgtatacaaacagaaatgaaaatggctgagaatatcaatagcgctcattaatatgacactcctatgtcatcggttcctgccagtcatagaacaaaaagtttctttttcaagaactgcaagattctgctttcaaagtcttaaagagttgtatattaactcctagaacctttttccagaaaaggttctcctacacaggtctaaatgagtacccctgatttactattgggttattgtctgttttttacgctttttctcaccaatttatcctgtcccatgcactcccttctggaatgacctatccttttctttctttccttctagcacttactaagcacttaattatgtgccaggtgctatgttaacacttattatgcattatttcatgtaaatctcaaaatatcctgttgtgtacataaactcagattaggtaaattgtccaaggtcatacagcttactagtagaagagtaatactttactctttccacttactagtggaagagttaatactttaacacaaatttcattcaattctaaagggtgtacccttaactatgaccaaatattgcatcttttgtcttccaaaatccaacttaaggcaacttcccatttggaaaatgtatagtgctttctatagaccattattaaataatgtgttgccaagtataattatgatttatttatacacattgttttctgctatacattgagaaatccaagggtcagttaaaatacgtgttcagtaactacttcttgaataagtaaatgagagttgacatattcagaattcagtgctctaatttataaatgtttatgctatttgagaatttttcacttatctgcttatagtattatatagtgatagaaacctatagatatagcaatgtctatgataagttccataatagcagtcaacttagctttaagaaactcctttcccagcattaatttccagtaactaaggggtgtgcaaatatgcaacaaaacaaaagaatttttgtagccaaatcatgtgtatttatactttgcatgtctaattgataaaaccacacattatagccatttctgagtatacctaataattaagaattgaggatattcagaactgggtttggggatattcctcaaaatgattaaatccatgcatgggccatagccatactgagtggttcacaaatatgctctaaaatgcagcagccactcaagcttcttacagttggtcatatccaaagttctttaattccaagcgccaaatgctaattcttagcctagttcacccagattcagagagctatcattcttcagctgagtcctagaaactgtggacattttctcaattgtttgcagatggcagaagctcaggtagctactgtgttcatattcatggtcatacaaaccaatgaggcatataatcaatttaaatttaaaatgtaagggtaaggaaggctatcattctagtgattaatatagccgcacgataggagagaaacaaactgccacacttttcactagggaagatatttcatgtattcagaaagtttaattatgtccatgtttctaaataattaacggggagtataatttcttttctgctcaaaccccaatctgtacattatagttactactgaaaggacaagtcttaaaaaaaaaaaaaaaaaaaaaaaaaagcctctcagccccattactacataggtgccgagggccaaaaaacaaacaaataaacacacacacacacacacacatccaggaagaaagagaacaaatagttaatagaagccattttcaaggcaatatgtaactggtgacagacatttgcaaagcaatctggaggagccagaaatcaaatgataaaagttctgcacttaaaatgaacttggggcaaatgcagacatgaaaaccaaggcttttttgcaaaatgtaataaagcctaattatgaggatacaatcattccagagtagaacaacaaagagcaagaataggacagtggagaaaggaatgtaggagagaataaactgaatttgaaaaatatacaaggataatagagactatcaatttattaggcctgtaagtatgaattaatttatttataactttcttcagtccttggagaatttatgacagccaagacactctcttaagcacaaggtgaagattttcactatttcctgagagattataaaatgaatattaataccagaatttcatacatatcatagtttttggttatataaatatatgtatgttaattgtagagttaaccgcccattttttttattctataagatgaattaaggtattatcaaattattatttcatcattttttaaatatacccaagtgttgtctgcagtcagatatttgaaatagattataaattatcaaaatcccagtgttagtgcttttttctgagactactacttattacactagctctaggggagactcagtaaacattgctgactagtagtattaaactattttctttttccttttggttgcaagtaaatcaaagaacaaaccctatcaaaaataaataaaacaaaatctaaataattgagaaagaagtaacattgattgtaagttattgaggccatttcacagactccaagagagttttgagtacataatacctaagaagggcagatacaaagcagctttagaggtctaagcaactgagcctcacataactttttccaaactgttctcattcatatgattcaaaattgatgactaccagtttggtatatctccagtacaaatttcaaattcccaggaaaaaaaaattcaactggccctgctggaatcaaatgtcttcctcctggatcagtcagtcctggccaagggcaggctcacataatctaaacatgaccatcgggagcccacctctgtggactgggggttctctgcagagaaagcagatcggtatctgctgcacaactccttcagaaaatatgtgtttcactgggagatataattacttttatgtaaatagcaaagtaaatttatgaaaccagtagcccccagttctatggcagaaatgaaaaagaaacatctactttctgattctctcacctgaccacagcactgagaataagactttaatgctggcgctctgacttgtgatcttcaggaagagtcttaaatgtagttgtttatttgttcctaaggttctacaatacaactaggacctaatctgggattcccagatcccaaggggttcaactccaagggaataatgaaagatgaacgatttataataattcaaaagacagaatcctaattatgcaatttccttgcaacaagactgcacaaagtaataaaatgtgaaagttcttatattaatattttgggctgaaattaccagtgtattagaggatcagaaattcttattggtattatacatgattgtgtttgatttacataggattactgccttattcatgtttatatttccagcaattggcatagtactagacacaactgaatggaattactaaactttgtagcttgaaaacaaaatttctgaaaacacacgttctatggtattctcttaggagaaaagtgttaaagaatgatgaagaggagaaatagaaactaccagcctaagagggtaaaataccattattaatcctctttaccaagaaatctgagagctgtgaaataatttattaaaacttactaaagagaaaaatcaacatataggagattcacatattgaaacttaactcccagaatttctgccatgtaccagggattttactagctgtggatatactaggaccccaaggagcacattgtctccatggagaaacagatgtaggaatcagtagttatgaaatgataccatcagggatacaataaaagaagtgttctatttatgaacaaataatagaattattaaaacacatcctttctcagttcaagatcagcctgttcaacagggcaaaacctcgttatttaccaaaaatacgaaaaaaaaaattagctgggcttagtggcatgcacctgtaatcccagctacttggggaggctgaggcacaagaatcacttgaatccaggaggtggaggctgcagtgagccaagatcatgccactacactccagcctgggcaacagagtaaaactctgtctcaaaaataaaaaccaaaaccaaaaacagaaaaaccacatcctttctctatcataagtagtccctaagcatgcactctcctctgatcatctgctcaaaaattaacatttttattctctgagtctccagcacatctgggctccctctgcactgcaggaatacctccaaaatttagcatcaccatctctccttcactaaaggtgatcccactttctcccccctgccacagataaacaaaaactgaggaaaaaagcttaatctcttacacaatctgagtgaaaatcaggctcccccaggcttactgctaacatagttgtaagacatgttatgtcagtccagtcgtatctttcagcacatggtacctcaacaatagataaagatatttaggaagctccacatattacttttccattgcctacaaggggagtcaaatgaggagaatttccaaaaggtaactttctaattttttgtctccatcatacacaaattatttcatgacagctaaactcatttacagtacacgtaattccaagagacaccactgtcatttctattaggcaatccatgtattacagagtatcatacattcagccactttcttcacacacttcagagtacagaagtagtagcatgagtacatgaaaggagaagtaggatgtctgggatctgttcccagtgctacaattgatgcactattcttactccctttgcattgaaatctcccatctgtagcacaaggataatgacatagtacctgtttgtttctaaggcactggaaaattctctggtagaagatactatgcaaatgcagagactattattacaccaggaagacttgaaaattgcaagttggtgtgctcatgactattaagcagttgacacagtgacaaaagagagagcatctttcttcaaggcatctaaaatcaagtattgctgaatatgcagctattctgaaaaacatatgtgcaaatatattcgttttaatgaccttccaactctaactcatcaataacccatttaaagcaatcctttccaagttatcctgactccaacaaaatgcatggaatccctaatcactgatattttttataatgcaaagctttctgaaagattattctttctccttgcaaaatatttgctttactccagaatttcagagagcattctggctcattccactaagattattccaaaatataaaaacatttatccttcaatctgctaatcttggaataatcaaacttacagtacagtggtggacaggcatccaagcaggggcttccactgaacaattctgggctgggcatctgccttggttttgctgcaaataagtaaaaattatattatattctatttattatgggccagtatgtatatatgctagctgacatgtttattatcaatatgtttattaccttatttataatcatagagagagaatgctttgttggtgcaatgctgcagaaaactaggtacataatttctactcttatcaaagcataagaaattatccttttccttttttgttactctaaggactaggtttctggcaccaggctgtctcagcatctggccttccaggcttcaataccaaccacctgagaactcttacaacccataggctgactgttctcttccaggctcctaatcaaccctgaaacatgctgtactcctgtaagatcacatgagtcaaggtatagaatggctgtttatttgtctctgtttccagactataagctagtgatggtgattctctctagagtgtttcatagaactccagaatgttgggttgaaagggatagatctcagaggccttcttatcacatgaaaaactgaagtgcagagaaataaaacaattttctcaaggagtcagaaatttgacattctaaaccattttccaggcacttctttatacaaaagaaatttatctctagttaacctatacttttgttgtaattcctgtaaatttacttctaattggcttttaaaaataatacagtgctttactttcaccaacaatactgctacacccctttgataatgaaaactgattagtccaaaagggggggaaagattttaataagccatactttatcttttatttttttcattgtattctcagtgataatataggcatacttataatattaataatcgccataaaaaccacagctgtgatttactgaacaactaaatatgcaaggcactattctggacacattatattattactagtccccacaataaacataagtaggagtattatgctcactttctagtggagaaaacagagacttagagaggttaagcaacttggctaaaactcaacctactagacagcagcatctctgagattgcagcaagactctggctgactctggtgcccatgtatgctctttcttttatgagaagttgcctctgttattttagactgtctctttaatgggaggtaagccatgtcatcatccaatctgattttatctaatgaatgatcctaacatttctgatttaactgaataaaatactgaattcagtactcctatcacactaaaatttttgcctgtgatttgtaagctttttagagcaactttatttggttgatctatttttaaggcatcactaagccctaaaatgctgtatgagtgactatggataaagtcatcataaaaataaacttatatcatcaatctccatgatcaatttctttaaagcaaaatatgatatgcagcagcagcagcagagtacagaaggtacactggtcagataaccacaattttaagctaattttggccatgtgcttgctgccatgaaatgctcttgacagtcacaactgtgaaacagtgttagtattttgcctaattcacagataatagatatagattctcctcagatcattatcacaatttgcaaggaagctactaatgagaacacacaacatattcacaaaatatgacgggtgcataaataaggtgtgtttcaacttctgcggtgctcagcatgggataaagaaagatggaaatgtgtgtttctgttttgccttctattattacctgatttctgacactaagatcttctcgtacgtgttttaactaagaaaattaacaatgattttacaaggccagacaaataaaaaagactagtgatgacacatgtcatgtgaacataaattattctttaatcctattgtatgataagcaaaaaacattgaaacagaagttagaaccttggattttagtttagtgttcccattgatctacctgtggaactttggaaaactcactttaacactttagaccacacttttctcatctgtaaaatgagaaagtttcttggatccatcattcaatgtggagagaggaagagccaaatctacccaaagatctttcccaaactttatagttctaccaagaatttaatatttggttttatctaccaaagtggtataccctgcagttgagatcatttatcattctgatatactgatgagacatcttttagggtcttgggaatatgaacaggaaatggttatttccctgtgagtttcagtgctagcaaagatccacaaccactagactagatggtctcaaaagagccttccacttaagtgtggttactgaaaatcctaacctcatgttttgtctaccacttcgctctacttctaaagaaggcaagatctaacatggatcagggaacctaccacagcaggtggagaaggaaagggatttaaaattctttttcctcgaagtcttcattctccttcttcagtatcttttgtttttaacatttaatgtgtacactgtggcataacagagtttgggcctacctcctactcaaaagagtaggaggtcagctccttagaagcccagctagaaccagaataaacactaggggaaaggacactatcatgtctaactcttagttaattcttaagccaaaaatcaagggagaacattagaattccctcaagggagaacctagctctctaagcaaagatttaagatagaagttggtgacaaaaggtaaagctttcccaccttccttctgtctcattcatctatccaggatgtttatacctgtagattagtgatatgtgactagaccaggattcggggatttgcaatgctgaccgttaaaaacatgtcctcttaagagacaaaactatcaatgggtcttagtcttttaaaaacagacaggttgatgtctccaaacctctcatcttccttggttatctgtttctcactttagaatcttgacatatttcattccagaatattctgagaacattagctaaatatgctgaccaattacacctgagattgattgtataaatatgtaactacaaagaactcgaaaagtgacctagagaaccctaaagatgttcttctcaaacaaccccatccctccaaaaacatgggaatatttttttttgtgtatcaggggcttatacacagttagagtgctttggagtttagaaatgcttatatatacattgagccctttcatccccagaaaaagttgtgtgtggcagagtgagagatgattcatacaaataaaattttgacctaaatgtttcattaaaatagcatgttcttttgaaagcagagtaagagctgaaaggttctgttgttctactgttcacagtaaaatgatcctcataaacaaaggagttttttttcggggtgggggtgcggtattgagaagtattgcatgatagaactgtacacatatttgctcattcatttacccatccctcagttaccaaaatacactccatgaatggtacgttaggtatacatatagattttaaatttagaactaaaaaatttaaataatccttattctcctaaagcccccaaccttttaggagatacaatacaatgtgctgagtttaaaacagggttaaataacaggaccattcatccattcatgtagttggtcaacaagcatttattgagcaattactaagtgccagctattgcattaggaataaggatatatcaagagtcagtatctgcctaaaaaagtacttattctaaggagaaagataaactaataaagctgcagttataaagcaatattactgatatgggataaataaaccatttcatgacagatcaaaaatattcactgcactcattcttggggcaggagtaagaaatgaacaagcgtaagggaaaattatacagaggaattgaggcaaaaggtggaagtatttaactctggctgggtaattcagaaatgtctttttgaagagacacttcaggtttccaacacagttttaaggaggcgaaggtgtaagaagagggcgttacaggctaaaggtaactcaaaagaccatctgatagtgcaaagtaaagacattattggccttgtcaagaaactcctcaattctggacctcagaatcccaggactgaggagaaagaatgattttatgctatacagagagctgagttcagcctttccctttatctcttcttcacaagactaaatggacagcagggtgtgggataaatgaatcctaccaggaagtggacatggaaggacccagatctgatcctgtaaaacacacaagaggccctcctgagtttaatctttgaacaagcatttcagctgtcttactcatccgtgagactctaaggtatttgacagatgaagaaaaagaggtcaaaacgtgatgcccaaggagcagaactaagtggctttttgcatgcagaactaaaatgacatgcaataatgtgtatgcaaatggactgtgagttgtaaagtactttagaaatgtaatggataattataaagcattaattatttgaaaattaattttatgagctaattcttgttattaaaattactagaacactttctgacttctagtccaatatactctctagcacatcaagagttaaaaattttttcaaaaagtttgaggaaaaacgactcagaaagtgcctccaaatcatcaatttcatatatttctaaatatagagatataatatatatctatatttgtatgtatgtatctacatacacatcatgtgttcattatgcatcatccacataatgtgtctatagatacatatatacttacaaatatgatttatgtgtgtgtatacaggtgtgtattaaaaaattattctggcaaaataaaggttttcattgaattagttttctaatttcccataaagacatgtaatttcagagtgagatgtttaaaaaaagagaagatcaaatcttgccatgtgctaatgtaaaatacattataggtggaaatatgtgcacaaaatgttacattggaagtcctaagacaccaagatataaaaatgagattccaaaggaggctagaccacgtgtgcaatattcaaataaattaccaagaaccaacttgaggatcctgaatcctatctataatgtaatataatgctggtatacaaaagttagatgactaaagatttagaaagggggagaatatctttgaagaggggttgagaagtcttacatatcacctacaattagcaaaagaaacttcaatgggactgcacctagagcttaacataacttccttgggtttaggaggtcagtatactgggatttgactctcacctaagaagcttaaccagtgagataacgtggcaaattggttcttaagtgagaagtggcttcatatgggttagcctgcactctcagagttcgtcaaggcaaaagattcattctggagccattgtaacacctgtcaagacaaccctccatatagggtgggctgctgtaaaatgtgacgctaaggaaatgcctcatccacatcataggagatttaggcccagaaggggaaacttccaaagactgaggaaagtgtccatgagggaaaaactcaagccagacattttctggctgcgttaaaatcccagatccactgtttgctagctatgtaaccctaggcaagttgctttacctctctttgcattagttatgaagattttaaaagttataagtaaagcacttaaaactatttctatacataatcagcactatttgtcagtaattttcttcctttttggttattcttactgttattatatgtcaggttcggaaggcaaaaaacacaattccagtttaataagaactttccttgtctccttttcttatttccctcttatgctccaaacttggaaggatcaataaccaactagtaaataggtaaatagaaaaaaaaaaaaaagtaatcgtaaataggaataaaaaaaaaaactagtaaaaaaaaaaatgaaaagagaagtctatgacatccccttcccccaaagcagatgtcctgtctgaagaccccacagtggaaaaaagagaatctttcatctggaatgtgttcagaattttgactaatatttgggactgagcaattttaattaatacattgggactgtatttgtgatattaagtgattgtaggacttttcatttcctgtaaatggaaagttatgagaatacccgttttcatttagagggcagggtaaggaccactgacattaagccattttaaacaaacaatggggaatccaaaataaaatgacttctattattacatcccatgagtattccttgttcaatgtgtcaattacagatgccaaacatactcatggttagtgttaacttttttcattcaactttgggcatattcctcaacatatgacttcatcccttcctgggcttatccttccatttgcttctttttattttctcaggcttcaaaagatgtttaaaataagttggcctaatttgtttctgaggaaatccttactaaaactgaagccatgctggggagtcatgaatttgcctcttttgtaaatgaagaaaatgctgctgacctattctccaaaggatgctgagaacaagcgtttttcagtgggcagtgatgatggtgctgagtcatcctcaacacttttcaaaatcctttgtgacttcaggcagacatttgcccaggttaacagaggtgcagtctgtggctaactagtgcataagaggattaaacactctacattaaaatattctaagcacctagctacccagattaacagtaatgagtggaataggctctgagttttcaagctggccacattaaaggattataaatggaaaccattgttgtgacttgatatttcagggtatcaatggggagaggacagcgggctttgacttaggaagcatttcctagatgtatgatgaaataatacattgagcaccattagatcccaggcacttgacatgcattgtcagctcattgtatcatcacattaaccctagatagtagaggagagagtttaataccatgaggaactgactggacccgggttacaatgccagagttttcactttttacatctgtggctttggataaatttcttaatctctgtgagtttcagttttctcatccataaagtggaaaaaataaaacctagcttaaggaattattgtaaggattataaaactatatacattataatatatataacatatatgtctaggggcctgatatatactctaatagtaataagataaatactatataatttacatgttaatatctatcttattaattggggatctttctcctgtttcacttagctcctctgagtctatattcttgtatctgagtataaaatagtaatatttatctcacaaggttactatgaaaattaaatgagaaaaagtacatgaaagcgcttagcaaatgtcaagaactttaaacttaagttttgtttgtaacttttttgtcagtatatagaagatggaaagaatgtctgaaatactgcagcaatttaagataactaaatttgggagccaaaaccgattctgcagtctgggattatttacttgaaatcattggttataaatatttctaaaaaatataatatggtattttagtattttatggaggcatgtcccaatattctctgaagctctgtcagtctccaaagtttgagttattactatgcatagttgaatgcaatagagtaatttaagctactaaatacaagatttaaaagcatagttttgtgaaatatttttaatgtaattaatatttgcattctgtcattgcatcctagtaatcagatgagaaaaacggaatgggctgtaattgtacttttctccttgcaaaaaggaaaatttggatattattactactatagaaaataaatattttttcattggcagatcttatctattataaactacaaagtctcatggaaacataaaagactgtaacttctaaaacaagctacttttttcttccaaacatatttataaattcacttagtaaaaatatatgaaatttcaggaccccaaaataaagtcaaacctttgaagaaagaaatgccattcagaaacaagatgaaagtaattcacttctattctctctgctaccatagagacaaagaaaaaacaaagtaaagagatttagcacacttaattcttcctgaaatttataattaactacatgggaaaggtaacaattaccatatttccaaagaataaagaattttaaaagttgagcttttgataagacataattacaacctattaaatatgcaattcatacaaatttgcttatgatcttcttgaatttcaaaaaatgcatatacattggatagtgttttctgaaaagtacacatggaatgccaccaagttaattgtacagagctttctcttatcggaggattttctcagttacctaaaatcttggcaaaacctaacacaaagaaaagggtcaatggatattacttgcatatatgccctgtcttcctgacacctatgaatatgtattttgggacaaatgttaatcaacaagaaaatgtgcaggcttttgtagatcaagtgccatggccaacatcaagcaatagccagaacggactagcaattagatatgttctcagtttaaacagaactttagatttctaagtaaattatgggtgtattaattcaggacagttttattttaagagacttgcaagaaaacaccatatctagaaatcctaagagattcaaaacaaagaaagggaggaagagtttattttgcttaaaatgtatactttcatttatggtttctttagcaaataaattttttaaatttttatcattaagaatatcaagaaattatccttgtaatgtcctatttagaactctatttaaaaacaaataatttattttattttagggtatcttaaagacagcatcaaaggttatatttctcattgtaaaagcatgaagtatgcgagaggtaagctaaaaaaattaatactttatgaaatgtgttttcatacaaaaatcaaaattcttgctggcatagataataaatggtatgatttatgtcttgaaatttgacttttggatattcttttttgaaacataattaaatggtcttcgaggagactctactgctaactacattgctgcttggtaaagtggtataatagattattctaagtcatttctgtctaggggtttcagaacaattttaagggaacatttgaaagtctgtaaagcttttaactcagatcttaaccacagaataacgtaacatccattcagctcctgtatgcatagtgctggtgtcatctgtggctagttggacaaattccaagtaataattactattatagttttttaagttccttttgtaggttacttgggataaagccatttaatgatactgatacactttgttctctgaaatgtaaaccagtataaaaaagtagccgaactgctgtgaacctcttcctagacaagtttgtatcctgaaagttgagtaaaacataatgtattccacttaaaaaaattatattatttctccaattattttataacctgataatttaggagaataacatcattttttaattttctattgcacacctttctaactcactttaatgttttcatagtaaaatatactacattaatattgttattcttttatagtatatttatgataaatatgttatatatatattataaagtcaaataattttccccaaaaaataccatgctatattaaatcactaagaaattaaatgaacatgagttggcattcttttatcaaactgaaaagcagatctgactgctttagtttttgtttaataaaaaggtgcaattgtcttctaagtattttgtacttaaattttagaaatttcaattatgatcatgataatttggtttatcatagatgtgattcaattgccattttccaggtgtatataaggaattttacctctattagtccatttcttttatacaaaaatgacacttccaagtatcatttcaggctcaccaaatattcacagataagtttaccaattggctgtctcttaactgaatagtttctccatcagagtacaaagatttctttcacaactatttattgtgaaatgcacattatatatacacatgtacatatgtgtgtacatgtatgtatatatgctaaaacatttgtgtatatgtgcacatgagtctatatatacacacacagaagtacatggatatctacataagagtgttgtgtgtgtgtgtagtatgtatgtatgtgtgtgtgtaaattagaggaaggaagaatttcacccactcattcacttattgaacagtgaaatagctatcaaatgtctgttaaatgaaagaatcaatcaacacttgtagtacatctgccagtaccatggtaagtgatcagctataaatacaactaagaacttcccctgtcctcaaggaattcacattctagcaagaaataggcacatggaaaagctaactacacaaccagataaagactataacaaagatgcagacaatgtgcggagaacatggaggctgatgggctcagtctagtaggacaataccaaggaaagtacttaaagagaaatccgcatttagctgaatcttaaaggttaagaaatgtattagggaagtatcaagctaggaagttgagaggtattccaggcataagaaaaaacaggcacaacgaagaaacaagaggatgaaattcaaattatttggggaaaccaaatgttattgattatagttgactaaggcatgaaaggtagtgggatctgagataggcagttaggcaagggatacaacatcgagggccatgtgctgcaggggaaacaatgcagactttatcttgaagggcagtgcttctcaaaccttaatgtgcaaaatcaactaaggatacaaatcaattatcgatcttatgaaaacgcagattctgattcagtagtttcacacggggactaagatcctgcatttccagcagttttctagcagatgatattgcatttggtgaacaaacaaaattttgaataagggagcagtaggggacagggaatccctgaaggattataacgagagttgcagagttgtgatatacatgcaaattatatatatatatacacacacacacataaatgcacacacatatacacacatatatatgtatatttatacacatatacacacacatatttatacacacacatgcatgtatgtgtgtctgtatatatattatatatatatatatatatattttttttttttttttttttttttttgagacagagtctcgctctgtcgcccaagctggagtgccatggtgcgatctcggctcactgcaagctccacctcccgggttcatgccattctcctgcctcagcctcccaagtagctggaactacaggcacctgccaccacactcggctaattttttgtatttttagtgaaaacggggtttcaccgtgttagcaaggatggtctcgatttcctgacctcgtgatccgcccgcctcggcctcccaaagtgctgggattacaggcgtgagccaccatgcccggcctgtatgtatattttttaagggaaggttcaagttaatggtgtggaaaatgtataggagtggaaagataggaaaggtaggaagacaaatagggattctattgtagaaatccaggtaagaattagtgagtctctgaaaaagaccactggtagtagaaattgtaaataaaggacagattataaggaatagaataaataaggattggggctgtgggagatttaggaataaataaaaatcaaggttaactcctacttttctaaccatgacaactgggatagtggcatacaaagaaattgagcacagagcagagtaggagaactgtttatgcttggaagactccagagagtaaacattttccgggaactttcggcttaaatttacttaataggtaaatagaattccaaattccaagaactcattcatttactctcaaacccgtttctcataaaacctgtcatctccaaaaggttagctcgagaactgaattacttagatacaaagaaagtgatatgtgtgggtaagcatattaaaacagagatatgaggggcaaaggttattttcataggcttttgaatctggtactatctttgaacgcacaaatggaagaagaagctaaaacatttggtatctttctctcaccagtaagaggctataaacctgcaaagtattattcactgaagccagaggaaatccccatcaccatgactacacaaatagaaatttgccaccagagtggtaactagctaattgaattagtgaaatttatccttcagtgtcagactcccagaaatgaggaaatgagagagaaagaggagagggaacagaaacaccatcagctgctatttattggctatgtgtatacatagttgctacactaaaccttatgtgtatgttggcactagctactccccttgtctgggatgttctttgccaagaccttcacaaaggtgatcctcttagatcttcttttaacttaagtttgcttaagtatttatgtgacctgtgtcacttaagattacttctaacacatatacagacacagctctcatttttctctaccatacggtgatgctaatggtaatgaaagatgccaatttatgctaggatatcttattttcaataatttctctcatcctttccatgtatagagtacttcgtacttttcaaatatataaactaatttgattctgtacaataatcctgttcaggaactactgataagccagtattattaccccatttcagacttgagaaaaataagggtcagagaggataaagtgagtttactaagattactagtataataaatggaaacctcaagtctatattttctgaatcttgatccaacacatattctcagattgcctttggtgaaacatacatacatgcaacaagacaggtccctcaggtagctataatcatgggtaatctgctttaagaaaatcttatattccaaacattcaaattaaataatggataaatactaaagggcagtgatgaattcttttttgtacatcatgaaagatttataatattttttaaagttttgagcacagtaaaattttttttttttttgagacggagtctcgctgtgtcgcccaggctggagtgcagtggcgcaatcttggctcactgcaagctccgcctcccaggttcacgccattctcctgcctcagcctcccaagtagctgggactacaggcatccgccaccatgccaggctaattttttgtatttttagtagatacggggtttcaccgtgttagccaggatggtctcgatctcctgacctcatgatctgcccgtctcggcctcccaaagtgctgggattacaggcgtgagccaccgtgcccagcctgagcgcagtaaatgtgtaaatgttatctaagttgtaaaatttcatttgcagttgtttcctctgcagacccacatttgtctgagaatataagatttatgtaaaggtcttataaaggacaatactctcagtctcatagctcttcatagcattgtgttgtttttactcacagaatcaaaaagggctaatgttatgaagtaacatcctgtaatcatgtttggagggaaaaccatttactacagatgtgttaacagatgattggtatgattcatataataaagttttattttatttctaaaagtttagttttacagactatggatatatgtctgaaaaactacaaatctacaactaattgtaattttaaattaagccctatataagtgcattgcttttatttaattagatatttaggttgagaaggaatgaaatgcaaagtatattatcaagagtatattttaactaaataataactttgttgtgattcaatcaggagagaataatagtgaatgggaacatggatattagagtcataaagacttgagttggaatccccactataaaacttattatttctgtgaatgcacctcatctttaagatatgaaggatcaccaggttggtctaaagactaaacgtgtttttattaaattcaagtaccttcaatgtcccagacattatacacacacacacacacacacacacacacacacacacacaagaaaaaggaacacagttcctttccttatggagtttctgtctagtcaaaagaaagacaaaataatcacacaaatcagtatgcactatgagttgctatgtgtggaaatgtggcataaaaatcagagtgtactccaagaatacataaaattttaggaaaggtagtgacatgtaaggtgacatctggaatataagtagaatttagatgggtggatggtcatctagaaaaaaaaataacaaatggaagtcgccgaaaccaaaacatggttgacaccttcaaagaacggcgggaagccagcaaggccaatgtgtcctttagtttaatgaaagatagggaaggtaacacagatttaaaagatggtctcgtccatgtattttcaacattcttggagtgtaaaatacaaggtataatgaaagaagataagacatgagagaaatttaggttctaagtcaaaagagaatcgtatactttggtaagaatttgtgtaactactcatctttcaataggttgctgagagtgatgttgttgggtttgtgtattagaatgatcctcttgcagctggatggaatacttaataaaagaaagttaagctattatattaatggcattagtatttcatatgtctgacactattaaatggttaatcccaggttattaagacagtcatagaatctcttctctttctacacaaaaaggtcaggttatgttaaattttccctactattagctgtatttatgctcctctttgccactcaatacattttttttctgatacatcaagccccctgttccaatctcccccacgtagacatgccaccttgcagacatttggttggaatgacaagaattagaaccagtgtcattggcaggataaatacaagaagtgcaccacaaaaaaagatacaaagataaagaagctatagaccctaacaaagaacagagtgcctactccctacaaggtaatatcctaagcattttatagttcttatctcaccgaattcttaaaacaacgctgtgagataggtaccctttcatggatgagaaaactgcagtgctgagaaggtcatccagctagtaaaaggggaaaccattattttactgaacaggtataagaatgggcaacacaggttgtggcagaaaataggagagagctcaaatcagggggatgaaatgggaaagaagtctgggcaagctgggatttggaaccagttttaatgatggatggaatatcctatttcctttaagataacaaatatctcaacttcatgatatttgtgacagggtgctgatctatctctgcatcctctatatcttgttactcatattggacaccttacatcccagccatattgtccttccattcttgaaatgtgcaattcattctctctctctccccccgccccccacccactctctctttctatctctctctctctccccacacacctgccagagctttgcctaaaacattctcccaaccccattgtggctttcattctgcaaatcagcttaattttcacttcctcaggaaagcctcccgatatttatccctgcctaccctgcaacaaagctaatcaggttctttaggtatccctgtatccctatcctcatttccatagcactctatattcattttcttatcagacatcactgctatttctgtaattggttgttttccccattagacgaaaggttccatgagaacagattgcctgttgtatccccacacctttcaacatgtcaagtgcatagtaagcattcaatatatacttgttagattaataaaatgaatgaataaatgtgatgcttctaccatgggagcaactgtacaccagcatgaataaatagctttgtctatgaacacaagaccactcaggaaaccatttgttgccttggtgatttgtttcattttctctacatgaagctctggtggaaaataaaaatcattttagcttttccaaataccttatttgcaaatatttctgttaagaatccacttacaaaaggacaagatgccaccttttaaaaattaaagtcataataaaaaatattatattcaccagctgtgataaaaatatttttaatgcctggcaataacttttatttcctttcagtaattctgagtgatttttaattcttattaaagatagtgggttgacagaggcaaagagtgaaatcatatttacaaaacagatgtagtattaactacatcaagaaaagcttcttttgtgctgcctggtccacttttcactctgctatgtgaattttattatgtacattaacctgttatacataataaaaatgaatagtaccatcatgcctttattaacaaattatagcagtaacttaacatattgcagttttatttgtagattttttttaaactttttcaaatgtataagtatggttaatggatatctgaaattatgccaatgtgtgattcacccactactactatttaagatacttaacctaaacaattttatcttcagagaaaatatagaataatgttagattcaaaatagaaaaggaaatacctcagagatgcaataaaatatactcattttaaagaaaaagacaatggtggccaaatgcctttgggtgcccatggtcagaaagtagagatttacttttcgcagttccacacttttttctgttcttatatcaaatcctttatgttattacatatgatacttgagaattcctaagcagtaaaagaaaaattctattgactccttgcatttcattaaattaggcagaatattctgcctgcgatccagaactattgtcctattgcccaatcatgtaaactcatggctctgcctaacattattttccttatattttagttgtgaaacttattgggattatttatctttcaactactcaaaacatacgtagggaattccattatataaaatgtgttgcattagttattggattgtgtttagccagtgttattgagatgacttcatttacctcaatgatcatactgaggggtattcattaaagttataaattgtgagttgctgaataaattatactatatacacatttttccatataccaggaattgtgctaagtactttacatactccaccacaacatcacttagacataggtaatatatccttttcgaagatgaagaaatcagtgtttgaggaagttaaacaacttatccacatcttaaaactaatacatgtcagaacaacaatttaaatccaagtctcgctccagtatcctgctattcacactaaaacatgttctttctctttctcagaagtgatatctgtgacaaaagagttaaacttgaaactggacagaaacatttgagaaaaagagatgactcaatcttctgaaagtgggttgcctgagcatttgacaagacttgggatccatgtgacagaaactctgtatttatgaatactctgatgatttcctagtctacaagatcttactccaaatctgatacattctgcaaatcaatctaactagactggagctcttaagactttaaacaatctgagttaaatggggtaagatctaaggtgggattattttatcagagcatttacacaaaatccacaatcatttccttccctttatatgtagaaacaaaataaaaatgattctccatcaccattctaactggcatgagatggtatctcattgtggttttgatttgcatttctctaatgaaaagcaatcattgaaaagtcaggaaacaacagaatgtggagaaataggaacgcttttacactgttggtggaagtgtaaattcaaccattgtggaagacagtgtggcaattgttcaaggatctaaaactagaaataccatttgacccagcaatcccattactgtgtatatacccaaaagattataaatcattctactataaagacacatgcacacgtatgtttattgcagcactattcacaatcgcaaagacttggaaccaacccaaatgaccatcaatgatcaaatggataaagaaaatgtggcatatatgcaccatagaatactatgcagccataaaaaagaatgaattaatgtcctttgcagggacatggatgaagctgaaaatcatcattctcagcaaactaacacaggaatagaaaaccaaacaccacatgttatcattcgtaagtgggagttgaacaatgagaacatatgggcacagggaggggagcatcacacaccggggccttttgaggggtggggggcaagaggagaaatagcattaagagaaataccttatgtagatgatgggttgatgggtgtagcaaaccaccatggcacatgtatacctgtgtaacaaacctacacattctgcacatgtatcccagaacttaaagtacaattctaaaaaattattctccagtatgtctaatagatccttttatattaccattatacaattatattttctagatttatcagcatccctctgctcattaatcttcttacaatctttaggaatgtggaacaaagacaaaaggaggaatttatctctatagtatgtccagtaggggaaaatggcagaactcagagctcacagaggtctaggaggagccaaggggacagtgagggactttcatgccaaggaaagggaaggaggaacaaaaatgctattaccaatggaaatatttctgttttcctgccactaaaaacttgacaaaggtagcggtcagctgtggtatcgaaatgtgctgtgaatgaaatggagcttaggacgtatcataattaacagttccagtctcacataaagcttctgtaaagcaataattgaagacagcaccttagccagagctattggaaagtgaacttattgctgggggataaggagatgagtattaaactaagatataattaaaatttccaaattgtgggcaagtttcttgtcaaacagtcccaagaaagtagagcaagggcatcccaagtgcatggccacttggggaaaaacagtaaagtatcaacagtggtagactaaatagataagatttgcagtctaaagtcctctaagaggtctcttcacctatgtccagcttttgaagcaatcatgcattatttaccatttaaatattacaatgtaactttgctgtatgtttgttctttaaagatgttatatacatcactctagaaatgttcgtggatataactaagaaaatgaaatttcatgtgggtctgtgttttgttgattcgtataatttatatgataaatcacaatactggagtaatgacatttatctcttattaagaatttaaagcaaaataataatatgtatcacctatgtacctgtagtcaataatatttttataagtaaatataaggcatatgacattttttattagataatgttttccaaattgaaggcacttggatttcggtattgatttaatttgtataatatagtagacttctagtttgggttctcattaataacttttgataacttatttttacaatattaattatgtttcacagtatctaaaattattataatttgggaataaataatcataaaacacaagtagatcagatttggtagtattgtctcaagaaaagtaacacaagggtaacacctcaggaagagtaacatatttaagaggatatttcctttagtagattacataaggacatacaatttcctacttaagattttttaaaatttattttagttgatttactgatttaactggaatactgcatgagatgtttggcaatttttaaaagtaaaataaggtattcatctaatttagaggcctagtcaactaactcaactagaagttttaggctttaaatccactaacatcaactgaagctgccatgtgatattaggccatatgggaagatatccattatgattttctggggcttcatttgtaaaagtaatatatttaaggtcatactatggggaacttggtttgtggctttgaaattaaataatcttttcttcagtggtaaaaggagatcacaatgggacatctacacttagttaactctcatgtactaagctattaattttgttatgtttaatagtcatctaatcaacgtgagatacaaaaagatatggttcaaattaactcatggtatgcttacatgcaaaatgaaaagggaactaatgaataaatgtctataattagtttttcccaaaaatattaggaatatctattcaaataatcagtgattataaaatttaaatacattatttagaactgatgacagaataaaataaaatgcttttgaaatgttttgctattttctgtaaaacaaatccataaaacgattgcctattgattttatttcattcccacttttatttatacttccaataatgcaaatatttgtgtataattaaaatagaattagctaaatattaaatattgtgtttgttttaactcagggccttgagatttttttcctttaaaataaatcactaaaatgcagaatatcagaattctccaatcagaagcaatatgtcaagtcacagtaaagctgattggcttcttcaaacacagaagacatggtttttaaatgaaaagctaattatcacactcagaaagactgccctgatatgttaagttaaactgatgtgtatgtgctacactactactatagatatttctattatgagctataaatagatgcaaaagcaaatcctgccataaaaaaaaaacaaaaaacaaaaaaacaggcaaattctccttccatttgcacaaacatgcaatatcactttaagaagttaaaatcacataaagacaggaccccccagaccctcagggaacaaaatgcccagcaaagtaaattatactaatcattttctctcatgaactggcagcacctactagaactgtttaattacgggaccagaataataatagaaaaatgctgcacacaataacagccctgtttcctatcctacctttgtggtgacaatgcacaggcaatccatcctggatccctacacaggactcagtacatggaaatcacaccagcaaatcagcaaaggtgagaaaagccttttggaaattgcacacagaaagaagcagagcttggattctgtacagacggcttttccaagggggcccctcatgggaaactcgagccctcctccatacagctcaaggcaagcaggattctgctaggcaccagaaaatcccctagaaatcagctccggcaaaacttcccggtggcttcctgggctccgtggctgcatggtcttttagcggattccttgattggaacaaggctcctgtgagtgccccgcacagttctatcgttgcgatgagtgtaacaccaagcaccagggaatcacatttcagctcttgctcttgtttctgaattctgatgtgctgcttcagtatactcataatattttctttgccaaagtcccccctttgttgccttcctttcttactaacactgagtaacacaaaaaactacccgtcccatctaccaaatggctgtcgttccagtgccagaatagcggctttggataataaaatgctatttattatgagcatgattgccgggagtctaaatgactcgaaagatatgactgaaaagctaaggtgcatgtggtactgcatacatcacatctcaactcacttgcaattacaagggcagcttcttacaaatgactaacagctggataaggaaaatcaagccagtgacataaggaaactgcggatttggaggtttaacttatagaaaagggttacatttctccttttttgtgtttacctatgtgtgtggtccatgacatatgcaaatacacaaacaacctgaacatataaatgaatattatgaaattggggtgggaggaggttctaaagtgtttacaaaacttccacattctgagtgaaaaaatgagttctttcccaaacttttccctcctcacttgctgtctgcaggcacttattaagtgggcagagctttgtgttgccttctgcagcattttaacagccaaatgattagcactctcccctcccccaaatccctccctttcttctagtaaagctgctactacatagacggcctttgaggtgcttgacaagcatcactctggataataatatacttttttttcccatcatcttagacacacaggcagtcacagactgaaacagaaaaacagacacaggagctcagaaaggagagagggggtgggaagggagaatgagggagagtgagggagagtgagggagagtgagagagagtgaatgacagaatggaaagcactgcctgaccaataaaaatcgaaaatcaatgattcgctttcactaggaagaaaatacatagtcaactggaccattgaaatatcaaaaataaatgtctagggacccatacactttatctcctcaggatactggcaggaccatttcccaccccactactaaccaccaccctcttttttttttttcataaaaagtatactttcttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaaaaaaaaaaagtatactttctatgataaacaatttggaaaaaaataatataaataatatgtaagacttctacttttcatgaattattgaggttctaacctcaatatcccaataacctcctgattgctaaataaatgaatgtctcagaaactgacatgtcattattttacccaaatgagagcactgttcataaagattttaagttcatagcaaatcaaatacgtgttctgaggaaaaaaagaagaaaagacaagctcctaaagttcaatttgatataaaaaccttcaaaagtggctcaaaaaatatttatagttaaaaaatataatttcttctgaactgctatcctactgatgtaagaaatttcaagtaagtttcaagttaaacaccaccaataaaatccatgctctggtccattccattaggtaactctgtcttatggttcagtaatttgaaaaggtcaaagaaacaccagtttgtctattcaccctcatttgttacatcatcacaataattattttaactcaatacttcctaagcttatctaagggtgcgtaaaaccttatatctttatgtaccagcgtgtttccctggcacaactaacatctaataggtaattgagacttactgccatattcatgttcaaaataattagtctttgtgtccctatagcaccttaaagttgacaaagaacttgtaacagtctcacaggcttgggaagtttaaatgacttcctaaaagcctagtaactttcaatagcaacattaaagaccacgtcccttaattccaagtccaggtctttgttagtcatagagacagtcagaatggagacaatcaggggttagacagaggaagtaaataaattggatagcagagtaagatgagtattttcacaaggtatcctggaagatgataccttcggaacttcattccatctttgcagagaggcagacacttagagaaaaattagcaaagggagcctgattagtcttctaacgttggtggatcacagaggaaagcactttgtaaactatagagacttgcagaaataaaacacagcttgtctagcataggttctagaataccttaggcagtccctaagtcattcacctgacacatgtttgttgagcactcattatgtgattatttgattaatgtctatatcaccctctaaaatgcactccttaaagatagttttaactctttatttccattgcctagactagtgtctcattcattcaacaaatatacttgagaatctacttatgtggaaacacaaagtgaggaaaagctagcaaaatccctgcccacaagagaataaaaaactataataccgtacagaaagcatttgggagtgttttacgtctacaaaatagaggcatttaacccagaatggagcagtgagggaaagctttctggagaggggccttgagctaagatgaggaagaaccataggagttaactagaagttaggagaaaagagaattgcgtgcactctattgtatttgaaaaaggaatgaatcagcaatatgttatacctttatacaatcagtttaataaatacatccaataaaagtgcttcagagcaagcattttacagcaagcattttacaaactgaatatgcaatctttatttgagaaagaagagcattgctcatataactttgagtacaagtatactgtaaatgcatgtacaatatgtatgttatatattcatttgtttgtattcgcctcaagtgattaactggataatgtatgtaggtttagatataagtacataacattttgaagtgtagacccatttgggttttccactttgtgtataccttatctttgattgattttcctcagatataaagatgatagaggataattcactcctttgcctcaagggaaacattatgttgtttttataattaacaaggtattgacatgaagcatttttttttttaacagacacagtgctcagttgggcctgtgattttcacaagaagtctttggcaagataaaaagcctcagcctgcaagctgctttacttgatattccttgaggttaatgatctaaaactagaaatatattgattcttagtaaaacctatcattgaaagtttgatatcataaaattactcttgtaaattacttgcactaaacctgtaccttaaccacttaaatccattattacttttattttgtttgtttccaacagggaaaaatatgtttagaagtgaagtccagtcagtgtctattctagaatctaagccccttgagggcagatttaatgtatatatctggcacctaatatggtactggcacttaagaggcacaaaatcaatattagtggaatgaaagaataatcacagctctagttatgctattttttgatagtttttaaaaaatctatttaaacttatgatcccttattcatatgagaaccatatatttatattaattatatacatatatacatatgtgcatacataaaaatttaaaaataaatatattggtgcatgtagctgaaggtatttgcaaataaaaatattttcattggaaaatccagtctgatgtaagaaggtatggtttagaacagtcttatctataatggagaagggcaatttctagctgaagtgttacaagtacaggatgctactgaaactaggtgcttgctattgtgttagaaaaacagtaataaatataagcatgttaataataatagtaatttatcaagtggctattatctgaagtactggggtaaatactttgtaactattatctcatggtcataataccctttaggaaataattataatccctattttatagttaaggaaactgaagttgcttgaggttctatgacctgccgtgacacaaaacctaggtgaccccaacacagagagtggtctatgttatttccgtctcatcacactgcaaatcctgaaatcgtttctgtccctctgggtccaaactgagagtatggcacaaacagatacaaaaggccttctccttagccaaaggtagcctggactccatgcagatgaactataaacaacctgtgatcctcctaaaaagataggttcatctctgggttcctatctgacaccttccatagcttataagggccttgggaataaccccagaaggaatggactccacattagaaagattaggtccaaaggaaataacaagaaatccacccacctggcctcctatccctgtctatctgttccccatatacccagaacagcaggcacacaaatgacatctgcaaagcttgttagcttagtaaaataaatagactgcaggcaggtcatggcaaaatgcctgccctcatttccaaactctccagaggtaagtaagaaattaggatcaactgaaaaaagactgaatttttcagagtttctatcattaaaaaaatcaggacagtaatggatcccgaaaataattcatgaaaagcaggagtctatgtattctgttcaagttaaatgtgtatccttacaaaaaaatataaaaactaaacaagcaaaattttgagtgaaccaataattgctaatgaaatgaattaatttttagttttaacccatcttttaatcatgatattcaattgtatggacctaaattttatgtcagtttttctcatgtgagttggaacatagttaaatgatagccatgtagctctcccagttattatcatcatcaaaatctaaacaacctttgaaattttatataaatggtaggttataatgtaaacattcaataaaaattgtgtccctaacaaatcaaagtttacataaactttgttgaacattaactacatttcttatgaggctcaatttttcctattatacaatgctgtgggttgagtggattccagaaatccaaatagttgtgtgcaagccacaaatctaaaaagctataatggtcaaaaataaaattttgctttcaagtcaatataaataacctcagcagtattgctaaatgccattcccatactccaccttcttataccctgatatggtttggttgtgtccccacccaaatctcaacttgaattctatctcccagaattcccacgtcgtgggagggacccacgggaagtaattgaatcatggatgccggtctttcccatgctatacttgtgttatggaatcagtctcacaagatctgatgggtttatcagggatttatgcttttgcttcttcctcattttctcatactgtcaccatgtaagatgtgtctttcacctcctgccatgattctaaggcctcctcagccaagtggaactataagtccaattaaacctcttgttctttccagtctcgggtatgtctttataagcagcctgaaaacgaactaatacatacccaaagcacactggcctgttacctgttcctcaatatagtgtttcactctaattcttcctccgggccttgaatttgttgtttcttctgccagaaactgtttttccctggatttgcacatggctggctccttctcatcattcaaggctctgctcagatgttaccacctcagcaagaccttcccaaactgatttcccctaattagaatctcttccatcccttctccattacatcatcccagtttatttcctccatatgattatcacaatccaaaattatcttctctattcatctcttactatctcccctatctgaagtttaccagtgagagcaggaaccttatgttttgtccatggcaatctcaccagtgtttagaacataacagatgctaaacagagatttttgaatgagtgaatgaatgaatgagatgcatcacatggaaactctttaaaaagtatatggctagaatcagcagtccaacatgaaatttgcaatgcaagatctttaacatagtttggtttctaaggatctgatttacactaacaatagtatttacaaacatacacataaacaatagttttttggattcaaaattaatttattttgaaataaattgtattgggaataattaaggtatacaacatcatgtaagatatatatacatagtaaaaaggttattatagtgaagcaaattaacatatttatcacttctcatatagttacccattttttgtttttgtgtcaagaacagctaaaatctactcatttagcatgaatcccatatataatacaatgttattacctacagtcctcatggtgtacattagctctttaggcttcttcatagtacatatctgctagtttgtatcctccagcctacatctcttcattcctcccaactcagtaaccactgttttattctgtgtgtgtattttttaaattttattttgtatatggtaagtatgtgtatatgtatacacacacagatagatagattccacatatatgtgagattatgcaatattttcctttctgtgtctggcttatttcacttagcataatgtcctcccaggctcctccatgtcatggcaagtggaaagatctcattcttttttaaagctgaatattattccatattatgtgtgtaccacagtttctttatccattcacccactgacaaacacttatttccccatcttggctattgtgaataataccgcaaaggtcatacgagtgcaaatatttttacaagattgtgctttcatttcctttgtgtatatgcccagaagaggaattgctgggtcatacagtgttgtatcttcagtttctttagggacctccatactgttttccataatggctgtaccaatctccattcccaccaacagtgtacagagttcccatttctccacatcatcaccaacatttgtcatcttttgacttttatttagaaatagtaaacaatttatatgacactcccaaaacaaagaaaggtatgcacagaataatttttgtagaaaatatgcatttgtaacctatctttttaaaaaattatgagtacatgatagttatatatatttatagggtacatgtgatgttctggtacaagcataaaatgtttaatgatcacatcagggtaactgggatatccatcacctcaggaacttatttttttttttgtattagacacattccaattccagtcttagttttttgatatatacaataattattgttgactatagtcaccctgttgtgttatcaaatactagatcttattcattccatctaactatacttttatataaattaaccatccccacttttcccctccatcaccactactcttcccagccttaggtagccatcattatactcttttctctccatgagttcaactgttttaatgtttagccacatatgacacagaacatgtgaaatttgtctttctgtgccaggtttctttcacttaacataatgacctcaagttccatccatgttgttgcaaatgataggagttcattcttttttgtggctaaataatattccaatgtgtaccacattttctttacccattcatcagttgatggacactttgattccaaatcttggctaagtgaataaataataaatacaggagtgtaggtatctcttcaatatgctgatttcttttcttctggataaatacctagcaatgggattgctcaatcatatggtaatttctatttttaatttttgaggaatctccatactcctctccatagtggatgtactaatttatactcccataaacagtgtatgagggttaccctttctccacatcctcaccagaactcattatttcctgccttttggataaaagccattttaactggggtgagatgataccccactgttgttttgatttgcatttcttgatgattaataatgttgagtatttttcatatatctattggctatttacacatcttcttttgagaaatctctgttcagatcttttgtccattttaaaatcagattatttgttttttttcccattgagttgtttgagctccctatatattagggttattaatctattatcacatgaaaatatttcctcccattgtataatttgtctcatttgttgattatttcctttgctatggagaactttttagcttgatgtaatgtcatttttctatttatgctttggttgcctgcacttctgaggtattactcaagaaatttttgcccagaccaatgtcctagagagtttcttcagagttttctttcagtagtttcatagtttcaggtcttatatttaaatctttaatccatttttattttatttttgtatatggtgagatatagggttgtagtttcatttttctgcacatggatatccagttttcctggcacaatttattaaagagactgtccttttcccaaaatatgttcttcacacctttgtcaaaattgagttcatggtagatgtatggatttatttttgcattctctattctgttccattgatctatgtgtctgtttttattccaataccatactggtttggatactatagctctgtagtataatttaaagtcaggtaatgcaattcctccagctttgttctttttgttgcccatgatggctttggctatcctgggtctatactggttccatacaaattttaggattactttgttatttctgtgaagaatgtcattggtattttgatagggatttcactgaacgtgtagattgctttcagcagtatgaacactttaacaatattgatttctccaatctattaacacaaaatatctttccattttttgtgccctcttcaatttcttttactaatgttttatcgttttcattgaagagatcatttacttctgtgattaaaatttattcctaggcatattattttatttgtagttattgtaaatgggagtttttttcttggtttctttttcaggttgttcattgttgacatttagaaatgctaatactttttgtatgttgattttgtatcctgcaattgtattgaatttattcttcagttctattagtatagttttttggtggaatttttaggtttttctaaatagaagatcatatcagctatgaacaagaataatttgacttctttcattccaatttggatgccctttattatttctctcatttaattactctagctaggacttccagtgctatattgaatagcagtggtaaaaatgggcatccttgtcttgttatatatcttagagaaaaggcttttaatttttccccttcagtctggtactgtgtaggagtctagcatacatagcttttaattgtgttgaggtatgttccctctatgccacattttttagcatttttgtcacgaagagatgttgaattttattgaatgcttttcagcatcaaatgaaatatggttttatccttcattcggtcaatatgatatattacattgattgatttctgtatgttgagacatctgtgcatccctggacgaatctcacttggtcttgatgaataatccttttaatttgttattgaatttggtttgtgagtattttgttgaggatttttgcatctatgttcatcagagatatttgcctatagttttcttttttgatgtgtctttctccggttttggcatcgtggtaatactagcctcatgaaatgagtttggaagtgctccttcctcctagattttttcaagtagtttgagtaggattggtattagttctttaaatatttggtagaattcatcagtaaagtcattaggtcttgaatttttctgtgatgggagacttaattatgacttctgtctcattacttgttattggtctattttggtttcagatttttttcatggttgaatcttggtaggttgtatgtgtctagaaatttatttattctagattttccaattctttggcatatagttgttgatagtatctctaatgatcctttgaatttctgtgatatcagttgtaatgtcacgtttttcatctgattttatattgcggtgtcttctctcttttgttctcagtctggctaaaagtttgttgatttactaatttttgcttgttttgcttttgcttttctagttccttacaatgtatcattaggttatttatttgaaatttctctactttttaatgcaggtgcttattggtatacttccatcttacaattgcttttgctatatcccataagtttatgtatgttgtgtttccattttcatttgtttcataaaatcttaaaatttccttcctgatttcttcattgacctgcttgtcactcaggagcatattgtttaatttccatgtgtttgtatagtttccaaagttcctcttcttattgatttttagttctattccatagtggtcagaaaagatatttaatataatttcaatgttttgaatgttttaagactcattttgtactttaacatatggtctatcattgagaatgacccatgtgctgaaagaaagaatgtgcattctgcagcttttggataaaatgttctataatatctattaggcccatttggttgacagtgtagattaagtctgatgtttctttgttgattttctgtctggatgatctgttcaatgctaaaaatgggttgttgagctctccagctagtattgtattgtggtctttctttctctttagccttaataatatttgttttatatatatgggtgctctagtgttgggtgcatatacatttataattgttatatcctcttgccaaatggactcctttatcattatataatgtccttctttgtctcttcctttagttcctatcttagaatttattctatctgatataggtatagctaattcctgctctttcttagtttacatttgtacagaatatctttttccatccctttaatttcactctataggtgaagtgagttttgtaggcagcatataattgggtcttttttttttttttttatcagtttagccactttatgtttttcattggaaagtttagtccatttatagtaaacgttattattgataggtaagaacttactcctcccattttgttatttgttttctggttactttgtggtcttctcttccctccttccttcctgtcttcctttgtgtaaaagtgattttctctggtagtatgttctaatttcttgcttttacttttctgtgtatctgttgtgggttttttgatccgaggttaccatgaagcttgcaaataatatcttgtaaaaaataattttaaactaatgacaacctaactgatttcagaaacaatgcacaagcaaagagaaaacttaaaaaaaaactctacactttatcctccatgttctttgacttttagttgtttctatatatttttatactatctatttcttagaaatatgttgtagttattatttttgattagttcttttactattcctattcaagatatgagtggtttacacaccacaattacagtgttgcagtattctgtatttggctgtgtatttgctgttaccagtgagttttgtaccttcagatttcttattgtttgttaatgtccttttcttttagattaaagaactctctttagcattgctcttaggacaagtccactgttgatgaaatccctcagctgttatttgacttgtaaagttttatttttccttcatgtttgaaggctattttccctggatatgctattctaggataaaagttgtttcattttttttttccttcagcactttaaatatgtcatgcacctctatcttggactgtcagatttccactgaaaaggttgttgccagatgtatgctcccttgcaatgttgcttgtttcttttctcttgcttcatttaggatcctttctttatccttagcctttgggaatttgattattaaatgtgttgaagtagtcttatgtggattaaatctgcttaattttctatgaccttcgtctacccgataatattttttctaggtttggaaatgtctctgttattatttctttaaataaactttcttacctgatctctttctttatttcctccttaaggtcaatacattttacattttcccttttgagactgttttctagatctcataggtttgcttcattctctttattatttttttcttctttcccccatggctgttttttatacagcctgtcttcaatctcaccaacttttccttctgcttgatcaattctactcttcagagattcgaaagcatttttcattttgacaatagaaatttttcagctgcagaacttctgcttgattatttaaaaaattatttcaatctgcttgttaaatttctgggataagattttgaatcccttctctgtgttatcttgatgctcactgaactttctcaaacaactatttttaattctgtttctgaaagttcatctatttccaccactctagaatttgtcactggtgacttatttagtttgtttagtagatcatgttttcctggatgttcttgatgcttgtggatgtttgttaatatctgggtatttagaagttaggtatttattttaagcttgcagtctcagcttgtttgtacctatccttcttgagaagggtttccaggtattcaaatggaattgggtgtggtgatcgaagtctctggtcactgaagccatatcaacactgggagataccgcagaactagtaatgctgtaattcttgcagactcctagaggtaccaccttggtaggcttgggtaagatctggggaattccctggattactgggcagcagtctctgattctcttccctcacttctcactttccccaaacagaagtctgtctgtatgtctgtttctccctctctctctctctctctctctctctctctctctctcctgagcttcctggagttgggggagggatggcacaagcactcccaaagctatcacagccaggactgtgctggataatacctgaaggcatcacagtatttgggtcttatccaaggtccatggctactctttcctggctgctagtgatgtttcttcaatgcccaagggctctttagtcatcaggtggcatatttagccatgaaggggtccctcctgtcaggggagcaggttcccttctagccaagggtaggtctagagatgccatccaggagctaggacctggaattaagggtttcaggatccagcgtggtgctttattttaccgtggctgagctggtacccaggttgcaagatgaagtcctttgtactttttcttctgctttcccaaagtctaaggagtctttcccaagctgaatgcctggaattagggaggggtaacacaaacacttccttgggtgtgacaactagtgtctcactgggtttcatgtaccccaagtccactggccccaagcccagagcagtgccaggacttatccaaggactgcaaaccttgttacctgactgacattcaaatttatctaggacattaggctactttagtcagccaatggtggagctaccccaaactcaggttcctaccactggggtggagaattcccctttgaatggagctagtctaaatgcttcatctgtggacaccggtggaattttgccctatgttgtattctgctgtgagagggcagaattgagttccaatgcaatgtctcacaatcacttcactctctctcctgcgaacacacagattttctgaatacatgccatcggttggggaagggtggtataggcaatgcgaaactgtctttcctaccttctttagtgtctctttccttgatatagtatttaagccagctactgtgatcactcacctaacctttggttcttatgaaggtgctttcttgcacagatagttattcaatttggtgttcctgcaggggggataatcactggaacgttctattcagccatcttcctctgcctccctcctatctattgactttttgataaagccatcctaatgagcgtgaagtggtttctcattgtagttttgatttgcatttccctgatgattgataatgtttagcctctttttatatacctgttggacatttctgtcttctttgaagaaatatccacccaagtcttttgcccatgttttaattagttatttgttccactactgagttgtataagttctttataaattttggatattaaccccttatctaatatatgacttgcaaataaccattaacttttcatttaccaagtataaattttcatatgcataatatcattaagtattcataaccaatgaattaagtataattttacaggtaaagaaactcagactaagaaaaactgacttacccaaagttatttaactactgacttgatgaaccagtatggtcaatattcttttattttattttattttactttatgttccaggatacagacgcagaatgtgcagatttgttacataggtatacgtgtgccatgggttgctgcacctatcaaccaatcatctaggtcttaaatcccacatgcattagctatttgtcctaatgttctccctccccttgccccccaccccctgactggccctggtgtgtgttattccccacactgtgtccatgtgttctcattgtacaactccagctgatgaatgagaacttgtgttgtttggttttctgttcttgtgttagtttgctgaggatgatggtttctagcttcatccatgtccctgcaaaagacattatctcattcctttctatggttgcatattattccatggtgtgtatataccacattttcgttatccagtctgtaattgatgggcatttgggttggttctatgtctttgctattgtgaatagtgctgcaataaacatacatgtgcatgtatctttataacggaatgatttatattcctttgggtatatacctagtaatgggactgctgggtcaaatggtatttctggttgtagatctttgaggaattggcacactgtcttccacaacagttgaactaatttacattcccaccaagagtgtgaaagcattcctgtttctccacagcctcaccagcatctattgtttgttgctttttaataatcaccattctgactggcatgagatggtacctcattgtggttttgattttcatttctctaatgatcagtgatgttgagctttaattcatatgtttgttggctgcataaatgtcgtattttgggaagtgtctgttcatgtcctttgcccactttttaatggggttgcttttttcttgtaaatttctttaagttccttgtagattctggatattagacctttgtcagatgggtagattgcaaaaatttgcccccattctgtaggttgcctgtttgctttgatgatagtttcctttgctgtgcagaagctctgtagtttaattagattccatttgtcaattttggcttttgttgctattgcttttggcatgttcatcatgaagtctttgcccatgcctctgtcttgaatggtattgcctaggtttttatccaaggtttttatggttttgggtttacatttaagtatttaacccatcttgagttaatttttgtataaagtataaggaaggggtcaagtttcagttttctgcctatagctagccagttttcccagcatcatttattaaatacggaatcctttccccattgcttgcttttgtctggtttgttaaagatcagatggttgtagatatgtggtgttgtttctgaggtctctgtcctgttcccttggtctatatgtctgttttggtaccagtaccatgctgttttggctactgtaggcttgtagtatagtttgaagtcaggtagcatgatgcctccagctttgttctttttgctcaggattgtcttggctatatgggctttttttggttccatatgaaatttaaagtagtttttttctaattctgtgaagaatgtcaatagtattttgacgggaatagcattgaatctataaaatactttgagcagtatggccattttcatgctattgattcttcctatccatgaggatggaatgtatacttgtttgagttgtctcttatttcagtatggtgaatattctattgaccaagtggatgaaacaggataaatcttgattatctgatgccacttcccatcccatctttgttctaataatcttctgcactttgaaaatcactgaactcattgatccaggtagtaaatagcataaacttcaatgtttggtcctaagtgctctaaatctgaacagaatatacttcattgttttcaagcaagtataaaaaaacagaatcctaaatacagatgtattcaattaatataatatcatttctgtagtgtttgtgttgctttagagacaacaaaaaaatatattaatattggactgattagttaaataaagctttataaatatatgagacttaacaaaattcaaacttgaccagatggaatgagctacgttgggaggtggtatatatcctacaacttgaggctttccagcagatgacagaatcccttttagcagagtgacaataaacaattaaaaactaaggagagccactactctatattgcctttaaaattacctttaatgctgattctgtaatattttcaaacttggccctctgggaagattaactcaaaaacatcagtttttaatttttttttttttttttttttttttttgagacagagtctcactcagtcgcccaggctggagggcagtggcttaatctcagctcactgcaggttccgcctcccgagttcacgccattctcctgcctcggcctccccagtagctgggactacaggcacctgccactatgctcggctaatttttttgtatttttagtagagacagggtttcaccgtgttagccaggaaggtctcgatctcctgacctcgtgatccgcccgtctcagcctcccaaagtactgggattacaggcgtgagccaccgtgcccggcctccgtttttaaattattattgtatcataagaagaaccacataaccttaaatttataatactgaccactcttaagtgtagagttcaatagtgttaagtatattacattgctgtgaaacacatacctagatgagtttttcatcttgaaaaactgaaactatataaccaataaacattaattccccctccctcatctctccagccctaggcaactacctctctactttgtttttatcagtctgcctactttagatacttcataggagtggaatcatacagtgtttgtccttttgtgactggcttattttgcttagcataatgccctcaaggtccattcatgttagcatatgataggatttccttttgttcctaaggctacatagtgtgtgtgtgtgtgtgtgtgtgtgtgtgtgtgtgtgtgtgtgtgtgtgtgtaacattttctttatccattcttctgttaacggacatttgggttgcttccaccacttgagtattgcaaataaggctgtgatgaccatggctgtgtaaatatttcttcaagatcctgctttgaattcttttggatatttacccagaggtggaattgctggatcgtacggtatttctatttttaaagttttcaagaatctttatactgttttccataatggtggcaccattcccaccaatagcatacaagcatttcaatttctccacatctttatcaacacattattttctgttattttgacagcaggcatcctaatgggtgtgaaatgatttttaattgtggttttgattggcatttccctcatgattagtgggttgaacatttttcatagatgtattggccatttgtatattttctttggagaattttctattcaagtcttttgtccatttttagttgtgttacttgttatttgttgttgagttgtagaagttcttcatatattctggatataaagctttcacatatatatgatttgcaaatacttcctccagttccattggttgtcttttcactctggtcattgttttctttgatgtacagaagtctttaagtttgatgcagtacaatttgtttttttttttttgctttcagtttcctgtgcttctggtgtcatattcaagaaattgttgccaaatccaatgtgtcctgacatttttctattagttttatagtttaaatattacattttctgtaggcattatagagtttaaagtcttacttatatctttaatccatctcgagttaatttttgtatatggtataaagtaagggcccaactttatcttttgcatgtagatatccagttttcccaccaccatttgttaaataaactatcctttccccagtggtagtcctagctcccttatttaaaataatttgccatacatgcaagggtctatttctgggatctacattctctttcactgatgaatatatctgtctttatgccagtaccacaccatcttgattactgttgctttgtagtaagctttgaaatcaggatgtctgaggtttctaagtttgttcttattctccaaaattgattaggctatttagtgtctcggaactaacgcttttaaaataaggatcatgggaagcatttaatgtaaacatatagagacaaagggattctcattctgctctcattccataaaacaaacaaacataaaaacattctttcccacagctgagtggcattcagaaaaagaagctcccttctaaatatcagaaagaacagttaccagaaaaatagagctgagctacaaaattcttgttaattagaaggtgcagctatttaacagagtataaatatacactatagcctaaaaataattaagagcaatgctgaaattctctaaagtacatgatcattctatcaaaatatactaaatgtattataatagaaagaactcataagttatttatttattaattttttttttttttgagatggagtctttccctgtcacccatgctggagtgcagtggcgctatctcagctcactacaacctccacctcccaggttcaagtgattctcctgcctcagcctcccaagtagctgggattacaggcacacaccaccacacttggctaatttttgtatttagtagagatggggtttcaccatgttggccaggctggtctcaaactcgtggcctcaagtgatccacccaccttggcctcccaaagtgctgggattacaccttggcctcccaaagtgctgggatcaccaccttggcctcccaaagtgcatgggctaccgcacccagctccacaaattattaatatctaatcagtctctcactttagattagggtttagattaggaaactgaggcatacagctagtctaagtgacttgcccaagaacattcaaatagtaagtgtataaagacaataatctaacatctgtttccagttatgacttactcttacacgattcttccttctcagtctgatatgtgtcctacagtcaaatgtgtttctaccttgttacctctctgttcttactgaaagaaacctaactttctgccccacccattgtggtacttgcatggtatttacttagtctcttaatcaaccagttttaattcataagattgtctttttcagcagaaaacagagtctagccaaagtatcaaacaactaaaacagtatctaaaacaaaatattcctgaaggcatttagtgctctactcatttctccaattgcatgcaacatctagagcatttacctatcaatcctttcatatataactatcccatttcatcctctttatattactatagtatagtaacaataggtataatctcattttatctcatttcaggcacaataaaaagtcatttaatgtgcctgaggtcacatgactaatttgtgatagagccaagatacaaatcctggtctctgactttggatcttttgttcattccattctatcacactgtcctacttttgatattacacttggttctcaacaaatatgccccatctcctctaaaggtattttcttagttgttcccataattgaattagtcaactctatctatccattagtcagctttcctctaaataaccccatttttgtgctgataccacctaactctcaatttacttagtcaccaagtcctgtcaattatttctttaagattcatcatttctctataagctgattacaattttcattgtttctcactaggactctggaatatcaaatctccaagctttatgctttgcatattaggtttatttaaacacagaagatatccctaaaaaatactcccaattattttaaattgttcaaaggaaataataggaataaaataaagaaagaaaccatattaaatatgaagtatttattcctcattaaaggtctaaagttttcattaatatctttttattttccaaatgttaataaaaatatcaactcaataaaataaatgcaaaacttgcaatttatttcaatagcatgaatatctactatttgccaagcagtactaagcatgttcatattgaggatcacattaaaatttcaaaagtaccctaaaagatgaggaaatggaagcttttagcatttaagcagcataagctagcaatatgctctccaattatgaaaacaagtttctctaatatatttttcagcatttatttaatttagctgcctggaaggttggcatatttgtatcccacttaggactaatgacttcattttcaggaagcaaaaatacaaatatccttgcgaacagccaggaagtacaaaaatgtgttttctaagtattcatgagcccatcatggatgcccaccctccctctcttcttttggagaaaaaaaaaaaaaaaaaaaaaaaaaacagtctcattgccaaattagataacttcctttcctggaagcacatttagtattttattactgtctcaaatagttaacatcttctaggttaaatgaaagtatttttcaagagaggaaaagtgaaatagcttacaaaatgactgtgtgataaccagcacttgaagactacgtactaaaacacagaacccaaaataaaacacacacaactactcaacgtgatacacattcagtgtcagctcagaagcctgagaacccaatatgctgaccaggccaaagctagaaattaggttacacattttcttttctttctttaacactactagcactatccacaaagaacaagacaagtcttacccatgaagcctagtaagaaaagaaaacagtataacacttacagttgtcgtctcatcagtttcattttcaaaactctgattttctttattttgctcaatacatgaagcattttcctttgatccactgcaatctgtaagctaaaataaaagtttaaaaaatcaatactccttttttattttctgcaatgtatattgttttcaaactttgaatatacacattaaaatatctaaggcctgaataaatattagatgttgcttatttcaattttagcatatgaatgtactatctaacccatttttatattgctcccaaagagaaaacataaaatgggacagttattcaaaggccaattttaaatttcaaaggtttccagcagggagtgttgaacatgggctattcaaaagtaaatggatgatctggttaaagctgagcatggttaatgggaagatgaagatagagggctgatttcactttatataagttctcatgcttggagaaatctctatggaagctattggagctctcagaactagcagtggcattgactgcctttgctttgggctgtctttttataactacagctttagatgataaaaataatgtctactttcaaagcaaagggtaggtttgcttactgaccattataaaacagatgttacctaaactgagggaacacaacctacaatatgacccattgaatatgactgtatcatgtgaccatctttgccttgcactgtaaaaattggggcttgagaaattggtacaagaagatgttgatagtctactgctgttgttgcaagtaattagtctctgccctacgattcttttggcagcatcgatgaaattgtggcagactaaattcttagtttgcaagtaggatacaatcttagactcctcacagttcttgagagtgacaaggatggaattctgacagattcatagtgttctggaagaggaaggatcagagacttctaggctgatgaaagggattcgtggaacatctttaggaactgggtagtaaacatgctgaccacactgaatgttcaactgcataataaggattcctcactttaggccaggcacaatgtctcacacctgtaatctcagtactttagaaggccaaggaggatggatcacctgaggtcaggagtttgagaccagcctggccaacgtggtgaaaccctatctctactaaaaatataaaaattagccaggtgtggtggcatgcgcctgtaatcccagctacttgagaggctgaggcaggagagtcacttgaaccagggaggtgcaggttgcagtgagccactgtgctccagcctgggtgactgagcaagactctgtatcaaaaaaaaaaaaaaaaaatcccctcactttaatgcacgttaatgaggagaaatttctaaagtggttgcaggctaggacagctcccaaatggtttttgccaactctcctctggctgggagaacttcctcaccaacctagcagtcggcctcagtttctaagattcactctaaaaggagtgggtgaacagaaatttccactccttttcaggcaatagctatagagacatgtacctgcactgattgtgacaggagagaaatttgcaaccactgtgggcagaaggatttctctgatactagtctattgtagactctcctcttctctgctcccgtagtttacatctatcattgtaattagcatattgtattataaattacataaatgtatatgtatatatatgtgtgtgtgtgtctacatgtatgtgtttatgtatgtttatctgtcccattagagtatcttgtaagacaagcaggatatcttactgtttttcagtctctagaataaatacatatttgtttgatgaatgaaaaataaagattaaattagatgaaaagttgatacatagatagatgaacaaactgagaagatgtgtcatctcatgaagagcagtttcaggctcaaccactttgggatacccaggtagcctctgtatcagaaacatagagctctttattttgtgctcccctctttgggccactcctctttggtcccatgaactatccaaataaatcagggcagtcaatctgactgtatctctcatgtagatgtacatagtaaggacctgtcctctgatgagacccactggaatcaagatgctgattgagcctgcactgtcaccattgctaattggatccatcatcatactgaacacggcggcacatccaccatcatagactaagcgcaaagtaaaagactgcttcccaggcaaaggctacctggttgtcctaaggtgattgagctcggcatttctcttagccagatcagagcccttattcattgtttgtacatttgttcatctatctatgcatctctttgtgatggttaatactgagtgtcaacttgattggactgaaggatgtaaagtattgttcctgaatatgtctgtgaggttgttgccaaaaagattaacatttgagtgagtgggatgggaaaggcagacttatccttaatctgggtgggcaccatctaatcagctgccagtgcagctaggatataaagcaggcagaaaaacacgaaaagattagactggcctagcctcccagcctacatccttctcccatgctggatgcttcctgcccttgaacattggactccaagttcttcagttttgggactcagactggctttccttgctcctcagcttgcagatggccattgtgggaccttgtgatcatatcagttaatacttaataagcacatatatatatatgtgattctagagggacagaatattaaggatgaagtcctttcattggtttgggggtttctggagttggctgcttaacatgattcgacccaaaaatgctaaaggctctacttctagtagtatggagaacactgatagtccttggcatgaactgtttagagagttatgcaagatgaatgcatttgacattcctgattcaccattcgtgagaggcaaggagtttagcgactctatacataatacatttgactatatgtggagaatcaaggaatataatgaagctggttggttgctcctgagttcagtggacaaagtgatgaaaggaaatgatgaaatcagggattctaaataccagcttcagaagcagatacggagcctcaaatctgctaagattaccctgagtgaaagtcttatctcctgtagagaaagatatgaaattgtgggaaaacagacacaagcccttaaagtgagggcactgattggaaaagaatgggaccctgcaacttggaatggcaatgtttgggaggtctctcatgaagctgggaacactgagtttgtaaactctgacgaagctttttttgccagaagaaacagctcccccattcccagtagtggcaacatcccctccccgacccattagcctttccaccgttgtctgaggagataaaccccgcactgcctgagaaaacagtgacaccctcccctgaggcagttgccaggcaagataatgttgattctcctcaggagccacccccaacagccctgtttgcttctagacttataactaggctgacctctcagtgggccctagaggtgaagttcagagtgtgacctataaggaggtacactatactcaaaaagaactacttgaattttctaatttatataaacagaaatctgaagaacaggcatgggaatggatattaagggtgtgcgataatggtggaaggaacatagaactggatcaggctgaatttattgatccggccccactaagtagggactctgcatttaatgttgcagctcgagtgaaaaaaaaggttgtaataatttgtttgtttagctgaaatatggattaaaagataacccactgtgagtgagctggaaatgcctgatctcctttggtttaatgtagaggaagggatccaaaggcttagggagattgggatggtggagtggattagtcactttagatctactcatcccagctgggaggtccagacgatacattcttgaccaatgccttacaaaatagatttgtgagggcagcacctgcatctttgaagggccctgtaattgttctactctgtatgtcagatctaagagtgggaactgcagtcactcaactaaaaaaaatttaaatacagtgtgaataatgggatcccgaggtggcaggggccaagcggtagcactcaacctccaaaggcaaggtaagcatagctaccataatggacagcagaggcaaaatggcaatcagaatagtctgactcgtgtagagctctggcactggctaattaatcatagtgtttctagaagtgaaattgataggaagcctactgcattcatacttaatgtatacaagcagaaaacttctaggtcaaatggacaaaagactaatttgaattataaaaacagaatcatggcccctcaatcaatttccacacttgagtcagtttacagacccagaaccccttgaatgaaggggagaccaggtccccttgaggaaggaccctactacactaccaacaatttatactgttaatttttctctctccttccccaaggagacctccagtcttttaccagggtatctgtgcactggggaaaggaaaatgttcagacagttcagggattactggacactggctctgaactgacatcgatttcaggggacccaaaaggtcattgtggtcctccagttaaagtaggggcttatagagatcaggtaattcatggagctttagcttggatctgacttacagtgtatccggactcatcctgtggtcatttctgcagtgccagaatgcataattggcatagacatacttgcaagctggcagaacctccacattggctccatgactggtagagtgagggctattatggtgggaatgccaaatggaaaccattagatctccctctacctagaaaaacagtaaatcaaaaacaatattgcatccctggagggattgtggagattagtgccaacaccaaggacttgaaagatgcaggggtggcaattcccactacatccccattcaactctcctatttggcctgtgcagaagacagttggatcttggagaaggacagtggattatcataagcttaaccaagtggtgactccaattgcagctgctgtaccagatatggtatcattgcttgagcaaattaactcctggtacctgctatgcagccattggcttggcaaatgactttttctccattcctgttcataagacccatcagaaacaatttgccttcagccagcaaggtcaacaatagacctttactgtcctacctcaggggtatatcaactctccagctctgtgtcataatcttatttggagagaacttgatagctttttgcttccacaagataccacaatggcccattacattgatgacattatgctgattggatccagtgagcaagaagtagcaaacacactggacttattggtgagacatttgcatgccagaggatgggaaataaatccaactaaaattcaaagaacttctacctcagtaaaattcttaggtgtccagtggtgtggggcctgtcaagatattccttctaaggtaaaaaataagttgctgaatttggcccctcctacaaccaagaaggaggcacaatgcctagtgggtgtacttggattttggaagcaacacattcctcatttaggtgcgttactcccgcccatttattgagtgactgccggttttgagtgtgttccagaacaggagaaggctctgcaacaggtccaggctgctgtacaagctgctctgccatttgcgccatatgacccagcagatccaatggtgcttgagatgtcaggggcagatagggatgctgtttggagccttcggcaggcccccataggtgaatcacagcagaggcttctaggattttggagcaaggttctgccatcttctgcagataagtactctccttttgagaaacagctcttggcctgttattgggctttagtggaaactgaacgtttgactataggtcatcaagttgccatgagacctgaactgcctatcatgaactaaatgctttctgacccatctagtcacagagtgggtcatgcacagcagcattccatcagcaaatggaagtggtatatacatgattgagctcaaggatgtcttgacggcacaagtaagttacatgaggaagtggctcaaatgcccatggtgtccactcctgccaccctgccttctctcccccagcctgcaccaatggcctcatggggagttccctatgatcagttgacagaggaaaagactagggcctggttcacagatggttctgcacaattatgcaggcaccatacccctgcatactacagctgcagcactacaacccctttctaggacatcgctgaaggtcagagtgaagggaaatcttcccagtgcacagaagttcaagcagtgtacctcgttccacactttgcatggaaggagaaatgaccagatgtgtgattatatgctgattcatgggctgtagccaatggtttggctagatggtcagggacttggaagaagcatgactggaaaattggtgacaaagaaatctggggaaggggtatgtggatggatatctgagtggtcaaaaaccgtgaagatatttgtatcgcatgggattgctctccaatgagtgacctcagcaaaggaggattttaataattaagtggataggatgacctgttctgtggacatcactcagcctcttttcacagccacctgtcattggccagtgggcccatgaacaaagtggccatggtggtagggttggaggttatacatgggctcagcaacatgcagttccactcaccaaggctgagctgcctggttatggccactgctgagtgtccaatttgccagcagcagagaccaacaccgagccctcgatatggcaccattcctcaggatgatcagccagctacctggtgtcaggttgattatattggacctcttccatcatggaaaaggcagaggtttatcctcactggaatagacagttactccggatatgggtttgcctatcctgcacgtaattcttctgccaagactaccctgtggactcacggaatgccttaaccacagtcatggtattccatatagcattgcctctgaccaaggcactcactttacagctaaagaactgtgattgtgggctcatgctcatgctcactggtcttaccatgttccccatcatcctgaaacagctggattgacagaacggtggaatatccttttgaagtcacaattacaacaccaacaaggtgacaatactttgcagggcttggccaaagttctcaagaaggctttgtatgctctgaatcagcatccaatgtatgctactatttctcccatagccaggattcacaggtccaggaatcaaggggtggaagtggaagtggcaccattcaccatgacccctcgtgatccactagcaaaatttttgcccctgttcctgcaacattacgttctgctggcctagaggtcttagttgaagagtgacaaactctgccaccaggagacacaatgattccattaacctggaattgccacctggacactttgggctcctcccacttttaagtcaacaggctaagaagggagttatagtgttggctggtgtgactgacccggactatcaagatgaaatcagtgtactactccacaacgggaagtaaggaagtgtgtgcgtggaatacaggagatccattagggcctctcttagtattaccatgccctgtgattaaggtcaatgggaaatgacaacagcccaatccaggaaggactacaaatggctcagacccttcaggaatgaaggtttgggtgactccaccaggaaaaacaaaaacaaaacaaaacaaaaaagcaaaacaaaaacacacaacctgctgaggtgcttgctgaaggcaaagggaatacagaatggttagtagaagaaggtagtcatcaataccagctgcaagaatgaggactgtaattgtcatgagtattccctcctacttttgttaaaaacatgtgtaagcatatatacgcttgtattaagaaaatatcttcattttatttcctttttcctttattatgtgacataaaatttattgacttcatatcagcattaaagtattgttaactttatgtagtagtatttgggttggggattggtgcatttccagttgtacaaacaatagttgtattatgttagatgtaattatggccttattattgtctttatttgaagattatgtatgatctcaggagatgtacgtgggttcaagttgacaaggggtggacttgtgatggttaatactgagtgtcaacttaattggattgaagaattcaaagtattgatcctgggtgtgtctgtgaggttgttgccaaaggagatgaacatttgagtcagtgggctgggaaaggcagacccacccttaatctggataggcaccatctaataactgccagcacagctagaatataaagcaggcaaaacaacgtgaaaagactagactggcctagtttcccagcctacatccttctcccatgctggaagcttcctaccctcagacatcagactagaagttcttcagttttgggactctgactggctttcctgtagacaacctattgtgggaccttgtgattgtgtgagttaatacttaataaactcccctttatatatattacacacacacacacacagacacacacacacacacacactattagttctgtccctctagagaaccctaatacactatctgatttaatcttttatttttttcattcattaagcaactatcttttgatctctggagacaaaatgacattaatatggactgcctgtcctctgaagaactctaattggccagagaaatataaaaatacgtaatttatattacatatatagatcatgataatagaaagtataggaggagcatctatattagactgtggaatcatgaaggcttcctgaaagatgtaacattgaaataatactgaagacaaaggaggttatctaggcaagtaggagtattcaatctaatagaaaatagtgtgggcttgaaaggcagcatgctctgaaggaaaaggcatagattttagagtaagaaagaaatggattaaaatcctttcacttccacctactacctatgtggaatggaggcaatatttaaattctatgactatcatcattgaaaatatggagatagtgccacccattgaatagggtcttcttccaccttactaaccaccctatagctgagttggatgccttggattgtaggggagaaaaaaatagctttcctctaccctcctacattctttggctgagctacaaattaaattgacataaggcagcttaactggagagacattattctaataacatgtgtacccatgtatgcatgggagtctcacaaaaatatgaaactcaaataagggacagaattcccttattccccagattgaagcttatttagcattctgagctacagaaagaaataagggcttggggtttctggggctggtgaagccaaattatagaaaggtgaggggaagaaatgtatagtgaataaaggttgccttgttatgcagatcaaagtctctcatctgataaaagttgtcatagactaactctctttctgacacaaatatctttactaatgaaaatctcctatataaatataaatttcctacataaaaggggagtttttcaatgctacttcagtgtctgtagtttcacaaaataaccagctttaaaaaaatcagtatgccacagaggaatatttggggctggtactctggtctcctatagtcatatttttgggtggcataccctgggccccagtgagatttacaaccttcctacctcataccagatgttgtcccatatatacatacatacaaagcactcagtctcaatatcatgactgattctctatttgtttatgtttccaccgttacttcatcccctgataacttgctgtcaattatgctctcatagaaatagtaaatttcttctatgcttctattcttccttcatttaaaaaaagaccctgatcacttcaaaactttaatctatttctgactttctcctccccagagtcaattctgttgaaagacataatagaagtagtaatagcaacaataaaaccgaatcatttaatgaaaagttacaataagctaggcctctcttcaaggatactgatatatattttatgtgcattaactcattagattaaaaagcatcttatgaagtaggcttatgatctttattttctgggtaagaaaacagaacctatttctgcctgaatgaaaagcctacataactaactaatatactaaactcctgagccactttcttactgcccacacatcctttcaaattgtggttcccagaccagcagcatcagcaccacccacaatgtcttagcaagatcaactcttcaacctactgaatcaaaccagtaggggtggggctctaaagtctgtgcttcgatgagctctccaggtgattctgacacatgctagtttgaaaacctctgatctagttaacaaatgttaaactattccaagttagcaaggtataagacacatttacgaagagatagatgattctcggcacaatggaaaattaatgcctgtctaacaagtgcagtctctagtcacttccaaacatttgttgccagatgtttaaaactatcaagagaacttagaagtctgaatttttatgtgaaatagcttgacttctaaatgttgacaacataaaaaaagaggttatgggaggccattgttttggactgagttccttcactaggccccaaaagaccagacgaaatcagaatggagtcattcatgctaggtatcacataatcaaactgacctttaaaatgggacagttttctaaagaacaagagattcacagcaacccattagaagaggccccatggccccatctaagtaaactgacctgataagaatgtctcctctgttttaactctataaggaaagtactttgaaatgaccagtctgctttttattccttagttctgcttctttcagctcctttctgcctgtaaggtcaataggctctgctcagctcatcagaacacctttctacttcatagatggaatgcttcctgatttcaacaaatttaatttaatgatcaaactggttttcaggaaattttgttctttgacagcaactatatatttttaaaatatcatctaagctaacatgcaataggccaaacaaaatataaacctgcactgcagtttccataagggcagccagtttgcaacctctgtattaatcctcaaatgctgccttctcttccctgaatactgaactcttaaaactcaccaagaacctcctagtcctcactgtcttcctagttctgtccaaatgaaaagcctgtgcagctaactactacactaaactcctgaaccacatctttactgcccactcatcctttcaaattgtggtccccagaccagcagcatcagcgccacccagagatttgttagaatctttttctgactttctatactcctcattatcttccactttctctgacatttcacacgattgacctcttcctccttcttgaaagttatacctatattcagaaacatctctctctcctatttgccacccaatctcttgaactctccttctctgtcatttcctcttcttccttttaactcctgaatcagctgttactctgaaattccttttatcgcttctctcactactcactactcaatgattcttcatctaggctttaggaagacattcttcccaatttctggtcctacattttcaattgcatgcttgtatttcctctaaaaaatcacactggtacctcaaatctgttctatctaaatgcaatcatttttttttcagaacccaatttggctacctggcttttggtaattccactacccaaatttcttaagaactatttatgactccctcctccacacagcctgtgctgatcctctttctttatccagctggatgggctctctcaatctataatgccttcaggaaatattcttctcctctacacctttaataatgattagtccacctgatctctttaggaacaacctagaatataaaaaaaaaggaaaaataaacttgtcattgcttatatatttatcttctccattcaagcagatttaaagcttcttcaacacagtaagtttattaccatcttgacatccttcatagtactttaacaaagtgaatgcccatagatattaagttgtttaattatgcagtgtttatacaagtattttctacattacacaatatgtatggacaaatatttgccaactttactttaaatgtattcatcttttatatacatatccgaaaagtttcctatataaaagaatattataataaacttagaaaaatctagatctcttttgtagagtaaataagtactcagtggtttaactgtttggtagattacttttttatttatttatattattttgctcaaacctagaattcttttctttggaaatgaatgtcagtactaatgagcatcatgtacaaaatctgtgtccttgcaggaaccaaaagccatataaactctaaaaatatatgttaaaaaagttaaacagagttctacgatgccaggtcactgggaagcactgccccttcccatcctctaagaatgtcaagtgtacagatcagcctgagtcagatcccagttgtactctggagtaatccaattctattaatatttcctgggtctcatatttatagaatgcctagtttacttaactctatactattctcttcatacaaaagaaatgttacaaactacagaggtatgaggtgaggaggagtctttaggtggggttcagaacatgctaccccaaaatagggcaatgtagcatttgagaaaacagcagaatcaggaagttcactctcactttcccgtcaccctgaagcaagtgataaaaccttcattccagaggaaccctcctaatacccagagggaaagaacatccttgtgctcaaagacacaaagaagacaagaagaacctgaacaaacaggccttaagtctgcctagtttattaccattagatcatatctcttttgccagtcatacttctgcatggctgcccactcttcatcaaattcagcataaaaatacacaggtttccctttttctttaggtcttcacttctctgtcatgtaaaacttatgttaaattaatgcatatgcttttctcttgttaatctgtcttttattataggggtcttagccatggacctagcaatggataaggaaaagatattacttttttcccctacacttttattttacagaaaacagcatgctaccattttatagactacttcaggattacaaacaatgggtaagtttaaactaagtagttctcctctgctgaaataataataaacttcactctcttagcctaaaggcctcaggattccttgaaaaaactgggcacagacaaataaaactaggcacaacctaggagttcaagagaagagagtatcagttatcaagaaaagtgtccaccttatttgttgattcaatatacatgtattaaattgtattacatgcaaagcactaaagaagatgttttggggaaaacacaaagaagacagtgtccaaaaagaatttagtgtaagaaaggaaacaaatatatacaaaagtcactataaaaccatgtggaaagatttgattgtcaaaaatgaagtgcagacaacatgctctgaaacttcaacagaggttcagttcaataaacatttattaaatgctcaatatgccagtcctttaagaaatgtagagtgaaataagtgaaacaagtatataagcagataatttcaatttaattttgaagtattataacagaatgatatagttggacaactacatttttgccatcaaatagttgttagaaatgaaatagaaaaggtaagcagaagccaatttaggagaatcttagacattatgccaaagaattcagattatcccaaaaaatagggaatcaaagaagggttgaggtgagaaatgatagggaagagtagaggggtcaaatgggaaaacattttaaaagtaaagctctcacagacttatttattattttacatttttctttgatttttaaatgtattcaaaataacttaaagcttataaaaattttgcagaaataggacaaaaaatatcatgtacctttcacatgcatttccagctatatagttgtttatggtagctggtcttatctagtaccaggtacttcattatgtcaatgtcttcgtcattgcaaacctttaaaaagtctggctgactactatgcaggtatgcaaataataaaaaaggtttctataaactaacagaatttttttcaggatacactgttaaagtaaaacaagcaaagtgctaaagaacacggtcatcccctcagtacccatgtggagttggttccagaaaccttcacagataccaaaatttgtgtatgctcaagtccctcatataaagtgaagtagtatttgcatataacctacacatatcctcccagatacttttaaacatctctagattacttataataccaaatacaatgggaacgctataaaaatagttgttgtactgtatttttatttgtattattttcattgccatactgttatttttattgtcttttaatattttcgatttcaggttgattgtatatgtggatgcagaacctgtggctaagagaagttcaactgtgtctataatatgctatcttccgtgtaagtgtaggggcaaaggaaattttccgctccctctctgaaggttccagtttgctaaaataaactgataacatgaaaaacggtacgtaaatgtattaacatgcaagtgtgcacatacaaactatgtatgagccatacaaaattgaaacacaaaaaaggatgagatggctaatgcttaaatagcaccctcttcatagaggacaaggagatgagggaatgtaggcaatttttaggggtagtaaatgatttttaggagagttgattgggcccaaagaacagatcatcatttgtgaattgctgtgtttggaaactgaatgggaccttaagaacagacaatagtttgtgacattctgtctagatatgtaatattcctcagtctttcttcctgaaatatgagtttactcctctctaaataataaaatttcagggaaggtatccaaagcaattatgttccttctggagtagcttcagataaagaaccttcagagagttcgaccctgtgcttgggaagagacacagaaggtcaaaaagtccttgattctgaggccttctaatttcctttaattcaagtgctaagcatgtcaaagagctatacttttgggtatcattttctaagccccaacataagaaagaagggaaaataaaaacacatacatgtatcttatttgtcctatggggggaaaagtttccccaagccacctaggattcctggctaagcctaaaaataggagaaaagcacataattttaattcaataaaagtttatatattacatggcagcgagccatcataaggaaatgaagatccaaagacccaaggaaaactgtattttaaaaaataaatctgataaaagcagtgcagagttgtgaagaaacatgactggacaaaaaggggtatgatctaatggtaatagactggagggacaggggagaggagaaggaacttcagtaaggcctgtttgttcagattttttcctgtgtctctgtatgacattctttccccccacatatacagcaggatacttgcctcgtaagaacctttagggtaaaagggaggccagagagtgacctttccaggtttcatgcttgctttggggaagaggaattctagtttctatgactcacccaaggggagagtaattctgctttctatgactcagcttgggcaggaaaaatagtggggaaaggtgaatagaagaaagtcaaagaaactctgagccccttacaatctccttcagttcaaagtactcagcatgacaaagtaccataatttgaggtatcatgttctgagcccaacactacaaaattcaagttaggaaggttaaataatgtcccaggttggcaactatctgaggctggtattgcacaggtggtaaaaagaatttaccaagacagctgtacgtaaagaaaggcaggtttgagaaagtaggaaaatgcattgcaagaaaacaacaggtaggtcagcaggagaggaggtgactgacaggagagagagacttgctggggattttataggatgatgtttgtgctgtgtgctgaagagggctttctctttttgctttcccttggtcccaccagcccaactccccttctctaattaggactccacaaataaggcataacaaataaaaaaaaaaaacaggggagaagggaaagctcttccttacaggaaaatgtcaacaaatacacgtagaagaaatgaggcaatcagaaaactaccaaccggaagacaccatagtaataattgtttggaaaagaaggtgatacacaaaatatttacctaaatgcaaaatatctcaaggggtgccagataagatagccaattagaagcagctgcagtctgcagctgtcacagggaggagtgaaaacaggaagcgaattctgtaccttcaactgaggtatccaggttattgcattaggactgactaggtagacagctggacccatggagagtgaggaaaagcagggtgaagcaatggcccacggagcagcacagagccaggggaacccccacctccagccaagggaggtggtgagtgattatgcaccctcatctgggaaaccatggtttccccatggatctttgcaaactgtagatcaggagatcccctcgtgagccaatgcgaccagggccttggatccgaagcagagagctgtgtggaaactccacataatggccactggggcatgcacagaggcccaagggttttgtataatctggccctgggaattccagtgaggtgggagatccatccacgcattacgctaggaagggggctgaatccaggagttaagtggcttcattctgtgggccctactcctacagcaccttacaggttaagacccactggcttggaattccagccagccagtggcagcaggctggagactgcctgaaacagaccaagttcctggggggaagggcagccaccatctctgaagttaagagtgggccattctaccctgccagctccagggagtccaggctgtctggactggaaggagttccccacaatacagcatagctgccatgccagatcatggccagactgctgctttaactgatccctccctcctcactgggtggggcctccctgtgggaattacagcaacttcagccaagtttttcagacagaactctgatctctccctaggatgaagccccagggggaagtggccactgtccctgtggttcagctggcttagatgttccagcctgctggcactgaagagtccgggcattctggacgagggggggttccgcccagtgcagcacacctgctttgctaaggggcagccatactgcttgtttaagtgggttcctgaatcccttcctccggactgggtgagtcctcccaataagggtctccagacgcctcctacaggagcgttctggccagcatcaggttggtgaccccctgaaatccattagctcccagaggaaggagaaggctaccctctttgctgtttcacagccttcactgatgatatctccaggtgctgaagggaacaaggtgaccagggtctagagtggacccccaggaaactgcagcagctctacagaagagtggcctgaatgttaaaagaaaaacaaacagaaagctacaacaacaacatcaacaagaaagaccccacaaaaaccccattcaaaggtcagcaacctcaaagattgaaggtagagaagcccacaaagatggaacagaatcaatgcaaaaatgctgaaaactcaaaaagccagagtgccttttctcctccaaatgactgcaatacctctcctgcaagggcacagaactgggctgaggttgagatggctgaattgacagaagtaggcttcagagagtggttaataatgaataacaaactttgctgagctaaaggagcatattctaacccaatgcaaagaaggtaagaatcatgatgaaacaatacaagacctgataaccagaacagctagtttagtgggaacataatagatctgatgaagctgaaaaacaacacaagaatgttacaatgcgaccacaagtatcaatagcagcatagaccaagcagaggaaagaatctcagagcttgaagacaatctttctgaaataagacaggcaaaaaaaatagagagtaaagaatgaaaatgaacaaaccaaacctctgagaaatataggattacgtaaagtgaccaaacctatgaatgattggggtacctgaaagagacaaggagaatggaactaagttggaaaacatacttcagaatatcatccaggagaacttccctaacctagcaaatcgggccaacattcaaattcaaaaaatccagggaaccccagtaagatacccaacaagaagataatccccaagatgcataatcgtcagattctcctaggttgaaatgaaagaaaaaaatggttaagagcagccagagagaaaggccaggtgactaacaaagagaagctcagcagactaacagcaaacctctaagcaaaaaccctacaaaccagaagagattggggccaatattcaacattcttaaagaaaagtatttccaacccagaatttcatgtctggccaaactaaactccataagtgaaggagaaataagattcttctcagacaagcaaatgctgatgtaatttatcaccatcaggcctgccttgcaagagttcctgaaggaagcactaaatatggaaaggaaaaacccattaccagcaacaactacaaaaacacactgaagtacacagaccagtgccactatgaagtaaccacataaacaagtctgctaagtaaccagctagcatcatgataacaggatcaaattcacacataacaatagtaaccttaaaaataaatgggctaaatgttccaattagaagacagaatggcaagctggatagagtcaagacccattggcgtgctgtctttaagagacccatctcatgtgtaaagacacacataggctcaaaataaagggatggaggaaaatttaccaagcaaatggaaaacagaaaaaagggggttgcaatcctagtttatgataaaacagactttaaaccaacaaagatcaaaaaagataaagaagggcgttacacaagggtaaagggttcaattcaacaaaaacagctaagtatcctgaatatacatggaccaaatataggagcacccaaattcatgaagaaagttcctagagaactaaaagagacttagactctcaaagaataatagtgggagacttaaacaccctactgtcaatgttagacagatcaccaagacagaaaattaacaaaaatattcaggacctgaactcagctctggatcaagtggacctgataggtatctacagaactctccaaccaaaaacaacagaatatatattcttctcataaccacacggcagttactccaaaattgatcacataaatggaagtaaaacacccttcagtaaatgcctaagaggcgaaataataacaaacagcctttcataccaaagcacactcaaattagagctcaagattaagaaacttatttaaaaccacacgactacatggaaattgaacaacctgctcctgaatgacactttggtcaaaaatgaaattaaggtagaaatcaagaagttctttgaaacaaatgaaaacaataaagtatcagaatctctgggaaacaactaaagcagtgttaaaagggaaatttacagcactaaatgccacattaaaaagctagaaagatctcaaattaacaacctaacatcacaactagaagatctagagaaccaagagaaaatgaaccccaaagttagcagaagacaagaaataaccaagatcagagtggaactaaggagacagagacatgaaaaacccttcaaaaaagtcaataaatccaggagctgattttttgaaactattaataaaatagatagacactagctatactaataaagaagataagagagggcagtaaaatagacacactcagaaatgataagggggatatcaccgctgaccccatagaaatacaaacaaccaagagaaaactataataaacacctctatgcacatcaactagaaaatctagaagaaattgataaattcctggacacatacattctcccaagacagaaccagggcaaaaattaaagccctgaatagaccaataacaagttctgaaattgaggaaggaataaatagcctagcaaccaaaaaaagcccaggaccagataaatttacagctgaattctaccagaggtacaaagaaaatctggtaccatttctaatgaaactattccaaacaaatgaaaggaaagactcctccctaacacattttatgaggctagcatcatcctaatgccaaaacctgatggagatacaacaaaaaaagaaaacttcaggccaatattcctgatgaacatcgatgcaaaaatcctcaataaaatactggcaaactgaatacagcaacacatcaaaaagcttatctaccatgacccgacagttggcttcatccctaggatgcaaggttggttcaacatatgcaaatcaataaatgtgattcatcacataaacagaactaaagaaaccacgtgattttctcaatagacaccaaaaaagtcttcaataacattcaacatccttttatgttaaaaactctgtataaactagatattaaaggaacatacctcaacataagagcaatacatgacaaacccccagccaatatcacactgaatgggcaaaagctggaagcagaacccttgaaaactggcacaagacaaggatgccctctctcaccactcctattcaatgtaatattagaagttctggccagggcaaacaggcaacagaaggaaataaagaataatcaaataggaagagagaaagtcaaattatctttctttgcagatgacataattctatatctagaaaactctgccgtcaccacccaaaagtatcttaagctgataagcaacttcagcaaagtcccagcatacaaaatcaatacgcaaaaatcactagcattcctatacactaacaataggcaagcagagagccaaatcatgaatgaattcccattcacaattgtcacaaagggaataaaatacttaggaatatagctaacaaatgaagtgaagagcttcttcaaggagaactgtaaatcactgctcaaggaaatcagagaggacaaaaacaaatgaaaaaacattccatgctcatggagaggaagaatcaatatcgtgaaaatggccatactgcccaaagtaacttatagattcaatgctattcccattaaactactattgacattcttcacagaattagaagtaactgttttaaaattcatgtggaaccaaaaaggagcctggataaccaacacaatcctacgcaaaaagaacaaagctggagacatcagactacctgacttcaaactatactacagggctacaacaaccaaaacagcatggtacctgtaaaaaagaagacacctagagcaatggaacagaatagagaactcagaaataagacggcacatctgcaaccatctgaccttcgacaaacctgataaaaacaagcaatggggaaaggtttccctatttaacaaatggtgctaggagaactggctagccaaatgtgaaaaattgaaactggaccatttccttacacaatatacaaatttaactcaagatggattaatgatctaaatataaaactcaaaactatgaaaaccctagaagaaaatctagatagtaccatttaggacataggcactggcaaagatttcataataaaaatgccaaaagcaattgcaacaaaagcaaaaattgacaaatgggatctaatttaactaaacagcctctgtgcaacaaaagaaactatcatcagagtgaacagacaacctacaaatgggagaaaatttttgcaaactatccatctgacgaaggtctaatatctagagtttacatggaatttaaacaaatttacaagaaaaaacaactcaattaaaaagtaggcaaaggacatgagcagacacttctcaaaagaaggcattcatgcagccaacaaatatatgaaaaaaagcccaacatcactgatcattaaagaaatgagaatcaaaaccacaatgatataccatttcatgccagtcagaatggcgattattaaagtcaagaaacaacagatgctggcttggttgtggagaaaaagggatactttacactgtgggtgggagtataaaattgttcaaccattgtggaagacagtgcagcaattcctcaaagatctagaagcataaatgccatttgacccagcaatcccattactgagtatatacccaaaggaatataaatcattctattatagagataacatgcacatgtatgttcactgcagcactattcacaatagcaaagacatggaaacagccgaaatactgctccatgatagactgaataaagaaaatgtggtgtgtatgtatatgtatttatatatatatatatatacatatacacacacacacacacacacacatacatacataccagggaatactatgcagccataaaaagaaacaagatcatgtcctttgcagggacatgggtagagttggaatctgttatcctcagcaaactaacacaggaacagaaaaccaaataccacatgttctcacttataagtgggagctgaatgatgagaacacatggacacatgcaggggaacaacacacactggggccttacagtgggtggcagagtgagggagagcatcaggaagaaaagctaatggatgctgggcttgatacctaggtgatgggttgacctgtgcagcaaaccaccatggcacacttttacctatggaacaaacctacacatcctacatatataccccagaacttaaatgttgaagaaaagaaatagtgtctcttatgagattcttattaactactaaaagaaaatagtaactttacagtagataatctggaagctaccttaaccaagtgaacaatgcataatcagtaatttaacaaatatatattttaaataccttctcaaatcatgtaatgagaaggatatatcccttttgtagtacttctgccaaaaatatataacttgaatttaatcataaggaaatagcagaaaaaaaattaaaggctattttacaaaataaatgtcttatatttggggaaaaaaataaattcaaggtcttgaaagacaaaggtagactgagaaatattcttcattgaagatgactaaaaagacatgaaaactaaatgcaatgtataacactagatcagagcctggaccagcaaattttttttataataaagacatttagtggaacatttaatacaattttaataagatctataagaatagacaatatttagaccaatgctaaattcctaattttgatcattgtaccttggttatacaaaagaatatacttggttttagaaaatacacagtgaagtattcagggaaaaaaggcaaattgctctttaaccacacccccaaaaaagtatgcatgtgtttatgcctaaagagaataacacaaatatagtaaatgttaattttggagaatctgagtaaaagttatacaggttattttttactatttttgtaacttttctttgttttagattatttataaataaatagtttttaaaagaaagctacagatccaaaaatccaaactgtttgaagaaagtattatactaaaactatagcaaaattagtaatcagaatgtaaatatgtccaatatgaatataataaaaggaatgaaaaagatcttcaataaacagaatgctcagagatagaagaaaatacaaagtcaattttttaaaagccaaacaaattatgttggaaaacaggaagagagggaacaagaggtagaacaagacagatataacaaagagccattaaaaatggaataaaaaatagtcattgcaacaaaaattaatagatattataaaccatagactaaacatatgcagaaaaattggaagatagcacaagaaatcccctcagaacacaacactaaaatgctgagatctaaaatagataaagagctgtacaaaagcatgaagaatagattgagagggtccaatatacatcttctcagagtatcatgaaaggaggatgaagagaacgctgaaaaagcaatatttgaataaatacagctgagaattttccaggatttcaaaaagagatgagtccaccgatagaaaaagctttctaagaggcagtgtacatacataaaattaaatatgcactcagacacacaagagtaaaactgaaaatcagcaggaataaaaaggaaatcttaggatctacaataggaaacaatctacagaaaaacagcttaattaagcagagaaaccaaaagtaatagaacatatgctcacagtgccatgagaaaataattgctgtcctataagcttatagccagctaaattatcatgcaaaagggagagtgcaagcatacaaatattaagataatttaacaataaatatcctcacaacaataattactaaaggacgtacttcagcaaaaagaaaaataaactcagaggaatatctaagtacaaagataaatagtgagcaaataaataaataaaatatatcataagtcaaatatgaagtattgtatggatatgagagactggagtattcaatgagttattaaaatccatcaaggtccttgtcatatttgagaaagataaatataactttagatttcttagaataatatatagattattatgtatgccaaaaagataaccaattaaagaacagaagacaatcagatgtttccaaccagcagaggaaaaaataagaagaaaacatagaaaaattttcagtacaacaggaggtacaaatgggtgggtgaaggagaaaggaaaaggatggtcaatgaacaatgtccttaaatggcggaataagtctaaagacattaggacccacaataatacaaatgaactaaacctatctatttaagataggtagcaaactgaacaacataaatgttaataacggtagttaatacttcctattctgcaagtgctttacaaagattaactcactgagtcatcacaatagcctatgaagtttatactattagtgcaccattattatggataagcatattgagatttaaagaattttagcaaattgtccaaggacacacagctagtaggtggctgtgatttacaccaggtaggcttattccagagtttaacctttgtgaccattctattctgctaagactcaatatagtcatatgatcaaaagttatgtattattaaatattatactctagaagaagctttatggatgtcaaaatgccagcaggattattttaagtgaaaaagtatgttataaaagaatatatactaataccatccaaagtttgattaaacacacacacacataagcacatatacatactgagaaatccaccagagaacagttgtaattacttctgaatcttgtgataataggtgacatttattctgttctttatatatttctgtattttctacagtgcataactgtatgtcattttgttaaactttttttaatgagccttgtacagtgcctggcacattaatgatcaagggagagagggcaaaccacaaagtcctttcattaactaaagttgagtggaagctacagaaccaacgatgttgtgttatcttactatcacaagctcagatcctagggacaaataaactgcatacttaataaaaagattcagcaacgagaaaatcctaacaagctgcccttttgtgttagtttcaggatgtgattttggaatccaacctcaattgtggcttcaaaagaaacctgaaaataaaagcttcagctgtagaaatgcagttaaatatcagcattaaatagaacatagagcccaggaatgtcagagctgcaaatgtacttatggagattgccacctacagactaaatctctcacttatacatcaggggaaaagatccacaaaagcagagacttgtccaagtttacatagactttcatagatgaacccagactggaactcagtttttctgtcttggataaagaaactgaggtttctgacatgaattacttgcccaaaattacacagctaccaaaaggtagagccagtattctaatttggtttgacaggattccaaaatccattctgtttctgaattataatcaaatagacaattttttaattattcatagaaatcttatttaatcaacaaatttatcaattgtttattatttaatattcttcaagaatatgaaagtattgaatattattcaataatttttattcacctagcacttccattttactagcactaaagaagaaataatttctctcttctttcaggcttcctcttcctgttgcttgaatatctccttctctccatatatatgtatatgtatatgtatacgtatatgtatatgtgtatatatatgtgtatatatgtgtatatatatgtgtgtatatacatagagggagaatcaatccatcacctcaagcatttatcctttgtgttacaaacaatccacttacacccttttagttattttacaatgtacaattaaattagaaaatagatatttttaagttactatgaattggagatggagttttttttaagaattttccctgtgatctctttcctttttaattttctatgacttactctctgaaaagcccaatacttttagaaagcaggtgtcatgtcatataattgcagttctccttttaaaatttaattttgtttccgttcccttgttattttttccctgtcaacactaccaatagttgcactcacaaataggcagtaacccttgcctgcatgcctagtgctgttttcctgtattcattttgcttctgattaaacacatttgtattaagagtgtacttgtagcacagccactttctacatgaaaggagaattttgttgtggtgatgaatattgttttccagtagataaaataatttctaaatatcttctctattagctcgatattttcaaccaggcttcatcctagataaaagatcctaactgaatgtagcaggagatcatcgtcccttacaggcttccaggaaatgctctcttcactgtcaattatttatattgtgaacatccaggcaaggagactgcatagcattctgcttttgtatttttcaaatttgcctcatctttgtgatgtggaaatttgtatggtgatgaagaaagtacacattcatctaatgagtgagaaataaatagtttttattttttgaatacattttggtagttggggttagatgtgatggaattaatgttttgtctctaatgtcctaggacctagtgtaggacctatttattccaagtactctgcctatgttatcccaattcattcttcacaaatatcttacgagggaactgtcaacccattttaacatgaggcttagagtagttaagtaacttgcctgaggttgcatagctaagacatgatggagtctgaatgtaagaccaagttgtccttgtgttctttacactgaaacacacttctcttcacaatctaaacatgttaaagtgatcaagtggagaaaaagaatgaaataagaattatattctttattcagcctgacacattttaattggcaaggaaatactaaatcagttagttgttctagaattgaaccacttacattataatttttatttaagaaacacaaactgctttttaaaaagcaatgaaaggctttagaaatgtatcagttttctaacataattatttgtctgtgtgtgtgagcaagtgtgggagaaaagaaagagaaagagaaatggggtggggtagacttatgggcacgcctgtgtgaacacacacattcagctattattctaaagtggaaatcactccccagcaacatattcagaaatttagctgggagatagaagggtaggaagccacaaaacaacatttaggaaattactagcaaagtaaaaatcctggtgattaaaaacaaaaagaaaaaaaaggggaggcacaaaagacacttgaaaccaagtgcaacaagttaccatggcaactagataatgtgggttgagatttatatgactccattgttccagcagagaaattctaaatgacaccctagtggcctgacagagtcgatgcatctcccagaatgctccggcttattactcaagagtgctttaggcacagagaaagaacaagatcacagtaactttgtcagttccagccttcctaagacacttgtttcttcattctggaggcaaaacattctcaatttctggagccagtcctgaccaagcttagcagaatattagcattcttatatttacctgtggttgaggatagcatttaccttactgtctgaagtacgtgatccagtatgaatggaatcagctttgggcacctaaatccctctttgtttttctgctggaacagtagtctgccctgattcccaggcaactttagctaaggctctaaaattctgactaatcattaccattgttaattaacaacaccatcagcacaacaatctagtattcataacaaatatttgttgaaaatatattacctctaatgctaattaacaaaccccaaagtagttatcatctatagatgctcatatgtttttattactttgctacacatgaatggcaaactgaggctaagaaaacttaagtgaccaaggtcccaaaacagccaaaatttgatttcagaaatgacaacaaaaccattgccagggggatttatcttactacatcaaatcttggctgtggttgggtccaggtccaccattttaacataaacactaacaggaataaaagacacacagaatattatggcttggtcctgttgtaccccatttactgcatgggcaggctgagatatcagggacagcaactccagtccaaattaagtccaaattagccatgctcctattacctctgaatattagatcactagttgagaaaacaggctgccctatttctaggttcattatcttagctggaactccatccgtttcttgcttctcactctttctcactgaccctcaatggaaggaaaaaataaaaaaggaggaggcaattaagatgtttaagcatctattatgtgctgggcactctatttgaatatgttatctcattaaattcctaccaaaaaatctataggctaattattttcctttctgttttacatatatgagaactaagaatcagcagataaataatttccaagggttatacagtaattattagggtttaaccaagtttctttgaccctagtcccttgccttttgtcccttaacccttggcattcctctcaacatagcttgttcagattataattatgtttagagctggaagggaccagagcatgatcaattttaagagatgtaattagtcaatatgaaagtactattaaaagtaatcaaaatagagaaaacagtaggagttagctgcataaattaaaacaaacttatgcatagccttatatcctccaatatgtaattctaaacaaggggatttttttttataaaagagattttcctttttttttttttaggaacaggtgtgcatagattaggaatttctattatgccaaggtttcattcgttgcaataaataagctcccattttgtagagaaacaaggtagttaataagcaaaccagtaatggcagcttttggtgtgactatttcctgataccaccaagcagtttcctccaagtgagactagttgaagccatgcttggagatataactgttattagaactgcccatttccctcatttggtacagtaaaggttagtttcttccctcagagtggaattaggtaatcattagccatcttccatgtcacagaggtaatactattagggcataaattaatacacatagttaaaattttaatataaacttgaacagtattagaagttagaccactatttttcatgttacacttctgtaatatgaacttctttggaaaaaaaaataaaagcaagttaccagtttccagtagagcaaaatgtgaataaatttaacaactatactgtgttatcatagcaaccaatttaaaaaaaaactgatatgataaaaaatgacacaagagaacaaatgtatcaagttgttatggcaactggggaacgtgggttgaaatttatgtatctagaatccaagagaatattctaagcaactaaaataaacatttgcttattaaaacatcccccaaatagcacttacctataagcattgaagtgttttcattattttgtctgctttttcttttatttccaatggatgattttatattgtgagcatttgtattttcagttcagcttactttttggcaacagatacaccaagatgcagtttggtttgcagaaaatggtgcaaaagccaatttcaaaatagcatcctcaatcatgttttacccttttactcttctcttaacaaaatgtctattctatctgctttttctttataaagaagctcttgcttacttgatcaatcaaattcattatgttatctttacctgattttggaagtcttcccattagacaggatatgggttaaagaattatataataaatttggatatttaggaagtcttccactaatttatgcacgcacacttttcttttagtagcataactggttgttttggactaaatgttctaatggcatctgcagtttctacagaactttgcccatgctcatgtagagtatctcattgtgagagcaggaaaggtgagattctctcatgactccatgcatttttgtaaaaccttttcccagtgccactaatactcttttttccacccttctatctgcttggctgattcttaatcataactttccactgtctacccatttgagctaagtgtccctcacctttgtcctcataacaccctctgcatacttacagctaagtgccatcatcctcatcgaaatcaacataattaacataatcattatcacatatattacatattaagcattatctgtatgttagtgactgctaactacttcccaaatatcatttcatttaatcttcacaaaagccatgtaaggtagatataattaccgccacttctctatttcataggtaagggaaaactgaggcctagagtttgtcacttgatttaggtcacatactaagttacagccaagagattttaatccatgtcaacaaaataccaaagctcatttctttatcatttagttagtcactaaaattttttctttagtttgttttgacattaaactatgaactttttgagaatttccatgtgcctacactgtagattttctgaacacatgtcttatctctggtatctcctgcactgttaaatagagacataatatgaaccacaattgtgagccatagtaaaattttgtattttctagtagctgtattaaaaaagtaaaaagaaacaaaattaatttaaataatatatttcatttaactcaatatatgcaaactattaccatttctacatgtaatcaatatataattattaatgaagtattttacatttcttttttagtactaagtctttgaaatctgttgcatattttatatgtatccaacatctcaatttacacatgcagctttagtggctaccatattggacagagcagctttaactcatgcctgataagtagatatgtaaagaatgttcaatacaagttttgtggaatgaataaataaatgggcaaatacatagaaatggagaattttagatttgtatttatagaatgacccaatttacctttatggaacttttaacagtttgtttatgaggaagctaaaagtggctattttaagacagaacatagatacgtagtagtgtattcatgttgtgataattccaggattactgtcacatcctgacctatcatggagaattgcctgcccagacacttgtgtatgctgaaatccatagcggtgtatcattagtcagctcaaaaagcctcccatttttagaacatgtgttttccattctcaggctcgggtttcaagttataattcatcatatatttcattttaaaaactcctttagatcattttaatcaatgcctattaacagtaagttaagaatatacattttaaattaaatcaaaatcagcccatatcgataatgaataaataaagtatatctcagagtatcccccttaaagaatatttttatattaaagccctggatgtgctgacaccacactgaatattactggtagaaataatcaacattttaaaaatccatttacatgataacagatatactgaacattgtaatatctttgcagtcaaaaaaccaacctcgaaatcacatctcagtggcaatactgaatattactaaaacactggcccaggggggaaatctatagaataaaaccggcaattgctaagactttacataataaaattatccttgactaaaaataaaccgaagaaaaacatcagggaatgagaatatggtgattactctagaaaactttaaaaaattcttcagaatacctatatgaaaagccaaagggggagaaaagaacaaataaaaatatggctgtcatgacctaacggttcattgcctattaggatgggacccactgacttatcttacaagggaactgccaattctgcttttaatgttattaatttgagtgctaactataatagacatgattaaaaatatatcgaattagaaaaaaaaggaagtataaaaactagacaaaattgctaaaaataacaatttcaggactctgggaaatgaccaaaagtgtacaacaaattgagaaatgtttattcatgaaaaactactcaactacaggtaagagagtggaaattagtgtcagcgttgactgggcatgctcccatctccactccatccagctcagtttgctagttctattaggatgggaaaagtagtaagaaccagtatctttgcagcctaagggaactcgcttgatttggagtggaacatgagaaaaaaatccacactcagtggcattggcagtaacagtaacagtctcagtggcaagcaaaaggaataaacagtggctccagtgaccttaggttgtagtgctggttggggcatgcaaaacatcagcagactaattggtagttcaacaggaagatccacgaaatgagacggccataaagggccttgataagctattcacaccaccctgctgatgggaaagtcttaaaactgttcaggagagattagagaaggccttagtctctctatgtgtccctggctgaatataatccacaagcgcagaggagacatgggaatagaggacctaaagagagtaaaagttggcaatggcttgtaaactacttgaactatgaatggaatccccaaaccaaacacagatccatcagtagagggtggaagccttgctgattcaagatatttaggcacaaactctaaccaaatattggctgaccactaagctatgctgacataggggtgacccatagaaagccaggatttcaaacaaaagtaaatattaaaatcctgcagggaaagagattacatagattgaatgcaggaaagttgcaaacaaacaaaacacaagcaataacaaccatcagagtgggaggcagaatctagatttgctataatctggtatctaaaatgtctagtttttttaaaaacagacaagcaaagaaacatgaaagcgtgatccatgctcaagagaaaagcagtcaacagaaactctcttaatgaatacacaatagacctaacaatgactttaaagcaaatattacaaatatattataagaattaaagcccatttttaaaaaattaaagtatgactataatgactcaactaacagaaaatctcaataaaaatgaagcaattgttttaaaaatttaagtggaaattctgaagtataacatttaataactgaaatttaaaactcactagagagactcaacaacagttctgaaatgtcagaagaaattatcagtaaacttgaagattagaaatgatctaacctgaagaacaaagagaaaatgaagaaaaattaacagagccttggagacctctaggacaacatcaaacacaccaacacaagtaacgggagtcccaaaaggtgaaaacactgggaaacagacagtaaaaataagccccaagcttttaaaatttgataaaaactgctaatctatagatccatgaaactgaacaaaaccagaatagaaaaaatgcaaagcaatatccatctaaatacatcacagaaaaactgttgaaagaaaaagagaaaatttttaaggcagcaagataaaaaatatgactcattaagtacagagaaacagcaatatgattaatggctgacttcccataagaaagaatggtggctaaaagacagtggaattatatatcaaagtgcttaaagttaaaaacaaaaacaaaacctgtcaaccaaaacctcctcgggaaaattattcttcaaaaaggaaaacaaaataaagtcattcccagatgaacaaaaataaaaaaaattcattcctagagacctaaaaactggaaagaacatttgtccatcagtggccaaatagttatacaaaccatgctgtatctattcaatggaatgctatttggcaatataaaacaacacactattgatacacacgacaacttgaatgtatctcaatggcattatgctgagtgaaagaagctagtctcaaaagattatatagtgtatgcttccatttacatatttttcaaaaacacaaaactatagcaatgaggaagagatcagtggttgtcatagactagatgtggttggagaaggtgattatagagagttagcaaaaggaaagagggtttgaggaattaaaattgtcttatatcttgattacaatgatgattacatatgttaaaattcaaagacccatgtaccaaaaggcatctttactttataataattggaataaaataaaataaaaccaagaaaacccacatagttgaacactacactcacaatgaatgtattttttttttcttagagacagggtctcattctcacccagactggagtacagcagtgtgatcatagctcactgtagtcttaaattcctgagctcaagagatccttgcacctcagcttcctgagtagctaggactacagatgtgagccaccttgactggaggatgtatcttataatgtataaattatacttcagtaaagctgtaaataaataaaagttactgtgaaactgaatctaattcaggcaggacttctaatgctttagacccttcagaaatgaaagtttgttcatcctagcaaaggatcatgaataaatagttcaggtactcaaatatgtgtaatcagtatagaaaatttcacaaaaagaattgagttgatttaatagaatttacctcccaaaacacttccttgaaccaaattactggtatagttttcttaaaagtattcacaatcatacacattgtttaaacattctcagggtcagaatagctcggactaaactaagtagctcctgagtcaaaatgatatatcacataccagaatctctggaagacaactacagatgtgttaagaggaaagtttacagcagtgaacacctacaatgaaaagttaggaagatctaaaatcaacaacctgacatcacccctaaaggagcgaaaaaaaaacaagagcaaatcagctccaaagctagcaaaagaaaagcaaataaccaagataagctacactgaatgaaattgagatgtaaaattcatttgaaaaaaatcaatgaaaccaaaagttggttttctgaaaaaataaacaagattgatagattgctagctagattaataaagaaaaagagaagatccaaataaacacaatcagaaacgacaaaggtgatattaacatcaaccccacagaaatacaaaagctctgttatgaacacccctatgcacataaattagaaaacctaaaagaaaaatgtttgatatcactaatcattacagaaattcaaatcaaaaccacaatgaaataccatcttacactggtcagaatgattattaaaaattcagaaaatgacagatgttggtgatgttgtgaagaaaagggacaattatacacttctggtgggaatgtaaactagttcagccactgtggaaagtactctggatatttctcaaagaacttaaaacaaaactgccattcaacccagcaatctcgttactgtcattactgggtacatacccagaggaatataaatcattctaccaaaaagacacctgcactcatatgttcattgctgcactattcacaatagcaaagacatggaatcaatctgggtgatgaaatcatttgtctatatgcatgcgcgcgcgcgcacgcgcgcacacacacacacacacacacacacacacacacacacacacacgtttggatatattcccaatgaagaacaacaacaaaatggcgtatggtgtatcgtaactttccgtactctttgctaagactttttggacccagtagtggaaggaaataacagaagttaaactctctaccactttttttaagcaaaactatgtaatcgatttcactcccaccacacaccacacccccaccaacacacacacacacgttgttcccccacttcatcctccaccaggttccactggccacacaactcaagatctatggaatgcaaggaagaaaacagtcctggctagcttgaaaaaatttactgacacgctctcagaagaattcatgctaagaaaatccatatcccatcactaattttcagggtatggcaatggctttctcaagaatattacagggaacctttggagtatgacagcaaattgcttcaaagaggctttcttgcttttctccttcaaacatgtgtatctcatgtatgacccaggaagatatatatagattggttttctgggagttttttcctccatccacagatatggcagaaatatactaccattgatgggcaggcagacattccagcaacagatgaatattgaatacttcttataagtctactaagagctttacatacattatctcaattgacccttacaataagtttgagagatggctattattattttcatattatcctgggctttttgaggctcagaagtgtgaaataatttcccccaagtaatgcggttaccttaaaataccctatgaaaaatgtattattgctattttacaaataagagaaatgaagtgacttagcaaaatttacataaatagaaaggagttgaactggaatcaaaatgcaatttgatctgactacaaatttacacgcttatcatggtggaattcgcgtacaggctttggagacaaaaagacttagggttatatcccattctttccacttactagtaccatgaccttgagcacatttcttacttaacttctttgtgcattggtttcctcatctataaaatgagaataaaagtgataaagcatgtattgagttcagtacatactaactactccataaaaacagctggtgttatcattatcattacaatcttgtattattaacttcagctaaattaaattaattcatccaaggaattctgatgggactgtgacatagagatagttatctataaggaattgggaggggaggtcaactacctagaacaaagggaacctgggggagaaaccatagggggagtgcctgattggccaggaacactatgacagatttgagaaccctaaggtagaaacaagtgcaacaggcattggagtacaaactggaggggaattaataggcacttattaaaagtgctaggaaacatgatagctaccttaaattcttcatcttattttatctggaataagaggacccaatttttccttttaatatttccttagattataataaatcaccaaatcctattacttttgcctttgaaatttctctcagattcattgtcccgtatcattcctcttattccttctgtcatctccctgaatcaagtgcctatctttttatattcagatgcttaaaccggcacggtaatagcatgcactccattcttcacttcaatccacccatgttcctgtggcagcatggaaagcacaggatttagattaggacagggctattttgttctctttaggctttgaactgaaatataactttctgttcaaaatatgaacagaaatatgcctttctgaagtgtacaacttcgtggctttcagtatattaccattatccttatataattccagaacattttcatcacctcaaaaagaaaccccatattcattagcagttactgtctattcccccttcctccaggccctggcagcaataatctactttctatctctatgaatttgcctattctggaattttataaattgaatcatatactatatgcactggctttttccacttaggataatgttttcaagcttcatccatgttttagcatgtatcagcagcacacgctttttatggctgattaatactcccttatacagattctatatattgtttatccattcatcagttaatgagcacgagggttatctctatttttggctattatgaataatgctgctatgaacattcatatataagttttcatagaaacatatattttcagttgtcttgaatatatacctagaagtggaattgctgacaactgtgtttaacattttaagggaatagccagactattttccaaagtggctgcactattgtaaatttccaatttctatatgagaattccaatttctccatatcctaatcaaacttcttccttctggtgggtgtgacttggtgtctcattctattttgacttgcatttccctaatgattaatgttatcgatcatctttttgtgtgttttagccatttgttcatcttatttgaagaattacgtattcaaattctttgcccatttttttaaaattggattgtatttttattgttgacttgtaagagttcttatatatgctgaatacttgaccctttcaatatatatgttttgtatattttctaccactctttgggttgtcatttttactttcttaacagtaacctttgaagcacaatacggttgtgctatgtggttcaaatgcagtgtcttggtcattttgtctgtcttaggctctgggtagccagggttatagtgctgcaggcacccatgtgaatgtgatggaataacaatggggcctcagggatggaaaaaattagtgactactggcccccagggcagaatgcactttagcagtggatttagtttcaagatggcaccattctgtaacagcttaggtcatggggatgagaggagtgtttaacatgggctcctactataaggcaatgcagtcatgcaaactcctggctactttcctcccaactgcatttggagtctgtgaagactgcaagactctcatgttggagaactgctagtgtctgtggtagcagtggggaccgtgagagatgtacagcttacttttttctcgtaagaagtcctttccaactccaagccaatcttagtgggggaaagagtatggaaaagctgtacaaggattttgctgctcccttggtactttccagcacacttcagccactgcagtcaaaatatagttatatattcattgttttggtccctctttgtagggggagacaggcttcaaagaacagtatttacccatcttactgatgtcctaaaagctgtttttcagtttaaatgctgcaatatgaatataaagatacaaagggcccagaagtctcagagagtagaatttcatataaagcaaacaagaggaaaacattttccgcactcccctcacccccacccccgccaaagaaaaattcaagcagaatagaaagagtatgggaggattgtggcatgaagttaaatgctggtacatccctcataggggcttataatcctgtccatcctcctggctaagcccctagtagggagaataatgagacaaactcataccgattgggatgggggagtagcacaaagcagatgaattttcatttattaattcagtttatttccttcatttattcattcatatattcatttaaccaacaaataattattgagcacttactatgtgccatgttctgtgtaagcattgggatgcagctaggtctcacttccatcataaagttggaaagtacaaaaagtctggtagagaactgttctatgtcagcctggctctgcaatagtagacataacagaagctaaatctaaaaagagaaggccagagatattccctacctgctattctcaagctctgaagcccaggaagaacaagggacagcatctaaaaattccctatgttcctgagaaaaaggtacgatagtggctgagggtgggagatggcccctggaggaacatcataattaggatgaattgagaggctattgtaatcagtacgaatctagttagcggaggcaaaggggaagaggacattttagtgcactgcagtaagagtcagttccagtgaccaaagatgttaatggtgactatatttttcaacagaaggcagcatgcatggatgcaataaatcatggacacattaacctccccactgaagccagagtaacaaggccctacccctgtggaatttagatcaaaggtctgaggagaagaaaataagtgaaaaggagggaccctgaagtcaccaagtagaaacctagaattgggcaaacttaaatcataaagtgaattattttctctgaaagtgacagtgttttttttttttttttttgagacggagtctcgctctgtggcccaggcgggagtgcagtggcgcaatctcggctcactgcaagctccgcctccagggttcacgtcattctcctgcctcagcctcccgagtagctgggactacaggcgcccaccatcacgcccagctaatttttttttgtatttttagtagagacggggtttcaccgtgttagccaggatggtctcgatcttctgacctcgtgatccgcccgcctcggcctcccaaagtgctgggattacaagcctgagccaccgcgcccggccgacagtgttttaaataatctgctatcactggaaatagggacttaactaaatatttttaaaatagaaacaattttgaaaagtaaaatttcatatactttggttttatggcaaaaagatgtatactcactataaagtatcattcattattttagataaaatattaactttttgtggtagaactttctttaaatatttatttttcttttggaatgagaattttcacactaagtagctccacaaacactagcaaattccacccagcgttgcctccttttatacttagggaaacaaagcacttttgaccataaagttgttgctcaaggttgtaaaatcagtgacaaatccaagttccttgacttccactccagtggcattttcattatcttcaaaatttctttaacaccaaatgaaaactaccacgcacacatactttggagactcaatttccaattggatgtgaatagtttaagtacgtttacaaaagtaaaattttaagaacaaactgttcaattttcctttatttaaattctctatagagattactaatgataaataacatgcaaagtatgcaatcctaactgagaaaataggtgagccaggcagtggtgtcctggtcagtgtttcacagctggttcctagtggttgaggggcctaattagtggaggctgctgatttccatagtgtaaatagtcccactataaccaatttcaagttatcaacatgatgtcaaaaaagtgggaagtttaaaattatttgaaaattttaaaatcaattttgcaagcttattacaagttggccttagcacactgctgggaccagggttgtttctccagagcaaagactgacttaagcatttacttattagaattcaggacattttatcaggacaatacactgaagtgctttaagaacatatatccacttagtatggataattatcatgaaattggtgtacttttaactacatgtggaaagtagctttttcttgtaatttcccccagccaaatataaaggaaagtgttaagtcttcacgcacatgcagttctctgaatggaatatttaagagaatagaaattaagtgtaaacacccttttgtgagattcacataaaaagaatcaaccatatctgtttaattttggcaccttatattcctctcatatgacacaacagaatagctacatttatacaaagtctaaatttttctcctttctacattataaagataaaagaaaactgagggcagttttaaaatggcttgtgaaatgtggtttaggcaaaggagtataggcacaagattgctaggcctctatacaatcagagagctatataatttggcagacctttctacgatgtaatattgaactttgccctttatagttgacatattactaaaatgatatgtctgtgttacattgtgaaaagtcaactcacgttttagaaccagagttctgtttttttcttgatcctagatatctttggaaatctaatgaaaactaatgagtctaatgaaacacttttaaagaacaatgcacatatttatagatacagaaaactttgcataaaatgttaaaggactcacagacattctgtcacttgaccatgggcttctagactcacaccaagaaccattttaaagtgtattaagaaatcttgacattcaaaggaaacccatgatgattattttagaaaagctatacaattatctgtaaaggaaagcaatcaccttaatttatattttccttaaattaagctttttaaacttattgagtttacttatgttaagtctagatttctagacataaatttctgaaagacatagtcacagatatgaggagtaaagggatctttagagataaaataccataccacaagtcctttattttataaacaaagagaggacctaagcactgaaccaactagaacaaaatctccatgaccgaggaggcctcataccattgtataaaggatacatccctggacaatttcagaaatttcagaaaccctgaattctagtaaagtcctgccatttattattcgcatggtattgggtcatcatttagcttctctaatgtttcctcagctaaaatcttagttatactacaaagttgttacaaggattaaatgaggtatttgtgaaaacagtaaatattctaatgccatgtaacaagttaatgaaattataattatgataaataacagacgaacgacatgcattcttcctgtcgggaccaaacttattagacgcaggtctagccaacacctaagacagtcttttataaagaaaaaaaaaagtggctcaaaggtactgagattagtggtcacaggaaagacttctggtataagtgggataatggaaaaagcactagattcggaattaagagatttcgttgtagttccaattctactactaactagtaaaactgaaaaattatttcagacctctggccctccatttttgtggagagcagattttcttaaacatttgaagaagtgccacagccagacccctttaagaacacactgaaaattatgaaaattctccccacaaaaagtatacatttggcacatcattgaaggatctcaagttagctattaaatttccacaagtggcatactaacaacccagacattacttataaattgtttctagaactaaatcaatttatatatatgaaatattctataaatgtacacattatagaattatagaattttgagaagtaaaattgaaggcaagtttacagatattttatgtgaaaaatgtttatatttagtaacagttattacaatattggtttctatatctacaacaaaaaggtatcattttactaccataattaaaaattatctactaaccctttgctacttttatgataaaatcaaaactcattattttggcatttctaatttgagttcaaccagctttttgcctcatttataactattcttctcttacaaccaccccatctttctcttacctcaagtcacttgccacacttaaattctcatcagttgatggatccagtggaacttttcatgctagattcactggggctccgtgcttttgtacctgataatctctctgccaaaagttcctctgttatcctaattcacccagttatcttcaagtttcaggtctaatgtcaaccttccccacacatactttggagaactagttggcagtactataaagttaaatatatgcctattttaggacccccaaattccactcctagacatttacccaaatgaagttaaagcctacatccacaaaaagatttgtacaaaaatgttcagagcaactttattcataatagccaaaatcagtgaataactcttcaatagatcaagttgtgatatatttatataatgtaatactactcagcaataaaaaggaatgtaaccactaatgcatacaaaaacatggatgaacctcaaaatcattatattgagcaagataagactgacaccaatgcacacatattttatgtttctatttacaagaagttctagaagagacacagctaatccccagggacaaaaatttaaaaaagtctaaggaataatgtgtgaagtgattctaaagatgcatcagagaacttcccagggtgatagaagtttatggtgaagtttacataattatatgcgagaatcaaagttcattgaaccaagcacttaaggtctatgcgtgttattggatataaattataactcagctattgcttggcttgatattctaaatattaattctgaaattcttcctctattataatagatctatattttaccaaccactcaaggtgattcttatgaagatggctagttgacctctctttggaaagtaccattgatgagagtttaaaacttgcccttttactaaaattatactttccacaaaataataaacaatatatagagttctaaccatgactttagacagttgtataaatacacacagtgagccacaaatagattaagccactgttcacatagtctagactctagatcccaaacctggatacacttcagaatcatatagaaaacaaaatatagaactttgggttctacccccacaccaagaacgcagaatatttttgtagtgagacccaggaattactttttttttttttttaagttttccctggagacagtgacatcaacaagatggcagaataagaacaaacatgctcatttcccccacaacaacaacaagaattctgtactcacccacatccaaaagtctctctgcagaagtcttgtgaattcagataggaggttgtaaacccccccatggagcccaacacctaggggggtcatttcgagagtgcacaccagcacccaggtatctgattcaacaattgtgctccagggttcaagcctagaaacagcccacttgccaaagagcttagctatagccctctttgtcttttagcctgctaccaaaaccatctgacacggggttgagatggaatcatcttagcaaagaggcttgtctgcctgtttaaatcagtcttgacagtgaatctaagagttatccagtggctcagctccagccttctcagttgaagtcccagctcagtgctgttcacggaagaatccagaaagagatttgttcatatctcacagcccaggcatctgagcctgcatgagactatcactaacctccatcctacagcggttcccaaggcggcccagtctcagcatcagccccttgcattgcagttggagaactaccccatctatgcagggacttgctgggagatgaatatttctctgagccaataaggctgggttctgcagcctctgtcccacagcagatatggaggtggtccagtctcagcttaggcccctcctgctgcagtcaggaaactatctttgcagagacctcctggagatacacatgctcattagagccaatgagaagggttctccagcttccttcccacagcagatcccaagggacctccctctcagctccagccccagtctgctgcagttgggaaactatcctgtttgtgcatatacttgctaggaatcacagacctgtctgagctaatgaatctgagctttccagcctccatcctgcagcagatcacaaggggccccatcagctccagctccttctgctgcagttgggaaactaacctgctgggagactcatgctcctcatggctaatgagaataagctctccagcctccagcccatagcagatcccagtgtagcccagtctcagctccagcccctcccactgcagttgaggaactatctaatctgtgcagggacttgcagggagacatgctcccctcttagccaacaagaccagcccctccagcctttgtcccatagcagatccaaagagagccagtctcagatcaggccccacccactacagtagggtagctacgctatctgtgcagagatctgctgaaagacccacacacctctgagccaatgaaacagtctcaccaatctcctttctacagcatctctggagagggctgagtctcaacttcagccactcttgctacagttgaagacccatgctgcctgtgctggagcctacatgtagaccaccaagacagtcttctatacctaggtccctggccagctttcccacacagccctggtatctgacttaggtgttccccaggtctgtctggcccagaaagctgtgaatctcaaagcccacgcaagacacatggcttgggtgccctttagtactggggtagctgtagtggtcacagtctcatgggacacaatagtcagtcttcttagagtctctggaaggtcctctaaagaagtacaggcacaaaaaagactgcaaagtaaaataaatacctatttcctcaatttgcagaaattgttacatccacaagcatcaagaacattcagggaaatattacctcaccaaatggacaaagtaaggcactagagaccaaccctaaagtgatggagatgtgtgatctctcagacaaagaattcaaaacaactacttcaaggaagctcaatgaacttcaaagaatacagaggatgaattctgaaatttgtcagagaaatgtaacagataaatcaaaataataaaaaaaattctagagcttaaaaatacaatgaatgaaatgaaaaatgtaatagaatcaacaacagaaataaaacagaagaataaatgagcttaaagacaaactatttaaaacacagaggaaaaatgaaaaaaatgaaataaagaaagcttatggactctatggaacaatgttaaagcaaatatttgtgttattggcattaaagagggaatggagaaaagcaatgtgataaaaagcttattaaaaaaaaaaacccaaaactttgcaaacctggaaaaaaatataaatattcaggtacagaaaggtgaaaggtgaacaagcatattcaacccaaataagaataacttaagacatattctaatcaaattgcaaaggttaaagacaaagaggattctcaaagctgtgagacaataaaatcaaataacatacaaggcagattcaaatatataaaatagccaagtatataaagcactggagcatccaaatatataaagtaaatactaatagatctaagggaaaaataaactgcgatataatagcattagggactttagcaccctattttcagcaatggacagatcatccagatagaaaaatcaacaaggaaacatcaaatttaaaatgccctctagaccacatagacctaacaggcatttatagaacatttcattcaactgctacagaataaatattctttcctccagcacatggaacattctccacaatagatcatatgttaagccacgaaacaagtctcaacaaattttaaaaggtcaaaataatattaagtctcttttctgaccacgatgtaacaaaagtgaaaatcagcaaaaagaagaaatttagaaactttacagatacatggaaattaaacaacatgctcatgaacaaccaatgagtcaatgaaaaaatcaaaatgaaaattttaaaaattctcaaaacaaatgaaactgggagcactttcataccaaaagctatgggatatagtgaaagcagtactctaagggaaatatataacaataaatatctacataaaaaatctaaaaacttcaaataacctatcaatgcacctcacagagctagaaaataagaacaaacccaacttatattattaaataaacttaatattaataataaatttattatttaataataaatatcagttctaaataaatatcccataggttttggtgtggtgttttctactttcattttccattacttttaatggcaaaaaaagcattacttttgcaccaaactaatacaacacaaaaataaacatcagaccatatataaatgaaattgatactaaaaaaatacaaaagatcaatgagatgaaaatctggttttttaaagacaaacaaaattaacaaacctgtagctagattaagacaaaaaaagagaagagccatataaacaaaatgagagaagagccatataaacaaaattagagatgaaaaaggagacattacaactgataccacagaaatacaaaggatcattagagacaactatatgccaacacattaggaaacctagaagaaattagtgaataaatttctggacatatacaacttaccacaagtgaatcaggaagaaatagaaaacatgaacaaataagtataatgagatcaaagaagtaataaaaagtctcctatcaaaaaaatgcctaggacctgatggcttcactgctgacctctaccaaacatttaaagaagaactaacaccacttctactcaaactattcaaaaacattgaaaagaaaatacttccaaactcattgtatgaggccagcattaccctagtaacagaactagacaaggacacagcacctaagaaagctacaggctaatatgcctgataaacatagatgcaaaaattctcaataaaatactagcaaactggataccacacattaaaaacatcatttaccataatcaagtgggatttagtccagggatgcacagatggttcaacctacaaaaatcaatcaacataatacatcacattaacagaatcaaggacaaaaacaatactatcatttcaattgatgctggaaaaacatttggtaaaattcaacatctctttatgataagaacttttaaccaactgggtatagaaggagcatacttttaaaatgataaagtccgtatatgacaaaccgacagctaacaacatactgaatggggaaaaattgaaagcatttccataagataccgaacaagatgaagatgctcactttcaccactttcattcaatatagtagtagacgtcctaaccagagcaattagacaaggaaaagaaataaagagcatccaaaatggaaaggaagaggtcaaattttatccttgtttgcagaagacatgatcttcttgttagaaaaacctaaacactttagcagaaaactgttagaactaataaatttggtaaagttgcaggatatagcatcaacatacaaaaatcagtagcatttctatatgttaactgcaatcaatctgaaaaagaaaccaagaaggcaatcccattaacaatagttaccaaataattaaaatacctagaaataaatttaaccaaagaagtgaaagatctcttcaatgacaattataaaactctgatgaaaataaattgaagagaacacacaaacaaatagaaagatatcccatgctaatgaattggaagaattactattaaaatatccatactccccaaagcaatctacgaattcaatgcaatcctttttaaaacatcaatgacattcttcacataaacagaaaaaaaaaactcctaaaatttgtatggacacaaagatcttgaaaagccaaagcaatcctgggcaaaaagtaaagctggaagcatcacattgcctgacttcaaactgtactacaaagctacagtaaccaaaacatcatggtactggcataaaaacagacacacaggccaatgaaacagaatagagaatccagaaataaatccacacatttacagtcaactcattttcaacaaaggtgtcaagaaaatgcattggagaagggacagactattcaagaaatggtgctgagaaaagtggatatccacacgcagaaaaataaaaatagatccctacctctcactttacaccaaaagtcaactcaaaatggagtaaagtcttaaatgtaaaacataaaactataaaactaacaaactaaatgtccatcagtgaattaatggataaagaaatatatataattcatatatatgtgtgtgtatatatatatatatatagatatatatatatataacaatggaatattattcagccataaaaagaaataaaattctgtcatttgcagcaacatggatagaaatggaggtcagtgtgctaagtgaaataaaccaggtacaaaaagacaaataacatatgttctcaaccatatttgggagctaaaaaaaagtggatctcatggaggtagaaaatataatggggttaccagagactgagaaggctataagggaaaggaggttgaagagaagctggtaaataggtacaaaaacacagttcaatagaagaaaaaagttacagtgttcaatagtatagtggaataactatggttaacactcattcattgtgtatgtatgtcagaatagctgtaaaagaattggaatgttgccaacacaaaaaacagataaatgtttggggtgatggatagccctgttacctggatttgatcattacacattgtatacatgtatcaaaatagcgcatgtatccccaaaatatgtacaactattatgtatcaattttgaaaaatctaaaacataaaagttccctatgggattcaaatgagcagcccaattaggaaagactgacccagacagtaagtattagcaaagaaagagatcagagtgtgatgtggttatctattcaactatatcttctccttgtatcaaaaagatttctaagacttactcaagatccaatctttttgttctacattttttcaaatgtaacacagaatacttgcattcctttacataatcaatagacacaatgttttatatagcattatatggtttggatctatgtcacccccaccctcaaatctcatgtggaattgtaatccccagtgttggaggtggggacgggtgggaggtgatttgatcatggggggcagatttcccctactgtactatcctcaagataatgagttctcatgagatctggttttttaaaagtgtgtggcacctccctgatctctatcttcctcctgctgtggctatgtgaagtgctggctcccccttcgccttctgccatgattggaagctccctgaggctttcccagaaccaggtgccagcatcatgcttcctgtacagcatgtggaaccatgagtccattaaacctattttctttataaattactcagtctcaggtatttctttatagaaatgcaagaacagactaatacatagtagaaagacctaagaatttgaagccagatagacctgggttggaattctagctctgccccttcaaagcatgtgacgttgaggaagtcatttatccacttgaagtctcaaactcctttttggcaaaaaattgagttattgatatttctttgatataatgaatatgaaagcaccaaatacatggtatataagtaataaaggtttgctttattttatcccaataaatgtgaacagatatttctacacttcagtaaaacaaaataaaatgggaaatctcctgaatttgtaatgaagtcgattctactctattccttcttactggttagaaagtgctaatcttctgggcgtggtggtaggcacctgtaatcccatctacttgggaggctgaggaaggggaattgcttgaacccgggaggcagagcttgcagtgagacgagatcatgccactgcactccagcctgggtgacaagagcaaaattccttctaaaaatgaaaaaaagcgcatatctttttttttaatttcaagtccaatgtcatcacatgtattttttgtcacaaaaaaaatcttcaaagattcatttatgtaacttcaatttcctctgggcagttgtttttcatagctacacttaccatagttctaatggtataattcattatctcatcatcgactggacatttcatcaaacacatttcactgttgagacaacttgtcagtgatattcaatttgctgtctcatcagcaatatagtatatagtaattaaatttttatcatggcatctcatccctattgctcatccataattcatatttttctgtcaaacatcaaccctacatatattgtactaatgaggagggaaaacagagtttaccttctcagatgtcttcttagactgtgtaaacaattgcattctttttctaagaggagggctagccaaaggcacaattgtgaagcaaaagccctactcccccagcctaccttccaggtatttgccaacctacacatatcatctacaacaaattctctctaaagtactaatgattatttaaaacaattataaatccaatttatctttcaagctgtaatgcaaaaactactccttctatattttttattcttcatcagtagcatttgagctaccaacttctggactgaccttcccattattttgtgaggttaccagtgggtaagttcaagtccttttttaatgcaattctcagtgcttaacacaatgcttggcacatagacccattacatgtgtcaaattttatttaaatgagtcaattttatattctgagagaatatttacattttgaaagaaatatgaaaagaatgaaagcttatatatccaaaaattcatattttggcacttagatgaaggagatatttatatatggggtgggaatggaactttcttatcactactcaaattatatcacattgtgtgcagactgtttcacccactcatctatctctccagcctcctttttacccctagactctaacataactattccttctgcttgattgccctttcatgccctctacatctggtaaactgctttttatccttcaaaacccatttcaaaagtaacctcctccaagaagcccttccaggcattctccacctcttctgagtttccagaagtggcatactgtgtttatgcctctagtaatagtacatagctaccagcaatggggtacttactgtggacagacattatattagatattttatagaacttacccagttttattcttgttagaaccatatgaaatagatgttcatttcattcttgaaaaacatattcaaagtagttaagtaacctactgaagatcacacaggtggtaatcaacaaagcaggaatggaagctagactctgactccaaagcccagaatattttccatgtatcatacagtttcaaaattaatgacaaaatgactgaatgaatgatgactgtgacaaaggatagcatgtcctcatgagcacacatatggctaagataaatttcaaatttcactctctcttccacattttatatttgatatgctagcgtatactaagatacctttgttaagatagctaaggcatgcagaaaaaaaaaacaatttcaatttcaatatgatactcttagaatcatgacaaagaccttctattgtaactaagcattttagaacacagttttgcaactcaaaacctcagtgtcaagccagtcttattatgtgttctttccatttaagcccattctgatcacattttccctggatcagccccagtggtcccaacagggagctataacatgcacaaaatgtctgctgagccaggttaaatgaatttcagttaagggactaatattattaacattatatgatgatttgcaattatcagtcaaataagatcagctaccagagaaccagggagtccttagtaagaggtgaaccacaaaatcagcacactccctcctcaatgagtttataatctaaatgggcaattgcaaacaagggagggatagaagggctctccggggagaggtgagaaggagtccttcatttgttcttgtcctcaatgaaaaaggcttatgtaagaaaacaagttcaaccgtactcccctatctaccctcccgcaatatgtaagtcctttgcaagtacactgggttcatgcactgataattgagaggtggctgtggttcagcaaaaagcattgatctggactttagaacccaaggattctagtcctaaatctgccactaactagctctatgaccttgctccctaactattcatcttctacagtccctgtttctcatcaataaaaataaagatcacactagttcaatctgagagcctccaactctaaaatgcagtaccttagcactgaatacaaatacttagttaagttcaatttctcccactctgtttccaagctaatatcaatgttgattttttttagatttttagcaacctgccccagtatagattcttcttgtactagggctggtacaagaaggcatcaaagaccatggagcagaattgtttacacaattctgatttaatgcctccagctcttctctgaacttatgggcacaaagaaatcagtcttttttttttttttttttttttgagacagagactttctccctgccctgtccccaggcctgcaacctctgcctcccaggttcaagcaattctcctgccttagcctcctgagtagctggaattacaggagcacactaccacacccagctaacttttttttttttttttgtatgttcagtagaaacagggtttcaccatgttggctaggctgatcttgaactcctgacctcaagtaatccacccgcctcggcctcccaaagttctgggattataggcatgagccaccataaccagcctagaaagcagtctcttcaccgaaattcatttatataatccaaaaatttctttataatctgaccttccaatactcctctgatttcatctcctatttccaatcatggactcctcttcagctgcctccttgctggtcctctgtcacaccaagcagactcctgccctcagaggctttgtaccttttattctccctacctagaatatctccctttttcataactgcctagtttgagctctcactttcttcaggttttcattaataagtcactttttcaataacacctgccctcatcatcctttctgcccactcaccatttcatatcctccatccctactttattctgtcctgaactttgatcataatctaattaattatttatcttgttgatcatctgtcttccccattagaatgtaaacccagtaaagacatatttttttgggtcagtttaattcccttcaatattccaagtacctagagtagtgcttaggatataggaggcaggtaataaatatttgttgaacagatgaataagccctcatgtctcaccactctccccctaattcactgtgctccagacacacttgtcttctccttcccttatcatgcacaccaaacatcctctccctcagagcctttgtattgtacttccttctgcctcggatctcctttcaaagatatccatatggggttttttcccacattttattcagacctatatccaaatgttgtcatgtccaagaagccttctcaggtcaaattatctaaaatggcagtctcatttttcatacacttttcttatactttttttttcctttataaccgtggcagtggtggaactaagccactcagatctctttcaaaagaactttcttggggagcaaattgactgacagtcccaactgtctgtattcacctctgcatgctctgaggccaagccttccccaagatggtcccagccagtatttcagcacagcaggaataatactttaagactattcctaatgactcgggactcctctaataggcaacttgggctcaggaactacccatcaacttagctgaaacttctttaaaactgctacaatctgagattcttcttccctaaaccttcttccttctcccttccatttcacaggcttcagacctgcataatagcctgaaggctctcctgtctaatcttattccctccccttcatctttcacaggtatctccccctttaaatctcattcttataccatctaattctgtcttggtgtttgcttcttggagtacctgaaataatacaataaaacttatagcatattcaatattaatttgtttatttgtagttgctcatctctacctcatgaaggttgagacttggtctgttttattaactactagatctacagcatgtagaatgatgcttgcaaagaccaaatatctttggtagacaaatattactgctacatattatttcatttatttgtgaaagaaaataatgagtgtctagtatgttttaggcactatgttaagtactcagtagatcaagggtctagtggaagagataaatatataaacgagtaattataactcactatctcaaggatttattaaaagtattcacaatgtatggagcacaaataacttcataaacagttaataatttaaatcctatacatgtttaaggtattgttaatatcccatgaactatagaaagggtaattcaaccccaacaactaagttcccttgtctcagccaagacctcctcagaagtaaggtgtcccttgtgaaaattttcttcaggtatataaagtgaagtgaaggctatcccttgctgtataagagtaccctgctcaagattacactgattggctaggtaaaaaaggtaaataagtttgtggttctatgccctaggaaaacaatctgtgaaccagataaattattggaacttttctagctcaagcttcaaaaaatggtcccatgcaaatatcacctattctatgaacatttatgataccctcactactcgtcgaggtcactccttttatatgttgaagcactctgtgcttctccttcctagcagttaccaaaagtgtaatttattagtcatttgggagctatctcattagtagataataagctccatgagaaaactacatctattatattaactgctatatctccattgcctggcaaggaaaaaggtctctatatttcttgaatggctgtataaaataatgactgattaattaaatgaaaagtttctgcttatctacctaattgtaaaaattatctccctcatcaaaattcccattgcattttatctattatcttacactccccctctatccatcatatatccatatatcccaccttatatccatatatcccctatatccattcatgatgtagatataaactttacaaataaagaagagtagtacacctcgaccccactagtcacagaaaaattgtcagtctttggattcagttgctcttgagatcattcatccttcccagatgttgacaccccgaatcgagatttgaaggtgacaagtaatagtcctctgatttccactcactccctctcctctcccctttctttctccgtctttctctctctctctgtcttcctctctctttataagaagctatgaaggcagaagcatagtaaaaaatgaatgggtttgagttagaaattctacttggtctgagttccatttctgtcttttccatcacaactgatttgctgatcattgaggactgactgtgctgacttacaggaaaacaaccattaatattaggaaaagcctagagagatgaggaccaacaaaatctctagttgagtaatgtaatctaacctgaaaatctgtagcaatcaggcctacaagagtaacaaaaactaatgctcagcatttctgcatctgctatcaaaaaatatcaaagcactctcacatctactatctccttattttccctcactataatctttaagtgctaggcaactaaggcattgagaagttaaatgacctgcccaaggtcacacagcaaactgatgactcatatctcaatgttctttctattaagcaacagggaggtaagttgaacatctgatcaaataaaagacctttctcatcctattacctcaactgtctctctatgtctttaaggcatgaaattaagaagtaaccagataaaagtaagatgaaaactgctactgcctttgctacaaaatgtgagtaggtaggctttgctgtaattatggagaatacatatctgatttaactcccttatttctttactgtctggatatttggtaatatttgataggaccacaaaggcataaaatgaagaaagagggaaagaaaaaaaaccatatagataaatgtagaaacattagaatttgccataatgattccaaagggtctctcagagttaaggtagatgctgttgatgaaaagagtaaaattctctaaaatatttgaagagatttattctgagccaaatatgagtgatcaatggccgctgacatagccctcaggagatacagagaacatgtgcccaaagtggtcaggctacaacttggttttatacattttagggagacataaggcatcaattaatacatgtaagatgtacattggtttagtccagaaaggcaggacaactggaagctgagtgggggtgggggtggaacacttccagttcataggtggattcaaagattttctcactggcacttagctaaaagagttattatctaaagacctggaatcagtagagaggaatgtctggggtatgagaagcagttgtgaaaaccaaggttttattatccagatgaagcctacaggtagcaggcttcaaaaagaataaattgtaaatgtttcttatcagacttagtctattttatcagcctaagttctctgttgatgttaatgctggtcagctgtgaggcatgtctgacccatccccctgcagttctgaactaccagttgatttctaggagattctactatgctgtcttaattagaacctttctatgtctcaactttggaatgcccttggtggacaggaagggtatgttcaggtggctgggggacttagaattgtattggtttacaatgcactaagaggactttagggtcctgccttaagaggaaccttagacagaaggtgatagtacaatggaaaaacagggaagaaagtgggagcaggtcacattgccacaggcctcagttcatatttctaacccaaaccccaaagtaaagaagataagctctgcatcttacctgctccttttgaatctcctccttctcattatagtaggttagttccagggctccgctaaacttcagggtagaacaagaaaattacctcagcccatgctgttcactcctaccatgtcccgttgtgagccccataaaagctgaatatggagatttctcatcttcccagtctctacggtctaccctctcctttcagctgctacttttttctctatagctcaactcctttttagctctcgtcttgattattaggacaaccttctggttctttttacttcctccagtgtcagccactcaagtcattgcttgacactatttcaaaactcacattcctgaagtagatagctgatctctacaacacctcgcaaaaatctttgaaaatttctcaactaaataaagaatacagttgaaattcctcaacttcatatgcaattcttacccatctctccctacacgtccctgcccactaccaatatatactccactgtggccaattaaattcacaaacctgacttgcatttactcatctgacactactctcacacttttcccagagcctaggatatcctcccacaagtatctacatctctttttgcagtatatgtttcccctctcatctgaatttcatcttgattttaaaatatcctaagctggtctccaagactacttagcttcaggtgataaggcttagctcaacactttggatatccacataaaactactttaaacttttgttaaatttatcttcttaaattaggaaacttgatttttttatatacatacaagaccaataaatactctgtaataaatattcagtttctaagagaccagtaactaagacttttccatttatttgcctgggtgctctgaatgataaatcttttatcaaaaatagagagatttgtgggtaagacaaattgctccataatactttcacaatgaaaacttatccaagtcagatctggccccaaatatcaattccctgtgcatttgtattctgacgaacctatcacagtgacctattttcataccagtgactaagttaagaacgtgattgcttttgaaagaaactgaaataaaaattccaagaatggtattaggagaaatgaataaatcaaacatgattttctacaaacacaagttcataatttaagcctgctaaaacatgtgtgtattttcagaatgagaggaggtgtttgatgttataagtccattgtgactgaataaaaaattacagaccagttcagttttttaatggcattatgggtgcttactaattttttgctaatggttactgataaaacaaaatttaaaacataaacgtttgctgaatcctgtgaaaatctctttttctcaaatactttcatttaatttatttaacaattatatatgaagaacacattctgtgtgctgaaggaattcagaatatgccacctcaaaatattccactttgacctaaggattattttgagctgaaagcaattgagaaaaagtagacaaagagcaaactctctgccctcaccttttctacaaggaagggcaagatgatttttaattataggagacgattctagactcttaacccaaagatgttccagaagaatctacataacaaaatcttactaaaacaacccttatcttccattagtttcctcatatatttacagtttgctacccctaaaagcctatttttctttgtcttgtcccttctctacaaatttactcttctttgttaaaatgctacataaacccaagttcctaccacccctttgaattacacaatgcatgcattaataaacttgtttgtttttctcttgtaatatgtcttttgtcaatttaatttacagggaatgaacctaaggaagtagagagaaaaaggtttcttatccctcatttacagtttcaagaacttaaaatatacacaatgcttgtcttcaaggatcctaaattctagtgaagaaggacaattaaacagatcattaggatataaaaataatttggaagttaaaaaaaaaaaaaggaagcacagactggcacaatgatgtgcatttgtagtcccagctactccagaggctgaggagagaggatccctgaatgcaggagttcagatccaccctgggcaatacagtagaaacctcatctcaaaaaataatagtaatggtaaggaaagaaagttttttaaaaggcaggcaattaaattagatttaaaacgacaagaaagtcagtgggctaacacaggatcatacaaatagccagtcttgacccctccagactttacgttcctacttatttatagcaaaagcagaaaataggccatttttttcatggaaataagtaaagtacctaaaaaaattcaacaggattaaaatccaataataagactacagaaatatttaatgtcattaatttatcttttgtgtttgttgttcatttattcatatctttgacaaaagcttttgacaagcatttttgcaccaggtttgtatgcagttatgggagattcctaggaaagttatacaggttccatactgcaagttatttaaagtcctgtagaacttcatcagttttcatgacattagcatgtttgaaaaatgggaacaatttgatttaggtaggtacctgaatataaatgtgaatcacagaatcttagggtcggtcacctagttgagaagcacccttatggttaaaataccttttttttttcttggagacagagtctcactctgtcacccaggctggagtgcagtggctgaatcttggctcacggcaacctccacctcccgggttcaagcaattctctgcctcagcctcccgaatagctgggattacaggcacctgccaccacgcccagctaatttttgtgtttttattagagacggggtttcactatcttggccaggctggtcttgaactcctgacctcatgatctacccacctaggcctcccaaagtgctgtgattacaggtgtgagccgccgcgcctggcctacaatatctcttataataattcacatttgtatagtacttcataagagttgaaaactcataagacttttaaatattttatttcattttatccccaaaacaatattgtgatattggtaaaacaaatattaactcacaaagagggagagtaagactccaaaagataaaattataatttttttaaaaaaaggaacagaactatgatatgaactcaaactcaagattttaatccaatatgtgttctattaccactcaatcctttaaaggtcacacttttaaaatggatataccgcagatcccaccatcacctagattctctctctctctcacacacacacacacacacacacacacagagtttcaatcatgcacacagagtcaattatacacaattgctaaaacatgaaattctgaattgcaagtctttgcaatgactcccaccttaaaatacaatacatcattttataaggaagcctccctccttttctatccttgtccaaaaccaatcaattaaacaccagagtcaagataactttggaaattccaggcaattctgaactaccagttgatttctaggagattctactatgctgtcttagttagagcctttctatgtctcacctgaattatcccagcttattcctatgcaacatactccagttgaaaccactcaatcacaagtacagctgaactcaattcaagcattttctaaattacaccacagtctctcctgattccgtccctttgcacatgctttcctctgcctgcaatgctattcccttccctatgtatctggtttatttaaaagttacctcttcggttgcttttgtggactttgtcaaaaattcttaccaaggccaatgtcaggaagagtatttcctagattgtcttctaggatttttaaagtcttacttttttttgaaggcttacatttgaatattttattccctttggattaatgtctgtacattgtgaaaggcgggggtcaagcttcagttttcagcatatggctagccagttatccaagcaccatttattgaatagggattcctttctccattgcttgtttttgtccaccttgtcaaagatcatacaattgtaggcatatggctttatttctgagttttctatcctgttccattgctctacgtgtctgtttttgtaccagtaccaaggaattgcaacaaaaacaaaaatagttaagtaggaccttattaaactaaaaaggttctgcacagcaaaataaactgtcaacagagtaaacagcctacagaatggaagaaaatattcacaaactatgcattaaacaaatccagaatttgtcctatgcaagaacaaatatctagaatctgtagggaacttaaataaatcaacaaacagaaagcaaataactccattagacaatgagcaaaggatatcaacagacacttctgaaaagaagatatacaagaagccaaaaaacatctgaaaaaatgctcattatcaccaatcatcagagagatacaaatcaaaaccacaatgagatatgatctcacaccagtcagaatggctattattaaaaagtcaaaaaacaacagatgatgatgaggctgtggagaaaagggaacacttatacactattgttgagaatgtaaattagtccaaccattgtgggaaattgtctgaagatttctcaaagaacttaaaacagagctaccatttggcctagtaatcccattactaggtatatacctaaaagaaaataagtcattctaccaaaaagacacatgaactcatatgttcctggatgcactatttacaatagcaaaaatacgaaatcaacccaggtgcccatccatgggagattagataaagaaaatgtagtatatatataccatggaatactatgcagccataaaaagaatgaaatcatgtcctttgcagcaacgtggatgcatttggaggccatagtcctaagcaaattaacacaacaaaaccaaatagcagaaaaccaaataccacatgttcttacttatagggggaagctaaacactgagcacacattaacataaatatgagaacaatagatgcttaagactactagagagggaggcaaggagcaggcatgggttgaaaaactacctatcaggtaccatgctcattacctgggtgatggaatctgtaccccaaacctcagcatcacacaatatccacatgtaacaaacctgcacatgtaccccctgtatctaaaataaaagttgaaattttaagaaataaaagttacctcttcataaaagctttttctgacacctctggtctctaggctagattatatactccacttctgtgttctctgagtttaattctcttataacactttcattacaatatttttccatatattagtacttctttagtctctgtcactagggtataaactccttgaagacagagagaactaggtcatttatcacaactccagtgcctaacatactgcatgatggtcaaaatagaatcccaaaatcaggacatcagcatggccgtgttctccctgagggttctagaggaggatattttcttgcatttcctagcttctggtggttgctaacaatcctgatgttcctttccttggagatgcatcactctaatctctgacactgttatcaggtggcattctccctgtgtatctatatctaaattcccatctccttataaatagtagccattaagttagggcccactctaatctagtatgacctcacttaactagattatatctgcaaagaccttacttccaaataaggtcacattcacagatttttgggtggtcatgcacttcagggaaatgcgatttcacctagtacactgtgtttcaactggagagaggagaatctgaaattctgcatttggagaacagtactcaagcaaccaacccagctatatttgatttgacatcccaggtcactgccttatttatgaaaccgaaacttcccacaagaaattacaactgctttttgtcttaatttggagagtttattcattcattcattcctccactcatccatcacatatttatgaagtacctttaacatactagtggtatggatataacaataaacaaagcatacaaaaatctctgcccttgtgaagcttacctgtgagcagtggggggagacagataaagaaatatgtaaaactctgcacatgatatcaaattttggtaacttcagtggaaacatactaagcaggaaatggagataggaaagttgaatggggttggaaatgttgcactgtttaacgtggtgactaaagaaggctccaccaagaaggtgctatttaagcatctaaagaggtaaaggagttagccttgtggatatttgggagaatatagtttttaggtagtagaaacaaatgcaaaggccctagagtaagagtgtgcctggggagttagagataagcaaggaggccagggtgatgactacaaagataagagagcagtaggaaatagggcctggggggtaatggaggatagtacagagatcaggatgttcttcctctctccactaccaactaaatagtcattgcaagatgccatgttcctagtttctacatagggtacattttgagctcctaagagacaagtttattatatcaaatagaaaaaaaaatatatatatatatataactttatttcacaaaaatgaaatgctatgctcattaaacattaaaattcaagtaattttagtgtccttcatctgtctgccttataatcaggaaactagaaacaatgtgggtatctagattataataaataaatatttatttttagataagttatacttctcatgttaaaaaatactttctattttaccatatcactctatatatgacacttgatttatcacaatttgtcttggcaaaataactatcaaactattttatttaaacaaaaagttgattccctagttcccttcagtcttgtctagattttcaggatacagttagtttctcatttggtgctaccttatgagagaatttgatagaaaatggcctactcaataaaaagtcaaactttcttttttttttttttgagacagagtctcactctgtcgcccaggctggagtacagtggtgtgatcccagctcactgcaagctctgccccctgggttcatgccattctcctgactcagcctctcgagtagctgggactacaggtgcccgccaccacacccggctaattttttgtatttttagtagagatggggtttcaccgccaggatggtctcaatctcctgacctcgtgatccatcctcctgacctcgtgatccatccgcctcagcctcccaaagtgctgggattacagacatgagccaccgctcccggcctcaaactttcttttctaaaaactcattcaatcagagaatattagacagatagacatagagtattagacagatagaatattagacagaacttcctcataggaagacactctctgttgaacattgtgacctctacatgtctgcactataactcagcatcttgtgcaaaattatcacatcttttcaattaatgttttgtttaaatccaataatttacatttttatggtgatctcaagtttacaaagttctttgccaaggtaacaaactatttttaagagaacagtgttcaatgtcaaagcacatgcgtgtcttatttaatattcacatcaactttataagaattatgatctttattttgcagttgaggaaactgaagctcaaagaggagtagtggtttatccaaggtcatatctgatggcaaaataagattcaagaccatttgtgcctgacttgaaagcctttgctctgaaactctggactctagcacctatttcacatttttattttgtgtaattttcccaaaaaccctgtgaagtacatattatatccaaaatacccagaatacattttctttctttctttctttctttttttttttcttgagacagagtctcactctgccagccaggctggaatgcagtggcacaatctcaggtcaccacaagctccacctcccgggttcaagctattctcccacctcagcctccccaagtagatgggactacaggtgtgctccaccacaccgagctaacatttcggttttttgtttgtttgtttgtttgtttgtttttagtagagatgagattttaccacgttggccaggctggtctctaactcctgacctcaagtgatccgcctgtcttggcctcccaaagttctggtattacaggcatgagccactgtgcctggccccagaatacattttcaaagaggataaataatatatcctaagtcatagacccatttagtggtagatccattaatttattcattcattcattcaacaaacatttaggaagtacctactccactaagcaatgagcattaatggtgaaaaaacacccactcttctggaacttaaacagtctaaaaagagggaattttaaaataactaacaattattaagtgcttattatgagccagttactattctaagcatttcactggtattccctcattggaaattcagaacagccctcatatgatagtattttagataaggaaagtgagtccccaaagaggttaattggaccaaggtccacagattgtaaagactgattcaggctttgaatccaggcaatctagacccagagactgtgcttttaactactctgctatgtttgttcttgagatagaaaataaataaatacattaaataattaaagttgtaatatggattccttgctgaattgcagctttcattgtaccacattgccttctgagatttttttttcccggctagtcctatggtagcttccctggtgtcccagttgtcagctaacaaatgggtcaagttagcttggcagtgacataagcagacactacctttatcacttcccttcttccactcaacagtttgtaagaacccagaatgcctggcattagtgggcatttcagatttctcagtgctggcacagacaagcaaccattccaaacctggaacctaaagcagcagtccaggaaggcaagaggacaaagaaggcaggattgagtgtgccaagcaaatcaaatgccaagaaagaaactttgtttgttactaattttaataacaaatcggaatttattacctataaggtataatctattaaaagtagctcaagaaccatttagggtttttaaggacataggagtaaacatcaatgccatgagaatttccaaacttggaaatgcaagacgcacctgcaatagattggtcctttcctagaagaagagatgagaagattgcagtgatatccaaaacaaaaacaacaaacaaaaaccataatagaagtctagaaggatgagcatggtggcttacacctgtaaatctcagcactctgggagactgagctgtgcagatggcttgagtccaggagttccagacaagcctgggaaacatggtgaaacccatctctattaaaaaaaatttatatatatatagcgaggcgtgctggtgcgtgcttgtggtccgggctactcagaagtctacctgggaggatcacttaagcctgggagaaagaggttgcagtgaactgaaataatgccactgcactccagtttgggcaatagaaggagacctgctgtttttttgttgttgtttttgtttttttaaaagaaagtctagaatacaggagaaaatgcactacaagccttactaaaacatctggaccacctcactttggccatcaagaaaatttaggaagcagttgtaataccaagtttggatgtttggattagggtaagggtgagaattaagaggacttaaccaaccctcaagtcacaccaaataaacattctaagtaaaatgtgtgcttacaataccaactcaagataaatctctctgctacccttccaactggatattgtgcaggggttataaagaggattctgggacagactgcttgggttcaaaacacatttctactttaaaaaaaaggtgaccttggtaaattatagaatctctttgtaccttagtttttacatcttcaaagtgggaataattttattacctaccacttagttttattctgattattaaataaaattaatctatataaaacatttagaataacatctgacacatgcacagtgctacatcagtgtctgagattattatgctgctaaaaacctctcccatatgaatttctagagctacaactgcttgaaggacataataattgacagaaatcaggtgtagggtaagaagcaacaggggaggagaaagaataatttttgagttcatgataagagtaggtctcatgctgcttataagtgcactttagactttttcagagacatggaaacatattttgtttaatacaagttgacaatactttctccttctctcctcattctgttcttaagtccttatctctgccattgaggtgtaggggactgagctgtttctcctggctgtactgattagtgattctccagataaaacactgttactgtccaggctgtttaaacttagtgaagaagagctaaaatcaaatattagcagaaatgttgctggaaagtattttctgaagtgtgacatgaaagctttcatcaaaactcttagtaataagtcattatctatggttgatagggttatgaatgatttatattttcatcttctttttttgtattttcaaaattgtataataaatcaaaatttcttttatgattaggaaaataaacaattacaaatcttaaagagtttaaaagagcaagacatgaagtcaaatcttaaagagtttaaaagagcagtttatatgtggttaacataatcgtgtaaaataagcaagcagacaaaactgtgtttagagaaagtactgaaaggaaaacagtataaacaacaatttctcattggataatgttaccctaccttttatttttctttattttataagttttcaacaaataacatgtggtactttgattagagaagagtgccaactaatttcaattaaaacataaaacctcaagcaggtttatcttaggtgtttgaaatataagtctttgtttttcttcttgcctaaattaggctttaaatttagtggaaaattatttcctgatcagactataaatgaaaataaatcgagcgggagaggaaacaggggctgtcatggaatgatggagtaagaaaaaaaaagcacaagttatttatggtttccaacctcttctaggctttcagcactgcccagcaatcctttcagttgtctctcctcagctatttctcctagaccctaaagtggctattataaacctccatcatgctcatgaagatcctgtcccagcccactcatctctccgcagatgaccttgctacctacttggtcaagaaaatagaggtcataaaccacaaacttcccgatctttccttctccagcttctatcttcaaggtcacacatacattaaaatcttaacctaagtttatctcctcttctccagggaaagaggtagctatccctctttctttccaaagttaactttcttctcttatgcttctggtcccagtttcttttgtactttccctttgctgttactttatttctttctctccactgacttctgccctccatactatctctgagttctgtctcctccttatggcattgcctcctctttccttttctcttctctctgtttatttttcaacccaaagcattccaatgttgacttggggcagatattctgctgccactccagaggtagtctcaaacatccctatagcttcttcagcatcacctctaaatttctgactaccatttctccatctcaaatcacaaccactcttcttagctcccaaaccatattcctaaacatttacatctgaatgtcatacagatacttgttaatatgtccaatattgagctcatccctactaccatggaacttgttccttctctgtattacctagctccccaatgccatcaccaaccagacacttattgtagaaacctctgaattatctctgattccttccttatctccttcctttaatcaaaattgaatttccaaatttcaatctccaaaaatatttcttgagttcaatcattgctctgcatatccatagtgacataattgttatattaacaatatatgtgttataatttttataataaaaataatataattgcatattctaatataataatataattgttatatttaacaatatatgtagagcacatttattagacatgtgggtggatggatggatggatggatggatggatgcatagatggatgcatggatggatagataaatgtaaaaaatagggagaaagctataagacaaaccaggatgttgtgtgtaatctttcacaacaaatctacttatgaaaaatttcgttattcacctaagtttcacatttgaatatgttaggacaaaacaccagctactcaggaagctgaggcaggaggatcacttgagcccaggagttcaaggctacagtgagctatgatctcgccactacgctctagcctgggcaacagagcaagaccctgtctttaaaaaagaaaagaaaaaacatacagacacgataacagaaagtgaataaatatggaatgaattcaaaatgtggaaaatggggtagaaacattggagaggttattaaaataatcaactagaagacatgatgtgttggagagaagcgtgattcctgtaaaatgaattcaaatttaacacaacagaaaaagacaatgatgttattcaccagtcctgaaaatccctatctcatcacctgaaattctgaaaacttccttgcttgtaccctatccctgctcttttagtgaaggagcttaccccatagattgttcagaactagagctgagttattaaccaaagatattgtctgtggtagtttaaaaatagggaccttttatatcagagttaaagtctttggtgaagcttaaacattcttagttaatgttacaattagacatcttggcttctttctcaagctgctgcaaaagacagaatggtatcaaggtggagggtcagagcaggaatgactgcaagtgaaaaccattcccaaggcctgccttatcacagaaagaaaggcaaaactggaaactgaaataaaacaaaaatagcatctatgaaaggaagattgctgggtcatcctggtgataatcaatcagctgaggctattaccagaactcctgaaggtagaaaaataagctaagctataaataaatgctttaaataaaattatttaagttataaataaagattaccagtttgtaatctaaaatcaagaaaaaatttttaataaagaaaaagaaaaagtcttgtaagtattcctgtcataggcttaatggataatagtttttggtttgttgttcccttaacaatacacaatggttatttctacagtcactcatcagatatacaactattaaaaataaataggaaaagatctggatggtaaagatctctctgaatacctcaagggaacactaacatggcaaagaaaactcactgatataaagctagtatcaaaaatgagcaaataaatctgtaagtattttctatctgccttgcataattctttgttaactatcttaaggaataaggagtttaatcttcacactgcagccacagtgataccacagaatatatcaaacaatgtttctcctctgttcaaaaccccctccaatggcttcccatctcattcagagaaaaatccaagtccatttggaagcatccatgatcttatatgatgtagcttcctaccacctacctggcctcatctgctactactctgtctatctcttattcatcctctagccacactcttctcctatttatttctagccacattattaacccatctatctgtattcagcaggtacactcctgattcggcaacatcacacatgttgtctctacccaggacaatcttcccccaggcatcagaaggtggtaccttactttctccagccagtgtaaattacatcttggatatgctttcctttactactcctcaatgagatttcctaaatatctttatttttttctcttacatgtatcactacctggcacactccataattatttgtttatttattttctgttcctcataccctatctcctaggagttcaattcccagttgtatcttaggcctagaatagtagctagtgcatagtagaagctcaatgaaaatttatggaatgactaactagtaaaggctaaagtatgatgaggcccccaggaagagctagcaagttctgctttatgcctgagttgttgcctacaagagaaataggaaggatgccagatagcaaaggggattcaaaacggaagaacagtatttcacatgatagaaatgtttaagaagaatcatggaagcaagcataagagagaacacttcagaactagttaaagccaatgaagcagggaaatacatattttagaatgcttcccatttaagctcagatttaatctttttaacctttgttggtaattccttcaccaagggttcaagatatctgaagtagtttagtttccctttatcattatgaaagttacctcactacctctgattatacttttgcatttaagcctactgtgtttgatattaatatagctactcagcttttctcttctttttttgatggctgttacatagcttatccttttttatatttttatggctaccctattggcttatttatctttaacttttttcttataaatggcttatatatgggttttgatattttagccaatatgacagtctctgacttttcattgtcatttcttatcctatttttattaatgtaattattattatagttggatttaagaataccattttgccatttgttttcatttgtttcatctatgtatctttttttaacttcttatgttattttggctttaaataatatatatagtattttattttatcttttttattggctattttcctatacctttttttgtatttttagtgtttattttaggaattataatatgcctccttaaattatcactgtccacactgaattaatgttataccacttcacatacatcacatataagaaccttacaactgtacacttccatttaccctctttctgtcttttctgcttttgttttcatatgttgtatacatatcctatagatcaacaacacagtattttttttttactttaaagagtcagctgtcaagaaaatttttgcaatctatccatttgacaaagggctaatatccagaatctacaaaggacttaaacaaatttacaagaaaaaaaaccaccccatcaaaaagtgggcaaaggatatgaacagacacttctcaaaagaagacatttatgtggccaacaaacatatgaaaaaaagcttatcatcactggtcattagagaaatgcaaatcaaaaccacaatgagacaccatctcacaccagttagaatgacgatcattaaaaagtcaggaaacaacagattctggagaggatgtggagaaacaggaatgcttttacactgttggtgggagtgtaaattagttcaaccactgtagaagatagtgtggtgattcctcaaggatctagaatcagaaataccatctgactcagcaatcccactagggggtatacacccaaaggcttataaatcattctattataaagacacatgcacacatatgtttactgcagcactgttcacaataccaaagacttggaaccaacccaaatgcccatcaatgatagactggataaagaatatgtggcacatatacaccatggaatactatgcagccataaaaagaatgagtttatgtcttttgcagggacatggatgaagctggaaaccagcattctcagcaaactacacaggaacagaaaaccaaacaccacatgtttggtgggagttgaacaatgagaacacatggacacaaagaggggagcatcacacatcggggcctgtcaaggggtggggagctagaggagggatagcattaggagaaatacctaatgtagatgatgggttgatgcttgcagcaaaccaccatggcaagtgtacacctatgtaacaaaattgcacattctgcacatgtatcccagaacttaaagtattgtttaaaaaatgcattgacaaagactgttaactaaatgttaacaatggctatctctcaggggtaggattacaagtgatgtttttttcttcttgctaatctgaattttccaaattgtatacattaaatttttacaataaacaaagcattctcacatacccacatgctcacaatttttggtgatttttattttttgtgtagatctaagtttatattttgtattatttccttttattctgaaaaacttccttcaacgtgtcttagtacaagtatgctgatgttgaattatctcgtattcatttatttaaataaacatatttatatagtgtataaatatatatttatattcattttcgaaagacgtgtttatggatataaaattctaggatgacttttttctttcaccattttaaagatgtagtttttttcatacttgcattgttttacataagtcagcagcattcttcataattcccagtttattataagacttaatctgactattcctaagatttctctttatctttggtttgtcagcaattcaagcatggttatgattgatgttcattaagcttcttggatatgtggtgctatggtttggatgtttattcctcccaaaattcatactacaacttaatccccaatgcaatagtattaagaggtgaggcctttaggtcatgaaggtcattccttatgaatggaattagcacccttataaaagggtttcagggagtttgatagtcccattttgcccttttgacctgctcctcttccaccacgtgaggatacagcaagaagacaccatcttgaaagtaaagaacaagcccttaccagataccaaatctgctggaactttgatcttggacttcctagctaccaaaactgtgagaaataaattgctactatttattagttaccaagtctattttgttatagcagcaaaagtggactaatacatgtaggttgatatttttaataaaatttgggaaactattaaactattatttcaccaaaaaaaatttgcccattttttcttacctctcctgttgggactgcaaatatacatctattagactatttgatgttgcaccaaaagttatggaggcttttttgttataagttgtctttctctatgtacttcagtgtggatagtatattttgcactgatttaagttcactgatattttcttctgcagcatctactctgctgttaagcccattcagttaactttttatatcaagtattgtacttttaagatctagaataactacttcattcttttttaaggtttcccatttcatggctgggattttccaccaactattcaatcactaagcccatcttttcctttacattattaaacatatttataatagcattttaacaaccttgtttgctaatcctaatatttctgtcaccaatctctattgactattttttttcatggttttctcctatctagtgatttcttaaagtagctggcaattgtagatgctacattgttgacatcatcagagtgacgagtttcattctggcaggcagctaatttactagcacattagctttatcctatcaagacttctttaaagactctgttaggggatgtctaaggcaatcaatcaaaggctggagtaggcctcctccaaacgcatgaattttgggtggtgtcagcccaatgactaacatgttcagcaaagtccttctgctctagctcacaaaaattccaacgttacccagaactgtgcaaactccagaatctctatgtagctcacaaatatttagttgctgccaaacctcatcaaatttcaccctgcactcacgcatcttattgttcaacaagactaggcagtatttcctatgcagattattggagttccttctccacacagttctctcatatctagtatcttaccctgcaaatttcacccaccttagcagctgtaagagccaatatttctttcctccacccattaagatttttgctttctaccaagcaacatgctaaataccaataaaacttgtcttatatactttacttgtttcagggatcacagtcttatgttgaatgttgtttaatgcccaaaaacagttgctttatgacttttgtccaattttttagttgcctatggcataaaagtaggtctgatatacattattccatcacatttgaataatataatatcttttgataatttttattttcatcaaaattttggagtgaaattagtccacttcaggttatagaaaatattcacaaatagcctaattgacaaagacagttattattgaaccatcagaaaaatcatatttactttctctcagaataaaagtctaatttaatttttaattacaacaaaggtatcaatatacctttccacaaaaacaatgttacctcttcgaagcaaatgatagatagatagaataaggcatttccatgagtatgtcatctggacaagctaagtataaatactttcaatatttcttatagattctttctttgtttttctctcacagtagcaatttacttttcctaatactcaagggataaaaagtcgtggcatcattcaggaaaaattgacatcactctcactgttctactctaaagcatacgtgaattcagaatgtgacaatactagacaaaataatttatctaaattaccttaatttttccataataggaatatgcttaacacatggaaagacaggaagccctgtcacagctttgtggggaatttaattcatggcactttgcagacagcaatatttccaaatgtacttttatttggtgacccagatgacaagtctctagatggaagaaaggtaaaacagaaactccagtttgaagatcttgcttctgtatggccttaatgcctttctttccatgcgttatgtttaattctattttaaatttttttactttttgtacctgtgatttcttttagttgcaatagtttggtagatttcatgtggttttttttccttttccttataaggagaaaaggctttctgcatgggaattccttttgttctgacatatgggtgatttcttggtgctatttcccacctatttctgtccccagctacaggttgaggtctgcgtattgttttttttcttagaggcatacaaagggcaggaggaaaactaaactaagagcatatgtggcatctttagagtaaaattgatcactctctcttcagagtttgtaaaacatcctgtcccaggattgacttctcctaactgtaatgttatattacctgtggtttccctaagatccctcatttttcacagagtcagcctcactgtttacttcatcattttagctgttttactccatcagccatttatagcagccattaataacaagaagaaaagcataaggctacccactcacttgtggggatctctccaggtttggtcatattagtgagaattctaaaagttttgtcaatgtactaattagattttaccagagataaaggggacagtgttggcaagataatgggaaggagggctagataccattagaagccaaactctgctgtgcctctctattctactctggatccttaattttttttttttttttttttaccttggactctagtttttcaagattgctgcatcagattttggacctttccttttctggtggtggtggctgttgtgactatgtgtgtgtgagttttaactagtttttgctcctgcaattaggtattgagaatggggaaatatgtgttgcagcttcagtatgccatcttaaacttgaaatatctttaattttcacaacaatcctgagaaatattagcttggcaattttaaagtgcagagaggttacaattattaatgagaagatgaaataggattgcaaagttttcattctttaacaatattaattgtgttcctactatgtgccatccactgtgctgggtaatgaggatgcagaaatgaaccaaagagatgtggcctctgccctcacagagcttaccctctagtaggggaaacagacatttaaactactgattataatatagtaaaatatgttctatgatacaggaaggtacatcaacaaacagagtctaatataaggacagtgagagcttttcaagttaaaaaatacagagtatatatggataataacagatgctcagaaaatgttaattttcttcccttcctaagcttccaaataaccacaaaacataaaggcactctgtattgcctactcctagcattgttggaaagatgccattatacagcgtgcacagaaagagtgtttgttatctctaggtgtaggctgatgaggactaaattctgagagtgaaatccaggtcatgcaaactaagggcaggaactgctacgtcaaatagtttaaccaaagggtttagtaatgcacctgatcaacagaaagtgcctaatgatcaatttgagtagacaattaaatggggcacccatggatattagagaaagagaaaaataattttctccactctttctgtctatccattagagtggttaagtccataactctatgtactaagtgatgatctcattcaaatgaaaacatattcaccataacaccttgggttaagacatttggcctggaaatcatgcctcagggttaaaagtaattttttaggttctctcccttatgaatcaattttttaaatccagctacagccactgataaaataaccttttttattttaatgaaattatttatttattctgttttctgtatttgtatagtgtcttttcatcaagagggacaaaaatcaccacagacacaaattaacctttccaatgtccctgtcagacaggaaaattatcgtgttactatatatgcatctatctctctatataatcattcagtttcacaaatattagggaagactaacaacaattgaagtaatttaaggaagacaatattttaaataaattctcaatttcaactcaggcaatagagcatgtaataaggcagatggattaatttcaaaatcaatattggccagtatattcaaccagcaaacagatgaagagaacattttaaaatactatgaagtcattagctgcaattaataattcatttcaaaagtttacagtttcaatttttaatagcaaacagtcagaattttaagtgcttctcaaatgtacctatcaagtaaagatattcttgttaaggtggtaggaaatacagatgggcttatattgggatattgtatgcctatgtcctttcatccatcctttcattcatccatctatccatcctttcatttacacattaatccagctattcacgcatttcctcattcaacaactctttagagtcaataattatagtaagaaaagtttagaagtacaagcaaaattcatttttgtttatgttgttaggaaaatcttccaaaaatgaactgaaacctaatgaatgagtagaattttaacaagggagttgggggaagacgggaacagaaagaattacatgtagaatgaaaagtgtggaccaaagaacaaaactaggaaagagtatgttcagaaaacaatgagtcaatataagtaagttgacataagtatttataattacttttaagtacttaaaagttatttaagaagatttgaagtagaaagtagaatagtaggaaatacagatgaaaaagtggtgaggatctagatttttgaaggctttgaatgccagaatagatcatatagaaattattttattgtcagtgagaagccagtaaaagttgttgaggaataaaataatcaaaggggtacttttggaagtctcctgtaggcaatgtgtagaatatagtttatgaagcattaactaaaaggagacttattcagtagataaaaacactgcgcatatatcgattacttgtattttaacacttctatagtcaggatgagggaaggaccaagcagataagagatggcttactaaaaaaagttaagtctatattctaagatctttacatatattaattcatttaatcttcacaacaaactataaggaagattattaatctcactttacaaacaaagaaactgtagcacagagaattcaaatccatgctgactcaaaatccaacactattttttaaaaagctgccactcgtccagtgccaacagtattactaatagtttgccaggacttctataacaaaacatcacagactgggtagcttaaacaacagaaatttattctctcacagttctggaagctgtaggcccaagatcagggtgtgagctgagtagatttcctctgagacccctctctttttgtcttgcagatggctgtcctcttgctgcttcttcacatgctcctctctctatgcaaggcacccctggtgtatcttcttataaggataccagtcatattgaatgagggtctcaccctgacagcctcattttaactaaataacttctttaaaggccttatctccaaatacggtcatattctgaggtaatggggattagggcttcaacatacgaatttcaggggagacataatttagtgtttaacaccaactatgtgtcagatgttttatgcatgttcttaattaaacctcaaataactatgcaagattcttgcatagttacttgcatatactgtgtgcatataacaaatgaggaaactgaggttctaaaatttttattgacttgcccaagttcacatagttattcaaaaagtggactgagacctaagcccaaatgtgtctaatctttctggtccaggtatccaacaatttcatctgtaagaatatatgttcatgatgacacaatgtgttaaagttaagtcaatccaccctttctccccaaagttgccaacaatcagcagaaactcatgttttaacaaaagcttcccacaaactacatgtctatgtgtggagacacagagcccacagaagccaagcttcatgagaccataacaatctgcacacatgaacacttctggtgaaatgacactgcccagccagcacctgaaaatacgccactgattaagcgaatgtcacctaatgagtgccagagttagatccaactctaaaacagatattgcttccaaagcagaaaagaatctagattgagttttcataaatttacagggaaagctcttacaacttcacattatttgctaaatggcaaaaaggagggtggaaattaaaattgttttctggtattaattaatagggaaatgaatgagatgccttcaccaaggggtttgtacaaaaacccttaaagagcctaagctgagaaccaagtacaataattaaaatatttataaaattttcttatattcatatagggtctgtgaaaaaatatacacagttgacccttaaacatgaaggttatgggctctgacctttgtgcagtcaaaaatccatttaaaacttgactcccccaaaacttaactagtgtaaactaaaaataaaatcctaaatccctccactaactgaatggacttacacttgtggccaaggggacccctgaaaaactttaaaactgagttcctgatcatgaccagatgggaggtcagacacacctcattataccccctcctgtctgtagtttagatgcaactgaccagcaataatgttaaaatacagactgtcagactgacaaaacaggctcttaaaaggcagacccttactggcaaggtgctttctgactttggagacatagcaccagaggaaccagtccagaaaaagggttttcattgtccagcccttcttgtacaaccaaaagactggcagttggtgttcatcttttcccttcaaagcagctttataaattaaagcagtcctaattagaaacttgatttatgcatttgtacaaaatattatagtagagtttgcctatccctttttgccttaaatcctggtgctcacttctttcccttactagtaaatattctttgtggattttttttccagaatagggcaggtttgtccgcattaaaaacctgtttaggtaagaatcctgtttcctcaatgattttcttaatggcatgtggaaactcatctgctgcctattggtcagaggctgcttttcctattatcttaacttttttttattttttatttttattttatttatttatttatttatttatttatttatttatttatttatttatttattttgagacagagtcttgctttgttgcccaggctggaatgcagaggcactatcttggctcactgcaacctctccctcctgggttcaagcaattctcctgcctcagcctctcaagtagctgggactacaggcgtgcaccaccacacctggctattttttgtatttttagtagagatagggtttcaccatgttagccaggctgttctcaaactcctgacctcaggcaatccacctgcctctgcctcccaaagtgctgggattacaggcgtgagccactgtgtcccacctatcttaacatttttaaagccaaacctctttctaaaattatcaaaccatcctttgctggcattaaattctccagctttagatgcttcttcttccttcttttttaacttatgtaatgactttactttttctcaaattatattagagtctttaggtatggctttcttatagcagtcctgcacctacataaaagctgcattttcaataagatagaaaaaagtattttgcaaaaagttcaaggtttttcatgcctgctggtatacctgaagtgacagcttcacaaattttcttttcttttttttttttaacaatcatccttacactgaattcatttatcttgcagtggctttgcaacgtcagctgcaaacctcaatatgtagtacctatcaaacaactcaacttttctttataatgtcatgacttttctctgcttcttgggagtacttccagcatcattagtggcactccatatggttcccatggtgttattcaagatttacaatattgtactatatatgaagaaaaatacacaagaaccttgaactttgagtgatcgctttttgctgacatgtgcaatttactggagagataaactgctcacatggagataatgagggttacactacctttattaagcagaaactcacaacacttgggctcaccacaatagcaacaagaagttattacagtagtacagcatgtactacagctaattttgtgcagttatgttttaatgctgcatctttacatttgtttacatttctctcaactgcaaatggcaccatgtatggtctataaatgtttgtgtgggtaagtttttatacattttagttttttataaaagatttctgtatattttatagtagtaaatgttaaaatagactagtatctacatatactttattcattcatgacatacctgacttcctcctaattttatcagtatttctagtttgtgtgagtttattcaagttatcacaaatctcaaataattttctaatacatttattttttaaaatgtgcatataagtggactcatgcagtgccacctgtgttgttgaagggtcaactgaactttaaatatagtggttttgactttataaaagtctatcctatttatataatcttttgggactccctttttccctcagtattacattgttaagattgatgcatatttttgtttgtagctgtagtttcaccaatttgaatactatgtaattttccattgcaagaacataacacaatccatttttctgtaaatggacatttagattatttccaggtttttattacactggacatgctatgactattcttgtctatgtttcaaactctacaaaatctgtaagaagtttctctagggtatatacctaggactagaaattgctggctcataggatatgcaaatgttcaattttacaagaccatgccaaactaacttgttaacttgttaaactcatagttccatcaacaatatataaaatcctgctattctacatctccttctttggtattgccagtgtttttattttattcccatctagaagactataaagtggcattcatcttagtcttaatttgcttttgcctgattataaaagaagttgaacttatctttatatatttattggctacttatgtttcctcatctgtgaaaagcctgattatttttcctttggtttacttgacatttattgatgttgttcattatatatgctcattatatgatcattatatattgatgttgactttatatatgttgttcattatatatttgttaaagaaatcttatgttgattactcttactgtagacatctaattgtttgtaacttggtttttcactttcttaaaataacttgataaacaaaagctcttatgttttaaagtcaaatatatcaccttttccttatggttagctctttttatatttaaaaaaaatcattctctacctccaatgttagagtaatactcaaatatattttatattaagattttaaaggcttgtttctgatatttaagtcttttatccatctggaattgatctttgtgtttgatggaagctgaggatccacctttatttttctgtatgtgtggtcagtttattgaatagctcttcccttctccattcgtctgtcataacaccacttttatatatcaacatttcacacacataagtttgttttttaagttacctttcattcttggtcaatttatcaataccaaccagtagcatggtgtcttattactataatgtgtcttattacgatgtcttaattactataactttataataattcttaatgcctagtggtaagccatacctctttactctttttcctatcttagttattcttaatatctatacttccataaaaatcttaaacaaggttatcaagtttcaaaagaaacctgttaaattttttattaatgtcattttaaataaagatacatttggagagaaatttgacattttcatattaaatatctctatgaacatgattttatttatttagatattattaatgctttttaataaagttttatacctttgtatacattcttgcacagttttggtagatttattactagatacttgattttttgatgctataataaatggtaccttttaaaattatgttttccagttatttgttagtaatgtttagacatgaagttgatttttctttgatgattttatatccagcttcctgttaaactctattatttctattaatttgtttatagggtatgggagggattaatagtagacagtcatatcatctaccaaaaatgttgcttttatttcttattttccaatcctttgacttttaatttcttttttcttgttttacaacattggctagggcttcccatatattgccaaacagaacttgagattgttatcatttctgtctcaattctgaattttaattttaaaataatgcttctaacatttctctgtttacattaatggggtatgtgtgtaagtaaaatggacttcatcagattaaggacatttctttctatgctttaggatgatttggctggatataaaattcaaagttctgttctaacacaaagaatcagattgttaaatcagagtcacatgactaagatattatccagtatcaagctttgctaataatttctaccatggcagcaatcaagtggcacaagtgaattagagagagatctgggacatcccacatatgtctataaattctttctccttgcattagatatgctatgtggccagattaatagaagtctgtaattaaggtttgtgagttcccccacataggtttgggttacaaaacatctctgttttatatcctagatagttttgcaactgatacaacatttccaagaagccatgtctcataaatccataaattataggtttgtttaccataagcaatcctaactcaaacacatcctgaaaagaggattccatatatagtgaatctccttctagcaaatatcatttatatgtctgtcaggtcatttatatggatattcaactaggccacctgcctctgtcccaaagagtatgccagccacccatacctcactatctttaataggagaataaatggattataggccagtgctttaaattcttcatcctcaattcaaagcctttttccttcaaaacttgaaagtgttaaaccatcgtcttcttgcatccagtgttactattgacaaatctgctatcattttggttttttttcctctgaatgtgatctcgtttttcctctttggaactttttataaacgttttattgttttctatatgtttaatgttttctattatgtatcttggtgtgggtctttatcattccagtctagtattttgtacccattactcttagattagctatctttcttaattcttacttctgtggaatttacctttgttactttctcaaaaatcacttctatagttttaattttctcttttctggaactcctgttactcaggtgttggtacctcaatttctattctctatctcttttctgcttcctcctggaggaatttctctttgctttcaacaacctaatccatttttttcagctgcattcattctattattcatcccatctgttatgttctttatttaaaatattatatttattataccaaataattggctttttatacttattttattttcttataattctaatatcttactttattctatctgttgagttttgatgcttgtcagaaaaccttgtctttctaacacctgtgatctacatggtacctgtaatctatatttgttcccttttttccttttaagtgtttatgctcctcagtcacattatcttgatctatgagtttatattcctgctgtgggtatctaagcacttcccaagactactcaagccccacaccaaggatgtgggtaccagaagtctgaagtatagctgccaattaccatggtaacgatccaggcatttggtgtcctaaggcaaaagcagaggagaatcaaaagtagaattcaaactgttttttcttttaattttaccgctcatagcctaatggaccaatccctgacctaggctgcagccatccccctaccaccaacagttgaaacagctttctgtatacccacaggttacttataatttttttattcccacttagatttccacccagagttgactttgagagaggagactagaagcttatgctaattttgcatttcattaggagcaggattcaaaaatgcaattgcttatttacttgtcttatgttttccactgtgactagacattgagcttttcgaattcagagattctatttcattcaattttacatcccagacccatatagcatctggcatgtagctgacatttaataaataattctaagttgaatgaataaattcccgacttaaagttggaaatatttcaccaaaaagtttttgctatgactacaagttaccattagtctttttcatggcaccctatagcttatttaccagctgtgttaccttgggaaagtcacttaagctttctagttttcagtttcctgtctaaagggttcaaagcagcagttggccttaccaatgcatgagaccagttttattgcaaagtcaaagagaaaagagtcatatgccaaaaacaaataaagagcatattaaaggaaataagatgtagaagacagaagcagaccctggagaagccaggagttctaactctagttctgccacaaaccacccgcccaaccttgaataactcactaaatatctctaaatattatccttaattctaaaatgagacaattgagagacagaatgacatggaagacaaactggagtaaaatctcagatctcccactttcttcatttggtacttggtcaatttcctaaccattttagtctaagcgtctttatatgaaaataaagttattatcatctccttagagttgctatgaagtttcaatgaaaaaaatataaataaagtgctttgcacagcatcagttacatattgagtgttcccaaaatgttagtttcctgtctctccacattttctcaagtgtcatccagctttacatagttatgaatctagatgatttattaaaaactggatctacttctctaatccaatatagatgcctaccaaagtttctactgcattatttctcctgagagctaaacttttcttttagatgtcaacttttagttataaattatttagaagtttagtaggtgtgttttaatgcttctgggtgttaaatattcagtcatcattggctagtggtgaaagtttatgcgaggaaaggaaaagctaagtgatgtgcatatatcatttatactttaacaacagcacctgctccagtcaaatagtcatccaccaatgatatacgagggaagtgtttatgcattggggcaacaatatggaaatcaacatctgtggttaaaaaaattgtatgtgtcactgcttatagctgtgaaatgaatgggcaaccataatgggatggtgtaatgaatttgtgacaaggaccagaggaaggaaatgatcatcttaatcagattgctattgatgcctttttttgtgacagcaaaaaataaatatctattaattacactaaaatgaaaagtgtttggatacagcactaaggaaatagatagttccagttaaattgttatatatgtcaatgatcagagataaaatgagtaagtgccaggaagtctctgctgaactatttatgtaacagcactatcaaataagtgagatggttcaatgatttctgtgaaattatacaatacagttgtattgctttagaataattagaactcttgcaggtgattcagatattgatcatgggacaatttctcatttatcacaagaaactttagtaaaaggtacacctcaggattcactccattcatttctgctgtttatcctaaaaactgggcaacatggaatcatagaccagtgtgggagcttagagttaggtggaattatgcttgaaaaatttacttctgctcattagtcaaaaaggtaaattaataaattcattcattcattcattgtgaaatttcagaacactatattaaagacaatattgaagactccaggaatgaaaataggacatcaagaaggaaataaaactagattcaggccttattaatccttattaataatttggccatttatattcaactgtaaatgttacatcttctgttgtatatctaataggaatttcaagttcagtctataaaaactttaatgctatatcttccccacctccaaacttgctctgcttacagcctccttcactttaaccaatgtccactcattctttctgttactcacaatggaaaccttgaagacattcttgatttctctctttcttttacatgccatagccaaggtattaggaaatattttgactttaccttcagaatatattgagaatcctaacacttctcaccacttccatcactaccaccctggtctgacccacaccatttccaaccattatacaatggcttttggcctactctgttgcttttactattggctcctgtgaagtattatccacatagcagccaaagtaattctttgaaatcatgataaaagatgtcaattttctgctcaacttcttgtaatgaatttacccatttcactcaaaataaaggtcagagtcattaaaatgaccaacaaaaacccagatgatctggccctccattccctctctggctttacctgctacactatacttaatacactccttctcatctactctactccagcctcaatgtcctccctgcttttcctaaaatgcataaggcacattttgttggacttttagattagttgttctctctgcttgagattctgtttctgtaaaaatccacataggtaattccttcacctcttttaagattttgctcaattgtcatattctctgtgattcttattctatcattttttaaattgcaactcactcccactccaatcctgatcacccttaactccatagcatttatcttctaacacatttatattatttatttaattattacttttattgtctatagcaccatgatcctaccttatgaggatgtgaattataaaattcaggtatctttattgattttgctcatggttgtatttcaaatgcctataaaagtatcaagaaatattgaagaactcaaaaaataagtatcaagtaagtaacaaagctctaaataagtgcccaaaaaataaacaacaaaatgaatatagaattcaaggtttattcacaaagaaacatgcatcagactagctgactagccccaatgaatgttagaaaacaggtcagtaaggtcattcatttctgaggaaatatgaaccttgaattccatatcaaaactatttgtctatcaacaaaaactgaagtaaaataaagccccatatgcttaatgtgaattcccaaaatgttaacattgtactgtgtttattactgtctctcacatgctccctctccacgtccctccccctcaccccctccctccagccacacacacaagtaaatatataaataatccaactactagataaaataaggaatacatggagctttaagtatgatgaagattaattctcagtaactaaaatctacatgtcttcatgagaatagttgttagtatttattagtagtcatataattgcataacaactgcataattatcctgtagttgtataattgtagtcatataattatacacttatatttgtgtagttgtataataacatgaacataagtctatatccaatctgaagatagaagtaatgcaagataacgatcactaacatagttatccaatcagtattacatagtaactaggcctttagtataatttaagagcattgctgtttttgctggggaacccactagaatagcattccagaacctcttctgaacatatacaagctggaatggcattttcagcttcatctttaacatgtgtcagtcactaaatgagcaaagcacacattatatgttgataaaatttaatgttcaaatcctctgttttcttctatctccatttataataggagtattacgttgatcatacaattttcttaaataattgtgtgcaagtgtattccacttatctgggatacaatataagcgtagcctttttgctatcagtaacatcagaaaactattagaaggggagatagtaaagaaaaataaataaagttatttgtattttttataatactatgtggttaaatggtaactctactgctgctgcatttgcctacctccccctgggcatggggtcagtggacttagcaggtaaactcaaagcgggattcattcatagaccataggaatatactttaggtctttattcaattgtcatcttctcagtgagtccttcctggccattctatccaaaattacaagtcctaaaccctgatacttcctgtggccccttcttccctcattttttccttagtattcatcactatgtgtttcatttattcaattttcttgttattagtaattgaataaaaaaaattattcaattttcttgttgctagtctacaggcaacagaggagctttccaaattttccaggggaatgaaatatttccctacccatacccagaggacttattcaagagacaagggatagctcaggaatcttttctgtctcttgaaaagtctgattttctgacttcaacaaagagactgaaggcttagcttgctatcctgagcatgagcattaatatatagactagctcatcattttcctaaatcacaggagtatatattatattagatacttctgttgatccttctatttcaatgtctcagcaactcagagccacattttacaatcattgctttggtccccttccaaattcaattatcttgacaacattcatcattctctgcaacttgccaccctgaagaaacttaagaccttatttatatcagctctctgatctcagatgaaaaccactatattattgccaatgtactccctgtcattccatcctagaaatgtagactggttgcatactcattatctattatatctgtgtagcacattttgctttcaaagtactttctcactgtctcactgaaccacgtgagatagctaagacaaatgctactacgccatttcacaaacaaacgaactgaggcctggtcttctcaatttgttaccaaggtaaaggcataacctctgttagtgttttcactgcttcatcatttggttctgatgtcagcatatttatacctttttgttgtggtcacccttgtaaaaagcattgagatcattattattttaaagttgcaatatgcttacattcttgacttcttcggtaaatagttctcaaatgacagattttttttttaattaaagattttttttaccttttaaaaatttagaagattcaaagatttgcttcaaagtcaaaacaaaacttctgacctttctacctggccagccatgtctcatgaatatgaattagaatcacagcttcagagtgtagaagttggagtctgaggtggttgtgttagggaggctggaggtgccagtagggatgagaagaaagaaacaaaaattcctagtgaaaatattcagtggagataagtcttccactaaaaacaggcaatctccagcaaggttactaaggtcaaatagggaaagaaataaggaagtgctaacaagtgaaaatatcagaaagtcaaccatagaataattaccaaattcaagaatatgcagctgcagcatcattttgcacaatatttatggcctcatgaagggcttaagtatagggtctggtaaccaaagtcaaggagtgacagattcagacttgggaatcttttgactaggggacaaattctaggactaatttttaggggcacaggtttgccaatgacagtagaggatatttcaaaattctaaatcaactcaatgaaatataatcatttgatggggagagcaatttacatctaaggattttttttaaagagtgtagccactataagtattaaaaaatctttttcttcactacatgttgaaaataaactatgctttatgaatattgtaggtttgacaaatcctgttggggattattattttcattactttatttctagatgttttatcatgctcatttgggatcatgtgtaactttttcagatatatcataggtaatgtaaatttgccattagattggaaactaatgatatttacatattaatcaactactactttaatgctgagaaacagttacctacgatagcagatgcaattcaagaaacagtgtgtatgatcatcattttagcctactataatgttataattttagcctatatatatctgtatgtatttatatgtgtatatatcatgtgtgcatatatatattaaatacatatataaatataaaataactgtcttataagatgaatgccctccttgtaggcttaaaatctaattgttctatgagaattgtatgttgacctatataacaaagtaggctctttctgagttgagagtgctgagaacaagtatcaaactgaaatgaagaaagaggcagggatcagaggcctgaaaaaatgcagtgacactaccaaaagcagaatcaatgatggagacaaaggtcacttatctgtcaaatatccaaagacaccatgtttatatcacaatgagaatgcaagctggagtccaggaacaaatccaaaatcaaatctggagatagtgggccaggaatcagagcaaggaactagattacctttgcagtagtccagatgaatttgcatatttccttgtagtgggacttcattcctgaagcaactaagaacctcttttatttcgggaagaatgctagacagcatggagaatttatgtcgacatttgtttaaaagaaaataaaaagaagaagaaagaaaggaacattgtccttactctaaaagacctcaaactctggtgtaaggcagagatttcatgctaacaaataaattacaatgaaatgttaaatggctaaacagaaatttttacaggggcccagcccaaaggagggagtgattgtgtccacatgggtgaagaggaataagaaaactaccatacagcaaggagtatggttcagcatacgtttgacggttttaaaggcacaaaattctaaagtcaagtatcataaatgcgtttctttttaaagtccctatcactctacatacccagataactaaggtgtaccaaataattaactatatatcagttttatttacccctttgtcaaacatttactgtctatttgctatgtcacccactgctctaggttaatgtacaattaatacaacatatatgcttattcttttagcatattatcatagtagtatgcctgcctcaaaatttgcagttcataaatccactgttttttaataaaagaagttaatccttttaaaagttattcatgtacttgtcttgggataacacagtataaatttactacccaattttttagtgggaaaggctctcatgtttttcttgcaagaagattattattcacctaatattttcctcataattgtatgtagcttctgctacattcacatttctctttgaggttcttgaagatacaaagatgaacagatcatggagcatataatttagtaaaaaagaaacataaactgctaactataattcaatgtgagaagagcaataatcaaaggcacaaatagtgaacctaatgaactttaagtttcagaagctctcccttagacaagctctctccaagccctataaggagccctaaaatgtcttcaaatggtcatattttttgtaagatttgaaaaaaatatatattttaactacaaatgtttaagattattgtgtatttttattctgacttctcctccattatattttccttgtacagggtgtcattggagtggtcaaagacattttggagacctagcaaagggtgagttgggaatacatttagtttaatcttagtaggatttatttacgaaatccatagctacttctatcaacagtaaggttgttagcattctcagtataaaaattgtttccaggtacactcccatcacccactgtgggaaagccagggatggccttatgacatgaacatgtgctatgatgcctggagcaggaagtgtgtggaaagtgcagaaaaaataaggtctcactatggaattaaaagctagtctgtggaatattcttccaatcttcaaacatgtaatattgtaagcagaatattgttttcattaacatctagtcaaaatggaaactctcatctgtgggaattatacttaataatgtagcacatcgttatatatatcccatatatttttctttttatgggaatcaaatgaaaataaactctatcagatttgctgtgttagtatagcacagatctgtcacaattacaataaactgtaagtatgtctctaataatgcatacgtgaaaaacttgatacagatttttttcaaatttgatcatcttaaaacaccctaaaatttcactgatatcaaataataaataacaattggtgaggcttaaagaagctttttaaaactatgaataataaaaaataaattttgatccactatgccagaggaaagatctaattatccttctgttctctctatagaaaatattacaaatttttggactgattaagaggccattaataagtatacagccagaaaatcgaggaaaatactacaaaaatatattaggccataattagttacaatatcatacaatattttatgattttgtgatatttgcagtaactttttactttttaaaatgtgtaacttattaaatttatttttgaactctaaataaatattcactttttaacctaattttgtattggtaattttatattctttacattaaaaagacaattataaaacctggatctgctataatagttatttcttttgtccacctgtgcgcttatataagataacaaaatagcaagagcaaaaagcccattaatgaaggagtttcctcaggccaaggcaaaggaaaacatgccaaagagaggcaatgaataaaaggcataaactgaaatatgagcttataattaagctggggaaaggaacccaactgtgcatctaacccaaggaaacattcacaactggatagagtaactaaagttttgcactctgtgatatcagagtagggaccactgaatcaacggcgtaagatagaaagggatcttttgtgaatgcacagagcagattttatggcccatcattacatcatgtaagagagggacagatttgttttaatagttaggaatggttgggaggccaaggcaggcggatcacgaggtcaggagatcaagaccatcctggctaacacagtgaaactgtctctactaaaaatacaaacaattagccaagcatggtggcacacacctgtagtcccagatacttgggaggctgaagcaggagaatcgcttgaacccaggaggtggaggttgcagtgagccaagatcacgccactgcactccaacctgggcaacagagcgagactctgtctcaaaaaaataaaaaataaaaaaagttaggaatggacaatatcatggtgatatatgttcttataagtgaatttgcacaagtgaagtcagtgtttaatacttacctaataaatataaacattgtaaatatctacatattttatgtatttatatatacagaattgtagggaattgaaagcatgaggaaaggctgtggggaaaggaaaaaaatacactggcaaaaagagcaaaacatatgtattttaaaggtataagcaagtaccaagaagggtttgaataacttggatatctactgaatctatccttctagcaattaaaactaattaaaccagtgtttctaaaagtaagactgctggacctaatctcaggagtctattaagttctcaaattttttaaaaaattctaaacctattgttaaaatccctgaaaaatagtctacaaattctcttatattacatatttattatcatatgctcataattacttcctatctctgaggatgtatttagtttctcttgttctgaatgaatttatatttgctctaatgcatagcatatacatgatttctacacattttctacacaaggatctgagacaagtgataccatctgcatagatgtggaagtaaaaattaaatggacaggttgacccaaaaattctactcccaggtatttatcctaaggaaaaatcacatacatagcaaaacaaaatttttatataaggcaagttatgatggtactactcataaagtgaaatactgaagcaggatatttccctgacccctttgtgggtggaaactggagtgaacaggtgctggaactggctggccactttagtgctgggaggggtgaactccactcactcgctgctccacccctcaccagagggagggtgaatagaagcaggtgcaggagccagggtgagtgcttttgggcaccgacaagagcgaactacataccagcccagcagcagtatctaggggagggtgcctgcgacccctgaagctccagaggaagggttacagtactcttttagctctgccatccatggacagcttaagtgttaacagctcagtggagggtcagtgtgacagcattttgcacccacactcatggcacccgagttcttgtctggtatccaggaggaatgagatcatacaaatgaactgaagatggtaaatgtgggagatttcattgccaatgaaagtggctctcagtgagaagggaaaaaaatgccaaaggggagctgaaaaggggacagagcaggaaggcaatcttcccctgaagtccagccatccaaggctggactcctctctgaatctacgccatcaatctgtccctctgaagtcaagccacttctctccaacatccagctgcttctcctctctgccagctgagccttgggtttttatgggcacaggatcgggggcaggacaggcattggatggttttggaaaaggcaacattcgggcaggaaaacagggatgtaaattctcactttgggccacagtgccaggctttttggcttgagggtggggccctcactggggacctgcccacttctgccaacaatttcactgcctcctgtccctatcaatactacaaataagttaaatttaaaaaaaggaaaattgtccagtaaactaaggtacatattaccataaacatcataattcattaaacatgtaggaaagaatagttctcaaaatggaagacatctacaatctattacaaagtttagaacaggttacaaaacagtatatagagaatataatgttgcaaacaaaaatatacacacttacctagaaaaatattggacagacttgtctgaagagcccagtcttacctttgtgtaatagcattattaacgatttgctttttcattctgtttttaatttaggtacatttatgttttctacaccttctatatttattaagcatgtatttatttctttgttattaagaaaaaattataaaagaaaaataggaaaaaaagtcatgaaatgatagttggatggttagaaaatatttaactctagatcttgactacatgatttcatgggaatcctggtatagtttataactgaggaaattcattcctctaaaaatcaattagcatttgtatttataagaattaggctgggcgtggtggctcacgcctgtaatcccagcactctgggaggctgaggcaggaggatcatgaggtcaggagatcaagaccatcctggctaacatggtgaaaccccgtctctactaaaaatacaaaaaaattaattaggcatggtggcaggcgtgtagtcccagctactcaggaggctgaggcagtagaatggcgtgaacccaggaggcggagcttatagtaagccaagatcacgccactgcactccagcctgggcaacagagcaagactccatctcaaaaaaaaaaaaaaaaattataattgtttatatgccatttggttgaagaatcaaataattttataaaattgaatcaaagtaaactaaaattatattaaataacaaactttttgctctataagtcatccactctaatcatttaacatctcaagcacatttcatacaactgtatttaaagttaaattgccaacatatcctttagagggcttataattaaaaggattcctatttaactccactgatatcacactactaataagcaacttaagtttatgaattttagcagtgttttaattttaccttgatatttaccacagttaaatcttatatacaaaggatattacatacacaaacatacgcatggatattcatatccacacattcataaatacacagataattatgtatataaactgcattttaaaatgccatatactcataataatgcttaaacatctaaattaatttcacctaaagttcaaatatttaattttcaaagaactcagtggaaaagtaaagagttattattcatttagaggcacttcaattctgccacccaattatttggttacatctttcactattctatgcccctgataaggcaatctaaattaacagaatcttaagtacatctgaagagtaatatcaaatacttggaatgcagacatatctcttatgcttctatatttgaaaatgacttctaattattatatgtttggtctttgcattggaagacaaatttaaaattatattagctcactgctggaagaaggaaggaaagcagacagaaataaagaattacaaaaagagtgagaataaaataaagaaaaaatgagcaagactgagtgggaaaagaagaaaagaatatattgcaaataaccatgtaatctggaaatctaaccaagatgtcctgtaatcgctgttaataataattcagagttaggggcaagaaacttcaggaaaattttcatatcttcagctaaaagatattagataatgatatggacaggagacaagaaaacactgggtagaagagggcagttctgtggcaaaggcccaacctccaggcctggaaacctgtggccctaaatgggaacaagcaaacctgtttttgtgtccagatgttgccttttggccagccacgccccctatcctgtacccatataaaccccaaaccccaggttccatgagcagaaaagcagatgaacagaagagcagaagaccagaagagaaggagtgaagagaaggagaatctgaacatcaaaaggagttcggctagggatgatcggagaggagatcagccactggatgaccaaactccaggcgaagatcatcttccgactccatctgctttccagctccccatccatgccactgacagccacctccaccactcagtaaaaccttcgcattcatccttcaagtccatgtattacctgattcttccttgatgatggataaggacccaggtagcaagagggcactgagctggttaacacttaagccacctgcagatggcaaagctaaaaaagcacactgtaacacatacccacttgggctccaggagtcgcaggcacccacccctagacactaccatggggccggagcccaaaatgctcaccctagctcctgcacccgcccatctgcatgctcctcctcctgtaagggggtttgagctcacatggcggccaaacagaggagccacgcccctgtcgatgtcgtgtgagggggggtcagggaactctcccatttcaattagaaagatgctttatatactttggccattaaaaaaaagtctttacaaaaaagtctagtgtatcattgttatcaatactttcgatactattatttgcaacagctcaagagataattaatcagaaaatattgtattcagaaaagccacctaatatagaatgttgtataattatctgaatgcttatagcaagctaactcaaaagtcttcaggtaattaaatagatttttaaaatgcatgacaatgaattactcaggctgaaaaaatggaaagtgtacatgtgagctaaatgtagaaaatgaaagaaagaaaaagacagagaagaacatcatcttagctagataaagattgatgcatgctgtatagacagggaatgaataatttcatgatatctagtgatacaaaaagtgggccacctagacacatttacttagttatggaaaggcaaaaaatcattacagctgtgaaagtaggcttaaggcaaaatcacattccatttattggcatgcaaatatacacatcaaacctctgaggggtaatatttctttgtcaaatgaaatctgttcagaatgctgtggaatgagttgaacttagaagtacctttttctatacaaaagtgtatgagaaagaaaacataatctagctatttataagaagcaaaataccagacatttgagagtcaatgttgaatttttacacgtagtggatttctgaaactagataaacacatgcaggtatgtctgtgaaaaatgttatttacaattcatcagactttgccattgacaacaaagtgattagaatttttaataacaatgcagtaaaactttttgataaaggtaaagatgaggtggatgaagaagcctgctattttgagcttgccagtccaagaaatgatcactgaaatatgtaggcaatattcacctaaatctatttgtacaataagattgtaaatgaactgatgttatcctatgtaatacaatgaatctttcaaagctttggttgaatttaccttcccaggaaacaacttctccataagaatgaaacaacaaaaaagagaatttaagtttataaactgcattcatatataatatcatttcatcctttgaagagttttacaaatgagaaaatataaggtttgagaggttatgaaatttaccaaaggccataagataatatattatgaagtcagtatccaaatgagtttcaagtagctggaacctggctctatagaagaagagctcttatatacacttttactctaaggactcaggaactgatactgtggttgtcttacagaccatttaaggtcacattagctaaggggcttcctcttccttttaagcaatgtgcctcaagtcaactaccaaatttagagtaatatgtaatttgtggccttatattactttcttccataggaaatgcattttttgaaaatacccaaaacttttcctgctgtagaaatatcaaatatgattattttgactggcttattcaatatagtcctctccactatttcttatccctctaaaactggaattgaaaagaataatcttgtggtattttctattatatgtgtaatatttaagtgataaaaatgaataaatcaagaaaggattgaaatactatcttaaatagatttttaggaaaatattcaactcaaagtatttagtattctgcttaaagaacaaaattcaagcaactgaaatatgaatttactacctgggatatgtgactttcctatgagaatacaaacccttaaggatcttggtttagcataatgcatttcaatacacctttactgaattgacttttatgctaagtgagcatttagtatatatttttaatgtttgtaagcatataccaggtaacttctaaaaaaggttctctaagagaaaatagttaaaaggtcaatgtacccgtctcccaaaaactcttctacaatacgcagttatgttccattcaaaggtgtgattattatggaacccataataaagctgagttaacaataggacagaagctctttaggatcagaaagaatcagtgtaggagaggggaggctcaagctctgccctctcaaagctggatattggagatggaactaacacttattgagtacctgttttgttcaggcaaagtgttgtgttttatctacatttaatctcatttaatcttcatgactattttctgaaattattataatccttatttcacagattaaaaaactgagcttcatagagagtaaggaccatatatttcatctgcctcctttgaggttctgtcaccccttactttaagactaattcccttactgtgtaatatggtttggttgtatgtccccacccaaatctcatgttgacttgtaatcaccagtgttggaggtggggcctagtgagaggtcattggattatggggctggtttctcatggttcatcactgtccccctagtgctgtctcctgactgagctctcacaagatctgggtgtttgaaagtgtgtaacaccacccccttcgctctctcctctctcctgcttcatcatttgaagatgcatctgcttcccctttgccttccaccatgattgtaagtttcctgaggcctcccgagaagcagaagcctgtatatcctgcagaactgtgagccaattataccccttttctttataaattacccagtctcaggcagttctttatagcaatgcaataacaaactaatatactgtgttgccttactttaagactaattccaccatgtcagccatggacaatccagctgaccctcccaagtaaccttccttggtttccctagatcttaatgtagatttcatattacacttctgcttgttttggggtgctatgaaggcctcagctacttaggtcccagctcttctgcttgcttgaatctggcccatcccatcacctggactcctataaagcttcccatctgaacctgtctctccataaattctgtcttacttctcattgacaatccaaatcccctggccagaaattgcaaattatttaatacatccacattagcctccacctcactatttttttcaggcatatttaaggcaattcagagctatggtgaagatgagtttattgatgtagaaattgtttggtattcacttatacatttcctgtacctaacacactatcttgtacaggtaggccatccaatatgttttttaaagtaataaatgaatgagtaaatgaagaaatatgttggtgagcattgggctaaggtacccagggcagattctctgttttttctgctgccattatctgagagcagaacacagaataaaaatttttggtttgagtcctggctctaccatcaacaatgtgacttttgttaagttattctgcctcaaattgcattatttgtaaaaagggggataaagataaaatccacctcatggagcattgtgaggattaaatgagagaattaatgtgatgcccttaataagcctggcacagtataagtactcaggcacaatatctctctattaccttacattctataattaggacaactgtcaatagagtgctacttcttgacttttaatagacattttttggatagatatacatgactataacataatgaaattgattgttaaacagttattccttccattgggcctatgtcaatcttcctttaacttcaacacttttgttctaaactttgaggatcttcttccacatgaaagctgaaagtttcaaggctccatggtcacttttggttgtacctccctaataccttaaactgtaaattccttcatatgtattcattcactaactcattcattcattaaataacacctattaaaatcctacaatgtgccaggtaggtactctgccagataaaaataaacagagataaataaaatacaatttttgccttcaaaacccatacttctatgcaggagatgggcttggttgtgtctctcttggccattctggtcactcgcttttgaatgccctcacttttgtctacattcctattaaagtttccaaaaaggagtacaacatgtgaccagtgctgagaagagcagaacaatcacttttttattacactgatctgcatgtgggaaagaaccagagatgggatgtagcaatctcttcatggtagacacagtcccaccccacctcacatgcaccatggtaggggtggggaactaggaggttaaaagctgttggaaacaaatggtagattctttttttttaatctaaagtctctcttgagatgttcccttttggaggatgtcatgggtgcatctggctggggcccagcgtagcaggtggtaaaagaatttactaaaacagtagtgagttaaagaaagcaagtttgtaagagagaaagtatgttgcaaggaaataacagacagcacagcagagaaggggctgtctgcaaaatggcaggggctggagggaagttttatagggtcatgctggaggggctacatgcagataatgttatgctgctggggctacatgctgagtgagatatttgggaacagaatgttgtgctagttgtttatttgtggttagccatctcttggaacaattgttttcccctacctgaggccccttcctcattgttgcttacttatgaggacaccacatcccccacccccaccacacctccccatagaacaacaatgacaagtctttggcattagggtggaggtctcaacttccaactacttcctgctggcctgcatcatagaattgaccctacctatggttgttgagagtctgtcagcagaccccgtgggccattgtcctggattgtgggaattaggatattggatcttgcgggaggaagggactcatcagagagggggaggatatcaaggtaaaactggggtatagcagaatccaggagagattcataaaggtagcaggcatcattgggaagagaccaatatccccttcacagcagcatttgaaggtgaaactgctgaattctggaagacatgaatttgacaagttgaagatgcaagggccaaaatgggatcataagtggcccctgacctagtgtgtgatgaggagaagggtccctgataaggaggcggcccttaaaagtgacatcaaggttgggctatcagggggaaggtgagggagaaggagtagatggagtaggtgtagttgaaagtgaaggtggtttgtcaggggaagaaagtatggcctcaacctgtccagccagttggggtgaatgggagagagaaaaaagttcatctaaaatgtcaggagagtcactgaggctagagaatttggcgaggcacatttgacaggtttggcagagatcgcaatcctgagagagagtcatgaaagcctgaatataaggaacttcagaccatttagaagagctgcaacagaagaggtcaagctacagaacagtgttggggacaagggtcccacctagaggccaggatttctgatccggaagttttttaagtggccatgtggcaggccaggtctgactaatgtaggcctccataacaactgtttcagcactgactgagtggttaaattaaatattaaaagctgatagagccagtgcccttatacaaaggctggaatgtaacaaaagcccaccaagagttttgcctaggcctttcctgggccttgaagcatgaaacataatgaaggaattcttaacaagacccgtttaggattaaacaagtttattggaggtctgaagaaaccacccgtacttccacaaacaagtttaatgggagtctgaaggaactcctcaaacctccatgatttagcaggagacaagataagggtaatcaccctagcacctggatccattcagattaagtaaatttactaaggctctagaagaaggtcttcaggactcagatcttagttatagatgagaaaaagttaaccacgtctatctttagatgaatgcacacttacacatagacatatagcttagaaggtacataagatctggaaaaactttgtaattttaagttggtctggtgatactttccaggccttctccctgtacctggttacagtaataaactcccttctttcccagttcatctgcatctcattatggagccacgagaataagcagcccaaccctcatttggtccgggaacagccatgctatgttacatgagaaaattagacatttctttttgagagtctgagagtcaaatttatcccagtgtttgagaatggagcccagggatgagtctgaggaatggaagggctttgtcccatggtgggaccaaaaagaatgtctgctggggacctgaaccataatttctctcagggcatccccccaggaaaagggggttccacttatgtctgctgagggactccaagatgcactttccaaagggcatcccatctattggaaaggaaatcctggcactagggccttacactggatgaatactgcatgagcaaccccaggtcagtccaggtatgaattatgcagggtgctcaatccaggtacaagaggaaaaggttcagggaagatttatcattccaatgctgtttgagatcacctggcttaaaaggtccagagcaggatggctggctggctctcttcatgggagaatttagagtgagagagggggtctgagttcccccaaaacgcatgtgagtttgcccaaaacgcatgtgggtttgccctggttgagctgccactgccaattgtgccacacatagggattgaggacttttgaccagaaaggataggagagagtcttcctcccttctgggcaagacagcaaaacctgttcaccccttgaccttcagcctacaccagggaatggccctggccagttgccatcagttgccagagggatactaaatattgtctgctggaagactggaaagaaaagtaaactctaaactctcaccctattgagtggcagtgttcagacgtctttcccctgtgaccttctgatcccctggggaatagccatggctgaggaccatcagttgtctccaggcttgaatgctgtccaatgagagattggagctggaaaacaggaaagggggatagtaggggagaggtccccatacgggtcaccaaaatgtcataggtgcatctggctgaagctgacatcataggtggtaacagttattgaaacaatagtgagttaaagaaagcaagtttattagagagaaagtatattccaaggaaacaacaggcatcacagcagagaaggggctgtctgcaaagaggcaggggctgaagggaagttttatagggtcgtgctggagtggcctgtgtagataaggtcgtgctgctagggttatgtgtagagcaaggtatttgggaacaggatgttgtgccaacaggtttgtggttagctgtctctcagacaattgttctcccccacctgctgcctcttccttgttgttgattgtttatcttattaggactccacagaggaatcacgttttggagtttcttttctcatgcatccagtagagtaagaaaagcctatatcctccacctttctgagaatatcctcttcctcccaccttggcccttagaaacaaagcagaaaccagggacaagactcaggggaaaagaggtacaaatggccagcttaagcctgatgttctaggccttttggtgaaatactttccttttctttggcattttcccccttaggtttatctaatcttccttcttctcaccatcaaaacagtaatatttaaagaactaagatggggtgaagtcctaatcaacaggacaggtgtttaggttgccagccatcattagatacatttttgattgaaaatggttaatactcagttttgctgtactgctagtcaacaaacccataataagggctattgatgagggccattgctatgaatggggtaccattttacctaaaaagaccaaaacaaagccaagataacagcaccgtatccacatggaacctcccaaccaccccaggagtgtagtcttctcagactacagggtactaagcatctttctctctcaaaatcagtatttgcccccaggggtttttcgcaagaaacatttctttcaggtctcatggatgtagcttcccaacagtcaacagttactgacattgaacttctgttctaatttgttcttaaaatcttccaaggagttcatactatctaaatccttagagattacgtaaggttcttattaatctgatcctgtctatgatccagtcttaccttctatcatcctccacttacattctagtcatgcagagctacttgtagctcctagtaaaaaccagacatgctctctttcaaatgtcatgtatttgcaaatgttactccttcagctataaactctccctactctatttgctcctattacattcctcaatatttttcttaagatgccttctctgagaagccctttctttcctatcatatggacaaatgcactatctatattatgacatcatattgtagtacagactgaatatctgcatgaccccactgaactaggagcttcttaaaaacagacactgtcatatacataacttccatttatttaacacacactatgtgtcaaacccaaaacaattagatgctttacatatatcagttccatcttcaaaacaatcataaaggcaaatttttttatatttatgtacaggctaagtgggacaagttcaaaaccacattgaagtaaataggggaaacagaattcctactttagccccatttggctccaaggcctatgctccttccatggcagcactctggcccccacgacatactgatagaggcaggaggcagagaaactctaggcagacaggggtgggtccctggtggaaaccccaccttcaagccaaatgtagcctgaaacctgcagcccaaagtgagaacttctattcctgtttgcctgctctcttgattggttctttctgattaatgtctttttaccaatcaaatgttgccttttccaaaactaccaatagcttgctgcacccaccatcctgtgcctataaagatcctagactcagccagtagagagaagtagctggacatcagagagaggcaacttgacttcggaggagagaggcagagagataacttgacttcagggaagagtgacctgccattcccattccctttccagctcccctgtctgctgaaagcttctctcattgctcaataaaattctccccattcaccatcctttgatttgaccacattacctcattctcttggataccagaaaagaattcaggacccaccaaatgtgggtacccaaaaaggctgtcacactggccctttgctctcactgactgagggcagccactccatgcaacgaggcaaagggccactgaggtgataacacactgctgtccatagacagtgtagctaagagatcattgtagcatgccctctgaagccttggagtcatgggccccccaacctggacactgccacaaggcctgcatggaatttgctcctgtaagggccaaagtgtctggcaagttcctgcactctcttgcctatgtgatccctcccatgtgcggtggatcatggtgggcctaagtaagtggagttcctcttgccagtgccaaagcagccagccattcccatacttgtgtgcttgtgtgctccctaccaaacaccgcatgttctcgctcataactgggagttgaacaatgagaacacatagacacagggaggggaacatcacacagtagggcctgttgggggatgggggactaggggagggatagcatcaggagaagtacctaatgtagatatcaggttgatgggtgtagcaaatcagcatggcacatgtatacctatataacaatcctgcatgttctgcacatgtatcccagaacttaaagtataatttaaaaaaaaagaaagaaagaaaagaaaaagaaaacatcctgcatcaatacaatgcagtttcactcatctttgtattctttaagtgtggcataaagtaggcttctgggcaatcaatgaaaatgtgttgaaagaatgaagaaataatttattaaatattttgtacgcccactttgctttcttttactcagaaccctcaattctgatgaagaaacatttgcttcacaaggagtcattttaccacagtcctcaaaaaatgttagaaaccaaaactttttagtgttgcaccacaagttatagagagtataaactttccattctgggtaataacagttttttcaggatatcctttggtagtagttacataattcaaactcagtggacttcctctatgctcccacaaaattttgcatccatctctactttaggattttgctatggactggatgcttgtatcccttcaaaattcatatgttgagattccaattcccaatgtgatgttatttaggcctttgaaaggtaattgggtcatgagggtagagtaatcatgaataggataagtacccttacaaaaagacatgagaggacttactttctcccgctctgttctctgctatgtgaaggtacaacaacacggctatctataaaccagaaacagggcttttaccaggaattcagacatgctggtaccctgatctcagactttcagcccctacaactgtgagaaataaatgtttgttgtttaacccacccagtctatggcattctgttttggcagcccgaactgacttagatacatttgctattaagctacatgggtgtacgcctgtctttcttctagaccatcacctccttgaggacagagatctgatctcacttatttctataccccccacaaaaaacaaaagagatcctgatacaaggtgctagttagtttatgtagaattgatgttgtcaaataatctgacacagtaacaccaaaaccaactcaaactagacaaacacctgtctatctgaaaccatgtggaatcagttatttaaaaaaaaaagaaaacaagttttccaggtagcttagactttaaccctttaaaagaaaatttttattttcattttatagggaagcctttctaaaatatacataattcttttttcttaaggaaatcatatttaaaataatttaagctactttgaacattatttctctactctataacaaaataattgtttcagacagtttaccccacacaacgatctcagacaactgtgatgacttttgtatgtgtgtgtgtgtgtgtgtgtgtacgtatgtgtgtgttcctgctttcctttgctatcaggctgtcagatttcatttctcaggatcatgaatatgtttgccaatggcaactgctccctgtatttaattactttcatttattgaaggttcactaacaaccaatgcactaagcactttatttgtattattttatttaacctgacaaatttcaaagagtgtagaatggactctgactcctcagagcttgttttctgcttttactgacacgttcttcatgcatgtgaaaggaaaatatcttgggccccttcaagctaggaactgctcagcgaaaatctacctaccattctatttaaagccatccctctgctcactgagatagatgcatatctgattgccttctttggaaaggctaatcagaaacttaaaagaatgcaaccattagtctctcacatatctgtgacctggaagtcccctccccactttgagtcttcctgccttttcttcacattgacctgcctttccagactgaaccaatggacttcttacatatattgattgatgtctcatgtctctctaaaatgtataaagctaagctgtgccctgaccaccttgggcacatgtcctcaggacttcttgaggctgtgtcacaggtgcatgtcctcaaccttggcaaaataaaatttctaaattaagcgagactcatctcaaattttcagggttcacatgggtaaagctctaggatgtaactaaacatggctaaattgttatccctttttcagaaaatcccattccaatgactttatgtcaggtagcacattacaaggataaatacttcactgtcgtcctattttcttaatgtttataataacacacaattagaatggctaatgcctctcaaaaagctctctgtgatgcctacaacagataaatacttggtaagaaaggttgggagaagaattagggaatgattggtggttttaaaatgatagaaaagaaagtatatttgccctgtggtttcaaaattacaactaacggatagaattttaaggaagtatatgctgctatttcatgtgtgagagaattttctaagtactagaatgtgtcataatagaaatagtaagctctatatctcaactctatacttttaaagtagcctaacattctaaccatatagctactagcttgctaaaatatcccaggaatgtgtgtgcttcaatctagttctcactcagatgttttccttttcaagcccacaatttctttattggaattattatttgcatcttgttactcagcctcctgattttcaacttctcccttgtagaatgcagattggatctacctcatctacttcctctgcttcagactgcctcagaaagcatgtctggcttggatcttggcccatcagaaaacatttggttggcctgctcaggtctttgcactgtgaagagattccaaattagattggattccagattagatcaaattaaatgctacataagacatcttcattacataagtccttgaactacttgaacaacaagatttctcagacttcttaggattccatgactccccaaggggcagaaaaattaagagtaaagattgtagagtcagagataactgagttggagttcttaatcttctactgcattataaaatatgctaaataatagtaccaatttcttaaggttcttgagagaataatgagactgtatatgtaagaagcttggcatactgttaatatacttagcaaatgttaactgttcacaatagtgttaatgttaggccagtagcaagcataatcgtaccaattccaaagccaagcccacacaaagagagaagaaaaagaattaaatgaaggtctgctcttgttctgttttgttttgtgattattgtccaggaacataatctatcattttgaaaagtatgtttcacttactggttgtgtaatgttgagaaattatttaaattttctgtatcttagattattcatatttaaaataatagtaataataatacccatcttatatgaatgttataagaattaaatgaataaatatatctagaacacttaatatatgtaaagcactgcttagaatataataagggccagataagtgttagctatcattaaaatgtgttagtacctgtattagtcagagttctccagagaaacagaaccagtagaatggatgagtgaatacatatatgaatacatattggtaccatttggctgtgtccccacccaaatctcatcttgaattgtaactcccataattcccacatgttgtggcagggacctaatgggaggtaattgaattatgggggcaagtctttcccatgctattctcatgatagtgaataagtctcatgagatctgatggttttatgaaggggagtttccctgcataagttgtcttctcttgtctgccgccatgtgagacatgccttctactttccaccatgattgtgatgcctccccagccacatggaactgtgagtccattaaacctctttcttttgtcaattgcccagtgtctggtacatctttatcagcagcatgaaaacaagctaatacagtaatttggtactgacagtggggtgctgctgaaaagatacctgaaaatgaggaagtgactttggaactgggtaacaggcagaggttggaacagtttggagggctcagaagaagagaggaaaatgtgggaaagtttggaactccctagagacttgttgaatgcatttgaccaaaatgctcaagatgatatgaacaacgaaatccaggctgaggtggtctcaaatggagataaggaacttgttgggaactggagtgaaggtgactcttgttatggtttagcaaagagactggcagcattttcctctgccctagaaatttgtggaactttgaacttaagacagatgatttagggcatctggcagaataaatttctaagcagcaaagcattcaagaggtgacttgggtcctattaaaggtatacagtattataagggaagcagagtatgaaagtttggaaaatttgcagcctgacaatccgatagaaagcaaaaccccattttctgaggagaaattcaagctggctgcagacatttgcataaataatgaggagctaaatgttaatcaccaagacaatggggaaaatgtctccagggtatgtcagagaccttggctcagaagccaaggaagaaaagatggttttgtgggccaggcccagggtccctctgctgtgtgcagtctagagtgtcctgtgtctcagctgctccagccatgactaacaggggccaaggtaaagcttaggtcatggcttcagagagtggaagccccaagccttggctgctttcatgtggcattgagcctatgggtacacagaagtcaagaattgaggtttggaaacctccgcctagatttcaaaggatgtgtggaaacatctgaatgcccaggcaaaagtttgctgcagcggtggggcactcatgcagaacctctgttagggcagtgcagaagggaaatgtggggtgggtgcccccacacagagtccccactggggtgctgtctagtggagctgtgagaagaatgccactgtcctccagaccccagaatggtagatccacccacagcttgcaccgtgcacccagaaaagccacagacactcaatgccagcacaggaaagcagccaggagggaggctaccttgcatagccagaggggctgagctgcccaaaaccatggggacccagctcttgcatagcatgacctagatgtgagacatgaagtcaaagaatatcaatctggagctttaagatttgactgcactgctggctttcagacttgcatggggccttcagcccctttctttgggccaatttctcccatttggaacaagtatttacccaatgcctgtacccctattgtatctaggaagcaactcacttgctttttattttacaggctcataggccaaagggacttgccttgtctcagatgaaactttggactgtgtacttttgagttaatgctgaaatgaggtaagactttgggagacttttgggaaggcatgattagttttgaaatgtgaagacatgaaatttgagaggggccaggtgtgaatgatatggttcggctatgttcccactcaaatctcatcttgaattgtagttcccataattcccatgtgttgtgggagggacctggtgagaggtaattgaatcatgggggcaggtctttcccatgctattctcatgatagtgaataggtctcacaagacttgatggttttataaaggggagtttccctgcacaagctctcttctcttgcctcccaccatgtatgatgtgccttctttctgccataattgtgaggcctcccaagccatgtggaactgtgagttcattaaacctctttcttttgtaagttgcccagtctcagatatgtctttatcagcagtatgaaaatagactaatacacatagattgattgattttaagaaattgactcttgcaattgtggagactgatatgtcttaaatctgtaggataggctagaagtctggaaactcaggcagaaatggtgtggcagccttgaggcagaattccttctccagaacagttttgctcttaaggccttcaactgattgtataggtccacccacattattaacagtctgctttacttagagctacaaaccactgctcaacgaaataaaagaggacacaaacaaatggaagaacattccatgctcatggataggaagaatcaatatcgtgaaaatggccatactgcccaaggttatttatagattcaatgccatccccatcaagctaccaatgactcttcacagaattggaaaaagctactctaaagttcatatggaaccaaaaaagagcccgcatcaccaagacaatactaagcaaaaagaacaaagttggaggcatcaagctacctgacttcaaactatgttacaaggctacagtaaccaaaacagcatggtactggtaccaaaacagagatatagaccaatgaaacagaacagagccctcagaaataacactacacatctacaaccatctgatctttgacaaacctgacaaaaacaagaaatggggaaaggattccctatttaataaatggtgctgggaaaactggctagccatatgtagaaagctgaaactggatcccttccttacacttaatacaaaaattaattcaagatggattaaagacttaaatattagacctaaaaccataaaaaccctagaagaaaacctaggcaataccactcaggacacaggcatgagcaaagacttcatgactaaaacaccaaaagcaatggcaacaaaagccaaaattgacaaatgggatctaattaaactaaagagcttctgcacagcaaaagaaactaccatcagagtgaacaggcaacctacagaatgggaagaaatttttacaatctacccatctgacaaagggctaatatccagaatctacaaagaacttaaaaaaatttacaagaaaaaatcaaacaaccccatcaaaaagtgggcaaatgatatgaaaagacacttctcaaaagaagacatctatgtagccaacagacacatgaaaaaatgctcatcatcactggccatcagagaaatgcaaaccaaaaccacaatgagataccatctcacaccagttagattgctgatcattaaaaagtcaggaaacaacagatgctggagaggatgtggagaaataggaacacttttacactgttggtgggactgtaaactagttcaaccattgtggaagtcagtgtggtgattcctccaggatctagaactagaaataccatttgacccaaccatcccattactgggtatatacccaaaggattataaatcatgctgctataaatacacatgcacaagtatgcttattgtggcactactcacaatatcaaagacttggaaccaacccaaatgtccatcaatgatagataggattaagaaaatgtggcacatatacaccatggaatactatgaagccataaaaaagaatgagttcatgttctttgtagggacatggatgaagctggaaaccatcattctcagcaaactatcacaagaacagaaaaccaaacaccacatgttctcactcataggtgggaattgaaccacgagaacacttggacacagggtggggaacatcacacactgcggctgtcgtggggtgggtggagaggggagggatagcattaagagatatacctaatgtaaatgatgagttaatgggtgcagcacaccaacatggcacatgtatacatatgtaacaaacctgcacgctgtgcacatgtaccctagaacttaaagtataattaaaaaaagtaagattaggtcgagcagtgcaaggaaactaaggtgggccattgttatcatagtattgcaaggcaatgataattcccaccagcaaataaactagtctcaacaacaataacaaaaaaagagtctcctttacttacagtcaactgaatgtagatgtcttacttatctaaaacatactttcacaacagtatccaacttagtgtttgaataaataactaggtactatagcatagccaagtttacaaataagactaaccattacagtaaagaagtatcataaaatatattttatattacacactgtagggtctcagaaaatgatatctccaaatgaagggttcacaagtgactctctctgaacttgtactctgctgtctctgaccattcattctaccccaagtctaccccaaatctcttccccaaggtgggtcataaaaacacaacccctttcctccaaagccagccataaaaccttaaaatattacttaaaataccactgtttgtaaataaattatctgtttgatcgtaagtcataagactcccattccagaaaggttcttgtaccatacccagaaaaaagaatgctgcacagagaggccaagaataatctaaacagacaggccttgctaggtttcccctctcagtttattagcattggatcataccctttctgtccagacatatttctacatggcagctcatactttgttgaacttaagcataaaaatggatagttttccctgtatcttcgggaagataccctatccttcattctaaaggctcctatatcacatgaaaattttatcaaataaatttgtatgccttttctcctgttaatatgctttttgtcaatgattttcagtgaaacttcagagggcaaaggggaagctttccctcagcccaacagaactatctttaagaaattagtttagccaatgactagaggtgctaattgctttgggttttttgactcacttactcttgtagactctacaagacaactcgggtttttctgctaatatgatatctggtattatattcatgaatttatttttcatcatgtggaagatgaccagaacagatttcaaaataaaacaactttctcttaaatgacaaaggattattcatatgctagaccttaatcttatattacttactttcaatgacagctgcatacttacaaatctgtcatatttactaaaataataatgaaattctaactgagaatactagtatatgtgaacatttcataaaatgtttaactaatagtgcactctctcatctcaaaaataatccagaactattatctgattcagttcttggacagtgctttgagttggataatcatatatctggattttcaggaatactctcaattttaaatattctgccctgtatagaaaaaaaaagtccatacttttatataatttgaaaactatgcttcctttagattagacagtaatataattcatttatttattcaatgaacatttactgggaagttaatatatgtaaggatctagcttagtcctgagaagatataaaccatatattcagggcacacaggtcctgactccacagtattgtaggggagttctatcatgcttacaataactataacacaatgtagaaaatacgaagctccccaagggaaaaaaaaaaatgcttactgattctaggtaaggacagtacactgttttaaggatcataacaagccattttgaagtctccacataaagctctccatggacggagtctaaggcaggtagatgtccttagacccactccagtgctatctaggcaacaatgtgtcaagcttgtatagtatggatattctgaaactttttctttactgttacattctgattatcaagttattggcagttctgcctcctgaacaaatcttactctctcaccataatattttcaaagttggattgacctccatataacacaggctcctttctctgcgggagaaaaaaactttaggaatgtggcacttcctctatcttttttgccaggatagtctgcctgttgaataagaaatgggattacagaatttcactattacaagaatgaatgtttaaaagaggtcaaattattaaaatgggcaagcaatcaacccaaatcaaatctgaaataggaaagatgatagtcattgcaacctaaccattctctccggtctccataatgactcagttttggagaaactctgacatctctaactctgatagtaacacaatctgcagggaagagtatggaactgtatgacatcattttagcccataattgtcccatgttgtgccataaaataagtaatttgaaggatagggtgagctgtaccgccatgactcattcctgtgtttttaaaactatcttcagaatcttacctaggactaagcatcttttcactgggtcaaccaggaaattttaattcatgtttctagcataatatacatatacttaacaaaacaacatatcattctctgacatcaagaaaaatacagtcaatcatctacttcataaacatttattgaatacttactgcctaaaaagctctgaaccatattacagctgtgtaaataaatataatacttgatattaaggtatgatctaacaagtgaaacacttgagcaagtcatttaaatgcaatatgtcaaacactataacagaggccttgggcagtacaggaaacagaagaatttttctagttaaggtcattagaaaattcgtgattgatagacaggtagacctttaaaaagattaagtagaaaatttccagatgaaaacaaagggaaaaatattccaggcagaggaatgaacaagaacaaggcttaagtaaagcttaatgtaagttcagtccagacagtaaagattatgctaaggagatggcacaataatctgtaaaaaatgaagatcaataaatagttttaaaactgttagcctagggaggtagagctacaagaggaaaatcctgactatgaagaccagttaaagcttgtttctaaatctgtagaaagattctatgaaagcctgaattagatcagtgccattgtgaatggagaggaaggtcaaacatagagatatttcaagaagttatgaataatagtgacattttacagttaaatatctttgcatcatccaagtaatatttctttgaggtctagtatttctggtaagtatgaatgtaatctaatttcattatatttgaaaaatattaggtagaaaaccaaagtactctcactattttagatcatattattggaaagttagctagagtactccaaagaaaaatcttactgtaaactattcacagataaatgctgagttaacttcagcctcagcaaagtaactaccagctctgtgagttactcacaggcttcctaggtgattaattttgcaagcaggatttttctttcttttacaagttagtttgagtgtattttctaaatttaatttgattttcttctttataaatcaagttactacccatgagaaatgatgctttgtcaagaaaaaatctatccatgatcttccaggagggtaatacatagtctccaggtacctagttgaacagtttctggtgtgacagctacctaattggtctccctgtcaccggtttctcttgtctatgatctactatgcatgatactgccagtttaatctgccccagcatagctgataatgccatttacttgcataaaaaccttctgtggctcacaacgacctgaagaaaagcatttaaatgctatagtattgcaattaaggctctcaagcagacagctagaataacctaatcagtcttactactctcagctccccacctactaatcctaaatgttcactatttataaaacctttcccactttctcctaagaaaggtgatgggatgtcagacacatgtttattaatccccactatagcacaatttactgtgtatctttgatgaagacatttaacttctctgaggcttactttcctcttctgcaaattataagtaatacctacctaccgcttcaaatcttatttaaaatgaagtgaggaatgaatcaataaaatatctaccatcatgggttgctatagagattaagagataatatattaaaagtgcctgggcagatcacctgaggttgggagtttgagaccagcctaaccaacatggtgaaacccgtctgtactaaaaatacaaaattagctgggcatggtagtgcatgcctgtaatctcagctactcaggaggctgaggcgggagaatcgcttgaacctgggaggtggagattgcggtgagccgagatggtttcattgcactccagcctgggcaacaaaagcaaaactctgcctcaaagaaaaaaaaaagagcctagcctggactttatttataagtatcaggttttattactcttctaagcctttactcacatagttttctccacctgcaagaccttcaacccagatcttatacattacacaaagcccatttctaaacccacccagctatgaaaccatctctagtactctagtaaaaatcatcctttctcggctatagtgtaaaggaaaaattcttgtcttgaaatcaaattcctgattctacccattttctaacagtatgaccctggacaagttgcttatcttcagcttccccatttctaatgtggatagcaacagcaactctacctgcctcactaagccattatgagaatcaagttagagaagttatatttttaactataaaatggcctatatatgtgagagactgttatttcctctaaagtataagatcaaataaaaaactttggttttcctcatctttataactgatatccaaaagatatgttatgaaagaacaccaagtccaataaagaagaaaatagttaatatccaggtcaagaactagaatattggaatcaagaagggatcaagtaaaaaggataggttaaagatagccgggcagagctgaagttatgaagaaaaaacatgttcctgagtttcactttacatagcaaccaatgtgtgcaaaggtaggtggcagcttaaagaagctacacaaagatgaatatacataccagatgctcaataagtgataaggagaggggagggaaggaaataggaagaagagaggaaaggaaaagaggagagagaaaggaaacagaagggaaaacagtttcatcattcctttcaagggctaatttctatgccacttgccaggctgctataataaaaagttaactggtagctaaagcttatgtatgaaaacactcacttctcctttaaggttccctttccttgactgtgccttttctctccactctacccctcttccaactcctatttatcagtgtttactttcctcccaccattacccaggacctccaaataccaacacaaatccatacgaagtaattactcttttccacccactatctcagaaaaacaaaccaaaacaaaaaataaacaagcaaacagcaaaaaaaaaaattgtttttatttaaatgtcaagagcctcataggtgcattcaagaacctattgagagcagtattgtgttaccctacaatagcatgcacagtttaacagggactaccttaactccctttgtcttctggagcctcaccaaaatatccatggaaggaattttaagtaacagtaataggtttaaatgagaagatatttgtgcattgtatagtaatgatggtgagattttcttatattcacataatgctttttgctttgcaaaatgctttcttattggttatttgatctgaattcccagggagaagtgacaaaacaaggggaaaagtcctatttatactatgcattttaatataatgcagttttacaaaattcctttttcaaagcatatatatatatccttttatttgattctccctgacatatagtttttatctccatttactgatgaagatagtgagtgagactcagagacgtaacaggactttccacaagatcattatcaatataagtgctctttatggaccatttcctaggtccaggaattgtactcagcactttacatgcctgatagcttatttattcttcacaataaccttatgaggtagacactattattactttgacattttacagattaaaaatcagataggttaaataatttgacaatggccatgtaactagcaactggcaaaagcaaaattcaaacagaagactttcagattactcttgattgttctgctataccaagcagcctccttcctggcccagtgctgttactgtaacactgttagtaatataaacttactttctttctgtcaccaagttagaattgcagatttcagcccagcagctcaagttctatggagaaaatacacacacatatacttaaagcagaagtgaggaggatgctgtgtccatttttttacaccaaaaaaacccataaatgaagcagaaaactcaccataattgggagctaaaaatcagttattatagtgttggcagacaggagaagggtgatatgcacctcagtatagaatattgtagaatagagagatgaattacttatagttcagcaaaacacctaagaaacaaacaaaaaaatcaaacctcggaatagatgcttcttttaaaatgtttttaaaaaggtcatttattttttattcctaaataaaaatttctatcatatttcaaaacaccaccaatccaacacagaatagccatattatgactctgctcctgtcatcttatgatatcaacaacatattacaggttaaaatgctatgggatgtgaaggatcagggtgctgatttacattttccagaaacttcatataaatcagagtttaaggtgagcagctagaattctatcacacatatgctgaggaagtaagaagacagatctctttccaccaggcactggagatgaaatttcaaaaaacggtaggtgaaacttgtatttaagatcttcccaagctgaatgcaaacaagtcgatgtcactttctttccagacaagaaaagtctaaaacctttacctccaggtcttttaaacttacatgctattaaaatcacatcaaagttttgcttcagaagcccatctgattttctttcaaggagaaaaggaatcattgggtggcacactgtagggactccatgagattcaaaataatgatcccattgttcttcctatcaaccttaatatatactaaatatatagctataataacgaagcctgtggaaactaataatgagttcaacagatccaggcaaaagtaaaatatttctaatttctaacaacaggatattctgtatgccttttgggaagctcagatcaactcattcatatgctcaaaactttccaacggtttctatttcgctcatagtaaaatctttccaatagcctctaaggctatcccttatctgtcctcctctttgagctcactgcagttaaaatggcttttataaaaaagacagggcaataacggatgctggtgaggatgtggagaatggggaacccttgtacactgttggcagaaatgcaaattagtacaaccactatagagaacggtatggaggttcctcaaaaaactaaacttagagctgccatatgattcagcaattccactgctgggtatatatctaaaataaagaaattcagtatattgaagaagtatctgtactccaatgtttattgcagcaccattcacaatagccaagatatggaatcaatcaaagtgtccatcaacagatgaatggataaagaaaatgtggtacatacacacaatgggaatttacttgactaaaaaaaaaataaataaataaactcctgtcatttgcaacaacatggatggaattgaaggacattatgttaagtgagataagccaggcacagaaagacaaatatcactcatatatggaagctaaaaaaaataaaatgtacacatgcagatggaaagttgaatgatgggtacaagggtctgtgaaggtaatgggcaggggagaataaagaagagatggataatgggtacaaaaatacagttagatagaaacagatctagtgctcagtagcacaatagggcagctatgattaataatatattgtatatttcaaaataacttaaaaagtggaattagaatgttcctaacacaaagaaatgataaatgcttgaggtaatggacatcccaattaccctgatttaaccatcacacattatatgtttgtatcaaaatattgcatgtaccccataaatatgtataactattatgtatccataataattaaaaataaaaattaagaaaaaacacacaaaatgcacaaattgctaacatcagttaccttgcatgcagggaggatagagctgatacagtataagcggaaagtgagtgaaaggggagtccacaaaaatagaaaaattgttttaagaacaactgtatttagaataaaaagtatatatttatcatttatgcttctatgcaatatatatgggactatgcatctagaaattgaataaaataatgtttttgaaagtttatgttctttcgtaatgacacatgcacccctgtatgttcattgcagcactattcacaatagcaaagacatggaattaacctaaatgtccatcagtggtagcctggataaagaaaatgtgatacatatataccatggaatactacacagccataaaaaggaacgagatcatgccctttgcaggaacatagatgaagctggaggtcatcatccttagccaactaacacaggaacaaaaaaacaaatactgcatgttctcacttataagtgggagccaatgatgagaatacatggtcacaaacaggggaacaacagacactggcacctactagagggtggagggtgggaagagggaaaggatcagaaaaaataactactggttacttagcacctgggtgatgaaatataatcttacaacaaacccctgtgacatgagtttacctatataacaaacatgcacatgtacccctgaatttaaaataaaagttaaaaattgattaattaattaattacttttttaaaaaaaagaaaattgaaaaatcaaaaatatcaaggcaatgaaagcctagaaaaaaatacaggagaatacttaactagtcctagaatgaagaaagataaagcaaagaagaaagaattttttaaaaagtaataattttatcacataaaaattaaaactattttgaaggttaaaaagtactataagcaaaattaataataataaacaaaccagaaaaaaaaacaattatgacaacaggatggcatgtttcataaataaactgctctttcaaagcaattaagaattctagtaccacttagaaaaatagacaaagagcttgaatggatcatgaaagaaaaatagacaaccaataatcatgtaaaaagttgaatcatgatagtgaacacgtaactgcaatataaagcattaagtaaaacatcttatctattaatttgacaacatattttaaataataaaataatgctactaaagatataggcagattggccttttgaaagatggctgatagcattgttctccaaaacagcttgacaatttgtatccagagacttaaaaatgtccatacccttgtactcaacagtttcatttataaaatcaatcctaatgaaacagttagaaaaaaaaaaaaaagcaatggcttatacacatgcacatccattacagcattattcaaagcaggaaattgaagatagcctagatttgaatgaagatctgcttaaataagttccaaatcatggaatattcatagccactaaaatattttccaaaaatgttcaatgttatgatatggataaatgctattagtgtaacattaaatgtaaaagacataaaatgccctatatgctattgtcccaacttcatgtacatatatttgtacaaaaaaggactaaaaaagtcaaaataattacttctaggtgctaaaattaggatgatgcttatttttatgcttttaagtataatttcacaaggttgatatctattatttatcaaattattgtcatgattaactttttttttttaagtgactagggtgataattaggctctgtccttcccagtttacaaatcagctctgagcaggacagaaaatatatgagaggcctcaatattaacaatacaaactcagcaatcaacatgctattgattggcactaggattccatgtagcttccaaaacatcgagttggctacatgactccaatcttgaaaaatagtgtgtgtgggtatgtactattacctcccttcaaagtattgactgccacttaaaagtatccattgacttgtccctgttagcccttaggtatgaacctgagacatgcctcaacttgccttagtctttggtaaatgttgatttttaacagtagtgtccaaactgtttgattccataattctatttgtaaaaacaagttgatcgtacaactctaattgctttatatttatttttaaaattagttactactaatatataagttacccaaatatagaaaattttaaagaatatgattaaaagaactggaaataggaattctaatattctgctcctacacttcaactgatcattttatattcttgccccaggatatgtgcccttcctatggaaatcagagtcttagaccacacttccctattctaccatccatctccttcccctacagcacaggtaaccatgttctgaaactccagaatgccttagacttgagtcaactcaaactatgacaattttgctaacataacccactcaaaaaatataaagaatcatatcattcccaccctattttatgttttggaaaaattgaattttcatatatgaaaattgcatacagtatggtataactacatttctattattgttgttgccatttgttgataataatcaccactactaccattacttctttagtggcctaagtcctagtattattcagttcttttggaagtttcagtagtatacctctgaagatttttgaagtctgtcatggcacggagcaagaagggatgtcttctcccatttctgtaaaacttgattggcttcttctatcttctgctcacaacttttttgagaatttagcaatgtcacctcataaaattcttggatatctgtaaagaaaatgtaaggaaagcatcaaaatgtaatgcatgacttcataaatagcttctgcatatatgtccatatatagacatacagaaattttgctgattaaaagaactgcataaatatatatcccaaagtaaaacagaagaaatcctgaaaattatctttttacctgcatttagaatgcttatagcagctttattcataattacaaaaactagaacaaatccttcaaaaagtgaataaactgtagtaaatccatataatagaatgttattcagtaataaggaatgagctatcaaacaaagcaaaaacatagatgaatcttaaatgcatattgctaagtgaaagaagtcagtctggaaaggatacatactgtatgattccacctatatagcatctggaaaaagtaaaactaaagagatagttttaaaaaatcaatgtttgccagaggttctgagaaagagaaggaggtttgactagataatgcagaggatgatgaaaatattctctaatgatactgtagtgttggacacataacatgaaccatttgtcaaaacccaaagaactcaatagcacaaaaagtaaaccttaacgtaggcaaattaaaaaaaaaatcatgtaggaagtcagaggatcccaagatgaaatgcagactgttacaaaggaatgtaactgtattacaaatgtataaaataacctccaagaagtcaacaggaaaaaaaaagtactgacttaagtaactttgaaaatgaacagagactataaaaccaaagtcaaggaaactatacaaaagcatcatactctagttggtaaacttgtgtcctgttgggtacagatgaacaattctgaaaacacaatacatgtatactaaaattgaacaattaagtgaatggatggtagatgatgggagccaagtttcttactgttctatagaaagttacaggcaagtaaggttaaaatgattcatatgatattagatgagagttggagacatgtttagcttaatgtagatacagatgaatacatataagaatatttacagacatgtatatacacaaatcagttatacacacatatatttccttgctccatctgctgagaaggcctagaagcaatgatgccatagtaataacaaacaaaactagcactctgattttggcctctgtgcagcattgctaaagagtaatgaacactgtcatattatattagcaatgagggtgtctatatgaactcaaagttttcaagagctacaggatagagagatagataaaaatatgtttagaaacagaaatgaatatgtatctggacatttcccagctttgtcatatataattcctggctctgtcttctgagaggacctagaagcagggacaccccagcagcaacaaacacacccagagcccagatcttggtttgtaatactattttccaataaaagaagctccttggagaaatggttgatcgtaggactggggcaggagacataagatgagcatggaacatcttatagccccagcaaataaagaaatagtcaccagagaaacaaccctgctacagtgggggaatatcaaagaaacacaagaaccacatgaaagagctgccaaagatggccaaagctggagcaatttgagcaaaaacaatattacctagtattggattataacacaaaatataaaataaagggatgagtaggagggattacaaaagggtaagaggaaacttctaagagtgatgtgtatgcttactatctttattgtgcttatagtgcatacatatgtccaaacctattaaattatgcattatatatgtagttcattatgtatcaattatgcataaaatatatatatgtatcaataaagaaagcaaaaagacaaggtacaaattgaaagaagataatttcacagcacacagacaaaggaacagtatccagatatgaaaagaaatacaaatcgcaaagaaaaagacaagcaaactaaaagaaaagaattggtaaaagttatgagcaggcatttcacagtaaaagaaatacatgtcacagataagcctaggaaagatcctcgacctcattggtgataaaaaatacaaactaagatcatagtcaaatgccatttacatcaaaaatattgtcaaaaataattaagtctcacagtacaaggactagaaaaagacatgaatccttggtaacttatttattcctagcaagtgcaaattgctatagccacttcagaaaataatttaacatttgtttatcctataagtcggtatttctactacccagtacatatcctagataaactttggcacatatgcatcaaaaacaaaccaaaatattcctaacagcatagattacagtagcaaacattagaaacattccaatgtccatcaaaagtgaaatagataaattgtgatatgttctcaagatggagtgtatggagcagtaaaaatgaatgaatgataatatcatgaaactatatatcttagaaaaataacgttgggtgaataaagcaagttgcaatatgaaaaaaattttgtaaagttgaaaaatgtacaaaactgaactatatatttttaagcatccatacatatacatgtaacaaaacaaatagacaaaagcaaaggacgacatgaaaagatgtagttacttcagtagacagggtgggcaaggaagtgggataaggaaagtacatatgagtagatacaagttaatggtaaggatctatttctagatgtcagtagcaatttcagaaatgtttgttttgttatgctgtgtatattatagataaattgcatatattattttgtatgaattaaatattatattttcataaataataaagaaaaattttgtgtttcataaatattaagatttacagagaaaagttagcaatccttaaattttatgtacagctacaactttattctccactagcaataaagtaactgtgaggtcatgtttgaaaaatgtgtaagaacagaaagtaaaatctgtacagatatacatctttcccagatttttttaataacatacgggctggtaggttactaattgggtggacaaaaatcagagaaataaggaataaaaaaaagataaaacccagaaaacaaaatatgtttgcatcatcttgcctcacgtattaatggagagaaaagaatttgggcatggtggtgtgtgcctgtggtcccagctactgaggaggttgaggcagaactgcttgaacccagaaggtcaaggctgcagtgagctgtgttcatgccactgcactccagtcctggtaacagaacaagactcactttcaaaaaaataaaaactaaaaataaagggaaaagaaaaaaaagaatttctgtaaacatatctgcagctacagtctcttaaaagaataacgacttgtaatgaataaaacaatttttgtagatagtaaaatttcaagagtctttttctctgtatcgttttataggatataaacagtttcatgagcagtatttgcaagtcaccaaaatttgaaatactacgtgtacaaattattcagaaaagaaagggtatttatcatactcacgctatgcatttatatcaataagctgtacttcgaaacataacaaacagtgatttgatcacatttagaaaaaccctagggacaatatttttaatattaaacttacaaatcttcattaatttatacccccaaatgtgaagaagtgttctaattctatttcactcttttgtctgcttattctccatgccttaagcaactactagagaggaagaaaataaccatgattaagtcaaagatgacttaaatttgatgataattcaatgatcaatgtcaaatttcacttttggttaacaagaattattttttaataattgacatatatccccttgtcactttccaagcatctctcttttgcaccctctttcctcaccaccagcaccatcattcccactgccagagttcaggccctcgccatctgttactcacactcttctctaggcccagatcccccttcccacacttagaaatcctccttctccttcaatgcccagttccagttcagtgtgtgtaaaaacaatatttgaagtcagagatctaaatatgaaatgtcatcatcaagaaattatttttactaaaactgggttcaattgagtaggtagtaagaacacccaagccactatcatcaaaaagaaaatatgtttggaaagttgtaggggattgtcttcttacagcttcaacaaacagatggtaaaatgtgttaaaacatacgcctatgcttcttccaacatgccttgttcccttacgacatacctgctttgaattcatctagacagtatagcacagttgatcttcctatatttaacgatgttgcaaattatattaggcttttctgaacacttggttctgcttagggagctagataaatgctcatatccacttcccttatcctgtatccaaatcccatactttctcttctgcaaagtaaaatgctgctgttttctcctgttccaaaaacatactgcttgaatctactcaaatagttatttctctttcagccttatagtagaaatagttgttcacccacctgttttcaacatttcaattcactaagtagtttttaagcgctatgcaaggcccttaggaatgaagacaatgttctatccagccatatattctctagtatctagcattatccttaaactcagcaagcacacaatgaattcttggtaattttcatttacttgtattccctctctttttaaggatctaacagaagaaaaatcattgaatgaagtcaaatcccttctcactcaggactgctaaaccctgcatattgtttagattacatttttatgtgacttgactccttgatttaatcacagcacctcaaattcttgaagacgtgtccattttgatgtcacaatttttaaagaatcatctataaattattgttaaatttacaggaaagtgtttacaaactctaatgtacacaaaaatttcctggggacatggggcctgaatttctgcacttctaataagctctcaggtgaggtacatggcttctgatccactagcaacattggacttaagaaatagcatctcagggataagaatttcatactctcaattcaaatagcccttttgagtcactgcaatcctcttgcagtgactcaaaagaaaagtggggttaaagaggggaatagggtgaaagatgcccataatagaaggaagatggcaagtgaagaactctgcctattgattcataaacaataagtacttagtatggatattattgactaaactgatttagattgaattcattagaacttagttgaaagaagctgtatgtccatcttctgcctttaggatccattaaaacaaaaaaattgacttctaggtgagagctgagagagcccctattcagtccaatctctctctcttttaacctacactccttgaaaatgagatctggtcttcataataatgattctgacacagttaggtcttcaattgtcaaacagcatgttgaaggaaattcataataaataggactggattttcaagcacatccttaaaaactcaacatatactcaaaatatttcatcttcttccaagaagaaacacctaacatgacatacctatttcaatgatgctactatttcctcaaaagacacttaaaactcctctttgagatataccttcaagcatttgatgagatttttaaggtccttggaaatggtaaatatttttctcttgaaaggaagtttggttttcttgaaatcaccaaaattcactaggcaaacttcaaatataagtaatggaaaaaaggattttttacatgacttaagaaaatacgattcttaaatcatgaggcttttttcttgtgtgactcatgagttgctctgcaattatctacttaaccacaataaaattaaaaagtaactagaatgcccaatgtgtaacatctttacatactttttaatctattatgggctagaataaaagtgactggggaatgtctttttgcacttcttcccatcccagccttcatgttaccaggcatagtattatgggaacaatagcagtcacctctgtactctgccaaccagaaacccctgtggaggttgttagtgttgattcatttggtttttggtgattggcatatatggccatagctcaccaaagctgtttaatcccaaaaatttaccaaaatcacctgaggattctcttctttttttttttttttttaagacagagtcttgctctgtcatccacgttggaatgcagcagtgcaatctcggctcactgcaatctccgcctccagggttcaagcgattatcctgactcagcctcccaagtagctggaattacaggtgcccaacaccatgcccagttaatttgtgtatctttagtagagatagggtttcaccacattgggcaggctggtttctaactcctgacctcaagtgatccacccgcctcagcctcccaaagtgctgggattacaggcataagccaccacgcctggccaggattctcttcttacagctgcaacaaagagacggtaagatgtgctttaagacatatgccttacgcttcctccaacataccttgttctcttaccacatacctgctttgaattcagctggacagtatagcacaggtgatcttactatatgtaatgatgttacaaaatgatattacagtcttgatgttccattaggcttttctgaacacttggttctgcttagggagtcagataaatgttcatatccaatttccttatcctgtatccatatcccatactttctcttctgcaaagtaaaaagttttcattctcccaatccatatgagtccaaaactactagacactgaagcatagaagtggaattttcaataaagcctttatcagtgtggtaaacgtcctatcttaggctttgtaccaagaaaagtttctttaagaatattacctggaactagaggaataaagttgaatgtgaggaagggactgaagttgaatgtagatgaaatgaaaatataaatttcacagcctagacccagtgaaagcaagtaccaagtaagggaataaaagagacaaaacaggaatgagtgcaaaacccggagtccaaggactaacgcaaaatggaactcaatagatgctgaacacataagaccagagaatgagtaaatgctcatacccaaagggtcatgcaaattccacattgttctgatatgattgggcttcttctgtgcctagacaaagcacaaccgaaggaaggaaggaaggaaggaaggaaggaagggagggagggagggagggagggagggagggagggagggagggaaggaaggagggaggaagggaagaaagggaggaggggagggaaggaaaagaaagagaagagaggagaaaggaaggagggagtgggggtggggcagagagattatgaaggaaatcttggtttcaaagtattttcctctattaaaaagaaccaaggctttttggagaaagggctcacaggatgagaacaaggaaattatgagtctagtacatctttttgtactagaaagtaaggaagtgctcaaaaatcacaggatcatatcaaaaggacatgtaagccagcttgaaggggctcttaatgactaaatctgaaataatttgagccttaaaaataaattaatagtcatgggatataacctttttaataaaataataatccattatttcatcctgatatagaaagaattaatgattaaatgggggagaagggaaagttcttccttccagaattccaactaataaatatagaagaaatgatggagttataaaatcattgagggattctgcaactagtggtaaaaaataggacaaagaatgtggcattgtatagccttatagtatctccccaccaattagaacaaaatgggccaggcatggtggcttacgcctgtaatctctttgggaggcgaacgcaggagataggagcaacagttgagcccaagagtttgagaacaacctgggcaatatagtgagacctcatctctgcaaaaaataaaaaggtacttataaaattattttttaaaatagtacaaactggcacggggagcctcctgttatcaaataccaagaagaacatagcataatttctgtaatattcctgcccaaaatgcgtaagttgaatctaatcataaggaaacatcagacaaatgcaaattataagacgttctactacatacttgacttgaaatcttcaaaaatgtcaaggtaagaaaagaaaagcttatgaactattgcagattaaaggaaactaaacaggcatgacaattaaatgcaacgggtaatgtaacttagatcttggactgaggaaatacaactataaaagacattatggagacaactgctgaaatgagtttggactgctcattagataataatattgtagcaatgttaaatttcctgattttgataactgcactatttatataagagaatattcttggttttagaaaatgtgtaagtatttagtgatcaatgtgcctaatgcccccaactattctcaaatgagtgaatggcatcaggcacttcattaataagatgcatgcaaagctgggcatggtggctaatacctgtaattccaacactttgggacgccgaagtgggaagattggttgaagccaggagtttaagaccagcctggtcaacatgatgagaacccgtatctacaaaaataaaaataaactgatatgcatatatatgtatatatgtgtatatgtgtgtatagagatacagagatatatagagacatgcatatatagaaaataataaatagagtgaaatgtaaacaattggtgaatctgggtaaagtgactactattcttataacttttctgtatatttgaaattacattgaaatacaccactttgaaaaatggtaaggtgactaggaggtgttagtgataagtatggaactgagaaatatccagtaacatttgtaaaaaaaaaaaatctacaggaaagagactcgaagaggaatgaagtatacagtgcagaatggcatggaagaggtagaagatcagatcattagggcatatgtgaggtagtataattacttggagataaaagcacaagctctgaagtcaaacaaaatggccctggctctgctacttactaaatgtgtgaccttatgcaagttacttaacttctctaaacctcaccttcttcacctataaaatttacatgtgtaagtactccatgtggttgaacagttatataaaacatagtaaatggtagctatgatattctttgattaacatatcttccaacaatactgtgtaccaggcagtctcattaaatgttgaatacctgaacatagaatatgctcagccaggagtcacttcttccataagagtcaagggtgcagacacttgaatcaataaagcagaattaatacttgacaaggaggcagaaattgttatttacaagtttttaaaaagctgattcaaatggaaattgtaacagagatgcaataagatgtgcatgaaggaacacagtatttttgtggcccaaataaggtctttaaaaatacgacctctaaaatgaattttaattcaaaatatctccttgatgaataaatgtgctacttcaagttgctcaaaaagcaggcactaaataaactcaagatattgttaatgcaaatcagctaccttttatcttacacttatagcacttatactcccaaaccaccaggaggtgtgtcttattctatatctaggagataattaactttcaatttcacatcaatcattcaagatgtaggaacgttgtcaattctttttacctcacaaagatttaccatgtaaattctacaaatcttcagaagataagtaactatatgtaatctgtatgagcccagttttaagttacatattctttcatgcctacctccccactaaaaaattcccaatatcttccaatctgtgattaagtattggtattgctcattgaagacaggagagaagaaagaaattagcatttgccatttaccagccatgcataaactccatgtgtttagttgtactttgtaaatgtcattcattttactaacttcttttgatcatcttatgagacatgtaggttacacccatgttagagatggagaaactgagactggttcaaggtcatcaggctggacaatggcaaggctattactggaattcacatttgacacttaagcctaaaccctttaatgcaacatgctgcaacagtatgcataatagaatgttaggggttaattaaataatatcagtgctaaaacaagtatattttattgtcaaacgcatgactagaatatcatttagaaaattcttcagatcaccagatggaaagaaaatcaaacctaaggaactctcaaaaactttccaggacctgttaccaaggatattttaactaatctcaatagcacagtgcttagctgaagctacttggttggtttccatcagcaaaatctcaaacagaatgagagtttggactccagggatctttccagctgatgaatgccaagggagacaagaatgcttatgcacagaagtagctatagactttcagtatagttaagccaggagacaaacattaaagaggatgctacaaattgactctattggcctctcagatttgctttttacatgctgtgaacacagagtattcaataaatattagttacgcaataatattgtaacaattttttccagaggataagaactaactttaacagaaaataagcagcagaagagaaaaagatggcaaaacagctatgaaataatagactttggaggaatctttgctgtcaggcacataagtatagatttacttaatattctgtttaatggtgattttatgcaattttataatcagtccaattaaacaactcatataaggaaagaatagcattcagtctacagggagacattatccatagagacacatgttaagtaggaaaataaacctctgtctctgacatgtaaaatacaacatccctctcatctcctcaaatcggatatataaggacttttattacaacttgccaaaatggcaagattgttttgtttcgattttcttttttttttttttttttcacttagttctttcttattttttccttcttttggacatacagctctgaatcagaagactgtaaagaattctactcataaataccaaaagcttagtcccctcttatgtataccatgaaatgaagggtattttttggcagattaataaatctaatatcaactatcacttgaaaaaagtatcacattccactgcaccaaaaggatgaatttaaatgaaagtctgtaatttcacctggaattggtccagtaagtgacagctgatggctaatctcaaaaagaacatgcttgtaaacacctgtgttccaattatctgaaaatcaattttagattgtagaaattattgaaaatatattcctataaaatgtgtaataaaattttattataattatgatgtaattttattatatataattatattattgtacaaaatgatacaatcatattataatttattgtagtgtacaaattatattaattatataaagttaattatcatatacatatcattatagtacagatataatcatttccattatattattttaaattttatgatctactgtgctagaaaatcttatgagaatgtactgcttaaataaaattgtagaaaaataaaaccaagagccattaaatatgtcacctttctttttccccaacttccccaataactaaagagttagcttaagagaaaatattatgcccaaataccaaagtacagattagaaaatatgctacccaatatacctaaggtatcattagcatacttttgtactggttaaataaagtatactgccttttgttctaaagtgatagtggaaagccagcttgtagatgaatggtttttatgttgcaagaaccatccgatcaactgcagtccccaagtacgacatgaagctttgtagttctctcttagactgcctaatgttgtatgataatcttgagaccactggaaagccacacaggaccccatagtcaaaccagcaggccattctgcctgtttccagacaaggaaaactatgctgatagttccactaacagtctttggaaaatagtaatgtttcttcttgctttattgaaaaatacatctatgagcttcttctcgtattttcttctttctcttttcattccattcattcttttcctttccctttccctttccctttcattcccttcctgaacaattcagtcccaaagccactgggtgaagtagagcaaggtctactctggtggtgaaggagtttggagaacagagctacagtggtccagagcagagtgtcagagtggcccagggcctaatcaagatgagaagggtattcaagtatggaggcagaccacagcagagttacagagcctgacagaatgaggaaagagtccttgaagacaggtaggctaatatgggctgttggaactaaaacaagttaaggaaggccaaataggctacataatgtctgagcatggagttaaaacctgagtagtatgaggagggcgcccatgtgatgggaagggactgaagtgctttgtcctagctaagtagagtgacgaggtctcccatgcagagcagtgacctagcaagggttgtgagagcctgagtttggtgaggagggtatctgtgctggggtggcagtagcaatgggagactggttacatacagaaggatgggtcaaataagtaaataaaataaggataatttgaatctatcagaaaagagagtgaaaatatggcagtagagaaaactacaatgaattatatagtgttagactggaactggagtaatcagtgtgaactcatggttttcaatagagatagataaatatagatattaatatagatgtaaatttgtctgagtttaaacatacacaaaagtgaaaataacttcacagtggggaagcctggaaaacacaacttcaattgtgtgctcagagtgaacatcataagtaaatgcagcaaatctaattacgtgccacctgataggatgcaatgaaaagatcacagcctcacttctgtaatactcctatttcagaaatgtcagtcacaaaaaaagaaaaaagtaaaagctgagagtctgccccagaattaaggaaattagaaagacatgacaactaaagatgacatgtgattctgaactaaattctttgctataaagcacatctaactgggacatctgttaatttcccattaataccaatattggtaatattggtattattggtattaacaggaaattaaccaatgtcccaatatgttaatttcccattaataccaatattcccaatattaccatctgattttgatggtaatattgcagttatataacagattgctcttgttcccaggagatacactaatgtattaggaagaaatggaacaagttggtcacttaacactcatatgggtcaagagacttttttaagtgctgtactgtactttcacatttgagattatttcaaaaaaaatttaatgccctaaaaataaattttaaaaattatttctaaaaaacaaagaaagaaaattacatctaggtcatagaagatgtaaattctttgtggttgtctagatgcaaacccctcacccacttttcaacttcaagagtctatttttgtgttaataataaaggccattcatcaaacataccatagcaagttgagcattgtatgtacattatctcatttactattcccaatactcctatgagataggtattatttttatccctttacgaaggaagaaactcaggaagagagaggttgagatgtttgcccagtttgcttaatttataactggcagagctgggataggaactaggtatgtctcactccaaagcctgtggccttaactattacaaactgactctttatgtctggagtaattgttagattttctttgttttgctctgggttaacagggattttgtttgttcatcttgcttttcttgtcacctaggatgttttatggaccatgactcagcagttccagctcaaagattctttctccctgaagcctccttcaccaaaagtcatttctcccttcctccccattattgcctttgcactttgcatttatcttgtgattcttatgaccctgtgtcattggaatatatgttttatttccctacatgtaaactttgcaaagttaaaggccaagtcacactccattctttatctcacataagcagtggctgtcaaattttattgtgcaccaaaatcacccaaagagcttgttaaaaaacagattactgggctgtatcaccagagtttctgattcagtagtctagggtagggcctagaatttacttttctaataaattcccatgcgatgctggtgttgctggtccagggactgcactttgaaaaacatttcagtactgtatagagcttaccagtctcttaccaaagtagctaaatagtgttttttgatttataaaactataacacatacattatcttctttgctataatatgtccaaatacagatataatatatgtatgccatagaatgcctcatattatatggtaataataaattggttggttcatctttcccaccttttattcattcactcatttcttcaacaaatatttcttaagtattgactgtgtgccttgtactgatagagcagtgaataagacagattagcctctgctatgataaaaactaacagtctagtagaaaaaaagaagactaagcaaaatatgacaaatttccatacttcacttccaattatcttcatgggaagagatatttgataaatgggagcaacaaaacaaaatgtgtattagcacaataacacattaaagttataatgggttaggcagagaaaggtttgttggtgttaagagacttttcactctagagtacctgaagcactaaaacaatcttcaaagatgtagagacctgagaacataatactgcccctccaactcctcagggatacagtaaatggaatcactacaggaaaagctagagtctggggcaggcaaaacaaacaaggagtaaaattagaaagaagcaggaaaaccataaaggagataccccttatgcccatcagagatggactctcagatgttcatatgctgtatgaatagatagatgggaaagaaaattagaattctgcagaatccttggggatccatgtacattcatgttgtccagaagcaaaattttctttctggatatatgcaatagtttaatcaagttactactatagtgtcagtgaatatcaggcctaaagaatatagggtataatgagaatacatgacagaaagcctgttctagggagtttatttcccaaaggaggaagaacattcaactgagacagaaggattagtaggcattttcaggcatgggagtttgaggacagggaagtggaagagatggagaacgtgcaagaacctgagagaggagaaagcatgacaaggaccctaaaaaaattattagagactggccgcggtgactcacgcctgtaatcccagcactttggtaggcagaggcgggaggatcacttaaggtcaagagctcaagaccatcctggccaacaagacgaaacctcatctctactaaaaatacaaaaattagctgggtgtggtggtgcatgcctgtgatcccagctgctcagcaggctaaggtaggagacttgcttgaacctgggaggcagagattgtagtgagccaagatcacaccactgcactccaacctggcttacagaacaagactccatctcaaaacaaaacaaaacgaaaaaaacaactcattagagaaggacaaagagaatggtataagataaggctggagaggcaggcaggtaggtagactgatgtattctgaactcggtttttaggaccttgaaagtattgatcatgtcagtaaattttatatcattgttgccaggaagactatatacgttctataaaggtggaatgagagaatcaatgaatggatggatgtgtaaagcaaatatatggtacaaaagacagaggcataaaattcagatggcatgatctggaagcaaagcgttgaatggaccaatgtaaaaaagaaaaggagtctgtgagtctcgattatgcagggctagaactgtgagggggctgaaaatcatcttatcaatctgcttactgtagaaatgaaaaaactaaggctggtgaactaaggtggcttctccaagaacacaaagccagtagtggctgaaccaggacttgaatctcctggttcccaaaccaagaagctttccactacagtcatagctcgttctggacctagaagtataagaataagtctctaacggtcactatgcaggcagatgccaagcacatcagaaccttatccctaacagatgcataactagcagctgccacaatttctctagttgaaaaagtttctagttagaacttagctatggatgatataagaaaaatacttatccctccctgtcataaaattgattcatttagaaaatggctattctctctgtgttattatttccttttctacctttagcctgagagaattaatacaaatagtatagtagcaacactcagcacaaaattatcttaagagcacatgaggtcagactgtcatgggaagaaatctctctaagcagctgcataactacctataattcacaggaaggtagactcaataggattctggaaggctgaccgcacattctgttcctctttaggtaactacagtttgtcagaaacttggacagacactactaacatatcacaaataatgattttgccctgagtgacttttggtctgttatttccaactttctttctctctgctgattaagttcactaataatactactacataaagaaataacatattttactcatttaaacatcacatttgttattaatcaaagtattacaatttggctttcttttttctatgcttctcatactagtcaggcaaggtggtaggtaagaactacaccatcatcttttaggaagtgtcagaatgcctgctgggcctacattccccttctgaaggatttcctacagataagctatcccagactgactggtgattgctgagcacctgacctgagactagtcaattgctagatgggccagtaggtatgaaatggcctggtataagaactctgccttacacaggtggtgataggctaatccaattggatactctcacttgaaaagttaaaaaaaaaaaaaaaaaaacagtcagttagttgataatttcagaggaatagaagccaaaacagagagctgcacattcagcgtaatagtagagatgagatttgggagaatggctgttgaggatataggagaataacctggtggctaataacaacagcagctacaacaataacaagaacaatcataataaaggcttacttttattgagctcttactatattccagacatgataaaaaattcaaatgcattattctacctaaaccttgcaactacctatgaagtgggttctgttattatctccatttcacaaataggaaaattgagacggagcaaagttaaggaagagcacagtcactcctttagtaagtgatggaaccaggattctaacccagatttgtttgattccagaaccctgctcttaaccactatcctaagttagagcttattttatgtttagaaggacattttaggcttcatacaatgtttagatctctaccttttgtattcccacctgaatttgtacagcaaacccccattacttaaggaaaattgaacacaaggaaggtggtgctctggaactaaaatgtatgctcaggcttggttttgaagtacacagctgaaagttatgttttccaaccttggaattgttaccctaccatatgtatcttaatcatatctctggcatcttactgtacataggtttcattatcactctttgttcattttgaccatgagaaatgatgataataatagcagagggagaaaagaatattagaatatgggaacatacatgtaaatatcttggtccatgtaattcaataaatatttattaagtgctatttatatgcaatgtacacatacccatgtatgttccccttattacccaggttgatataaaagtcacaatgcagcatagctatgtgttgtgttcatgtctcccaatctctataatttctgttaccatactatcatgtatcagagttgatactaagatcagaaattgtgtttgtgtgtgtatgtctgtgtgcgtatgcagtatggggtgctagaaagattcagagatctgagttctagtcccaattgccattaactagctatctggccttataaacttcacatcaactctctgaccccagttccctcatttgaaagaaatggataattgaacaagaggaaatccaagaccctgttaactttgaagttctgctatttagttctcatttacttttatttaaaaagtgaaattaaatgtctctccttgaccagatagaagaaggcataccctctaaatgtgtactggtcaatttccaggacgtaatgaaatgttatacatggttttcaaaaatattttttgtggagggtttgaatcagacctttttgtcaaacaaaatcttagacaatcccaaatacataaggctaaaagtaaataaacaaagctgctctattgaagaaaggaagaggaagccttgttgttacacctagcagattctgcttgggttagatctgtggaaccctacattttccaggaacatagcttaaaaactatggcaaaccagacagcagaggtacattaatcaagttaaatgttattgttcatccactatgcatagagcaatataaaaggaaagtagagaagtagaaaacataccctctgcttgcaaggagcctgcagtttccatgaagagattgggtagaaacttcagaattaatttaagaaaaccacaaagcaaagaaaagcgggggcaagaaaggtaaatcctaggttctgagaaaatgcacagtagagactaactgaaggtccaagaattttaattaacaaaattcaatatttttgaaaaagagattatacaggttgagcatcccaaatcccaaaatctgaaatctgaaatgcccccaaatctgaaactttttgagtgccaatatgatgctcaaactaagtactcattagagcatttcagatttcaggtattcagatttgggatgatcaactaataaatatttcaaaaattaaaaaaattgaaatccaaaacacttctggttgaaagcatttccgataaacgatactcaacctgtagtacagaatacttcttgattaaacagaaaagggcagtaaagctgtcaggggatctgacaacatggaagtcattgctgactttaagaacagcagcatcagtagaaagttggaaatggaaatgatttgtctgcttatttccccatagtatttattcaattatgtaagcattttatttccatatttttaaatgtatttattgtctgtcttctccctattagaacatacgctccatgaggacaagtatctttccaggtacattcaactctatattaccagagcctaaaaatagtgcctggaattgtaggttctcagtaaatatttgttgaatgattgaatgaccatgtattgtgctaggtattagggaatagagtaagggattacaaaatgaatatggcatggtttctggttttgagaagcttacaatctaatgaaagacatatactaattcacaagcaactacatcactgcttctcaaacttgaataaagagcggtactctttaaatgtcacaggctattgataaagtttggctgaaactaagctgctactttccacataaacgatactgactgtggtaacttggctttagattggtataaagcagcgattatagattaagtccacctctgttctctttaccatagcctgtgacatttgaagagtaccacttgtcaccaacgaaacagtaaacacaagcgcaactacaggccttccgggaaatctgcagcagtgcttagttgtaaagtggttatccagagaatctgaaataggctttggatttctttctttcctatttatttatttatttttttgagacagagtctcactctgtcgcacaggctggagtgcagtggcgcgatctcggctcactgcaagctccgcctcccgggtttactccattctcctgcctcagcctcccgagtagctgggactacaggtgcccaccaccatgcctggctaattttttgtatttttagtagagaatggggtttcaccatgttagccaggatggtctggatctcctgacctcatggtccgcccgcctcggcttcccaaagtgctgggattacaggcgtgagccacggcgcctggctggatttctttcttttatactgtgaaaggaaaacacaaaaatgtttgtaatgtcacagaaaatgtgcagcacttagtatatatctaactcctctcatagaccagctcctttattttcatatgttcccggatcacaagtaggcaatgtagagaggaaagaagatacattccagaatccaacttgggtttgagtcccagctctgccaccaactagctgtgtaactgtggacaagttacttaatttctatgagattcaatcttctcacataaaatacagaaaatacccatcttgtaaaattattgtaagattaaactaaattatatagagaatgatgcctgacacataatagaagttcattaaatgtcagtttacctccccttctcctggtttcagcctcatctgcaagtctcttctatgccaccaccatttatgatacatttatttcacaaatatttattgagtactttctatgtacctgccactgctttgtgtactttggatacagcaaagagaaagggcctttctctcacagagcttacattctataaaatgcctgacccaagtaggaggaatggagataaatgtttgagatgggtattaaaaatacatagctggcaaataaacctagtctcaggctcttggcttagagattaactacaacctgtccagatttacttgctgctgccaggtgaatggggccgaagagcccttccaaccctttaggaactattagtggagatctgaccacatgtatgtcagtagttgaaccttttttttgagacggagtcttgctctgtggcccaggctggaatgcagtggtacgatcttggctcactgcaagctccacctcctgggttcaggccattctcctgcctcagcctcccctaagtagctgggactaccagcgcccaccaccacgcccggctaattttttgtatttttagtagagacggggtttgactgtgtgagccaggatggtctcaatctcctgacctcgtgatccgcccaccttggcctcccaaagtgttgggattataggcgtgagccaccacgcctggccagtttaaccttttttaatgtaacctggaagactgaagactccctagctctaaattctattagtaaagcaatgttatgctaatgaaagttgtgaatttgggaactcatgacaaagtcaatgtcatctcaagaagaaatgcaaaggctgcaaggaggggggatgaaaaatactgcaagaaataagcaacaattgaactgaataaactattgtaggcaaagacaggttggccatccacacagtataacgaaagaagacgctgaccttgtctttagggcacaaggcatgtgctccacaaacatttgttaaatgtatgaatgaatgcctgtgactgcaatctgtcaaaacaacaccaccaaaaatggaacggaagaaaactggaggaaaaattaaaagtacataaaacagaaatcgaagaaatagaagactcaagacaagtaataaaagaaagattgttagagatatataatacataacatagtttgacagactgtaagcggtgggaaaaaaagagaaaaagaactaaaattgctgcctagattctaagcatgtgaaaaaaaaatcctcttttagttagtgtagaatttaattatgaagataactactttatatggaaatctttcttcaagcatttttttagcagacgttggctaggtgacagaggagaagagccaaactcataatgaggtcatttttctctaaaccacgatgatccctttcctcaatttcacaggaatgttgaatcaccccatagtataaaataattcccaacaccaatgggaaagagatgtttcctggtcctgccacagtactgatccactttcaaaactgaaaatagattctttactgacactgatttagttccttatccatgtgctatctagtctggtctctctatttaggcacagtttcatttgtgtttaattggatgataaaaccactgatatattagacttacaatgttttttgacagttacaggtgcttatgtcaaaataaaacaagaggctgggcgcggtggctcatgcctgtaatcccagcattttgggaggccaagaccggcagatcacttgcagtcaggagttcaagaccagcctggccaacatggtgaaactccttctctactaaaaatacaaaaattagctgggtgtggtggcacatgcctctaatcccagctactcagaggctgaggcaggagaatcgcttgatcccaggaggcagaggttgtagtgagctgagatcatgccactgcactccagcctgggtgacagagcgagactctgtctcaaaaaataaaataaaataaaataaaataaaataaaataaaataaaacaagaaagaaaaggtaacaactcttttcagaaagccagtttctaatttaaagaaaaaattaaggggaaaaaaggaattaaaaaaaaaaactgacccacaaaatatgctagttatcctatttaccccttaccatccattcacttttctttttcctgcaatgtgcccaggatgccgatttctacagactaagtcactaagattctttgccttttggcttctggttgggatcagctaatgtgaggctctggcagaaaaccagagaataggagaagagaaggtcagggtatttttttgccagtggttgtgttcttctccctaagagcaaagctcctatccagcaacccctctcttgcagctgaagctcttaccgaatcctggtcaaacttccttttgtcctttggacctaagtgtaatgatgatggccagatttttgtagttccccttaactatgaacacatctgtctaaataacccctctaataaattatcttcaattaaacttttgagagtgtgattcctttccttccacgactctaactaatatgcaaaattatttaactttactatataagctttactagctaataataatgttagctagcatttatttaatattccttatatggcagactatagagagtactttacatgacttatttcatcatttaatcttcacacacaaaatactactattgttattattttccctatggtgggtaatattattattcattattcagacattgacacccattcgcctcacttccatgagatgcatatacttactccattgatgttggccttggtcctgtgtcttgctttggcctatagaatagggagaaaataatgatatgccaatctgagcccaggtcttaggaggttgtccagtctcctatatttaccaccaacataaaaaggacatgcccaaattagcttctcagtcccaggagaagatttagagacatgtaccagagccacctcagtcaaatacaatacatatcaatccacctgcaaaaaaaatgtaacatgagcacagccaagacctcccaaccaatctaagtccagctcagataatcctgagccaacacacagatccatgagtataaaagattgctatcttaagccactgagttttgggatggcttattatgtagcaattttacagtaatagcaaactgatgaattccaattttatatatggaccacagactccatataggggttttctaccaaaaaaaaaaaaaaattagcatgaagtcaataaaaagtcattctccagtaaaaccaagttataaaccattaaactattaatctgcaaaaattgtttctaattgttactaagaaaagattcccaataggcatttaaatgaaacatatagtcattaccacaaaagacaaggcccttcatagcctgcttatgtctttattcccacaacctgacatcctccctgtccctgcccatcactagagacacacaaatttacctgaatttgtttgggtatgctgtgcagtctctcagctctgtttctttacatgtactgttctctccacctgaaaatttcttctactttttatcccttaactcacctctagtatcatcttaccctgattcctgcaggctgagtctggtgcccttgttctgtgttttgtgtttgcctctgcttatctctcccatagccattatggcactgtattttaactatgagttccttgagggtcaggattttgctttctgtttatcaccatattcctactaataacatgctacctggtacatagcagtctctcagatgctgatacaatcattttagaaagctataaaccatccaattggtttgaagggaacactgcattggtaactgataggaaaagtaattgaggaattaagagtttgtcagtcttaattcagcactatctaaaatgaaaggtactgattcctggttcttgatacaaatcaccctagaatagacaaaaataatccatcaaactgccttagcttgaggtatatattccttgagaatatctaacaccctttgtctaattctttgctcagcattcttatgctggcaaagttggtgtcctgggtggacaaaatattggtcaggaagatagaagaagaaaatagtaaagataaccaatccctcattctggagctagccacacttcatagaaataggttagcatgagtctgtttttgaagttaatctccattgaataaactaaaaataactgcaggatttccaaagctacgccccaatcctgacttataagaagtcccaacaagggactgtcccttcacccaagaggcctggcctaaaacaaccagcagatgtcttgggcatccctttccctacagtactctgcagtggtagcaactgctaaggggaagaaaaactagaaaaatcagactggtgggatagcaaacccagatgctgtcctccctgttgctaatggtaacaggattagactagatggggaactgtaattaggcacttggcttttatatctgacatgtttacagccatcgtgctattctgggctcttatataacatttatatctgatgctataataggcatttttgtgatcgtactttcttcctcttccatctaagtgactacaacaagcaagcacttctttcctcttccaagtttggacctgaaatgccccactcatatatgtatgctctgtaaatatctgctttttagccttaactttttaataaacacagatgcttaatcttgattctatgctgttatttatttgattaatttctctattcatgtagatcagagattagcaaactatagtccatagacaaacctgcccccacagtctgttttcatatggcttatgagctaagaatgatttttacatttctcaaatgttatataatacaaacaaacgtaagcaaagaaaaatgcagcaaagccaatatatgacccacagcctaaaatatttgctatttggcccgttacagaaatgtttaccaactcttcatctatatcgatgttgtccattacagatgaagctaatttatctagcatttgatgatgatggtgaggatgagaattaatatttgtaggatgtttaccatatgccagaaactaagcacttgccatttattatctcagttaatcttcacaaacattctttgaggccaatgctgttatcagccttatttacagatacagaaagtttaaataacttgccatggtcacacctatagtaagtggtgaagcccagatttacatccacacaatccagttgaagactccatcctataatacttccaaaaatcaatagaatcatgacatcttccagtaagtatataatcccctttacatgataatctgataaaggattactcagtctctggttacccatgctgaggtaaattgtcccatcattgaatagctcgaaattcagaagttgtctacagtttgaaatgaaaccttatagataacttttatctcttagacttatttatttcctctgaaccacacagactaaatttataccctttacaacatgcccttcaaatattgaagatagctcagatctttccaaagtcctatttcactctacacattcattcacctagaacttttcaagcattcttccttattttttattcaatagaatttcaaagccttctcgccaccctagtcacactccttggttggctctatagtataaagtatgctgccaagaaccacaaaataccaaatatctttattggtctctagttacatgtacctaatcaacactcactaaacataccattgtttttcatgactctgtcctgtgctctttatctctacaaggaatgttcttctcccttttctttatgggccaaacttctaataatttttcaaaagtcaattatctctgtgttttaaccatactctgtacattcctctatagtaaaatgtgtcacactgtattgtctctattaattatctcacatgtaagattagggcttcttaagaaaaaacattgtgtcttattcagttttgtatgaatgcatatatttatgaaccaataatggataataccttattttgttataataccatccatattacttaggcagccaatattaaacctatataaggaattctaaaaatgacatctctcagctttgtaaaattttaacttattataatttattataatttataaccttataagtatataattataattttgtaattatgagttacatgtaatatacaattatatttaaattataatttataaacttaccatatttaacattctttgagatgttataaattaaatttgataatgatcattgtttttattgagatatcatacattcatgctgaaagcatgaaaagattttcaaattcctaagtccccagatcctaaagtttcagtttgactctgataaacaaaattctgaccagagaaaattcaaggcagatttgtctccatttaccttttaaaaatactttcactcacctaggagcttgaaaaagtaaatactttagagtctaaaaaaattcaaaatcactcaagatcttgtgaaagactgttttctgtctatgaagtgtgatgtccacttcaacttgttttccatagagcaagcacttttatcattaaattgatggatgtggctttggcaagaaaaacatttagaaaaatattgagaaatgatgaatttttaaaactaccctcaacttatttagaattaaaacactctttaggaactatggcagagatttctagtaatcaccaaaacccttttggatatacatctaggtcaaacttcctggtctcccttgcatttggctgtggctatataactgaattatggcttttgagacgagaccatacatgatgtgtgtcacatctagacctgaccaataaaaacttctcacaggttcagggaagtcatatttagaaagaaaaaaataaatttttaaaaaaggggaaaaaacctttttacaggtgatcccccttcctcttttaactcttttggctagctagaatggaaatgatccaaagagtgaccttcagagccccttgacctacttgttgaagatggcaaagtcataagatgaaaaacattaaagttcttgaattaatgctaaagggaaaactacctaaccatgtacagtcacattagattttgacataaacaagaaataaatccttattgtgtatagccactgagattttgggatttatctgttatagtagctaatgttaacaaatacaaggatagatcaacttacacagattcccagcaaatgaaaacatctccacatctcttcatggacatttaagtacattaataaactacaataatgtaacatagtctatatccaatagtcaaagtgtttacaattgtttttcatgtaaaagcatctccacagaggtgctgcatggagaaaactatttaaaaacttacaaatgccattacataactaatatttaaatgtgaatgaacctatttattcataattgaaaaccacagcatcattgaaggtaaaataatttacttcttggtttttgtttcctaatatgtaaaagtttatgtatctctctttttttttattcagcagttaaaaactcttgagcaataactgcactcctactgagataataccttcctgcaaatatatatgacctcaattgcaaaactcattgggtctctccaaagtaatttaaaaatcaatctgatctgtaacaagaagtcaatagaattcctgaaaaatttacataacacaactccctctgtgtttaaaatttcacagcaaaagttgtatataaggaagagctttacagaaagcttaagcaatggccccaaaatgaaacaaaaagtaaagaacaattagactgcttctaaattttagtggactgatgttattatatttattcaaggaacatttattgagaacatacaatatgccaagctctgtgctaagcaacatgacagctacaaaactggctcctgattttctggatagtataggagataaaaacacaaagtaattaactgtttccttttggtattctgaactctaaaatatttctgtctaacacgatagaaaaataaagcaaatcccaagctcactcctaataaaatatcttttaaaaatatcaataactgtggatagggttagatgttatctgaaaggaaaaacaggtcagctaggaaaagattcaaaaatagagaggatcatataaatatatctatatgtatatatattgacatatatactcatatacaaacatacatatatattatacatgcacacacatatacatataatatatatacatcctaattttgtcaaatttcagatgatagtggtgtgtcttagctccagtgtcctataagtagagcctgaggcaaattaaatttctggtactttattttggggggtgaaagtcctttatttaggaggagcaataagagaaatactacagaagaaaatgagcaaagaaacgtgcaaagcaatgtagtataatgcataattgcattggctttatgaaaagccatgaattgccctaccagctctctcagcacaggatacttctttggaaggctttcaaggagaaactatactgtgggacagttcacagaggggagaaaggagagatacattgtcagcctggtagtgtacctcaatcttccatttcaccttcatacagaaccagttcccccatacttcagtgttgtgtcgtccagcccaccaatggttatttcacaagccagatttcacaggctctgtgtcatttcatctaagcctggaaagtgagaggcaactcagggtacatgaggttggcatgagagaattatgagctatctaggcctgtgcctctgatctttgagggttgttgggagggattagagcacatataaaaaacgcctgtcataaaataagattccagcctggaaaagatagttaaggaattaagtaacagcaccagcaccaaaacaagtccctggcaggttcatcactgagctcacagcttccccatgtgctttttacctcaagaagtgtcccaggctagcattattgcttctggctattccactatcttgtcctgtcttagcatgagccaactttaactccatccaatcctgtcttgccatcctgtttttcctagcagaatcttcaataaggttgataaacaaccactccagctgcaaggactccctgcataccattagttctgatatggtatcataaaaggctcagttctgctaacaagtcctcttccaccagaggactcagcagtgggataaccctggagtcatcacctggtgtaagactgctctacaacatgctactatgtatttctggattgctgtgcatgcatcacactgatatcgaacatcttccaatgcagggagcaacagtgaacatcatatatcaggacacaccaaagatgttggtacctcaacccaagatagagacaggacacctgttaaggcagctctcatgcttctttaaaaccaaaattgttttctcaaactgcctattctatagctgtcctattggggtgctaattctctaacgctcagtccacacaggagtgaggccaccttgtttcttatttcctcccaggaggctgtgtaggatatttaaaaactgcctcttcacctctctcaatcagaggagcagtttcagatctggaaaaatacaaggatttccctgtctcctctgctctggaaaaaataaaatgtcccccaatcacagggtgaaaggttctccctcacctgaattatctgccaatgcccagctgtgtccctcccctctctgaggacgatttgaccccaattcataacaggaaaaacttttaaataaactaaagggttgaattactgttcaccacttattacattagctgggcttgagcacagctcgaacaggtcaaacagaagatttttttttttaaagaatgtgaatccagtcagattcatctgcaaatagatcaaataaactactactatttaacagatcactgtttcttattagctgaaactttgttctaaaatgactattctcaatgtcgctagtgtaattaatttaaaatgctacttcgatttataaataactctcataaactagaaagacatatttctataatctaaacaccgatttaagctatcctgatgtttagttatttgagcatgagatggacagaaagacaagacttatatttttaaatatctggtactatctcctaccaagtgggagccatattgggattaatatattacctcaaaatctcaaagggacatcattatggagcaaggtgggttacaggtagcaggaaagaaggggaataaatgaatactatagatgatgcagcagaataaagaaggaagaatgtgtcttctttcttgtgcctatttgctgctcttagccaatgcctctcatgtacaaaagctaaagataggatacaactgggtatttgaagagagtgaccaggacaaactcaaccctatctgtatacagggcttccctattttattcacataaaaatagaaaatcttctttggcagaagaaaaaaaacaggtaaaatacaactgggttttattatttcaaaaaaattgggatattttctttgtcccagggactaggcaaggcactaaggataaaatggtaaataaaagtacggtccccaccatcctagaatctacagtcttatgggagacacaaaacttatcaaatacatacttaaataaatcaaaactgtagtaaaagcaatgtaaaaaagatacaacatagcacaactggggaacatgacctgttctgaagtgtcagaaatggcttccttgttcccagttttgatccaaagtatgaatatcaactttgaaggtaaaagggggcagaagtggaaaagtaaatacagaagcattgtattccaggcaagtaaacatcttgtgtaaaagctctgacgcaggaagcaacataatttgtttgaggatctgagagaaagccagtgtggcgtgacaacaactaaaagaggatgtggtaaagctgcagacatagacggggctccattttagtctttatttaaaaataatgtaaggccactgaaagggttcaatattaatcctttattctaactaaagctaccgagaaactaacatgccaacttctccagctacaaacggaaggaatcatcactctgaaggcagcctcatgatataattttatgctccaaaaacattaatttgcccagtatgtagcaggccctaacctagaaagaaatgagtaaaagaaaattaaagaatatgctgtctaatgttttatggtctgatggtagagacagggtcttactggaagaaaatacaggaagcactaaaatagtggtatgtgctggatgctatgagaatagtcttttgttccttcctccaaggaaagaattgagcatttaggaggaccccattaagttccccccagttttagggactgaacaaaataataagtaaataaactacagtataggtgctcaatgatgagaacacatgaacacatagaagggagcaagatacactggggcctattggaggatgaagggtaggaggagggaaaggatggagaaaaataactaatgagtactaggcttaatacctgagtaatgaaatatctatataacaatccccatgacacaattttacctatgtaacatatctgcatatgtaccctgaacctaaaaaaaaaatagcacccaatttaggatatatttcatgtaagtgtgcacatctgtgtgtctgttccacaatactcataatcaggaggtagcacacatctgaggataattttatgaaccaatttaattacatttccatgccaatccatcacaatttttttcttgttcttatttacccttctcctctagtatccaaagtcaaaaaaaagtagaagcagtatttaatctgagtggattatcaataacttgtcaaatttataaaatgtagttttaagaccagctgcatgtgaaataagccagcatattggcatccctaaatgatcactgaatcagagaattaattcttcccacactaaatggacttctggcaaagtaaaagtctactacaattttccaatgtggccaaatccttctccagaaattgcactttgagaactagaggctcctgatcaatgtttatcaagttctaacaaaacagaataaagcagcagaaacccagtagactcatgatataaatagttgacaacattaatgagtagaaaaaaaaggaaagtacactctacgttttgaggaataaaagtgcaaaaaagaaaccaggcagccttatcttggccaaagctctcatttttcatcatctttgagctgataaaatgcttcccaaaaggctttgtaaattccacttggttgaaatgtaagggaagggaaagggaagtaaatatgaagccaaccggactagaaaatattagagaaggaggaattagggaggaaacaaatgaaagaaagatttctaagaaaaaataatttcattactcagaaggtaaggaaagaccataaggaaacatgaaagttgagcaatactgttgcagcatctttactttccacctcttatcacttccttccagcaaccctctaaaacacttctgccactaaggtccactgttgaggttaagaatccatgacaactatggattcaaggtatcaaagtttgtcacattatacaatgactacataacaatttgccactgctaatttcatccacaaataaagccatcactaacaaaagcaacacaagctaagctttactattatgtagatgacagtaagtcatttaaaacaagaacatctcacaaatgcctagttgcatttaaatttttaaataaaaatgttatttttcaaatgactctatctgtaacttctctggttctttttatacatccctacttcaggataatgtgaagctaagcaatttctttaagcccaaaatgaaaccatataatatgctatttcttaacagtctcaaaccacaaagacttataaccttagaaacaataaaaaaaattcaagaatgcttttaaatctttcttttttcccaaaattaagttgaaaatagtaatttatctttcaaactcatctaaaagtgtaaatattaaggtttaacaatagtaatcttggagagtagttccagtacatcattaactttatgaaacattttaatagatgccactttccttctggttttctctactgctttgtaatagcataaatatttattcactaaattctagaactcttgctatataaatgttttatggctatatcatataatttgtataaacactatcctctatatcttgaagaaaagcctcttaatgtacagtttcagcaatctgtgttaaattataaaactcatggtataaaaagatatcatccacaaggtaaggtagagaagagaaatggaacgcagtgtctgaatagtttgaaaatttaaagaagaagcaaccagcctgccaagacaggtcactgaggcaccattcctggagaatgttcaatgtgcattaacatattcaacacagtataactttatttatgctctctaattcttaaggagatataagtcttaaaatcctgtgtctctgatgaccttctcaattgcaacttaaaatctggagagcctacaccataaattttatttctaagtagttgagatcttaaattactcctaagtcaaagtttacagcttggctattttagtttttgtgaaaaaaattgcaacatttttgggtactcaatcatgtttcattccttcatatcaggtaaagcccataactgagatgaaggtagaaaaatttcttaaaccatgctctttgagcctctcatatattttctagatgcctgaactaagccatgtgctagcagcacatgccatcttatagactacatccctcagcatcatcctgtagataagttaccatatgctgtgataaaaatattggtgaaaggagtgaaagctcaaagaatgaaaatttagagtcatgagcattatttagggatagaaaggtccttagaattcatctagtccagcagccttattttacaaataacaaagctaaagctcagagaaattaagcagcttgtctaaattttcagagcatgtaagtagggagctagcttaggaaatcaggtccatctaattcttggttcagcacttttatttgtatattatgcagtctcttaatcaaaaagaggcatttaatcattcaaaaaaatgtactgacaggcacaggaattacagaagagaatgaaaaaagagatggtattcctagtctaataaagctcacattcaagtgtgaggaaaaaatataaaattatatacacaaaataaatatatgatatatgtcaggtagtgacaagtgctctggagaaaaattcaagaggtgaaagggatgaacagtgagaaagattactttatatcaaatagtcagtaaagaggtgaaaagtagacagacacttgaagaaaggatgaagcaagccatgtaattatctagggataaagtactgtaggaaaagggaacagagggtgaaaatatcttaagtcaggaatgtactattcatgctcaagaatcaacaaaaagccacagagactggagcagagtgaatgaaggtgaatcatgacagaagaggatgttggaaacatggtgtggtggcttattgtttagacctttggattttttttttcagtaaggaaaatcaatggaagttttcgaatagagaaattttatgatctaacttccattttaaagtgtccctccttagtctcatgtatggtccaaaaaataaaataaaataaaataaaataatctctccagctactgtttagggaataggaaactattgagcactctaggtaagagatgatagtgatttgaatgagggtaataatggacaaagtgatgaaaaaatattggatatattttgaagatagggagaaagagatttttgcctatagactacatgaaggctatgagagagaaaaagtagttttttagcctgggcaagtggaaaaattgagtcactatttattaagatggaaaagacaatgggagaagttgagtatcaagggcttagtattggctattataaacctgagatgcttgtaaggtattccaaggtgaatattgagtagtgtttggttttatgagtttagagcttaaaagaaaacttataactagagatataaatttagaagttggaattatatagattgcatttaagtcacaaaactgaataaaataatctagcgagtatgtacagctagaaaatacagactaaggatgatagggtacataagagaagcaatgagcaagcaaggctacaggtgtgagtcctggaacatttcaatatttagagatttgggaaaataaacaggaagatctaggtaagatgactaagaaggagcagccagtgaagtaggaggacaagcaaaggattgtagtatccaggaagccaaatagagttaaatgtatcaaggaggaggaaaggatcaactgtgacaaaagattctgataagtcaaggaggatgaggtctaatcaatgtttagtcattgataacactgacaggatcttcgcaggacaggtttagtgacgtggtcagcaagaagagtaagttcaagagagaattagaggaaaagagatgcagacagtaagtgtgtataaatttgttgagtctggagtaaatgggagcagagaaatggggcagttccgagagaaaaaagggatcgatgttatattaaggctataagaatcaaccaggaaatgtgtggcagcagttccctatttcctattacattttacttcattatattcagtaatattctcctctactccacttttatacctactctccaaaccttatcatcactccaaagtgccctactatatcataaatagatacactccaccttctggtcaccatatccttttctcacctcatctgtactttgactccagtggtacctccagtgtactgattcctctacatcaccgccacccataagcccctttccgtgtaaattttcctatccattcagcttatattccttggtccatcacttcagtcactctctcattaagattctaaactcctttcctctatggtcattccactgagtacaggaaatcctcaatcttggaaattttggatgaaaatcatttgcctaacctatactagcatcttggctgctgagcacagtttaagtaaaatcacacaatgggaaaggtttgcattattataaattagtgattatcaacctcagattagtgactaatatcagctgatattgcttccctatgtagactgttctctcattttccacaatgaaaattttcaaaaacaccttaaccacatatccttaaacctctcttattactttgaaacagtaaatggttccataaccaaaaacaaaaacaataacaaaaatcttattctcctccactagtatttcttacatccagaaatatttccactgatcacccagttgctctgtcagagacttcaaagtcatccttgatacctccctctctgccacttccccctctccaatcaattatgaagtctatagatcctatataataaatatctcttgatttgtcaatttttcccattcctgctgctgctagctaaatccaggtaaccaacatctcacacctgcactaccacaagagcctatgattcctgtttctaccctttaaataggataatcttttaaaattataagtctgatcatgatgcacacacaacccccattgatttaactttttaatgactgttcattgcatttattaataaaataaagtaaaacaattcttaatatggcctgcaaggcccccaataatctatgttctttctaactcacctgtcactttttccttcactctgtaccatattgggtcactgtgaggagctggaggaaacctttctctctctcttgcctgtaggcctttgacctaatattagtattctaccctcttccaaccattactatcactaacagtctcctaaaatattgtcagctgaaatatcaactccaaaggatctctttcctaactaggcagaaaaagttaacaccataaacttcccttgcaaagcatttgttgcacagataattacttattaaatgcccttctttctttttattttttgacatataattttacatgtttatggggcacatatgttttgatacatgcatagagtgtgcaatgatcaaataaatgaaattagaatatctaccaacacaaatatttgtcatttctttgtgttgggaacattccaaatcttctcttcaagctattttgaaatatacaataaattattgttagctattctcactctactgtgctatcaaacactagaacttattccttctacctaactgtatttttctacatattaaccaacctctttttatcctctcctccctactacctttctcagcttctaataagcatcatactactctctaccttcaggaggtgaacttttttagctcccacatattagtgagaatatacaatacttgtatttctgtgtctgacttctttcacttaacataatgtcctccagttagatccatgaactgcaaatgacagaattccattctttttatcgctgaataatattccactgtgaatatataccactttttttaaatccattaatctgttgatggacactttgccaattcaccacaggtggctcagccctcctgtcacttccaattgttcccatgtaagtggatggtagtgggcttccagcaaagattctcagactggtggggagtgaacatctaactccaattctctcctctcacctcagaaaccatgggtctaaagaagttctctgtaagtgacatcgtccttgcttggggtagggggtcacacagtctgaaatgaccatttatttaagtcaccagacatggcttctctgaattatgtaggcccagagagcttctccacttctcccctgagttcaccagaattcctgtctttgaatagcttctacttgtatttttttggtggagtgatgccaggatattttttattccaccgccttgttgacatcacaccttctatctagctttcctgctagatagactataagtttcatagaggtagccttatatttctatcaccattatatccttagctcttactacagagttagaactcaaaatgtatatgttgagttgaatttaacaccttattttgcctttaagattttcatcaaaaattcgggaaagactaaaatcatctgaacatctgattactgatacactggtattattaaactttcggagcatcatccccatttcctaaagaaaagtaaaagctgaaatctagatttttataaacattgctctatctttagtagtttctaacatacctgaaaacggctgcctacagaaaaaagctacacaagaggttttgaggtttgctgtatttgtgaagaattcaggaccaaaagaaataatttttaggtgactgaaaaacggtgtgcttaaagaagaaaaagaagttggggagggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaattgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagctgggaagctcgaactgggcggagcccaccacagctcaaggaggcctgtctgcctctgtaggctccacgtctgggggcagggcacagacaaacaaaaagacagcagtaacctctgcagacttaagtgtccctgtctgacagctttgaagagagcagtggttctcccagcacacagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaattattttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcgggaaatacagagaacgccacaaagatactcctcgagaagagcaactccaagacacataattgtcagattcaccaaagttgaaatgaaggaagaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttccacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagacgggcaagttggataaagagccaagacccatcagtgtgctgtattcaggaaacccatctcacgtgcagagacacacacaggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcagggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaccggcacaagacaagaatgccctctctcaccgctcctattcaacatagtgttggaagttctggccagggcaatcaggcaggagaaggaaataaagggtattcaattaggaaaagaggaagtcaaattgtccctgtttgcagacaacatgattgtttatctagaaaaccccatcgtctcagcccaaaatctccttaagctgataagcaacttcagcaaagtctcaggctacaaaatcaatgtacaaaaatcacaagcattcttatacaccaacaacagacaaacagagagccaaatcatgagtgaactcccattcacaattgcttcaaagagaataaaatacctaggaatcccacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaacagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaactgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaattaaaaaaaaaaaaaaaaaaaagaaaaagaagttgggatgtaaatttttttatttcttttccagagtctgctcaaattctcatacataaacccttacttccacctggtggtttcccacaatgtggaaagtgattattgggatttcccatgtatactgagtattactacacttgaaatgaatcacggtaacatgcagggatgataaaatacaaactatttatatgaggcacgaagctcatctgtattaagtttaaaatatatgaaatgataaaattctaaaatatgcccaagtacaaaaataaacccataatgttgacattcactttattttttccaagaatataacttctgttttctaaagatctgaacctgattttgtagtatgttgtcatggcctatggacatgtggcatgggtttcaactagcaggccaaaactgttaatgagaacattaatatgacaaaatatgtaaatagacgccctataaaaagggttcctggccaaaaaaagttcaatatatatacctcttagaggtaaatgtatacaaatgcatattcacttttaaagatgctagcggtaataaaatcatttaacttctttttgtgtgccttgcccttctttttctttattacattttgttgttaattccaaaagcctggttttcttttttatttctttttcaacttttactttagaattgggcgtgcatatgcaggtctgttacatgggtaaattgcatgccactgggatttagtgtacaaataattttattatctaggtagtaagcatagtgcctgataggtagttcatcaaacctcattcttctgccacctgccacctgaagtagtaggccccggtggctatgattcccctctttgtatccatgtgtacttaaagtttagctctgcatatacgtgaaaacatgaagtatttagttttctatttctgtgttaatttggttaggataatgacatccagctgcataccagttgctgcatttgacacaattttgttcttttatggctgcatagtatttcatggtgtaaatgtaccacatttgctttatccatccaccactgatgggcatctaggttaattccatgtctttgctattataaatagtgctacaataaacatacaagtacatatgtcttttgggtagaatggtttgtattcctttggggtatatacccagtaatggcattgctggattgaatggtaattgttttaagttctttgagaaatctccaaacagctttccatggtggctgaactaatttatactcacaccaacaatctataagaattccctttcctcttcaaccttaccaaaatctgttattttctaactttttaataatagctactctgactggtttgagatggtatctcattgtagttttgaaatgagtttctatcatgattagtgataataaacatttgttcatgtgtttgttgtccataagtatgtcttcctttaagaagtatctgttgatgttctttgcccattttttattaggttgtctgtttcttgcttgttgatttgttcaagttgtttatagatcctggctattagacctctgttgaatgcacagattgcaaatattttctcccattctgcaggttgtctactctctatgggtccttttattttgcagaagctttttaatttaactaagtccctcttgtctattttttctttttgttggaattgtttttggagacttcatcatgaaatgccagagctgatgccagaatgatacgttttagattttctcacagaggttttatagttttagatcttaaatataagtcttcaacccatcttgagttcattcttgtatatggtgaaaggaaggggtccagtttcaatcttctgtgtatgactggccagttataccagaaccatttattgaatagggagtactttccccattgttattattgtcgaccctctcaaagatcagatgactgtaggtgtgtggatttatttccaggttctctaacttgctccattggtctgtctgttttcctgcaagtcccatgttattttggttactgtagacttgtagtatagtttgaagtcagagagtatgatgcctccagctttgttcttttggcttaggattactttggctattcaaactcttttatatttaatatgaatttttgaatacctttttctaattctttgaaaaatgtcattgctagtttgatacgaatagcattgaatctttacattcctttgatcgtatggccattttaacaatattgattcttcctatccatgagcatggaataattttccatttgtttgtgtcttctctgaattctttcagcaagtgttctcattgcagagattttttacctccctgattagctatattcctatgtatttcattattttgtggctattgtaaatgggcttgtgttcttgattggctctcagcttagatgatagtggtatatagaaatgctactaattcctgtacatagattttgaatcctgaaattttattgaagttgtttatcagttctaggatcttcttggcagagactatagggttgtctgggtataaaatcatatcatctgtgaaaagagatagttcaacttcctatctgaatgtcttttatttatttttcttgcctggttgctctggctaggactttcagtattacattaaataggagtggtgagagtggtgatccttgtcttgttccagttctcagagggattgcttccaccttttgcccatttagtatgatgttggctgtgggtttgccatagaggctcttattctgaggtatgttcctttgatgcctatttgttaaggggttttgacatggggagattttcaattttatcgaaagctttttctgaatctggtgagatgctcatgtggtttttggttttagttctgtttatgtgatgaatcaaatttattgatttccatatgttgaaccaagtttgcatcccagggataaagcctacctgattgtggtggatttgaattttgatgtgctgctggattcagtttgctagtatttggttgaggatttttgcacctatgtttacctgggatattggcctgaagttggtttttttttttcactgtgtctctgacaggttttggtatcagaatgatcctgccctcacagaatgagttagagaggagtcctccttcttgcttctctggagtagtttcagtaggatttgtaccagctctgctttatacatctggtagaattcagctgtgaatccatttcatcctgggctttttctggttagtaggtattttactactgattcaatgtcagaattcattattggtctgttcagggtttcaatttcttcctggttcaatcttgggacattttatggttctaggagtttatccattacttctaggttctctagtttctgtgcatagaagtattcataatagtttctgaggattttttgtattcctttggggtcagtagtaatgtctcctttgtcatttctggttgtgtttacttggatcttctctctttttttatttattattctagctagcagtttatcaatcttatgtattcttttaaagaacaaattttttgtttcatctatattttgtataaattttcatgtctcaattttgttgtattaagttctgatttttatttctcttctccttctagctttagcattagtttgctcttgttttctctagtttctctaggtatagtgttagattctcaatttgagacctttgtaacttgttaacatgggcttttagctctataaactttcctcttaacactgctttagctgtgtcccagagattttggtatatctttttttcattggttctaaagaattgtttgatttctgccttaatttcattctttacccaataacaattctggagcagattacttaatttccatataattgtattgttttgagatatcttcttggtattaatttccattgttatttcactgtggtctgagagtgtggttggtatgatttcatttttattaaattgtagagaactgctttatggctgagcatgtggtcaatttgtgagtatgtttcatgtgacaatgaaaataatgtatattctgttgttgttgggtagagtattctgtagatgtccgttaggtcctctggtcaagtcttgagtttaggtcctgaatgtctttgttggttttctcaatgatctctctaatactgtcaatggggtattgaagtctcccactacttttctgtagttatctaagtctctttgaagacccataagaacttgttttgtgaatcagagtgctccagtgttgggtgcatatatatttaggatagttaagtcttctcgttgaattgaatgctttatcattgtgccctttgtcctctttgatcaatattaaagtcactttgtgtgaaataataatgtgaaataacagcatctctgctttttttttttgttttctgtttgtttaataaatctttttccatccttttactttgagctatgggtgtcactgcatgtgagacgggtctcttaaagacagcatacagttgggtctttcttctttatccaatttgccactctttgccttttattggggcatttagcccatttaccttcaaggttatattgatatgtgaggacttgatcttgtcatcatgttagctagttgttatgtagacttgattgtgtaattgctttatagtctcaatggactatgttattatgtgtctctttgtaatggcaagtactgatcttctatttccatgtttagctctcctttaaggacctcttgtaagaggccttatagtaatgaatacacttagcatttgcttgtctaaaaaggattttatttctcctttgcttatgaagcttagtttggctggatataaaatgcttggatgacaaacaccgcatgttctcactcataattgtgagttgaacaatgagaacacatggagatgggggcggagggcatcacacaccaggacctatcagggggtgggggactaggggagggatagcattaggagaaatacctaatgtagatgacgagttaatgggtgcagcaaaccaccatggtatgtgtacacctatgtaacaaacctgcatgttctgcacatgtaccccagaacttaaagtataataaaaaaaaattcttggttgaaatatcttctatttgcacatgctgaatataggcctccaatcttttctcccttgtaaggtttcactgaagggcacactattaacctgatgcggttccctttgtattgccaaaagagcatcccaagagcctgttccatggtgtacccatattttttctggcaatggcaatgtactcaaccagctttgcttctgactcattctgatttggtgaccacaccaacatgccaagactgtcccagtcttggctgcatcttgccagtttggtggggttgaagtcagtcaccaccacctggtactggggtctgccccttatgccaccaccactgtgctccccatggctggacaagcccaaatgatctgccttcatcccaggaggttctgctgccattgccattgagatccccccctgccaaatttttattctggctattactgggagcagtggcagttgaggcagcagcagctgaggtgtaggtggtggcagtggacaaagatgtgggcaaggcatgggtggccaaggtggtagcagcagctgaggaggtggccaacatagctgtgttgttcctccctctccacttctctgagacctcagggcccttctccaccatgactggcatcagcaggggcaaaagtgctggggacccacagctcctgaggatggggtcctgagccaggaggagggaatgtgggtggacatggggtgggtgtggggccttttaggcaaagtaggagcccacaggtgcaagttagagctggggcaggcccagatgagcagagcagagcacagttgcttcaatctcccagtgccaaactgagcaattttggtcttatgaccactttcacttcattagtattcttttaactttaacccactatttaatggaaaaaattaaccatcaatccattttctcacaaatcaccttttagcatctcatatgactctagcattcatccataggctttaagaaatactggctttaggaagtactggcttccactgtagtcatgattttcctagtttgacacaaaaactattattcacatgctttcttaaaatacataaataaataaaaggcaaaaatgagctcttcattgaatcaactgaaccaaaatttgcgtagttcaataaagtttaaatcattccgaaaggctaggacacttaagtaataatatgtgagcctaaactattaattcgcagcataaattcatcgtggatcttatttccaaatataattaaaatatatctatgtcactgaattattctgttaaaaatattttaattctttttctttttcttttttgtagagacaatgtctctctgtattgcctaggctggtctcaaactcctagcttcaagtgatcctcctgtctcggcttcccaaagtgttatgattacacgcctgaaccatcaggcctggctagatattctaattttaatctgatgtacacacttctaggtaatgattcctaaacttagtgtttattagaattacctcgggtatttatgttaaaatgaaatttcctgggatccatatcaaagtttctgaatcagaattattgggtgtaagatgcaagactgtacatttttagcaaacatcttaggtaacacaaaaaattccatctctaaaactttattattacaggtgattgccagcatgagaggatttctctatcacagttccagaatgcctaagttcatctgcttatgctgattaggctcagtaaagtctagataagtccttcctggtgctctacactggaagaaaatatctttcgtctaccatttctgcttctttcacaatgacaaaactgcctaatgacccttttctcaaataccccattgttaagtgaagcattggtgtattgaagaaacaaaaacactgccaaatgtacccaggcagattttcgaaagaacaaattagaacatctagaaatattaaatgtaatcattaaagttaaaaattcacttgactagttaaactgaagattgtacatagctgcagaaataattaataaggtggaagatagtgctaatataaaaacttacccagaatgcagctcagagtcacaaagtaataagaaatataagagagacacaagaaacatatagcatattcaactacctaaaggaaagaagagcaagaataaaagagaggcaatatttaaagagttaatagtagagaatgttttcaataaatgcatcttaaatgaaaattatattctattgttaactctagggaaaaaagggaaatccaaaaaggagtattctgtaagacaataaatagtagcaaccaagtaacacaagaaaaacgtaaatcaaaagaatctcacaataaattaaaagggaattcatttggcatcaatacttggaacagcatttatgtacaaatcactttgtccccagcttgcagtattcaattatgataatgttttcacagttacttaaatcagttcttttctttcccatccactgcagtgtggttaggtcatccatctataatacaattaggttcatttcttagtattgatattcctttgtgggttcaatctatatcctggttagtgttgtttagtttggtggtgtgtgaagggtatctgaaatattactatagtaatatttccatattaccagattatttgaaaagatatactcagataagtatatcacatcctgctacctaaagcccactgcatcacttccttccatcctttcccacacaccctctgtgtataaataattttttttttttttttttttttgagacggagtcttgctctgtcgcccagctggagtgcagtgacgcgatctcggctcactgcaggctccgcctcccgggttcactccattctcctgcctcagcctcctgagtagctgggactacaggagcccaccaccgtgcccggctaatcttttgtacttttagtagagacggggtttcaccgtggtctcaatctcctgacctcgtgatccgcccgcctcggcctcccaaagtgctgggattacaggggtgagccaccacgcccggccatgtgtaattaatttatctggtttctgatatatcctacctgtatttccttcacacaaataagcagacatctgtgtattttttagatccccttatttcttacataaagagtagaatattatatttttcttttgagctttgctttttttatttgacagtgtgttctgaaaatgataccatatcagtctgtacagatcttccttattctttcttaacagatgtacagtactccatgtggatttgccatagcttatgtagttgctctcctacatatgaacatgtaagttgtttgcaattttttataattagaaaccatgctataatgaataattttctgcatatatatttttgttttattggagttatctctttaggatacattgctacaagaaggattactgggctgaaaggtaaatgcacctgtaattttttactaggtattgtccattttccctccagaagggttatatcaatttgcattgacatcaccaatatatgaaaatttctgtttctgcacagccttgcaaatagaatgtgttatattttttataagggaaaaaatgatgtctcagtgctatttacatttgtatttctctaaatgaaagtgaatttgagcatttgttcatatatttctgtgccacttttatttcttgtgaattttctgttcttatatttttcaaaaatttttattggcttttcagtcatttgtccctcagtctttaagacttctttgtatattaagaatattagccctttgtgggctaatatccagaatctacaaagaactcaaacaaatttacaaggaaaaagcaaacaaccgcatcaaaaagtgggcaaaggatatgaacagacacttctcaaaagaagacatctatggagccaacagacacatgaaaaaatgctcatcatcactggtcatcagagaaatgcaaatcaaaaccacaatgagataccatctcacgccagttagaatggaggtcattaaaaaatcaggaaacaacagatgctggacaggatgttgagaaataggaatgcttttacactgttggtgctagtgtaaattggttcaaccattgtggaagacagtgtggcgattcctcaaggatctagaactagaattaccatttgacccagcaatcccattacttggtatatacccaaaggattataaatcatgctactataaagacacatgcacacatatgtttattgtggcactattcacaatagcaaagacttggaaccaacccaaatgcccatcaatgatagactaaattaagaaaatgtggcacatatacaccatggagtactatgcagctataaaaaaggatgagttcatgtcctttgcagggacatggatgaagctggaaaccatcattctcagcaaactatcacaaggacagaaaaccaaacactgcatgttctcattcatatgtgggaattgaacaatgagatcacttggacacagggcagggaacatcacacaccagggcctgttgggcgggtgggggctgggggagggatagcattgggagaaatacctaatgtaaatgatgagttgatgggtgcagtaaaccaacatggcacatgtatacctacgtatcaaacctgcacattgtgcacatgtaccctacaacttaaagtatataatttttaaaaaggtaaaatttttttaaaaagaatattagccctttgcctgtggtacaggttaagagtattttatttatacatcagatgtccttaattttgtttatggtgttagttgtcatgcaattggtagtcaaatttatcaatcttttctttcgttttctctagaatttgagtcatagtagaaagcatttccctgtatcaagatgaaagaggaattcatgcatgtttcattgttgtacttataggatttcatttcttatatttagatccctaattaatttggagtgaacttttgtgtatgatgtgagatatggatctaattttatctttttcaaattgctacacagttatctcagaaccatttattaatggttgactgaattctacttgactgaattcttttcttgttgagttaatcattgattctctgaggtagaaggtatgaaaattttgtggctttttcttgtttgtttttgttttgttttgttttgttttttgagacagagcctcactctgtcgcccaggctggagtgtagtggcacgatctcagctcactgcaagctccacctcccaagttcatgccattctcctgcctcagcctcccgagtagctgggactacaggcacctgccaacatgcctggctaattttttttgtatttttagtagacacagggtttcaccgtgttagccaagatggtctccatctcctgacctcgtgatctgcccgcctgggcctcccaaagtgctgggattacaggcatgagccaccgtgcctagctgaagtatgaaaattttatgtaacagtgtatcatctgcgagtaaagacagttttattgtttcacccgttcttgtgcctccaattgatttatcttgcctaattgcattggctgattaatctagtacaatgcttaatagtagtgaagatagttggcatctgtaccttagtcccgatcttagtaaaactgccactagtgtttcttgattttaaaacatacttgttttaggacaaaacaatcctaaaattgtacttttaggacaaaagtacaatcatgcatcatttaacaatgaggatacattctgagaaatgtgtcattaggtgatttcatcattctataaaaatcatagagtgtacttacacaagcctaggtgataaggcctgctacacacttacactatatggtgtagcttattgctcgtaggctacaaacctgtacagcatgttattgcactgaatactgtaggcaattatagaacaattataagtatttgtgtatctacacatacaaaagatacaataaacatatggtaaaaaatataacaaatgagatatctgtataaggcccttaccaggaatggagcttgtgggactctgatgagtcaatgagtgagtggtgagtgcatgtgaaggcctaggacattactacacaccactgaagacattataaacactctaaactttggttacactaaatttatatttaaaatacttttatttcttcaataattacattagcttaatataacttttttgctttctaatttttctaattttttaaacatttttactctgttgtaataacacttagcttaaaatgcaaacacattgtacagtggaacaccatgttttctttctttatatccttgtttgttaagattttttctaccaattttttttttactttttaaactttttttgttaaaaactaagacacaaacacacatattagcctaggcctatatgaggtcaggatcatcaatgtcactgtcttccacctgcatattttgccccactggaaggtgttcaggggcatggagctgtcatctgctttgataataatgccttcttctagaatacctttctgaaggaactgcctgagacggttttccaggtaactatttttttatataagtcaaaggagtacactctaaaaaatgatttaaaagtttagtacagtaaacacataaaccagtaacacagtcatttattatcattatcaagtattacgtgctgtgcataattgtatgtgctagacttttatacaactggcagcacggtaggtttgtttataccagcatcgccacaaacgcatgagtaatgcattgtactatgacattacaacagctacaatgtcactaaataacagaaatttttcagctccgttataatattatgggaccaccatcatataagtgctctggcatttaccaaagcttaatatgtgtatgtaaggtgtgtaataaagtaataacatacatgtataatatatgtaatatgtagaaatatactaacacatatgtatctaatgcactttttttatctactatgactgtgtcctcagttggctctctaaaaagtagttctccctaactttaatgctgtttcgtaatgtgagttttttcattactattctctacctttatatgtcaataaattttcaattcctctaatatacagtctatattcaaattgccctaactgtctcaaaaatgtcatttgaatggctttgtccaaaccagtacagaacccaggtttatgtattgcatttggttataatatccattgtgttcttttaacccaacacaattccattatttcccattttttcccaggagacagccttgctgaagggacaaaactagtagcccttcagtgtgtcttaccttctgaatttgtctaactgctaccagagtgacactgagcttgtgcactctctcccctatatttcctctttgtttatccctccctaaactagatggtgaacttttaatggtccaggattgtgacctgttcatttttgtatttccagatttaataccatgcctgactcatggtcaagttttagtgtctttttttaattaaataaaatatgtattgaataaacctgtgaaagagcagtcattgctaaagttaccagcaagccttggcatttttttcagcttattatgacctaaaaagttcacttatgtgtgcacacgttctctctctctctctcacacacacacacgcgcgtacacgcacatacatacacacacacacacatatacacactagaacatatcatttgaaagtacaaaaagagagtgatgatgtatggtttttgaggaaggcggaacctgatagagcagcgaggaaaaccttctgaagtgcaatgataatgacagtgattatacagtgtaaatgttgctattaggtgagcaacagggagtgttttcttggcaaatgggctttgagcgtaaatgtttccagaaatcatacatcatttcagcaaagaaaattaggatacagatgcagaatggaagtaataagccactcaatcacagatttgaaaaagtggatgtgaaggaagttaatttttaaaaacaataatagcagtatcttatgtttataaatataccaggcagattagtaagcacccaaaataatcatcttgagacctgattctagttctccccccattgtgtgttactttcaataaagcattttacttctttgtacctctgtccacctataaaatgcaaataatacttgctattgtcttaagtagacctgttggcttcctgaatctgatcaatctcatcatccaaggcaatgaaaggaaggtcttcttatggggcatcttggtcttaggccccagttcttagctcctgagcttcaccttttctatgagactttctcaggtgactcatagagattgtccctaattgccatctcaaaaactcgaggcttagttttgttacgggaattagagggcttctttagagcctaatgacggacagaggcagaaataaagcccaacataaagatacgtgaaattcatttcaatagaatttatatgataactacttcatataaagaatttatgatataaattctattctcttgcccatgactaggctctctgaacttttattcagtaaaaactgtttccactgtagtttcttttatttcctatttagattatattatgcaatattgcttattctaataagacactatacaaagtatagtgatctatcattttgattgtattttcataatttctcaaactgccttccaggtgttccattatggatcctacaggctatattttataacttgattgatttgcttctcatttttatttagtattgctgagttggatttcccttaaacatgtcattaaatgtttttcaattcctgcttactcttgttttttttcaaacttcattacttcattacagaatttattttaaatcttagagaaaataaaaagttgatagtaacaccatatgctacacactgctcaagacagagcaataaagttcaaatcaaatacataattttaaacaaaaaaaaaacagcaaaatactgtacttaagtagaataggtagtaactcaatacggttggtttctatactccagaaagtcaagtaaataaaatatctcccattatgtcaagagtaaagaagcacattgagggttgaagtacaaaagccaacactgtgaaaatagaccatttcaaatcattatgcacacggtctcttcattcttgttataaatcatactaaatattgccaaaattcatcttggaagttgcataaggatcattccttagaaagatatttacagtaatcaatagcttttgtggaagtatggcatgtcttggtgctccttggggcacaatattgcttaattctccaaagggagaacccccgactccccaattcaaaagaacaggcaagtacatagggtgtggcttgatagtgacgttaagaagaaaaggaaatttacacattgttgaaccactaccagatgtcaggtagtacatagttttacacatattttttattttgaatttcacaacaaccctctgagaaatctgagacatacagaagttgaggaatttgcatgatatcacacacctggcagaaatggaaccaggattcaaattaggtctgtctggaaagtccattatcctttcactgggccatgctgcatggctgcaagacctttcatattcccataaaatacatccttaactggtctgcctaaaaagcagcaatcatccctctttcatccctctttctacttgcctgaaattattacccccattagcctgataataggatcaagatgacaggttttagaaaaattaccattgagaattgttaccccaaagagcacagctgcatgcctttgtgttgccttctccagagcaaaagttagttgatcacatatgataactattgctttaaaaaaaacaaacgccaaatctggtttgtgtgcttcgacaaatgagattcatggtgttacagggaagaggtccctatccagaccccaaaagagggttcttggatctcgtacaagaaagaattcagggcgagtccacagtgcaaagtaaaagcaagtatattaagaaagtaaagtggtgaaagaacagctactccatagacagagtaggacgttcctgaaagtcagaggaggaacgcgtccaccttaggtacgatgcttgtatatatgagatgtgctctgctacaagggtttgtgataaaggattaattttctttctttttttttttttctttgagacagagtctcgttctgttgcccaggctggagtgcagtggcgctatctcggctcactgcaagctctgcctcctgggttcacgccattctcctgcctcagcctcccgagtagctgggactacaggtgtctgccaccacgcccagctaaattttttgtatttttagtagagacggagtttcaccatgttagccaggatggtcttgatctcctgacctcgtgatctgcccgcctcggcctcccacagtgctgggattacaggcttaagccaccgcgcctggccaattttcttaattactatattttgcaataaccgatattattgtctttaaagcaaaattaagaatgcctttgttctccagaaatcagaatacgtagacactcccaagtctgggtctgtttagtaagcactattaatttgttcccttaaccgtaaacatctagaggcaagaaatgtctaactttctgagaatgcagcccagcaagtcctagcctcattttcctagccctcactcaaaatggagtcgctttggttcaaacgcctgtgacaatgggactgcaataagatgttaaaaacagtaaaggacatcacaaagaaagggcaaataatggtgaggcatccattcccttaacaggtgggaggcgggaagtagtcaatgaatggagaaggcagactgagggtcaggatttgtagaatggggttgtaggcaaaaggacacagccaggaaatatggaagctctggccaagggtcaggataaagacttcacagaagtagagaaaggaatcataggtgggacataaaaggaaaatgcaaccacacataaaaaggaatttcaaatcaccattgctcacctcaaaatagtcattccaaaagtcaaagaaacaatatagatgtatgtatgtataatgtatatattcttgttccactttgccacttttgggggtgcagaaaataatcacccaaattatgacatttgggcatgctgagtgcttttgaaaaccgaaaggcctcagaaattagtctcagaatcatgctccccctaagcttgtcttgtttctccccctgaagcacagggaggggctctctctggaattttctaatctggccaagaaagcttcttactaaaagaaacacaagcgccttctatccactccctgttatctgattgcagaaaataaaacaagaaagcaaccagacctggatggactttttagcaagacaatgcctgcctgttgggctcattcaaattccaaagaaaattatttacaaattaatttctgtctccttggtccattcattctttctagtaatcatttactgtatgtcaaaaaactgtcacatttcccctctcctctgtcccctatataaaagggtatataagcttctgtactctactgggagattgaggtaatcaccatgaactcccccatgatgttaattaatctgtatgcctttttttcctattgatctgccttttgtcagttgattttttagcaaaacttcagagggcaaaggggaagttttcccgtgtctcctacataactattgactttttccccctatcaagggcatggtacactaagaggcactcttttttttttttttttttttttttgagagcaagtctcactctgtcacccaggctggagtgcagaggtgcaatctcggcacattgcagcctcgacctcctgggtttaagcaatccgctcacctcagcctcccaagtagttgggactacagactcatgccaccacacttaacttttttttttttttttttttttttttttttttgagacagagtctcgctctgttgccaggctggagtggagtgcagtggcacaatcttggctcactgcaatttccgcctccctggttcaagcgattcttctgcctcagcctctcaaatagctgggactacacgcgcatgccaccatgcccagctaatttttgtactttttagtagagacagggtttcaccatgttggccaggatggtctcaacctctttattttttgtttttatttcttttttttgagacagagtctcactctgtcacgaggctggagtgaagtggcacgatctcagctcactgcaacttcagcctcccaggttcaagtgattcttcagcttcagcctcctgagtggctgggactacaggcccgcaccaccaagcccagctaatttttgtactttcttagtagagacagggtttcatcatgttggtcaggatggtctcaatctcctgacctcgtgatccgcccgcctcgacctctcaaagtgctgggattacaggcatgagccaccatgcctaacataagaagcattctgaatttatgatcagaagttataccaaggcatttagcagccaaccggcattttaaattcaatgccccaaactgaagttattatctctttcccccctccatgattaccccaaaatagcaacctaactttcctgtactttcctttccttggagataaaattctcattgaatagtgcaagccagaaatttaggagtcattccagattcttttgtctacctcacatttacatccagtcaatcactaagttctgtcaattatatctctaagcatctctccagtcatcccttcatctccatccccattagtatatcttgattcacactcattatttttcatttaaattattataacactgctgacagtattctttctaacatgcaaatttgattaatttacttcccctgtttaaaaatcattgagttgctcatgtaaaccaaaaataaaattctaagcccccaaccaactgaatggactcctcctctcagccaagggcattccaagttaaccagaaacaccagttcaggccatgattggaatgggtggttggacatgcctctttatagctttctttctttggaattcaggctcaactgaccagcattaacattaaaacagagaccttaactctaactgagcagactgtttgtagataaacaaatacaagcatgacagacagcattaacattaaaacagagaccttaactctaactgagcagactgtttgtagataaacaatacaataaaatacaagcatgacagacagcagactctgaaagaaacaccaaaagaaacactaagtgccttctatccactacctgttacctcattatttatagctgaaaagaaaactaaagaatgcaaccacacctggatggacttttttttattattattatactcaaagttctagggtacatgtgcacaatgtgtaggtttgatacataggtatacatgtgccatgttggtttgctgcacccaacaactcatcatttacattaggtatttctcctaatgctatccctcccccagccctctaccctccaacaggccccagtgtgtgatgttccccaccctgtgtccaagtgatctcattgttcaattcccacctataagtgataacatgcagtgtttggttttctgtcattgtgatagtttgctgggaatgatggtttccagcttcatccatttccttgtaaaggacatgagctcatccttttttatggctgcatagtattccatggtgtatatgtgccacattttctcaatccagtctgtcactgatggacattttggttggttccaagtctttgctagtgtgaatagtgctgcagtaaacatacgtgtgcacgtgtctttatagtagaatgatttataatcctttgggtatatacccagtaatgggattgctaggtcaaatggtatttctagttctagatctttgaggaatcgccacactgtcatccacaatagttgaactaatttacactagcaccaacagtgtaaaagcattcctatttctcaacatcctgtccagcatctgttgtttcctgactttttaatgattgccattctaactggcatgagatggcatctcattgtggttttgatttgcatttctctgatgaccagtgatgatgagcattttttcacatatctgttggctacatagacgtcttcttttgagaagtgtctgttcatatcctttgcccactttttgatgcagttgtttttttcttgtaaatttgtttaagttctttgtagattctggatattagccctttgtcagatgagtagattgcaaaaattttcccccattctgtaggttgcctgttcactatgctggtagcttcttttgctgtgcaggagctttttagtttaattagatcccatttgtcaattttagcttttgttgccattgcttttggtgttttagtcatgaagtccttgcccatgcctatgtcctgaatggtattgcctaggttttcttctagggtttttatggttttaggtctaacatttaagtctctaatctatcttgaattaatttttgtacaaggtataaggaagggatccagtttcagctttctacgtatggctagccagttttcccagcaccatttattaaataggcaatcctttccccacttcttgtttttgtcaggcttgtcaaagatcagatggttgtagatgtgtggtattatttctgaggcctctgttctgttccattggtctatgtctctgttttggtaccagtaccatgctattttcgttactatagccttgtagtatagtttgaagtcaggtagcgtgatgcctccagctttgttcttttggcttaggattgtcttggcaatgcaggctcttttttggttccatatgaactttaaagaagttttttccaattctgtgaagaaagtgattggtagcttgatggggatggcattgaatctgtaaattaccttgggcagtatggccatttgcatgatattgattcttcctatccatgaggatggaattttcttccatttgtttgtgtcctcttttatttcgttgagcagtggtttgtagttctccttgaagaggtccttcacatcccatgtaagttgtattcctaagtattttattctatttgtagcaattgtgaatgggagttcactcatgatttggctctctgttggtttgttaatggtgtataggaatgcttgtgatttttgcacattgattttttatcagtcaaactttgccaaagctgcttatcagcttaaggagattttgggctgagatgatggggttttctaaatatacaatcatgtcaactgcaaacagggacaatttcacttcctcatttcctaattgaataccctttatttcctgctcttgcctgattgccctggcaagaacttccaacactatgttgaataggagtggtgagagagggcattcttgtcttgtgccagttttcaaagggaatgcttccagtttttgcccattcagtatgatattggctgtgggtttgtcataaatagctcttattattttgagatacgttccatcagtacctagtttattgagtttttagcatgaagagctattgaattttgtcgaaggccttttctgcatctattgagataattatgtggttttcgttgttggttctgtttacgtgatggattatatttactgatttgtgcatgttgaaccagcctcgcatcccagggatgaagcaaacttgatcgtggtggataagctttttgaagtgctgctggattcagtttgccagtattttacagaggatgttcatatcgatattcatcagggatattgggctaaaattctctttttttgttgcgtccctgtcaggctttggcatcaggatgaggctggcctcataaaatgagttagggaggattctctcttttgctattgattggaatagtttcagaaagaatggtaccagctcctctttgtacctctgatagaatctggctgtaaatccatctggtcctggactttttttggttggtaggctattaattattgcctcaatttcagagcctgttattggtctattcagggattcaacttcttcctggtttagtcttgggagggtgtatgtgtccatgaatttatccatttcttctagattttctagtttatttgcatagacgtgtttatagtattctctgatggtagtttatatttctgtgggattggtggtgatatcccctttatcattttttattgcgtctatttgattcttctctcttttcttctttattagtctagctagtggtctacctattttgttgatcttttcagaaaaccagctcctggattcactgattttttgaagggtttttgtgtctctatctccttcagttctgctctgatattagttatttcttgccttctgctagcttttgaatgtgtttgctcttgcttctcagttcttttaactgtgatgttaggattgattttagatctttcctgctttctctggtgggcatttagtgctataaatttccctctacactctgctttaaatgtgtaccagagattctggctacagtaaccaaaacagcatggtactggtaccaaaacagagatatagaccagtggaacagaacagagccctcagaaataataccacacatctacaaccatctgatctttgacaaacctgacaaaaacaagaaatcgggaaaggattccctatttaataaatggtgctgggaaaactggctagccatatgtagaaagctgaaactggatcccttccttacaccttgtacaaaaattaatttatgatagattaaagacttaaatgttagaccaaaaaccataaaaaccctagaagaaaacctaggcaataccattcaggacataggcatgtgcaaggacttcatgtctaaaacaccaaaagcaatagcaacaaaagccaaaattgacaaatgggatctaattaaactaaagagcttctgcacagcaaaagaagctaccatcagagtgaacaggcaacctatagaatgggagaaaatttttgcaatctacccatctgacaaagggctaatatccagaatctacaaggaacttaaacaaatttacaagaaaaaaacaaacaaccccatcaaaaagtcggcaaaggatatgaacagccacttcttaaaatgagacatttatgcagccaacagacatgtgaaaaaatgctcatcattactggccatcagagaaatgcaaatcaaaaccacaatgagataccatctcacaccagttagaatggtgatcattaaaaagtcaggaaacaacagatgctggagaggatgtggagaaataggaatgcttttacactgttggtgggagtgtaaactagttcaaccattgtggaggacagtgtggcaattcctcaaggatctagaactagaaataccattggaccgagcaatcctattactgggtatataaccaaaggattataaatcatgctgctataaagacacgtgcacacataggtttattgcagcactattcacaatagcaaagacttggaaccaacccaaatgtccagcaatgatagactggattaagaaaatgtggcacatatacaccatggaatactatgcagctataaagaaggatgagttcatgtcctttgtagggacatggatgaagctggaaaccatcattctgagcaaactatctcatggacagaaaaccaaacactgcatgttctcactcataggtgggaattcaacagtgagagcacttggacacagagtgggaaacatcacacactggagcctgtcatggggtgggaggaagggggagggatagcattatgaaaaatacctaacgtaaatgatgagttaatgggtgcagcacaccaacatggcgcatgtatacatgtgtaacaaatctgcacgtcgtgcacatgtaccctagaacttaaagtataattaaaaaaaaaagaaattccttaataaaaaaaaaaaactaaatcataatagagtcactgcagtatttcacttggaggaatcagatgtatgcctaggtcctctcgcactattcatttttttctatgcctcatctttcgtgccccactaccctatatctccacaaaataaaggagataaaaaagtgatttccaactttcaatcttttagtatcatagcagttttaagccaaaaattatctcatgtctttgaataatttcaagacataacgtaaaaattgatataaattaaaactaacttaaaaaaatgatttaagtatttattgtctcctatacaccaaccacactcatcagatattacctacatttatttatatatataatcactcaaaactcagatatacgacagtcactctcctgcatgagaagaacaaaggggaaggcctataaattttcacaatgtcaccttcttataaagtcattatttccttccccttgttcttcaggggtattccaagtctccagctttcacaattcctgggtcttatctcatgaaggagccaatacattttttttttcatgatagcaaatgtgccacatctatcatctgatttggatctaatttatctgagggttgaatatcatcttgatctttggtttagtacttggtatgctgacattttgttgagaaactgccaaatcattaccaggagcaccacatttgactgatttccaacgtcactgtttctctctctctctctctcacacacacacacacacatacacgcatgtgcacacttacccattcttatgaatattaatttttcaaatgcttttttggctggtcttccccacatttcacatatatcttagaacagaggaacagaagacactacaaaagtgaaagataattaactcttgtctcttcgtttcataaattaaaaaaaaaacagataacatttcttgccaaaggattatagcccagtactttggatttttagttttaaaaatttgtgacatcatgctattttgttttttgcacatttttggcaaattttgacaatatattttctatttataatatgccatttaataaatcaggctttaatgttataatacatgaaatttttgtggtatatacacaatttatactaaatagttcagtgctcagcacaagaagatgatcaattgatcagttgattgaataaaagattgaatattcactgagttttcattatgtgcaaggtatttttctaggcataaaagatttgattagcacttttattgaaattaaatcaaatatatggaaaatgatctgttaattactttaaaacatttttaaaatgagtgtggggttttctggattattatccattattttctttatattttactttcttttttccaaaaatacctatctttttaaatgacaatcaaacatactccctgtgaatttaatatattaaagaatacttatcaagattcttcctaaattttgattagtcagttgctcatgtttaaaagaaataaatggtctaatcaactttaaattatactaggtttctcataacagctttgttgctgataagaagcctagttgagatttatgtgtttaacaataaaggaaaagctgtacttttgtttgaggcatgtgctttaaagacaaaaggactaattttttatttttaataaaatgttaatgaaaatttctagatagtccaatatcaggcatcccaagctccagcaaaggctggataacaatatatataaccatatatataggataacaatttcccatgattccttgttaatgtggccctgtttgctatccaagactaagagtttaatctccaagtcgaatcacccttgggtttcctctaaaaacaaaattgctcaactagctaatgagattgtccttttccaacatttgtcagctatttactgatctacctatctgcctttgagaagctgggctgtgatccatcttgcacagatcaccaaacacccaccaaagggtaatagctttagctctttagacccagagcttagagatgaaagaatctgaatctcattttaaactgcctgaactatccatttaatcagattaaagccaatttcatattgcacataaaaagttataagaaaaagaggcagaagagccacagactctccatttgttgcctttttctgggaaatcattctctaaatacacagtcttcatcttcagctgctatagctcatagtaattccatattctttttttactcctgcttatacaatgcccttgctgaataatttttcctcttcagaggcatttttgcctttaacacagtatgatactttatagtctgtttacttcaaactgaggagtaacagaatttgtccttttttttttacataatgatgaggaaagggagtcacacttgatactgagagttgaaaatgtaaagtgaaaatgcaagctcctagagtacaaagaaatatttatggaattattatgagacagagatccaattttgataagtctggtatagacctattatagtgagacattcaaaacaagagaaccacaaactgtgttcacttacaacaaagaatgatatgaatttctacagcagcattttattccttgagcatgtactagtccattgatcagtcaatgatctcaagcttttattttttcatatttacaaaagaggtagaattcttgcttttcagtgtatgagctccaagagggcaggaatcatgtctactttgtttactacagcatgcccagaaagaaacagtaggtaagtagatagatagatagatagatagatagatagatagatagatagatagatagagatgatagacagacacacactctttcattttgctcagtgaaaattgtttcacttattccacccccactcctcaacagtgtgtttccagaatgtggttaaaaggcttaggaagcagaatattttactgggaagcttctgggttcttatgtcagtcaaacctaagtttcaaattcatgtatataatatttggcaatttacagaacttaattaggcctgtgtctcttatagaaatggcaccaagtaggtgctcaataaattgtaactattagtactttttaaaatgatttttagaaggtgaggacaggaggagaagcaagtcacagagcagcctgcatttccttttcactatgcatacctccaaaaagataaggtttgagagcaacctatcagattcctttcaatatcctctttgtgtgtgtgtgtgtgtgtgtgtgtgtgtgtgtgtgtgtgtgtgtgtgtgttcatgccattctcctgcctcagcctcccgggtagctgggactacaggtgcccgccaccatgcccagctaattttttgtatttttagtagagaagggttttcaccgtgttagccaggatggtctcaatctcctgacctcgtgatccacccacctcagcctcccaaagtgctgggattacaggcgtgagaatatcctctctcctttaagtagttggaggtggcactgttgtaattgtttttattcttatctatgactacaagtcttctgatctagtttgctggcttcctcttttcctgacacttaaaagtcaatagtggctaaatttattattcagccaaaggttatctttcttgtaagaatttggaggctaatatggctactatatatgtacaatacgccaggcactgttctgaattatatatatatatatatatatatatatatatatatatatatatatatatatatatattttatactttaagttctagggtacatgtgcacattttatcctcatgacaactgttagaggtgaatgttatattgctcttcttcctctcaatttgcagatgaagaaattgaagaacaggaaggataatctatcatcacaaaactagtaaacagaagtattaggattcaaatcaggcagtctgcctccaaattctacctatgttctgagctactatgctagaggttatctccaagaacttagaaataaaggaaaaggatcagcctctgagaattaaaccctaagatggtgattaagagattagaaaagaaatatggaaaatcgcctgaaaaacaaaaaaaagaacagaagggaagaagagaagaaggaaaaaaatgacttttcaaccatggcacctgactgtaaacttttttaaaaaaatagttggaatgaaagttattagctaacaagacatttaaaaagaaatcacagaagtagatactgggatttttcacttcaattacatggtgttcatattttgacagacaaccacagctccctcactctctgtgtttactctctttctaccaggtttcccatgtggctttcaacttaaataacaccctctacaagcagtctgcactgactaatccagatcccagtcttttcctctaattttccatagtatttaaatctgggctgctcatgtatttacccattcagacaacaaatatttgagcactgaaccatgctctaaaaattattgcaatattcaaaaccagagataatgaggtgctgaaccagggcagtgaaagggatgctgtgttcaagtgttcaaggcaaagactataaaatcagagccagtataatttagcacatgctatatattgtcttgcagtgttccaaattgcttcaagtgttatcaataatgtcttctgaaccagatgtaaacttctagctggaaccaaacactgaatcttaaattctttcaaatactcagaatagtgtggcaattagtagatatctgataaataattgcttattgaatgtacacagatacaacttaaggagccattacccttctctttataagacaatggtagattttaacaacttcttgttggcttcctcagtttaaaacaaaatggcatctatttcctcacagctaattactttttttctttatcttacctaagtttttttctcttcagaactcactactctgcgctttatctaaatttatactagatttgccatttgttaatataagaaccaaaaatttaaaaacctccaggaatgcaatttcagcaaattatttagtgaaaagcagataaagccttgatcttccctagactatgcaaagacattgttatcacacgaataatttacacagtctcattaagttggcttttaacctcatgtcccaatgggtggagttcacttcagattctctaatgaacacatcttcaagctcaagatagctcaatgctcagtggtaattaggattagatgaatggaagcaatccgcttcattcaacatatgtcttcactctataaaattccaccaagtataagaagattaatttaagcctacctttcaaccagcaattaacaaaaacaaaccataagttctcaaccttaaagggaaaaataattgtattttcagagatcagagcaagataagaataggaaaaactactttactaaaatctataccctttcaatatcaagctggtcattataatttgttcaagaaacatttaatcacaaatctgatgtgtacatagtgctatgctgagcactgtgggagaaataaagatcaataagacatggctcttgcccttaagcacctcttaatcaactagaggtgatatgcacaacaaataattgtttaacatggttgtaattatgctgtagtataattagagagctgacagttcaggcaatgctctttaataagaaacatgatatgacagcaaacaccataggggagggcgcaacaacgtgaacaaaacaataagaaactcaatgactgttaaagtagggtggtgaaggagtactacagaggagtagaatacattatagcacaaaaaaaggaagaggttctccccgtcacacacaaaagaaaagaagatttgggtgatgagacatgatcatgtctaaagaactatcgtgtgaaaaaaatggtttatataaccaagtgttctccagaggatggagcttacaacatgagaaaaattatcagagagactcattctctctatactcagctcacacaccctgcatactcagggcgtgtgctgaagcagagcgaaagattacccacaggcattatacagatgatccctgtgctgtgtgaaggattcagttggacggaaaagtcctctacaattcaaaactcctgtggtatgatttttaacacacttgtcagcggtttctagttgtcagtttagaaaacaagggttttaaaataaaagtacgcaatacactgtaacaactgagaatataggctgtaatgtctgaaaggcttccattcttctaatcactaggtgtgtaactttgagtgtggcttagcctttttgtgcttccgtttcctcacctgtaggaggagaataatattagggcttaagtcacataattgttcttaggattaaatgacataagacatgtaaaaagcctagcacaatgttctgtaagcatttagtacatggtaagttttgttattagccgggtcttaccttcactactattcttctacaacccagttcatcctcctcatagctgtaagtcttatttttgcttagaatcagtcagggccacctcttcactggagaatgctgtcctaactgattagtttggtctgatcttctccgtggagtcttatctttgacttttatcccaccacacaggaggctccttccaaattgcttccagttttaaattaccaggatgcttcaaactttgctcacactttcaactttactggaagtgtcctccccttctcccaagctaagagtgattcaacttcaaaattctcttccaggacgcccttctcaataaaatctctcctggtatcaacataaaattgaacacagaagaagtcttcatacaagtgaggaaatgaaagctcagaaaagttaacttagccaaggtcaccaacttataaatgactacagtggtaataatagtagtaatagcaaaaataccttacatgtatagagagtctcattgtatgtaaagctcttccctatagtatttcattgtatttttacagctctatgaaaaaaaaataaaatcttcttcttttttatggatcaggaaaacagagagtctgagtgacttgtacaaggtcacacaatttgtcttgttaaaggcacagtcatgccagatcccagaccccagattctgttattcttggtccacaaacttttttctttagacaaagtctcactctgtcacccaggctggagtgcagtggcacgatcttggctcactgcaaactccgcctccctggttcaagcaattctcctgcctcagcctcccgagtagctgcttattccacagacttttctatttttttttttaatttttatatacttagggggtacaagtgcagatttcttacatgcatacattctgtagtggtgaagtctgggctttcagtgtacccatcacccaatactgaacattgtacccaataaataatttttcaaccctcaccccctcccaccttttggagtctccaatggctattattccactctgcatgtccatgtgtacgcattgtttagttccctcttgtaagtgaatacatgtgatatttgactatctgtttctgagttatttcagtcaggatcatggcctccagttccatccttgttgctgcaaaagacatgatttcaggactttttatatagctgagtagtatccacagcatgtgcgtatatacgctgttttggtcactatagccttgtagtttaatttgaagtcagtaatgtgatgcctccaactttgatcttttagctcaggatttctttgtgtatttgggctcctttttcgttccttttgaatttggggattgttttttctaattctggggaaaatgacattggtaatttgatagggattgtgttgaatctgtagattgctttggacagtgtggtcattttaagataccgattcttccaatccatgagcatgggatttttttccatttgttcttgtcatctatgatttagttctctttttttgagacaaagtcttgctgtgtcactgaggctggagtgcagtggtgcaatcatggctcactgcagcctcgacctcccaggctcaagtgatccttccaagtagctgggactactggcatggaccagcacacctgtctaatttttgcatttttgtagagagggagtctcactatgttgcccaggctggtcttgaactcctgggctcaagccgtttcccaccttgggcaccccaagtgctggaattatacgcataagctatcatgcccagcctcctgtgatttgtttattttttgtagttctacttatagagatcttttgcctccctgatttaatatgtccctaggttttgtttgtttgtttgttgtttgtttttgggttttttgggtagctattgttaatgagattgccttcttgatttggtcctcagatagatcactactggtgtatagaatgctactgatttttttatgttgattttgtatcctgcagctttactgtattcatttatcgaatctcagagtttttttggtggagtctttagagtttcctagatataagatcatatcatcagtgagcagaaataatttgacttcctcttttccaatttggatgcctttttttttatttttttttaatgcctgattgctctggcaaggacttccacagacttttctttacaaaacatgccattttgtaaataagtgaaattattccttttagtaaataaatgaaattattccttttttatctttgacctctcagggatgatatttttcttttttgaaattattgaataaatgaaaaaacaaaaatgactcaatttattttgttgatactgagtatcttattctaaaactttgagcatgtcaaggacacaggaataaagttgaggagcagcctttaataaaagcaaaattttctctctaaaaattactgagctaactgcaaaagcatcactaatttgccaggactaaaggtagagctggtttaatgacaggcatagtaacaaagcttgcacacactgtcacagaagatgcaaaatttcacagttaactaactagattgaaccttaaaacaattagtgaacaaaagagtgttgtgatttctggagcagtggggttaggagtcttcggcaagtaccaaattatccacacagtttacatattttagaacatctgaagagtaagtgaaaccatcatggtatttactaggcacaaactgacttatcaattaaatgcaatgtcctactaagaagaaatacaggaaatgcagagactgcctctgtgcgtaatcttctataaatttcccaggagtttttagtaagctattctcctattaaggaagctgtcaaacagctagaataatgaaggggaatggaaaggaaaggaggcttgaacagatagaggaagagtttttgaaaaacaaacaagtctctaaaatttacattaaggatgacgatttcttctaattgtaggaagacatctatggttaactatgttgtctaatattagtaagaaacttgagttatttatctctgccagataatacacagacattcatctagctaaagttctaaattagcagtgcctaacatgttgtaggagctcaatctttgaaaataaataagagaaaggaccaatttaatcctgaaggttcactgtgaatggtaaatacatttcaaaaactatattttaccttttaagtacctactatgtaacagacatcatgctaggatctagtcatttggaaaaaattttaagtgctttggcattttaatgttcataagacatggaaatgttcattcatcttttcatatagttgtcaaagtataacaatggttactgaggataaattcagagtccctcttcccatgcaatgcagggaaattatagtttgtatattacaagttgacagcatcatttctcatatggtttgcaggatgattggttcataggattaaagtgggtctagtcttttccagtcttaaaacaaaagtcatgtttcctattattaatagaagatttgtcagaaagtatatataattgtattagcagttggtgctgaagaccaatgttctacagatgagctgggttataacaaggttctttcatttctgcagtaataagcaccttggctgaggtccagctatgtttctacttatagaaaaaaaatcactaatgcctaaaaatataggtatttgtatcagtatctagaatgatcttgttaagatggtgtagcaaacactgtctatgcccccaaccatattccttaggccttactattatggtgcaagccagacttccaaactgccttagggctttttctggagctaaagtccactctgccagtatgcagagcagactggagtaccagggaatcaagagatactccttcccactaagaagcagcccttaactaataattgacagggattagtatataataaataccctagctgcttcgtcactgtgggtgacagagatataattaattgaggctgactgattctacactgacacatggagttgccagtgagattaaggtactagcttgttaatgcatcctttattagctaccttaccttccctgccttttttccttactgcccttctgatgctttctgggatcatctctgaaaaaaaccatttaaacataaatgtgaatacttgtttgggggcctcttcttggggaacataaactagacagaattgttaagcccttataatattcattgttactgactttaatagtaatacatttagtgttaacaattccatgaagcatgacatagaatgtgatttcagatagattttcaaaatagctttaaggaaacattcttttaatttagttttatcacatagtttttttgtttttccctatccttctgagcttttttttttggttcagagttggtacattgtttaaccaccatgtatcaccaaaaaattataaaggtgcttccatctcctagagaggattagaattatagacgggggcaagaaagaatgccagtcatactttaatctgggaccctcaccctacagacaaaaatgtaagaatataaggccaaaaaacatgaaataagtttcctaacaccatacagctggtcaattatttagtcacaagaattgttgtttataaaaatctaacttaaaaaaaatcattagcaaacctaggacggcatcccaccttgctgactctcaggagcggctctttttgtaatactatcctaaatagcatccttctttgtgcaggtaagattaatggcaaagggtatcccagaaaacaataatgggagagaatgagaagatcacatgcctatatataatttatgagtctgatatttaaataggtcaaattctctattctttgattcattaacttgcacacgtgtaagtctggtaggaaagggctgggaactgcacagttgaatgacaagaggaagagttatctggaatctgtgttaacctttaaaattgaacttctgtatcttcaattgaaccagtagacttatttcacacattgtggaagacattgtggtgattcctcaggtatctagaaccagaaataccatttgacccagcaatcccattactaggtatatacccaaaggattataaatcattctactataaagacacatgcacatgtatgtttattgcagcactattcacaatagcaaagacttggaaccaacccaaatgtccatcagtgatagtctggataaagaaaatgtggcacatagacaccatggaatactatgcagccataaagaaggatgagttcatgtcctttgtaggaatgtggatgaagctggaaacaatcattctcagcaaactaacacaggaacagaaaacaaaacaccccatgttctcactcataagtgggagttgaacaatgagaacacgtggacacagggaggaaaatatcacacaacaggtcctgccaggaggtggggggctaggggagggacagcattaggagaaacacctaatgtcaggttgatgggtgcagcaaaccaccatggcacatgtatacctatgtaacaaacctgcatgttctgcacatgtatcccagaacttaaagtataataaaataaaataaggatgttggagttgaggatgggggcagtcccagacattaccaaaatgtaattgctagctctggattgctataattctaagaaaggcacatttggaggtatggagaatatgagaaacctgttgatttatatgtcttcatgtgaaataacatagcttttcaccttatctttacaaacaccagtttcatcactgcctattttttattttttctatttcatcccactcctcttcccacaactaaatagaatgtagctttttttcttctttgcacaatatatataaataaatatctaaaaagaaaattattactctagaggattatcaagccagactcaaaaacaaaaagtcattaatttgtatgggcattagaaacaggagaaacttagaagtccaatttcagttaactaattcctccatggttttctaacaaatggatatatcctattaaatggacattgcatatttaaaaaccaatattttttgttagacattcaggttatatttaatatttagctattctaaataatactgaaattaacattcttataaagaaattgttagccatatctcagaatttttggggggtagaggataagttcctagggaatttgctggataagagagttaaagtatacattttgatgtatatatagccataatcgttggatttattttcttcccaccaacagggaacaaatgtttctctgttaacatattctcatcagtcttgaatactattaatcttataagctttgcaaactttcttgaacttttcactttttaagtcaaccattattaactatatttttgtgaattccttgtttatgatgtcatgatgtcatttcaattatgtatcactgtgattttgtttttctcattgaataattttcacattttttatagtatacttccagaaaagttttactaaagatactgttgcctgaatacttcaacaccttgttactgaatttaatggcaatgtatttagcgttaacaattccatgaagtatgacatagaatacagaatgcgattttagatcaacgttttaaaaaataatttcaaggaatcatccctttaatttagtttaataacatagttttttgtttgtttcatattgttttccttcatttattatgagggatgattgttcaaatgttctagaggcagtatagcaactgctctgaaagcagattgcctggatccaaatcataattcactgcttaatagccgactgatgctgaagagtttacttaaactttctctacctaacttttcctgtcagtaaaatgggaataatgatattagcatctgtgtcatatggttttagtgaggatgagttaattcatttaaagtgtttaatgtagtatccaccacacagtaagcacttgaaaatgttagccaaatataaatattatggcactattattattgttgcatattgggaggtgctctgacagagtggcttaatcaatattacatgttcttgttttcatatcttagctttctcatatgctaattatgtgcatttgagcaagttactaaacattgtgtgtgtcagtttttctcatctaaaatatgaagataaaatacttcatgggaattttgtatgaattaactgaacatatatatacttaaagcacttacaataatgcctagaacatagctcattatagcattcaacaaatgtgagctattactattacctatttcggttgcatcttttatttattaatgatatgccatattaatagattttctcatagtaatttccattgcatttatagaacaaatctttcttggaactttttaatgtactcttgaattagattagttctcttattagtatttttaaactatattcataaatgagattaatctgtattttcttttagtgttcagtttttatatacactattttcctaaaattagaaagtttctttgctatttcactagtttggaaataagcaccaatcatgagacttacctatctttgaaagtttacatgtatttgattttaaccctacctgagtttgtttcattaaagttaattctttgacaaaattttaatttattccaaggttatgagtctattcatgttttcaatttctaattggatcaatttaggtagtttatgtggtgaaaagagaaaattataagcccatattctttaattcagctagaaattgcaaacgtgaggttgcattcttcagttaatacagctgctttaagaagacaaagccctgtgctagccatcacttctcaataaattgatgaggcaactttattcttccagttgttcaggtctaaatctttgaagatacccttgatacttctcttctttgacatctaatccaccaacaaatcatttgacatatatccaaaattcaattgcctcaccacctccactgttctcctaaattccaacctatcattatctctcacccggagtatttcattaatcttctgatgcatcttcctactttttctcttgtcttctagagtatagaacgaggtgtactacccagatctcccaatcagaaccaacgctttcaattcccaacttccaggattgttggtggccaacagtgcatatctgagtctctctcaataaattgctctcagctcaaagggaattccttcatctagggtcacacctgtttcccaaaggtagacagcttctaactgagacaaccaggtgggaggggtccctggagaaactctaaccagcctgcccactgcggtggaaccgcaggaagttcacaacatttgcagcagagaggagactgaccccttttcttcctgtgtggagcctgggattcaggcagtgggcaggaagcactctagtggaggtactctggatttgcaagagtccctgattccccagaaccccatctttagctaaacgaaggaaaagtcctgcaacatttttggcaccaaacatggggctccaaaagcagtgaatgaaatggggactcaaaatctctcactattgctcctaagcattttcatcctcagactactgagggtgggggaaacaagccgccaagccctgtcactcttgggggtcggaggaaaggcccttttcttcctttttcaggatggacaggcaagcggggtctccttgctccccctcccctctgtgtggaggctggggtgtatggcccaagggtcccacacagctagctggctggctcccagacaaaagccacagcagccttccctttccccccgccaagaggttcagctttttctgacagtaattaagcttttctcctggtggaggaaccactttcataacaataagaggttcttccccaggcatttttaaactgttttttttttcttccccttctctaccccgtcagcagttaacctttaactttttttttccttttagaagacgtttttactagaccaggcaacccaactatcactgtttgtactctctgtaaagttttggtcatgaaaaaggatttgtggggctagtctttggctatggcccatctggtgtgctttgcctgtctgcatggtttgtgctccaagcctccatcttgctttacatcctgggggcatagctggtaagtgcttggcaaggctttgtttagcaaccctgccttaggggatgagctctctctggttcaatatctgcaggttttcctagccctgtctcttaaaggacaccacaaccactgggttttcttctgcctgtctgtgtgtgtactgtgatgtctgtacaaggagctctgattcatgtggcctaaagaaagggtcttggatcaagtattttttaaaaagggaagataaaagctgtggtacctttcaggtcacatgactttaatctttgagaaataaaatcagccttaaagattattggtaaaatgtagatgtcattaaaatgtaaataggtgaactgaagaatgcaggtcagatgcaaggtttgccaagtgttttgaggttacaaactggtttttgggttttgaaaagtatttgacttgctggcttcacaattgataaggcctatggaactgacatacggaactaaccatgcccttaattaagaaggcaaaatttggctgcagttagcacacaattaaagcaacttaccaagttttaccttaaagttaaaaatgcctaggagttaactgaaactactagaaatagatttacatgaaaggtgtataagaacagtaaaatgtgttttttagtaaaaggttataagaaggcatggaaatgtaaacttttgcctagagttaaaggattgttttgagttaaattaggaaaaagctgaaggttaaaagaagtagtgcaacaactgtggaaattaatcttgcagaagaggttcttcatgtgaacgtattgactaaattcaaaaaagggtattatatggtttttctgtaaattgagcactcaaataaatgcataacaaggttttcctatggcaccaatctgctctttggcaacatttgtaagtggttataaaaggtttttgcttctttaaaatttctgagtcatcattttggcaaaataattaccttacggtactctggaattctattttataatatcaagtattttacacctcaaacatttaacagccttccgaaaatcaaacttcagtttcaaaattgtcttccctggcacctggctttttgagtacttcagagggcccctgacgtgtccagaaaagagaggtaaacaggattatttgacatgtttaggtagatgggatttccaaaatgatgctcaatcttctttaggttatatattggtactatatatggttatatatataatgctaatatatgttccagaattgtatgggatttctaaaattctaatgtctaagtatatgctaccaatcacaactaacattgttatgttaagttattgtaagccatggagttaaccaaacttctctgacatgagtgtttctgcttgtagctaccctggacattttgttattcacagacaattgtcttgttttaatccttttcaaagatggtttataatgagctatagaactttaacaggtgctctcaaatacagacttctgataactttggatattgtgacattggaatacaggaacatgcccaggactcatgaagagctgaaatgttcatgaatatcaagcaaaacaggagttaactaaatggactgaactcaggaagctgaagcaacctttttgactttcgcttggaatattgctaatccatgttttgtttttcagagtcaaggaaacttattttggactatttacggcctttaataattgagtaaggtatactcctatgaatgaaatttgaaacatgttggttactctctgcctggttcctctagaatttagaaactatctgtgagtattcttatgacaatatagttatgtgcatcagtgcaataagaatccatttttcttttgcaacaggacacaattggagaaagtagttattttaccaaggctttgactggaagggtatgcttccgtttgaggagtgaagcttgacttgcagagccaataaaagccccatggggaaactggcctcatacccttgtctatgctgtccctgtgcagagttcttgacctgtggtcagtaaagaatgtcactttataacagggataggagctccaagtttatcttgggacctttggagaggatcacccaactcacaagtatttgaagatgaaaacccatggctgggcttggttttaaaaggtcttatccgtgattccttgtggtacacacttccatcaaagccagtccaaaaggcctatgtagaaatagttattcttgctctactttatgcaaataatcaggccaagtataagactaaagtcccttttgcaaaccactcagtcctgacataatttgttttttaacaaaaatgagaactggagagagagaaattatatttcaaaacttatacatttgtcattaaattctaaactcactagctgtttttaagtttttgtctacattttagactaaccctgcttgttcctttgaaccaaggagcaatctccagctgtagctccgaaagaactaaagggatgggtaatataaaaatctggatcaatattctagttctgagcagttatcctgcaaatcctgccaggtgatgggaataagtagaatatccatcacttggaagtttcctttttgggaaagtaagactgagggagctgaccaaggctgggcaccaggcagccaaatcctagcaagcataactatagctaccaattatctgggtgtgtaacaagacatcctttcctctcccttggaggagaactcagttccacagctttacttagcctttggtttatgataaggagtccatgcaacccccctgagatacattttgtctcagactcaattccaagcttcgggtcaaagccctaggaaagaaaattgtatctaagggatccagaagcaaatgataatgaaggttaaaacacacagtgcaggtgagcgtggctgattactgccaattaaggcaaccccaagctttttgtttcatggataaaagccacattaatatccatggcataaatgaggtctagggaactctaaggctactaagactaggtaggaaagagacataggtgacagcgaataattcctattctctaggccctctctgcttcatgggtacagccactttggcactcatggcagcacctgccaaggttgccagaactcaggaatacaaggatggaagagggaaagtggacgctcttccctctctccctgaagtacccctggtatctgttaggaagagaagagaaccagggacacctgctcccttttttctagatgggtagccactcaccttcagtctgtacccatttcaaatgcatcctgaacccttgggactcctttaaaaaatgctttatttttcctttctcttcctcggttctctcttcagataggtaattgtgtctccataccatgggacactcccctcagatgcatcctccaaactgaaaagagttaatttcccaaaccttaaactggtcgacctaggtttgggcttagggaagggaacccggaagtccaacatgctggccaaagggtaaagctttttttaaccagtcggacttttggcttccctctctctgtgcaaactggtaaaaggccttggaatttttgagctgtccttaaccctccccttgtttcattttgatacatgtttcctaataatctggtttgtctgttcttgcattcaggccatcaaactccagtcacacaactggagcctcagatgatggcccctcctaccaggaacacttaggcttctagggaagctctgactgccatttccccaaaacagcggcccatgtcagcaggaagcatttaagatcagtcttcatccttatccttaatctaacatcagttagatgtacttctttggaggcaggaatgagatagtcagatgggaaagagtccctggagaaactccaaccagcctgcccattggggtggagcctcaggaagttcacgacatttgcttcagggaggagcctggcccctcttcttcctgtgtggaacctgcaattcaagaggcaggcaggaagcactctatctagcaaagggactttggccttgtaagagtccctgttttccccttttttcccttttcatgcaataaaaccctgctttactcaccctttaaaccatctgtgagcctaaattttcatggccatggggcagacaagaaccacgtctttagctgaactaaggaaaagtcctgcaacataatgactggtcaatgtagatctggcccctttgcctcaatttaggacaactctgaaaggatatctgagtttcagagctcctgtggatcagtggaggatattatgatagccacttttcatgtaacacgtcactctgcccaatcctacattctcactaactcataagtattgttcctgagcacacttcctaataaactttctatgtgcaaattcttcatctcagaatctgcttttcagggccactgacctaagatgctttgtgcaaggaattatatgaaaaaaaaagcagacagtttttgagctgcaacacccagtggctctctggccagtgagaactttattggtggtgtaagtaaaaactgataattcttagcatgttataatgatgaagttactaaaactttcacctgtggtgaactgggagaaaaaaaacagagggaaggaatgcactggtagttatgacatcccagtcacacaagaggttttggggaaataataattataaaaaccatggatttgaatggatgttgttgaatgtgatcaaagctttaaagaaagacaatgcaagactaaaggtgattaatcaccaatatgaggtaaaatgtaaaagtcagagaactcctgagctataaagatacttatgtcctacagccacacctggctaattttgtatttttagtagagatggggtttcaccatgttggccatggttggccaggctggtctcaaactcctgacctcaggtgatctacccgcctcagcctccctaagtgctgcaattacaggcatgagccactgcagcgggtcaaatatttttaaaataaactttactacagcaataaaagagggtactggcactcaaaacctagaaaccactcaagtacctcaccctaactacaaagaatcttctatcattgctggctcaagaaaatttaaaacatttccaaatgaaaagaaaaccaaaaacaataatcatatatatctataacaagaaaaaaacagaaaatgtgatagtggtattgaggttctgtcagagactatctttgttcttaggagatatatactaaaacctttagggctgaaatgttacgatacttgcaatttaatttcaaattattcagcaaacacacacacacacacacgaagacataaagtttagtaccagttagcaaatataaacaactatgtcttctttttacttctttattccttttcatttctttttttttccctttgttccttcttttttcttttcttttttttttatcctggaacattttctacattcacaagtaaggtattatttctctagttgtaatgatactggatataaacatcctcatttctgaccaaactgatcaaatatcacagaagaataattgtatgaccttgtagaatattggagaataagcaaaatgcattaaataactactggggactatgttgaaaacttttgaaagttcaatacacatagatcttcacagttaagaagtgatgtgatgatttcttgcctaatcaaccagatcaaacacccgaatctaaaactgctcttttttcgactgggcatggtggctcacgcctaaccccagcactctgggaggctgaggcaggaggatcacttgaggccaggagtttgagaccagcctgggcaacatagccagacctgtttctatgggaaaaaaaccaaaaacaacaacaaaaaaactgtccttttcagttgtcattcacaacaaaagttgttatataatcaatcaatgtagttttattttttcagtatttttcagtactcctttgtaagtatacatacccacacaggtatttcctgcttatgctactagtctaaaagtcactgatctaattgtttaattcaatttgaacagtaataaggacaacataactcacatggaagcatttgataatgatttttgactgtgctcttgtaaagcaagagaccatgatgatttgatttagacagcagttatgacaatacaatttgcattcagaaacttaataaacactttaattgtgctcttggttgactctccccaagataagatatttagagatacagagagaagtctaagtaaacacaggatgccacatgttagaaaataagtccaatgagaaagaaaaatgccaagtatacatagatattaatattttacatttgtatatactcccagttaacaaagcaccattgcactatttcaacctaataagtagttatagagcacatactcaaggcactataccagacagtctacgaaaaacaaaaaatgaatacatccccacagagggcttacaatccagtagaagatatggtctgcttaactcaaagaaatagaaattgtagagatgcaaattgttataggaatatagagggaggagagatgaaatctaactggaggtgtcagggaagacttcattcagcaagcagtatttgaatttgggccttgaaaaaataaaacatcatttgattaaaatcaaacattataagacaatcatagaattcactattatgtcaatctcataggtcaagaaactgaggctgaaagaggctaagaggactctcctactcatggtcttacaactggtaaatgtcaagaggcctgaaccaagtttttttattcctttatttagtgctcatttactatatcactctataagagttgtcttaatctgggcaagagagcagatgttctttcagtatagtaaaaaactttttaaaaagactactcatttctgctataataaacttggttgtcctttgtaaaccatatgaaaataaatgttcttatcctctaaatgttaatgttattccctactgtaagtacagaaaattccttacggtatttcaagtataagtactggaaaaatcagatctttgtttaaagattaagaaaccaaccattagaaaagggtgaaaaccaacttcatcatgataagtaaacagactgtggtatgatagtgagagtgataccccactactagtctttgcatccccgggaggatagaaaaggagaggacaacaggattaagctgtactggatataaggtaaattttttccaatgggaaagaatacccaagaaaataataacacatgtgcgccttactatatgtcaggcactcttctaagcaccttgtacttaattctcaaacaactccatgaaataggtattattattaccaccctttatggataatgaatctaagccacaaagaaacatagccaaggtcatgtaagtgatagaggtagcatataaactgtgtctggctatagaatcctgattcttaacaattcaactctaccatctgtcaaaaagtgagattgcatactctttttgaagatggctttaaaatattaatgcaagtacaaattaaatctgtaacacataatggaagttctagtcctaggaagcaacagcttagcaaggcatctaagaacataaactttggcatcaagcataccaggttttaaggcctcagtcaacctacctgtgtgaacttgggcaagttatgaaagcttgagtttcctcctttcgaaaggaggcagcaattattgtgctttgagatgagaatgggagcaagcagcacagtatggtaagaaaagtactgggcttgaatgtctaaaaattcagattataccctcagctactaaccagccctgttaaataaaataacccatgaatcaacaaatatttataaagctttatatatgactctgttgtatatactctagggatatagcggttaaaaaagacattgttccttagtttctgagagctaattcattcaagtttgctcattggtttccttaataattggactcaagccccaaattaaggctgtttggcatttatattctatgattctgagacagaacttgaataacaataccatggtggctctgtttcttgctaagtgcaatttgtgtgtgtatacatatatatatatatatatatgtgtgtgtgtgtgtgtgtgtatacatatatatgtgtgtatacatatatgtgtgtgtatacatatatatacacacacacacaaacacacacacacatacatatatatatacacatatttcaattcctccttttattagttataaggagatttgtacagaaagaaatagagactgaatttccagtcactacctacagctgctataaccagctgttcccacatattttcttcatgggacaacatttttctggaatgtagattaatacatgacacttcattgagccacagtaaaagaaagcagaatcaatgtgatttacagaaacttcatggaaaatattgtcttttttctcttcctccaaaaggagctcagtgacaattccaaacaattcatacagaaattggagaaataattttcacatcttgaacatatttccattcctctagttgacagggactggcaatactactgtgaattttttgtgattattcatgaaatgaagtctcataatggtaagagcatcagctttgaggtcagattgtcaagcacagagataaatacaaatatacatagatataaatcccaatttcatcacttacaagctgggagactttaactgttttgaccttcagtttcctcatatgtaaaatgaaaatgattatacctattttctagttaccaaattagataagacttggtatatagcacttcatttaattacagccattaaacttataatcatccttagctgttaaatatatatatagatagatgtgtgtgtgcaagaagaaaaaaatgaactatcttttcaaaatctaactgatttttatacaagaaaaactactacttcagctattttacattaaatcaccacttaggaaataaaatagacaacacctcctaaattcctttgtaggcagatcaatatttaatacatgccattaaaatattttgcagtttagtactaaaaccacaccaaaatggcaaaccaaattacaagtttattctcaatacttacaagatttcatacataacaaaagtttgaatacatctttccatgtacctactattaaaattatactttaggtattctgacaggaaaaatacacataaatttctaagtaccacttcaagttacgagctctaattttgcatcccctttaccagcacttaaattgctggttttataatcataaatgtaggaataacaagcaaaacaaagcaaataatacataacttcagaattcaatatttgtgagcaaatcattgaaatatttcaagtcaccagtcatgcttcattcaccataagtaggtcaacagaaaagtaaattaacttacaatgaacaagaacttccttggactccatgaaaatgcggagaagagtgggatgaacttagacttttacacataaatgtctgctagtcattgttagactccctagctctgtcccttgctcataccacctcatcaaacatacaaccacagacgctcctccctaacagctgacttttaatcctgtctttaggtttaaacaagatcctttcaaagatatgtagcatgtgatatgaaagtcaccaagaagaaaattattttaaaaaatcatctcctagtacaggaatgctctatctccctacatgttcctcagaaaaagcagattgacttaagagtggaacgataatttgttttcacaccagttgctacattgaatatattaagactacccaaaacaagtctcttcttagagctggaggatgtgcactctgggatataacaaaaatgtcaaagccatttgggtaccaataaaaatgaaacattaatgttataaagtcaactattataatcaggctatattacttccaggaaattagtaaacactatctaatccaggctctcccacaacacaaaagcctagagccagtggattggcaatgatattatagagattgcaacgatacttctggctgctgtttttccctactataccatgtaagatatgaaggagttctcttcacctaactccctcaaatgctaaatggtggtggtactttttactcacagaaaataatttcaattccaaaaattcactagctgtttctctttttttatatgtcacaaaatgtcacgttttcttatttacaagccttatcacttacaaatatttgagaataattacataaaagatgaacatcatttcctattactatctgtatcaacaaaatataaaagtactacgtttgattttccacaaaatattgcccccaagatttttacacacataagaactcctcacctaaatatcacccacagctaacattcatttgatgcataactactgaacctagctgtgctagaccctagagatacaaaaaatgtaagacatgatcctttgtgaaaaagtttacaatatatatagtgtttattccagtggtatacaacaatgttgccacattgaaattctccctcaatattcccttttcaaaaatctctgcatcgaaatacgttccatatcattttatttcattaaggtaaattctggtcaactatactgaataaaagaatatttaaaagtgaacatgggttgggcacagtggctcatgcctgtaattccagcactttgggaggccaaggcaggaggatcacctggaggttgggagtttgagaccagcctgaccgacatggagaaaccctgtctctactaaaaatacaaaaatttactgggcgtggtggcacatgcctgtaatcccaactactcgggaggctgaggcaggaaaatcccttgaacctaggaggcggaggttgcggtgagtcaagattgcaccattgctctgcagcctgggcaacaagagtgaaactccatctcaacaacaacaataaaaaaaagtgaacatggaggagtgacagagaaacagagaagcatcataactagttaactatgcatcaaattggatttgcacattgaaggccagtttatttctatagaggctattgaggataatccaaggaatgacaacacttataggagtccagaattcttactagactgatctaaacatttaagtcatccagttgtccaatcagagaagatcccctgaagcagcaaccacaaactcaaaactctaacaagaccaagggaaaaatgtaaatgagtagcatcggctaagagttacagaaaaatcacatgaactttttggtttatcttctatttcccagaaaaacttaggtaaaaatgaatatttctctactataagaaaaggaatgttgaatgcaaatgcagacaacttatactctgcttcagtataagagataccatcaggagtgctagcgactgtagtctaatgaagagagcacagccatgcacttaaagtatgcagcaaccattgccatgtacaaatttgagccaagtattattattagactttctggtttttcaagtgaagccagaaattcagatttttgtgtgaagtttcctaatatttgtatgttagttcaatgtttaaaaaaattggtaggttcaaatgcatcagtctgtataacagatccagcctcttcaacatgaataaagggtatctatgaaaaactcacagctaacatcatacttaatggtgaaagactgaaaggttttcccctaagatcaggaacgatacaagaatggctgctctctttatttctttccaaaattatactggaggttttagccagggtaattaggcaagaaaaagaaatcaaagtcatctagactgaaaaggaagaaatcaaattatctctagttacaggtgatatgatctcgtatatagaaaatactaaggaattcacacacaaaaaagaaactattggaactaataaatgagttcagcaaggttgtaggatacaagactaatacacaaacattaattgtattttatatactagcaatgaacagtccaaaaataaaatttagaagacaattccatttgtaaatttttttttaaattattaataagtttaacaaaggaagagtaaagcttgcacactaaaaactacaaaacattgttgaaataaagtaaagatatagataaacagacattccatattcatgaattagaacgcaatattgttaagatggcaatactccctaactgatttacagattccacatgacctttatcaaaatcccagctgagtctatggtcataacaccctgaaaacaaaaaatctcagatgacttttttctagacattgacaagctgatcctaaaattcatacggaaatgcatgggacccagaataaccaaaacaatcttgaaaaagatgaacaaagttggagaactcacacttccctatttcaaaacttacttctgtaatcaagacagcatggtactgacataataaaagtcacacagattaatggagcagaattgagagtccagaagtaaactcacatttatggtcagctgattttcaacaatgatgccaagacaattcagtgtgaaagaataatcttttcaacaaatgttttggggacaattgaaaattcatatgcaaaggaatcaatttgaacctttatttcataccatatgcaaaaattaacacaaaatggatgaaatacccaaatttaagagctaaaactataaaacccttagaaaataatattaagcgtaaacctcatgaccttaggtgagtgaactatttcttagacacatcaaaagcataagcaacccaaaaaatatagacttcataaaaatttgtactccaagtgaaactatgaataaaatcaaaaggcaacccaccgatgaaaaataacatttgcaagtcatttttgataagggtttattattgagatatctaaagaactattacaactcaacaacagaaagacaactcaatttattaaatgggcaaatatttgaacggacaatttgccagagcaaatatacaaatggccaataagcacatgaaaagatgttcaacatcattagtcattagggaaatgcaaatcaaaaccacaatgagatagcacttcacgtgagaatattgtggctacaataaaaatgacaaataataagttttgcttaagatatggagaagttgtaatacattgctagtagaaatgtaaaatagtgcagtggctttggaaaaagttgtcagttcctcaaaaagttaaacataaagttaccatatgaaccagcaattctgctcctcagtatagacccaagagaactgaaaacacatccacacaagaatctgtatgcaaatgttcatggcagtattattcataatagtcaaacagtagaaacaaaccaaactttcatcagctgatgaacagataaataatatatagtctatccatacaacagaatattattcagcaataaaacagaattaagtactaatgtctactaaaacatggatgaccttgaaaactttaagtgagagaagccagtcataaaaggctacatgttgtatgatttcatttatccaaaatccagaaaaggcacatgtacagaaagtagattagtagcctaggtgctgaggataggggatgtgaggagtaactactaaggggtctgaggatcctcgggggtgataaaaatgttctggaattatatagctataactgcataactttgtaaacttactaacaaaacgctgaattgtgtactttaaaggataaatgttatggtatatgaatcatatgtcaataaagctactagtaagaacaaaaataagcccagcccaaccactttgcaacatttgcctaaaaggagttctacatcaaaacggctccttactaatatttaaacggagttttgcaaatattagcacacggtaagtagagtgctcagttttctaacgtcaactatccggcataacctatttcaatatttcaaataaaatacagcctttaaaattttagtaataacaatgattttcagaaaaagaatacttcaatgctagaaattgcttccttctgcctaataaagttatatcttttcatccacaatccagttagccaatctttccaattttacagcttatattaataacttccctataggcttcccacacttctgccaagttagatcctttctgtgccttgaaaacacctcaggctttcttaaatgtgctccacctatttggagtgcccttctcccctacagaaatatctgaactatacctactcgtcaatgtttgaaatgccattgctttttctgattctccttcaaaatcaggttctgactctaagtaaactgtctcctagttaatactcctttatatctttcctaggatactttttattgaattttatgtgcacttgtctcctttccccctactgaacagcaggtcttataatacatatgaaagtccaacatgtgccaggtacatcagttctaatcctcacaacagccctgcaagaaaggtattattcttattctcttatagatgaagaaattgaggatttgagaggacaaaattacttattcaaggtccaataataagtggaaagtctgagatttgacattggttcatctttggtggcaactttgtttcccagaaattgacaagctgatcctaaaattcatatagaaatgcaagggatatttgaaaaaaaaactttgcatttaataggtcttcaaagatggttcattgaactattaattggaactcatatcaaaaagctagttacttaacttgagcataggctttagagtcatactcaccttggttcaagttttatcttccctatttataaactgagctgaggtaagttactaaatattttttgtttgtttttttgtttgtttgttttgagaaacagtctcactctgtttcccacgctggagtgcagttgcatgagcttggctcactgcaacctccacctcctgggttcaagtgattctcctgccttaacccccaagtaggtgggactacaggtgcatgccaccatgctgggctaagttttgtatttttagtagaaacagggcttcaccatgttggccaggctggtctcaacccaacccctgtccttgagtgatccacccacctcggcctccaaaagtgctgggattacaggcgtgagccaccccacctgaccaagttattaaatcttagtctcaatttcctcgtttgtaaattgaagattataatatttaggtaactgcattctcatcaggattaaatgagaaaaaataaaattacattcttagctcatagtgggagctcaatagatgtggattttcttcctgtttatacttttttcccctgtgccctgcctcctacttacagtggcttaatgagaactaattctttgagaccagcaaatatgttacacttctacaactctttagccttctggctcaatcattagtacaaaattatctactttatagaaggactgtaaaaaataaatgaatgtatctgagtcagtggctctcaaataatattttagcagcagagcctgatagggttattttatggaagaaatgtgcttgaataggaaatgaggagataagggctgcagtccaggttgaagcatataccactgtgctccacagtcagctcttcgtggaagggtagaaggagcagctataggttttttgtttgttttgtttttttaccaaggagtagggaagttatttcttcccaagttttataaaactctttataaggatgaataaatagaaactagaatcagaaggaaaaacacaaatgaattatttgtagagcaaacctataagtggggaaattccaatctaatgataaacatcagaaatccaaagaggatcagatgtctcatgcaagatccagccaagatttaagaaataaataagtattttagcctgttcacatcagtaaactccatgtttttattcctaaaaatctcacttaggcaagctatgctaaggctgtgaaactgattaatttaaaagctatttttcctcccctgaggccagaagggatttttgaatgatgcaagaaagaaagagagaataatagaaacaacaggtgctctgaacagctgtggggagagaactgaacttttcaagatgatcttaagaactaataaattgttaaatccctgtttcagaagagacacaataaacaatgcacctctaaaataaaagtttccctttactccaccccacattccctgaaaactgactttacccacgattagttgacgattccctgagatgtcagagttcatcctcgaggagaattagtcttttaattgaaaatccttttacatgtgttttctttaagagaaaaacagaaatttaattggttactgaaatttcatttttaaaattctgtgatccacaaacttgaatatgtcttggaggaaatatgaaattgtggaagaatcacagactttgaaatctaaaaaatcaggttctaacacattctagctgtgtgatttcaggtttgtaataataatgcctacataccacctattattctaaccactttcatatgttaacttacttagccctcagaataagtctctatgtaggtattattattgattcactttaaagacgagaaaactgatgtttggtaagataaaatagtttgatcaaagcttcacaattaataagtgacagaactaggatttgaatgtcgacaccctacctccagagacaacattcctatctcatcacattgacttctgacgtgcttttctgattttttttctgtgttgttcttttttcaactgtaaaatgggatgaattcgtaggactattttaaatactaaataagataatatatgtaaagtacagttccttgcacataggtacatgacaaatagatttttatatgataattattaacatagattatgttatagggtctcaaattagcccctgtatgatttacagaattgtattttctcttcattaaataactatggtatatcctttaaaagaaaggagcttatctttttatttctgtttgtagctgtgcctaccacagagaagatgtttaataaatgatagtgaaaaaagaaaaaaaggaagggagaaaggaagtaaaacaggaaagaaagagagaaagagagggtaagacaataggaaggcaaccaaaaaaaaaaaaaagttaaagaatatcctttcttttttttttcttttttttttagatggagttttgctcttgtcacctaggctggagtgcaatggtgtgctcttggctcactgcaactcctgggttcaagtgattcttctgcctcagcctccctagtagcttggattacaggcacacaccaccacactcagataatttttgtatttttagtagagacagggtttcacctgtctggtcaggctggtctcaaactccttacctcaggtgatccacctgcctcagactcccaaagtgctgggattacaggtgttagccaccagaatatcctttcttaatgaaatatattttatctttgtgaagaacattccagtgcacaccaattattgcaaattgtactctacaacatttttataacatttccttgtcttaatttcaagcagttgttccagtaaactataagatgatatttagtccattctacctcaagactattaacttgtatgaaaagcaggtaataattttagactaaagggagttctcaatttttccaaaaaatcagtgtttgttttaccatttaaatacaagccttactagtgagttctcaatttaattacactcaatgtgtaacattttcaaaagtaagtttgaggaagggccacaatatggatcctagccatgtcagctgacaaatgaccagtgtatgtctagcagctgtggatgctgaataatgcaactaatacagctgtcagtaagtcaaatattttgtttaggacctcaataatggatcaatgagtatcagctaatttctgaccaccatgtgcaaaagggcatcctcttactttctgtcaagccagtaatatttgaagagggacatatcactctgagtcaatatatctaaaatgataggtataaaatctttatctttaaaagtggaaaatctagaggggaaaaaatggcagacaggaaggaggcaggactaactggcagctcctactcagaggaacagagcagcatttggaaacccacgtcatgaacttttctccaagaactaccacaggtacaaccaggaaaactgagagaatccacagaccatttgaaggaggtggaatgccactgcagaatccatgggacagctgaggaactgtgagtctgcttgctttcttagctgggaggcttgtagcctgtgacaagtactcagccctgctcactggctgcctggaaataaatttggtgctgttgggggtgtgggggccacagtgggagtgagactggtcttttgggctgcaggtggcatgggagctggttgaggccagtggctgctagcttttccccacttccctggtgacccgtgtgacccagcagagacagccataagtcccctgagaacataattccattgacctgggaaccacacccccagcccccaaaacaaagcaagccctgcttaaggagagtctgagttcagacatgcttaaccctgtccccacctgatatctttctctacctgccctggcagccaaagacaaaggacatatctcttgggagctctatagccctgcccaccacctgagaaacctgaatacttatccaaaggctaccctaggaaaagcttgtgtcctccctatataatcacagctgatatgctcttgaaagcaccaccttctggctggaggtcaagcaccacaaaaccagagcacttaaaaaagacacaagcaagcgctcatacagagaacacttcactcccctgctaactccaccagagtaggtgctggtatccacagctgagagacctgaagacagatcatatcacaggactctttgcagacactacccagtaccagccagaagcctggtagctcctttgggtggctagatccagaggagaaataacaatcactgcagttcagctctcaggaagccccatccctaggagaaacgggagagcaccacatcaaggcagcaccgccatgggacaaaaaaatcggaacagaagcccttgagtcccagatcttccttctgacaaagtctactcataagaagaaaccacaaaaaaacaattctggtaatatgacaaaacaaggttctctaatgcccccaaaagatcacaatagctcatcagcaatggatccaaaccaagatgaagtttctgaattgccaaaatataaaaaattaagaagggtaattaccaagccaatcaaggaggtaccagagaaaggtgaagtccaaataaaagaaatttttaaaaaagatacaggataggaatggaaaaatctccagtgaaatacatagaataaataaaaaacaatcgcaacttctgaaaatcaaggacacacttaaagaaatacaaaatgcactaaaaagtctcagcaatagaattgaacaagtagaagaaagaacttcagagctcaaagacaaggctttcaaattaacccaatccaacaacaacaaagaaaaaataattttttaaaaatgaacaaagcctccaagaagtttgggattatgtgaaacgaccaaacctaagaataactgatgctcccaaggaagaagagaaatctaaaagtttggaaaacatatttgagggaatacctgaggaaaacttccctggtcatgctagagatctagacattcaaatacaagaagctcaaagaacacctaggaaattaattgcaaaaagagcatcacacaggcacacagtcatcaggttatctaaagtcaagacaaaggaaagagtcttaagagctacaagacaaaatcatcaggtaatgtataaaggaaaccctatcagattaacagcagttttcttggcagaaactccataatctagaagaaattagggtcatatctttagcctccacaaacaaaacaattatcagccaagaattttgtatatccagagaaactaagcttcataaatgaaggaaagatacagtctttttcagacgaacaaatgctgagagaattctccactaccaagccagcactataagaattactaaaaggagctctaaatcttgaaacaaatccttgaaatacaccaaaataggatctccttaaggcatgaatctcacaggacctataaagcaacaacacaatgaaaaaagtactcaggcaacaaacagtatgatgaatagaatagtacctcacatctccatactaacactgaatgtaaatggcctaaatgctccacttaaaagatacaaaatggcagaataataactcaccaaccaagtatctgctgtcttcaagaaactcacctgacacataaccactcacataaacttaaggtaaagggatggaaaaagatattccatgcaaatgaacaccaaaagggagcagaagtagctattcttacatcagacaaaacacacttaaagcaacagcagttgaaaaaaaaaggagagacattatattatgataaaaggactagtccaacaggaaaatagtacaattctaaatatatatgcacctgacattggcactcccaaatttataaaacatttactactagacctaagacctaagatagacagaaacacaataatagtggggacttcattattccactggcagcacaagacaggctatcaagggagaaagtcaacaaagaaagagtggacttaaagtataccctggaacaaacagacttaacagatatttacagaactttctacccaacaactgcagaacaagtctcaacaaatttaagaaaatctaaattatagcaagtattctctcagaccacagtggaaaaaaaatgaaaataaacaccaaaaggaaccctcaaaatcatgcaaatacataaaaattaaataatatgctcctgaacaatcattgggtcaaaaatgaaatcaagatggaaatttaaaaattctttcaactaaacaataagagtatcaaaacctatcaaaacctcttggatataacaaaagcagtgctaagacgaaagttcatagcattaaatgcctatatcaaaaagtgtaaaagagctcaaatagacaatctaaggtcacacctcaaggaactagagaaacaagaacaaatcaaacccacacacagaagaagaaaataaataaccaagatcagagcagaactaaatgaaattgaaacaaaaaactgcaaatgatatatgaaacaaaaagctggttctttgaaaagataaataaaattgatagactattagcaagattaacaaagaaaagaagagagaagatccaaataagctcaattagaggaaaaacaggagatattgcaacggataccacagaaatacaaaagatcattcaaggctattatgaaaacgtttacatgcataaactagaaaacctagaggacatggataaattcctggaagtatacaaattcctcccagattaaaccagaaagaaatagaaactctgaacaggccaataacaagcagcaagactgaaatggtaatttaaaagttgccaacaacaaaaaatagtccaggaccagatggactcacagctgaattatatcagacattcaaggaattggtaccaatcccattggtactattccaaaagataaagaaggagggaatcctctctaaatcattctatgaagccagtatcactaatagcaaaaccaggaaaggacataaccaaaagagaaaactacagaccaatatctctgatgaacataaatgcaaaaatcctcaacaaaatactagctaacagaatccaacagcttatgaaaaagatcatccaccatgatcaagtggatttcataccagagatgctgggatggtttaacatccacaagccaataaatgtgatacaccacacaaacagaactaaaaacaaaaatcagatgatcatcttaacagatacagaaaaagcatttgaccaaatccagcatctctttatgattaaaattctcagcaaaatcagcatacaagggacacaccttaaggtaataaaagccatctatgacaaacccacagtgaataatatactgactggggaaaagttgaaagcatccctgctgagaactggaccaagacaatgatgccaactttcaccacttctattcaacatagtactagaagccctagccagagcaatgagacaagagaaagaaataaagggcatccaaattggtaatgaggaagtcaaactctctgtgtttactgatgatgtgattacatacctagaaaaccctaaagactcctccaggaagctcctagaactggcaaataaattaagcaaagtttcagaaaacaaaattaatgtaaaaaattagtggctctgctatacaccaacagcgaccaagttgaaaatcaaatcaagaactcaaccccttttacaatacctgcaaagaaaataaaatacttaggaatatacttaagcaaggaggtgaaagacctctgcaaggaaaactacaaaacattgctgtaagaaatcatatatgacacaaacaaatggaaacatatcccatgcttaaggatgggtagaatcaatattgtgaaaatgaccatactgccaaaagcaatctatgaattcaatgcaattcctatcaaaataccaccatcattcttcacaaaactaaaaaaaaaaaaaaatcttaaaattcatatggaaccaaaatagtctgcatagccaaagcaagactaagcaaagcaaaacaaagaggaacattatataatgaaaaagaacaaatctggaggcatcatactacctgacttcaaactatactataaggccatagtcaccaaaacaacatggtattggtataaaaacaggcatatagaccaatggaacacaatagagaacgcagaaataaactcaaatactcacagtcacctgatcttcaacaaagcagacaaaatcataaagtgggaaaaggacaccctattcaacaaatggtgctgggataactggcatgccacatgtggaagaatgaaactggatccttgtctcatctctcaccttacacaaaaatcaactcaagatggatcaaagactgaaatataagagctgaaaccacaaaaattctagaagataacatcggaaaaacccttctagacattgacttaggcaaagacttgataaccaagaacacaaaagctgatacaacaaaaacaaagataagtagatgggacttaattaaactaaaaagcttttgcacagcaatataaataatcagcagaattaacagacaacccatagaataggagaaaatcttcacagtctatacatccaacaaacaactaatatccacaatctacaagaaactcaaatcagcaagaacaaaacaaacaatcctatcaaaaagtgggcaaaggacatgaataaataattctcaaaagaaaatatgcaaatggccaacaaacatatgaaaaaatgctcaacatcactaattaccaaggaaatgcaaatcaaaactgcaatgtgataccacctcactccttcaagaatggtcatattcaaaacaccaaaaaataatagttgttagcatggatgtggtgaaaaggaacacttttacactgttggtgggaatgtaatacaactactatggaaaacattttggagattccttaaagaactaaaagtaaatcaaccatttgattcagcaatcccactcctggatatctacccagagaaaaagaagtcattatatgaaaaagacacctgcacacacacgtgtatagcagcacaatttgcaattgcaaaaaatggaccagcccaaatgcccaacaatcaacaagtggataaagaaaatgtggtatatatatatatatggtatgcatatgtgtgtgtgtgtgtgtgtgtgtgtgtgtgtgtattcaggttgcagcaaatgtcattatttcattcctttttatggccaagtggtattctattatatgtatataatatgtatgtatattttatgtatatatgtggatggaactggaaaccattattctaagtgaagtaactcaggaatagaaaaactaaacatcttatgttctcactcataaatggaagctgagctatgaggatgcaaaggcataaaagtgatacgatggacattggggactcaggagaaagggtgtgagagggatgaagaataaaagactacacactgggtacagtgtacactgctcaggggatgggtgcaccaaaatctcaggaatcatcactgaagaacttattcatgtaaccaagctccacctgttccccaaaaaaacctattgaaatattttcaagtggaaaatctagaaaaaagaatctatatatcagcagaagacaggttgtctgcccttaacttctgttcctttttatctttttgtttaaacatctaaataactataagatgtatatacttgaagatattttaaaacaaatgaggtaatatatatgttaattagattgatttagccattccactatatatcagtgtaaatcaacacatcatgtggtacaccataaatatatttcatttttatttgccaactttttaaaagtgaaagatctgcttaaaaaacattagtacgtttaaaatttttaacaaaccaatgagcatggcaatagccactttcagataaaaagagtaaagctttggaagctaaagcatcacacagcaggtgagtgacagcaaaagacaacactgatgtctgtgccacctgcagcagatgtcaggccccgaccctgccaaaacacactgaaatgtgtaaacatctctgatttagcactaaagttggttagaataattgttgacttctcaaaagactgagaaaatgtaacttaacattcagtaagtattttattaactcaagacatttattgagcaatgaatcactgaataaggcccagccattcaagaataaaataaggcaatttccctattctcacaatctagggtgagacagatattataaagacaaaagtgactccatctcagatgctaatctgccatgttgacttctggttagccccaacaccatgaatgcctcctaattcctacttcatttactgttcttagtgtaagaacatgtgaaccttgatgttaccacacaaattataggttatgatgaatatagcattcttgcctgttctgcagggctccaattaattgtcttgctggaacatgtatacttttgcactatgatatataagccctgggcctaaggagtagtaccagagatctacctgtcttgcaaatgccaaagaccatgcttctgtctgtaagatctcccagtgaaacactcttactgacaaactggatttgtctgcctctttctttgtttatctgttcctttggcacttggggacaactttgcataaacagccctttcatggaacaggtacataaacatataaatgaaaaaagtgttaataaagatcagaatgttaggatatttaggaagagcctcacagaagagtaacatttaagctggatcaagaaagataagaagcagttgcttccagggtggctgaataggaacagctctggtctgcagctcccagcaatatcgaggcagaagaggggtggtttctgcatttccaaatgaggtacctggttcatctcattgggactggttggacagtgggtgcagcccatggagggtgagctgaagcagggcggggtgttgcctcaaacaggaagtgcaaggggtaaggggattccactttcctagccaagggaagccgtgacaggccatacctagagaaacggtacactctgagccaaatactgcacttttcccacagtcctagcaaccagcagaccaggagataccctcccatgcctgactcagtgggtcccctgcccacagagacttgctcactgctagcacagcagtctgagattgacctgcaatgctgcagcttgacagggggaggggcgtctgccattgctgaggcttgagtagctcacagtgtaaacaaagaggccaggaagcacaaactgggtggagcccaccacagctcagcaaggcctactgcctctatcgattccacttctaagggcagggcatatctgaacaaaaggcagcagacagcttctgcagatttaaacatccctgtctgacagctctgaagagaccagtggttctctcagcatggggtttgagctctgagaacaaacagactgcctcctcaagtgagtccctgacccctgtgtagcctgactgggaaacacctcccagtaggggccgacagacacctcaaacaggtgggtgttcctctgggacgatgcttccagaagaaggatgaggcagcaatatttgctgttctgcagcctccgctggtgatacccagtcaaacagtgtctggagtggacctacagcaaactccaacagacctgcagctgaggggtctgactgtttgttagaaggaaaactaacaaacagaaaggaatagcatcaacaacaacaaagaagacatccacaccgaaaccccatctttaggacaccagaatcaaagaccaaaggtagatataaccacaaacatggggagaaacaagagcagaaaagctgaaattccaaaaaagagagcacctcttttcctccaaaggatcacagcttctcaacagcaagggaacaaaactggacagagaatgagtttgaagaggtgacagaactaggcttcagaaggtcggtaataacaaacttctccaagctaaaggagcatgttctaacccatcagaaggaagctaaaaaccttgaaaaaaggttagacgattggctaactaaaataaacagtgtagagaagatcttaaatgacctgatggaggtgaaaaccacagcacgagcacttcgcgatgcatgcacaagcttcaacagccaattcaatcaagtggaagaaaggatatcagtaattgaagatcaaattaatgaaataaactgagaagaaaaggttagagaaaaaagaatacaaagaaatgaacaaagcctccaagaaatatgggactacgtgaaaagaccaaatatatgtttgattggtgtactggaaagtgatgcggagaattgaaccaagttagaaaacactcttcaagatattattcaggacaacttccctaacctagcaaggcaggccaacattcaaattcaggaaataaggagaacaccacaaagatactcctcgagaagagcaaccccaagacatataattgtcagatttgccaaggttgaaataaaggaaaaaatattaagggcatccaaagagagaggttgggttacccacaaagggaagcccatcggactaacagcagatctctcagcaggaaccctacaagccagaagagagcaggggccaatattcaacattcttaaagaaaagagttttcaacccagaatttcatatccagccaaactaaacttcttaagagaatgagaaataaaatcctttacagacaagtgaatgctgagagattttgtcaccaccaggcatgccttataagagctactgaaggaagcaccaaacatggaaaggaacaacaagtaccagccactgcaaaaacatgccaaatggtaaagagcatcaatgatatgaagaaactgcatcaattaacgggcaaaataaccacctaacatcataatgacaagatcaagttcaaacataataatattaaccttaaatgtaaatgggcaaaatgcccgatttaaaagataaagattggcaaattggataaagaatcaagcaccattggtatgctgtattcaggagacacatctcatgtgcaaagacaaaaataggctcaaaataaagggatggaggaagatataccaagcaaatggaaagcaaaaaaaagcaggagttgcaatcctagtctctgataaaacagactttaaaccaacaaagatcaaaagagacaaagaaggccactacataatggtaaaaggatcaattcagcaagaggagttaacatcttaaatatatatgcgcccaatacaggagcacccagattcataaagcaagtcatcagagacctacaaagagtcttagactcccaaacaataataatgggtgacttcaacaccccactgtcaataacagacagatcaatgaaagaggaggttaacaaggatatccagggcttgaacacagctctggaccaagcggacctaatagacatctacagaactctccaccccaaatcaacagaatatacattgttctcagcaccacattgcacttattctaaaattgaccacataattggtagtaaaacactcctcagcaaatgtaaaagaacagaaatcacaacaaactgtctctcagaccacagtgcaatcaaatcagaaatcagtattaagaaactcactcaaaaccgcacaactttatggaaactgaacaacttgctcctgaatgactagtgggtaaataacaaaatgaaggcagaaataaagatggtctttgaaaccaatgagaacaaagacacaacgtaccagaatctttgggacacatttaaagcagtttgaagagggaaatttatagcactaaatgcacacaagagaaaacaggaaagatctaaaattgacaccttaacatcataattaaaagaactagagaagctggagcaaacacattcaaaagctagcagaaggcaagaaataactaagatcagagaagaactgaaggagacagagacacaaaaaaatcttcaaaaaatcaatgaatccaggagctggatttttgaaaatatcaacaaaattgatagaccactagcaggactaataaagaagaaaagagaaaagaatcaaatagatgcaataaaaaatgataaaggggatatcaccacaatcccacagaaatacaaactaccatcagagaatactataaacatccctacacaactaaactagaaaatctagaagaaatggataaattcctggacacatactctcccaagactaaaccaggaagaagttgaatctctgaataacccaataacaggttccaaaattgaggcgataattaatagcctactcaccaaaaaaagtccaggacaagacagattcacagccaaattctaccagaggtacaaagaggagctgctaccattgcttctgaaactatttcaatcaatagaaaaagagggaattccaacactatgttctggccagggcaattaggcaggagaaggaaataaagggtattcaattaggaaaagaggaagtcaaattgtccctgtttgcagaccacatgattgtatatttagaaaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttccaggggatatgaaggacctcttcaaggagaactacaaaccactgctcaatgaaataaaagaggacacaaacaaacgaaagaacattccatgctcatgggtaggaagaatcaatatcgtgaaaatggccatactgcccaaggtaatttatagattcaatgccatccccatcaagctaccaatgactttcttcacagaattggaaaaaactattttaaagttcatatggaaccaaaaaagagcccgcatcaccaagtcaaccctaagccaaaagaacaaagctggaggcatcacgctacctgacttcaaactatactacaaggctacagtaaccaaaacagcatggtactggtactaaaacagacatatagatcaatggaatagaacagagccctcagaaataatgccacatatctacaacgatctgaactttgacaaacctgagaaaaacaatcaatggggaaaggattccctatttaataaatggtgctgggaaaactggctaaccatatgtagaaagctgaaactggatcccctccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgaccaatgggatctaattaaactcaagagcttctgcacagcaaaagaaactaccatcagagtgaacaggcaacctacaaaatgggagaaaattttcacatcctactcatctgacaaagggctaatatccagaatctacaaagaactcaaacaaatttacaagaaaaaaacaaacaaccccatcaaaaagtgggcaaacgataggaacagacacttctcaaaagaagatatttatgcagccaaaagacacatgaaaaaatgctcaccatcactggccatcagagaaatgcaaatcaaaaccacaatgagataccatctcacaccagttagaatggctatcattaaaaagtcaggaaacaacaggtgctggagaggatgtggagaaataggaacacttttacactgttggtgggagtgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcattattcacaatagcaaagacttggaaccaacccaaatgtccgacaatgatagactggattaagaaaatgtggcacatatacaccatggaatactatgcagccataaaaaatgatgagttcatttcctttgtagggacatggatgaaattggaaatcatcattctcagtaaactatcgcaaggacaaaaaaccaaacaccgcatgttctcactcatagatgggaattgaacaatgagaacacatggacacaggaaggggaacatcacactctggagactgttgtggggtggggggagaggggagggatagcattaggagatatacctaatgctaaatgacgagttaatgagtgcagcacaccagcatggcacatgtatacatacgtaactaacctgcacattgtgcacatgtaccctaaaacttaaagtataataataattaaaaaaaaaaaaagaaaaagagggaattctcccaaactcattttatgaggctagcatcatcctgataccaaagcctggcagagacataacaaaaaaaaaagagaattttaggccaataaccctgatgaacattgatgtgaaaatcctctataaaatactggcaaaccaaatccagcagcacatcaaaaagcttatccaacatgatcaagtgggcttcatccctgggatgcaagactggttcaacatatgcaaatcaataaaagtaatccatcacataaacagaaccaatgacaaaaatcacctgattatctcaatagatgcagaaaaggcctttgacaaaatttaacagcctttcatgcaaaaaactctcaataaactaggtgttgatggaacgtatctcaaaataataagagttatttatgataaacccacagccaatatcgtactgaatggccaaaagctggaagaattccacttgaaaaccagcacaagacaaggacaccctctctcaccactcctattccacatagtattggaagttctggctagggcaatcaggcagaagaaagaaataaagggtattcaattaggaaaagaggaagtcaaattgtctctgtttgcagatgacatgattgtatatttagaaaaccccattgtctcagcccaaagtcttcttaagctgataagcaacttcagcaaagtctcaggatacaaaatcaatgtgcaaaaatcacaagtattcctatacactaataatagacaaacagagagccaaatcatgagtgaactcccattcacaattactacaaagagaataaaatacctaggaatacaacttacaaaggatgtgaaggacctcttcaaggagaactacaaacccacttctcaatgaaataaaagaggacacaaaaaaatggaagaacattccatgctcatggataggaagaatcaatattgtgaaaatggccatactgcccaaggtaatttatagattcaatgccatccccatcaagctaccactgactttcttcagagaattaataaaaaactacttttaatttcatatggaaccaaaaaagagcccacatagctaagacaatcctaaacaaaaagaacaaagctggaggcatcacgctacctgacttcaaactatactacaaggctacagtaaccaaaacagcatggcactggtaccaaaacagagatatagaccaatggaacagaacagagacctctgaaataacaccacacatctacatccatctggtccttgacaaacctgacaaaaacaagaaatggggaaaggattctctatttaataaatagtgctgtgaaaactgggtagccatgtgtagaaagctgaaactggatcctttccttacacctagacaaagattaactcaagatggtttaaaaacttaaatgtaagacctaacaccataaaagctctagaacaaaacctaggcaataccattcaggacataggcatgtgcaaagaccccatgactaaaacaccaaaagcaatggcaacaaaagccaaactagacaaatgggatctaattaaactaaagagcttctgcacagcaaaagaaactatcatcagagtgaacaggcaacctacagaatgggagaaaatctttgcaatctacccatctgacaaagggctaatatccagaatctacaatgaactcaaacaaatttacaagaaaaaaacaaacaaccctatcaaaaagtaggcgaaggacatgaacagacacttctcaaaagaagacatttatgcagccaacagacatatgaaaaaatgctcatcaccactggtcattagagaaatgcaaatcaaaatcacaatgagatgccatctcacgccagttagaatgtcgatcattaaaaagtcagtaaacaagagatgctggagaggatgtggaaaaataggaatgcttttacactgttgttgggactgtaaattagttcaaccattgtggaagatagtgtggcaattcctcaaggatctagaactggcaataccatctgacccagcaatcccattactaggtatatacccaaaggattataaatcatgctgctataaagacacatgtacacgtatgtttattgtggcactattcacaatagcaaagacttggaataaacccaaatgtccatcaacaatagactggattaagaaaatgtggcacatatacaccatggaatactatgcagccataaaaatggatgagttattgtcctttgcagagacatggatgaagctagaaatcatcattctaagcaaactatcacaaggacagaaaaccaaacaccgcatattcacactcataggtggagttgaacaacaagaacgcatgcacacagggtcgggtacatcaaacattggggcctgtcagttggtgggggctgggggagggatagcattaggagaaatacctaatgtaaatgatgagttgatgggtgcagcaaaccaacatggctcatgtgtacctaagtaacaaacctgcacattgtgcacatataccgtagaacttaaagtataataaaaaaaattaaatttaaaaaaaagaaagatgagaaggacataacaagcaaataagaagtcaggtatagaggcacagagcatgaaaagcctggctttgggagaagagtccagttgcatatgcctagagtctagtgttttgtgggcagggtaaggaaaatgcaactggagatgtatgatatcacgttttggaaggagagagtggaaaccaacagaaatctttaagcaggatgatggcatgagcctctttgttatgggggaagatgcctctggtagatatgtgaaagacaggctgcagtgggaagaagcagtagtgaaaagaccaaaagtggtaagctgttgtaatataccacacaaaagaagacagaggattgaaacaagacattgatagtgaagacagagagctaggggtaaattcaaaagaagtttctaatgtagaagggacaagatttgttaaaataagggttgtaataggtgaagcggggagaagaaccatagccaccaagcctctaacttgcacattttaagtttgaactgttaacataagtctacagatttgcagagtagagggaaacttaacaagcttgaatcattttatgaaaagagtagctctggagaccctaaccttgaatggattagaagataagggtaggatccacgttatgatactaagaagacagaaatacaagtttgagctcaggagagagattagtattagagaaaaatatctggcatcattggcatatatagacatgaaataggagaaagtaaggtaactcaagaagagtgcacagaggtgaattcagaagaggaccaaagatgtaggccctagaaacactactactgaatggattaaaagaagattagccatcaaaagagaattaaaaggaacaagaattaatttattccaaattgtccaaccactctattctattattattgatcacctaatacagaacaatcattgtaggtaccagggagtagggattataaaaattaatatgatagagtttctgggcaaggattgggctctaatggggttcacagaaaatttgagagacacttgcaaaactgttgcatagctgctacaacagaaaaacttacatggtggaaggagagtacaggacagcacccatttaaaggacaatcaagaaaaattatgaaaccaagagaaaagagattatcaaaaaacagtatcagcactgtcaaatgtgatctctgcacagatgttattaaaatttgaatgttggtatttatagtctctatcaagttgctccttccagtaaaacatgctgactcttaaccctcaaaacatttttagtggtcactttacacattctatcataacgtatcacagagcaattgaggcatgtctgagaggctgtgaaaaggaaagtaatcgtgttttataacttatacactcaaattaacactatttagactgcaaagtgatccttggacagtcaggaggttctagaaaatcccttgaagttccacagatactgtattttcccccctagagttacaagagtggtggaagaggaaaaacaatggctaatatagttttaaaaaatgttgctgaatgacattctatttggtcaggcactgagcaggccctgaatacccagcaaggcatgtagtgtggtttgacactgctaagtactatagatttgtgctcagtcccagctctgccccttgcatgctagattttaatgtttcattttataaaatgaatgatttgaatagaatattcaacattttgtggctcagtgagcctaacttgtatgaagaaaagatatagtctctaaggaataagcaactaataaacaaaaatgtacaacatggccaagaagtccttacgcataagattttgtcttctgtgagttatttgtttaataacaatttcaggtaataacagttaaagacctaaaaatcactaaagaacataacagaaaatcaaggtttacatggagaatgaatgagaacatgcagatcatttataatgagcacacacatgtattttctgtgtatatttaaaaacagttaatgtgcactgactgcttaccatccaccagacactatgctaaatattccatacacaatattactaatctccacaacaactcagtgaattaggaattattattattcccattttacagattagaaaggggcttagagaggttaaatattttgttcaaggttacaaagctaatcactgacagtagtaggttctaacacaatttacctaaatccacagcccatgttcttcaccattccacaatactatttataaatcatggtaactataaagagaggtgaaagaaaagtattgaatccagacatgtaccaactgattgaaaattatgtaaagtgaatcagagaaagtctcattaaggaaatagatcagaagatatgctttaaagttagattatcaagagatattaccataatactgatctaaataatccaaaagtgtttcactttcatggaggaaaaaactaagctagatatactcattttaagtcaacagttatcatctaatcactacagtaaattttacctcttatgtcatagtgagtactgaatttccacacaatttattcttcaattatagagtcacacaacttatacagagggtagactgatggatatcaaacattggactctgaatgaaaagtttattcaggagaccattagacaattacatccaaatatgtgtgcctctgataagaaaccaggctgcaatttaacaaattctctctgacagagacagcaggagaaaaaaaaaaagaaggaaaaaaggaaggtatctgtagaagttaagataaatatcactgagaaaagagagtcaagcttcatgagagaatctcagagtcagcattgtagggaagtggaggaaattctgaaaggaatttttaaaaaaacagaaaaagttagaatactgaaagcacattcaaaagcattgaacgacctatcaaaactgaattctgttaaatctaagcagctgctgtggtgtgtcatcatgttgctgagacagaagacccaattacaactttagtggctaaaccataaagatacgatgactggtgagagctggtaaaaaaaaatgccgagagtcagaaaaactatttgatataaagaatttctcttcctctggtattcaataataacactcatcagcatgacttttattcattcattctttaacaaatatttattgaggccactgttttgggtaccagaaacagagtaagttaaacaaaacaaaaatctctgctcctgcagagcttagattctggtccaataaaccatttttcagtgaaatatatatagtataaaagatggtgctaagaactatgaggaaaaataaaggaaggaaatgaaaatgaggaacatgggagacaagcccaagggaaatgcattttttaaaaggaatgagaggaaaggactcaataagcagataacgtttaagcagaaacctgaaggagatagagaaaagagtcatggagatattggaggaagaatgtagaatggccagtgcaaaggccctgaggcaagagtattcttggcagcttacaggaaaagcccaatgaccagtatgcctagattagagtgagagaacgaaaaatcataagaatgaagtcgaaagagtagtggaggtagagggaccaaatcatgtatgatgtttcaggccattataagaactctagtttaacttaaatgaaatggaaaaattttgcaaaatttttagcagagaagaaacataatcttctacatgttaaaaggtagtaaaggcaagcctagaagagaaccagttggaaggctaatgggtatattcatgaatgccttaaaattgctatcaattcttaaagaataatggttaaaacttaggctctggagtcaaacctgtgttcaaaccctaactcaactacatacccaagcctaaatttcttcctacatgaaataagaatccaaaaaagaagtattaaacaaccaaacaactgctgtgtgtcagaccctgttctatcatatctaatattagatttccttctgaagtggactaggaggcaagaatttgagtgcaatttgcttattagggaagaacaggaatcatatcacgggagtcacgaagcagcacaagcagggaaagtcagcctatgtagagtatgttaccacaccaactactgcagtggacagctgaaacttaatcacacagaaaaactctgggaaagagactacaacacagaattgtcccacccaagaagcagggagatggaataatacttatactccaagttgagtcagccatgagttataggcagctacagagaggtgttaatttccatgtactccagtctgtccctgtctttcatcagcagaatggctttctgcggttcttgaaaaagccctcaagcatggagaggcacatatggctgttggaagtcttttggagtacactgaaacaggctgatctgagggatatgggtcaggcaccgacagcaactgctatatatctagacaaaaaaaaaagactgacagtctataacacaaaatgctaaaagtatttatttctcaataacaagaattttttgtgttctgtattttattttctgggcacctttttatcttaaaaattctgtaacaaatatttattatttataaaataagatttaatatataatatctaatatttatagaaatcttttttttgattttggaattattttctttttttaattcaaaatacagagtttaatcataacttattgctgtgtaaccgtcagaaaatataaaaccagaaatagttaaaagaaattatccctgacatataacagaactgacatttgggtgggcagaattggtatttatcttctattgtaaattgttttgtactattatttttattattattattattattatactttaagttttagggtacatgtgcacaatgtgctggttagttacatatgtatacatgtgacatgctggtgcactgcacccactaactcgtcatctagcattaggtatatctcccaatgctatccctcccccctccccccaccccacagcagtccccagagtatgatgttccccttcctgtgtccatgtgttctcattgttcaattcccacctatgagtgagaacatgcggtgtttggttttttgttcttgcgatagtttactgagaatgatgatttccaatttcatccatgtccctacaaaggacatgaactcatcattttttatggctacatagtattccatggtgtatgtgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgagcatcttgtttcttactgagctcttatgacaacttagtgaggagaaggaattattattattatttcaattttacaaagaaaattgagtcattgagaaatcgaatggattgctccaagttgcatcagcagttattggttaagacagcttgtgtagatgtcatgattccattaccttttaccattcatagtctcaccaccttgaatatagatactaagtcaaacactttattttacagatgagacaaatagggtacagagtaattaaccccaggtcacatagccagagaaaaatgaaagcttcaggccttctgagtcctggtttacatgtaatctggttcacacaaggttaagaacatggactctgtatccacgctatctgggctcaaaggcatccagagccactttggcaaggtgaccttgagcagtttttcctccctaaaaggggaatataaaaatgtctacatcagggtaatggtaagcattaaaataacaaatgcctgaaaattatggtcaggagtatcatataataattgctattattaaaggagaaaaaaatggatacagaaaagaaactgcctaggattaaggagttcaatggatcttggaaggaaagagttttagcatttgtattgtagtccggttacacattaaagaatcttgaactcacttccaaaacttctgattaaggtcatcaagactaatgccaatgggaggcagttatatatctgggggggtggagaaataccgaatactgggcttgaactctggttctgacacagctatttgaccttcagcaaattatttaaactctctgtatgaagattttctcatttacaaaatgggaagagaagtacttaaaactcagaacagtgtctacactacataggaagtaatcaataaatgttgctcattatcattactagatgttggagctgctcagttcaacgcatattaaattaaaagagaagaactgtgaccgaatataacaggatttcatcctggagacaaaagatacaatttgatcctaggtagggatgtttacagtggtgggtccaggttttagtacggaatggcatagcatactagaatcttttattgtcagcagcattaaacatatgtgctcatgtaaatcactactgcaaaattgatggacacataagacaagaataagaagttagcaagttaatgaaaacaaagaggaaattgtacacttaagggtgtgaagtagaagaggctttttctctcccattatgagaatcagcacctcattttttatattacagatacactgcatttcatcttcttcaaagtgcaagagctgtcttgagcaagataaataaaatgtaatcactgtgaaactgaatattaatatatttattagtatgaatattaataaatataaattaagtacaaatcaggaccaatagtagcccataagccacttttgagtaaagtagaaaaaggtgcccctttctcaaaagaatttactttcatctgttaggaaattgtcataatataattattttcttataattaaacacttcactacaatctgccccaaaattgtaatgaatgtacaaatttaagatgtgagtgatgttagtggtatgccctaggattgtgtagtgaaaatatgaacaactgtataccagtgggtccgcttaatgtgtgtttaatgaatgaagtatttgtcataaaaattcactttgctaaacgctgaaaatgtgcatatttaagaaaatatggtctcagccctcatgaagctcacaaccaaataaacaaatgagtacactatggtatagtaagtgatgtgttacaggggagaaattcctaaactgagtaggagtctgtattaacagatttgcacatactttaatggcagtgattataaaaactaaaacagccacccccaattatctggagtaggtcgatgctcattattgtcactctttgcttcagttgacagatgccttaaaccaaagaaaacaaagccacagcaagtttgcttccagaggcaaactattcctatagttagtgaacctgctaggaaggcatagctaatttatcccactggaaagagataagggaaagaaggtaagtgaaagggaaataaaagcaagagatttgagggaatattcttcagagcagaaaacagaaaagcagaagtataaagagaacaagtacaaaggaggaggaatagtgggaaagaagagaaataagtgacatgatcaaggcagtaccttattattacatgcatgcagtgtacatctgcaaaaaattaaaagtaaaagaaaaataaggacaaaaaagaggaagcataaaatgagaaagaaaaagaaagcttggaaatgaagagaggaaacatggcatttagctagactccaagacacttacaaaagtagtctatgagtctcttgcagcgttaaagaacatagacattataagagagggtactagttgggatattgaattctcaaattgctttgacctcaagtttatcatgttgaatttgcaaatattaataacaaatttgttgttgaaatattaggcttgcagcatagcagttttgataccactaatttctattgtttcacatctgtaaaatataggtgttgcaaattgtacctaattgtgatgatcaatgtcattcagtcatatgcatacatccacattttgagcatacgaaatggataattattctgtcaacagatagatctgtaaaatgatagatgatacatttatttgattgatgggagtgataagcggtgttgaggaaaatagtgattttagcctcatggaagaattattcaagtagaaatatgagaattccaatacaaaaaatagctctaattctagcctaagaacaagaaatataaccaatttgcttattcatactatcacaaataagaaaaagccctccacttctacacctctgactgcagtgtcttttctcattctccaaacttatctaaatttaaatatttcaaggctaaaacaaaatgctcctctgcaaatccattctattctcccctatgctgtatcaccaatgtgtttttggtaattgaactcaggtccaatttgagctctgattagtctaagccaatcatgtttaaatcatgtcctatcttcttttccaggcctgagcaaatcaacccatgtcattcccctggtgatattttagagttaggaataagcatatggcctaagtcggctcaataagactgaaggaaatgatttttgttcaatagctggcaggaggcatccattctcttctgtttgataaaataaggaattgtatagtcctcattgctctggcaggtagctgaccacagaccatgaggaagaacagccctaggatgaaacaacatgatggatggtagggaggtaagacagaggaacctggattcctgatgacattctttttttcccataggttattggggaacaggaggtgcttggttacataagttctttagtcgcgatttgtgagattttaatgcacccatcacctgggcagtatacactgcaccatatttgtactattttatcctcgcccctttccattcttttccacggagtccccagagttcactgtgttattctaatgcctttgcatcctcatagctcagctcccacttatgagtgagaacatatgatgtttggtttttcattctatgtaatttcacttagaataatagtctccaatctcatcccagtctctgtgaatgctgctaactcattccttttgatggctgagcagtatttcacacacacacacacacacacacacacacacacacatatatatatatatatatatatatatcacagtttcttaatccactcattgatggatgggcatttgggtgggttctacgtttttgcaattgtaaactgtgctgctataaacatgtgtgtgcaaatatctttttcgtataatgatttattttcctctgggtagatagccagtactgagattgttggatcaaatagtggttccacttgtagttatttaagaaatctccaaactgttttccatagtggttgtactaatttacatacccaccagcagtgtagaagtgttccctcttcaccgcatccctgccaatatctaccattttttgattttttattgtggccattcttgcacgagtaaggtggtatcgcattggacttttgatttgcatttccctgatcattagtgatgttgatcattttgtgtatgtttgttggccatttgtatatcttcttttgagaactgtctattcatgtccttagcccactttttgatgaaattgttttcttcttgctagtttgagttcattgtagattctagatattaatcctttgtctgatgtatagattctgaagattttttcccactctgtgggttgtctgtttactctgctgactgttccttttgctgtacaaaagctctttagtttaattaagccccagctatttatctttgtttttattgtgtttgtttttgggttcttggtcatgaaatccttgcctaagccaatgtctagaaggatttttttgatgttatattctagaatttttagagtttccggtcttagatttaagtccttaatccatggtgagttgatttttgtataaggtgaaagatgaggatccagtttcattctcctacatgtggctagccaattattccagcaccatttgttgaaaaaggtgtcctttccacactttatgttttggtttgctttgttgacgatcagttagctgtatttcggtttgtttctgggttctgtattctattccattggtctgtgtgcctatttttataccagtgccatgctgtttgggtgactatggccttatagaatagtttgaaatcaggtaatgtgatgcttccaggtttgttatttttgcttagtcttgctttggctatgcagcctcttttttggttctatatgacatttagaatttttttttagttctctgaagaatgatggtggtattttgataggaattgcattgaatttgtagattgcttttggcagtacggtcattttcacaatattgattctacccattcatgtgcatgggatgtgtttccatttgtttgtgtcatctatgatttctttcagcagtgttttgtagttttccttgtagaggcctttcacctccttggtttggtatattcctaaatatttcacttttcttccagctattgtaaaaggggttgagttctcaatttgattatcagctttgtcgttgttggtgtataaaagagctactgatttgtgtacattaattttgttttctgaaactttgctaaattcttttatcagttctaggagctttctggaggagtctttagggttttctaagtaaacaatcacatcatcagcaaacagcgacagtttgacttcctctttactgatctggatgccctttatctcttcctcttgtctgattgctctggctagggcttgcagtactgagttgaagagaggtggtctgaaagagtgcttgatataatttcaattttcgtaaatttgttgaggctcattttgtggcctatcatatagtccatcttggagaaagtttcatgcgctgttgaatagaatgtatattctgcggtttttggatgtaatattctatatatatctgttaagtccatttgttccagcgtatagttttaatacattgtttctttgttgactttctctcttgatgatcactctattgctgtaagtggagtattgaagtcccccactattactgtgctgatgtctgtctcatttcttacatctattagcggttgttttataaattgggtagctccagtgttaggtgcatatatctttatgattgtgacattttcctgttggacaaggcattttatcattatataatgtccctctttctctttctttcattattatactttaagttctgggagacatgtgcagaacgtgcagattttttacataggtatacacatgccatgggggtttgctgcactcaccaactggtcatctacatgaggtatttctcttaatgctatccttcccctagccccacaccccctgacaggccccagtgtatgatgtacctctccctgtgtccatgtgttctcattgatcaactcccacttatgagtgagaacatgcagtgtttggttttctcttcctgtgttaattagctgagaatgatggtttccagcttcatccatgtccctgcaaggggcatgaactcatcctttttatggctgcatagtattccatggcatatatgtgccacattttctttatccagtctaacatttatgggcatttgggttggttccaagtctttgctattgtgaatagtgccacaataaacatacatgtgcatgtgtctttatagtagaatgatttctaattctttgggtttatacccagtaatgggactgctgggtcaaatggtatttttagttctagatccttgaggaattgccacactgtcttccacaatggttgaactaatttacactcccaacgacagtgtaaaagcattcctatttctccacatcctctccagaatctgttgtttcctgactttttaatgatcaccattctaactgatgtgagatggtttctcattgcgattttgatttgcatttctctaatgaccagtgttgatgagttttttttcatatgtttgctggctgcttaaatgtcttcttttgagggtgtctgttcatatcctttgcccactttttgttgggtttttttcttgtaaatttatttaagttctttgtagattctggatattagccctttgtcagatggatagactgcaaaaattttctcccattctgtaggttgcctgctcactctgatgatagtatctatcatcagatactaactaaactaaagagtggaagctctttagtttaattaaatttcatatgtcacttttgggttttgttgccattgcttttggtgttttagtcatgaagtcttggcccatgcctatgtcatgaatggtattgcctaggttttcttctatggtttttacggtttttaggtcttacatttaagtctttaatccatcttaagtttatttttgtaaaaggtgtaaggacggggtccagtttcagttttccgcatatggctagccagttttcccaacaccacttattaaatagggaatcctttccccattggttgctttcgtcaggtttgtcaaagatcagatggttgtagatgtgtgacattatttctgaggcttctgttctgttccattagtctattgtcaaagatcagatggttgtagatgtgtgacattatttctgaggcttctgttctgttccattagtctatacatctgttttggtaccagtaccatgctgttttggttactgtagccttgtagtatagtttgaagtcaggtagcatgatgcctccagctttgttctttttgcttagaattgtcttggctatacagactgttttttggttccatataaaatttaaagaagttttttttaattctgtgaagaaagtcattggtagcttgatggggatagcattgaatctgtaagtaactttaggcagtatggccattttcacaatattgattcttcctatccatcagtatggaatgttcttccatttgtttgtttcctctgtcatttccttgagcagtggtttgtagttctccttgaagaggtccttcccgtcccttgtaagatgtattcctagggattttattctctttgtggcaattgtgaatgggagttcactcatgatttggctctctgtttgtctattgttggtgtgtagaaatgcttgtgatttttggacattaattttgtatcctgaaactttgctgaagttgcttatgagcataaagagcttttcggctgagatgatgggattttctaaatatacaataatgtcatctgcaaacagagacaatttgacttcctctcttcctatttgaatatgctttatttctttctcttgcctgattgccctggccagaacttccaatactatatcgaataggagtggtgagagagggcatccttgtcgtatgccagttttcagagagaatgcttctagcttttggccattcagtatgatattgactgtgagtttgtcataaatagctcttattattttgagatatgttccatcaatacccttgtttattgagagtttttagcatgaagtggtgttgaattttatcaaaggccttttctgcatctattgagataatcatgtggtttttgtctttggttctgtttatgtgattaataacttgtattgatttgtgtatattgaacaagccttgcatcccagaaatgaagctgacttgatcatggtggataagctttttgatgtgttgctggatttggtttgccagtattttattgaggatttttgcaccgatgttcatcagggatactgacctgaaatattctttttatggtgtgtctctgccaggctttggtatcaggatgatgctggcctcatcaaatgagttagggaggagtgtctctttttctattggttggaatagcttcagaaggaatgacaccagctcctctttatacctctggtagaattcggctgtgaatctatctggtcctcagctttttttggttggtaggctattaattactgcttcaatttcagagcttgttattggtctattcagggattcaacttcttcttgctttagtcttgtgagggtgtatgtgtccaggaatttatccatttcttctagattttctagtttatttgcatagaggtgtttacagtattctctgatggtcatttgtatttctgtggcttcagtggtgatatcacacttattttttattgtgtctattatattcttctctcttttcttctttattagtctggctagcagtctatctattttgttgaacaaaaaaacagctcctggattcattgatttttttgaagggtttttaatgtctctatctctttcagttctgctctgatcctagttatttcttgctttctgctattttttgaatttgttttctcttgttcttctatttcttttaattgagatgttagggtgtcgattttagatctttctcactttctcctgtggacatttagtgctataaatttccccctaaatactgctttacctgtgtcccagagattctgatacagtacactttgtttttgttctcattggtttcaaagaacttatttatttctgccttaattttgttatttacccagtagtcactcaggagtaggttgttcagttttcatgtagttgtgtggttttgagagagtttcttaattctgagttctaatttgattgcactgtggtctgagagactgtttattatgatttccattcttttgcatttgcttaggagtgttttacttccaattatgtggtcaattttagaataagtgtgatgtgtgctgagaagaatgtatattctgttgatttggggtggagagttttttagatgtctattaggtctgcttggtccagagctgagttcaagtcctgaatatccctgttaattttctgtctcattgatctgtctaatattgacaatggggtgctaaagtgtcccactattactgtgtgggagtctatgtctctttgtaagtctctaagaacttgatttacgaatctcagtgctcctgtattaggtgtatatatatttaggatagttagctcttcttgttgcattgatccctttaccattaagtaattcccttctttgtcttttttactctttgttggtttatcagagactaggattgtaaccactgctttttgtttgctttccatttgcctagtaaatatccttccatccctttattttgagcctgtgtgtgtctttgcacatgagatgggtctcctgaatacagcacactgatgggtcttggctctttatcctattttccagtctatgtcttttaattggggcatttagcccatttacatttaaggttaagattattatgtgtgaatttgatcctgtcattatgatgctagctgtcagtaagttgatgcagtttttcatagtgtcgatggtatttacaatttggtatgtttttgcagtggcttgtactggttgttccttgacatattcagtgcttccttcaggaactcttttaaggccaggccctgtggtaacaaaatctctcagcatttgcatgtgtgtaagaaattctatttctccttcgcttatgaagcttagtttggctacatatgaaattctgggttgaaaattattttctttaagagtgttgaatattggcacccactctcttctggcttgtagggtttcttaagagagatctgatgttagtctgatgagattccctttgtgggtaacccaacctttctctctggctgcccttaatcttttttaccttcatttcaaccttaataaatctgtcgattatgtgtcttgggattgctcttcttgaggagtatctttgtggtgttctctgtatttcctgaatttgaatgttggcctacctttctaggttggggaagttctcatggataatatcctgaagcgcaagcatgttttccaacttggctccattcttctcatcattttcaagtacacctatcaaatgtaggtttggtcttttcacatagtcccatatttcttgaaggctttattcattccttttcattcttatttctctaatcttgtctgcatgctttatttcattaagttgatcttcaatctctgatatcatctcttccacttgatcaactcggctattgatacttgcatatgcttcacaaagttctcatgctgtgtttttcagctccattaggtaatttatgttatcctctcaactggttattctagttagcaattcatctaaccttttttcaaagttcttagcttccttgcattgggttagaacatgctcctttagctaggaggagtttgttattacccacattctgaagtctacttctgttaatatttcaaactcattccccatccagttttgttcctttactggcaaggagttgtgatcctttggaggtgaagaggcattctggtttttggaattttcagcttttttgtgctggtttttccccattttcatggatttatctacctttggtctttggttggtgacctttggatggggttttcatgtgcatgtcctttttgtggatgttgatgctattcctttctgttttttagttttccttctaacagtcaggcccctctgctgcaggtctgctggagtttgctggaggtctactccagaccatgtttgcctaggtatcaccagtgaagtatgcagaacagcaaagactgctgcctgttccttcctctggaagcttcgtcccagaggggtgcccaccagatgccagccagagttctcctgtatgacatgtctgtagactcctgctgggaggtgtctcccagttaggaatcttgggggtcagggacccactcgaggaggcagtctgtcccttagcagagcttgagtgtgctgggagatccactgctatcttcagagctggcaggcaagaatgttcaagtctgctgaagttgagcccacatccccccttcccccaggtgctctgtcccaaggagatgggagttttacctataagccccctgactgtggctgctgcctttctttcagagatgtcctgcccagaaaggaggaatccagagatgcactctggctacagtggctttgccaagctgtggtgggctctgcccagtttgaacttcctgacagctttgtttacactgtgagggaaaaaccaaccacctactcaagcttcagtaatggtggatgcccctccccccaccaagctcgagcatcccaggttgacttcagactgctctgctggcagcaagaatttcaagccagtggatcttagcttgctgggctccctggccgcaggatccactgagctagaccacttggcttcctggcttcagccccatttccagaagagtgaacagttgtgtcttgttggcattccaggtgccattggggtattaaaaaaataaaaataaagataaaataaaaatgaaaaaaacactcctgccactagctcagtgtccaaacagctgcccagttttgtgcttgaaaagccagggccctggtggtgtaggcacctgagggaatctcctgttttgtgggttgtgaagaccacgggaaaagcatagtatcggagccggagtgtaccattcctcatggcacagttcctcacagcttcccttggcaagaggagagagttccctgaccccttgcatttccctgcttcagcttgtcctttgtgggttgcacccactgtttaaccagtcccaatgagatgagctgggtacctcagttggaaatgcagaaatcacacccctcctgcgttgatctcgctgggagctacagaccggagctgttcctattcggccatcttaccagccatccatccctcccccttttttttttttaactgctgttgctttgaagtttgtttcatctgacataagaatagctacttctgcttgctttttgtgtccatttgcctgaaatgtcttttttcacccgtttaccttaggtttgtgcaagtccttatgtgttaggtgggtctcttgaaggcagcatatagttggttagtgaattcttaacctttctgcaattctgtatcttttaagtggaggatttaggtcatttacattcaatgttagtcttgaaatgtgaggtaccattccattcatcatgctatttgttgcctgtataccttggttttttgttttttgtttttgtttttcttgaattgtacttttgttttcttggtcctctgagatttaggctttaaacagtttccattttgatgtgtttccaggatttgtttcaagatttagagctccttttagcagtttttgcagtggtgggtcggtagtggcaaattctctcagcatttgtttttccgaaaaaggctgcatctttccttcatatataaagcttagtttcactggatacacaatttttggctgattattgttttatttgaggaggatgaagatagggccccaatcccttctagcttgtaaagtttctgctgagaaatgtgcttttaatctgataggttttcctttataggttacctggtgcttttgtctcagttcttaagattctttccttcatcttaactttagataacctgataacaatgtgcctaggcaataatctttttgcaatgaatttcccaggaattctttgtgcttacctgtatttggatgtctaggtctctagcaaggccaggaaaattttccttgattattcctctaaatatgctttccaatttttagatttcttttcttcctcaggaactcagattactcttaggtttggttgtttaacataatcccagatttcttggaggctttgttcatattttcttcttttccctttgtctttgttgggttgggttaatttgaagaccttgtcttcaagctctaaatttctttcttctacttgttcaattctattgttgagattttccagagcattttgcatttttataactgtgtccattgtttcctgaagtttttattttttttggtgggggggatttgtcggggtttctttgtttctttgttttttgagatgattctcttgcctcagcctctggaatagtggggattatagacacgtgccaccacatctggctgatttttgtatttttagtagagatggggttttaccacattggtcaggctggtctcaaacccctgacctcaagtgatctgctcatctcagcctcccaaggttctaggactacaggcacgagacaccacacctggcatgattggtttttatttctgctatctatttctttgaatatttctcccttcacttcttgtatctttttttttatttccttacattgggctttgcctttctcttgtgcctccctgattagattaataactaaactcctgaattctttttcaggtaaatcagggatttcttcttggtttgggtccattttttttgagctagtgtgatttcttggaggtgttaaagaaccttgttttgtcatgttactagagttggttttttggttccttctcatttggttaggctgtgtcagagggaaggtctagggctgaaggctgttgttcagattcttttgtcctacaagttgttctctgaggtagaactctcccctttttcctatggatgtggcttcctgagagctgagctgtagtgactattatcactcttctgggtctagccacccagcaagtctaccaagtactgaggcttgtctgcacagagtcctgggatgtgaactgtctgtggatctctcagctgtggataccagcaccttttccagtggaggtggcaggtggatgtactggatcctgtgacagttcttagctttggtggtttaatgcactatattttgctggttggcctcctgccaggaggttgagctttccagagagtatcagctgtggtaatatggggaggaacaggtggtgggcagggccatagaactcccaggaatatatgccctttgtcttcagttaacagggtgggtagggaagaaccactgggtgggaagagggctaggtgtgtctgagctcagactctccttgggcgggtcttgctgcagctgctgtgggggatgggggtgagcttcccaggtcaatggagttatgttcctaggaggattatgactgtctctactgtgctatgcaggttgtcagggaagtggggaaaagccagcagtcacagatctcatccagctcccatgtaatcctaagggctggtctcacacccaccatgcccccaccaacagaactgagtctatttccaggcagttggaaagcatggctgagaacttgccccactacctgcatcccagctgcaaaagcaaatatggcttcccttcttcccccacctacggagtctgtacaacagattcatgccctcccccaggttctggccaggaggcttcttgatcagttcaaattgttacaaagttcagctagagatttcccccatggccatttccccatggccttttcccagtgcctctggccaacctcccaaaggaccccatgaggccaggcaaaaatggcttgctaggggacccattgcttcgtctaccactgtattttgcttggctgtctacactgactcagctccaggtaaggtcaatatcgtctcccataatcaaggccttcagtttccctagctggggggtgtgttcaagggtggatgatccccctttcccactttcacaatttgggcactcacagtatttggatgtctcccaggtactgcaggagcaatcttcttttttcgggggatctgtgggttctctcaggtttcctgatttattcctgccatcactctggagcaaaaattcatgatgcaaggcttcatatgctgctctgtccatccaagtcagagctgcaatctagtcctacctcccatccgccatgacccccagttctcctgggatgacattcatgattcattgaataagacaaccctgaaacccagcctactgatatccagttagcagagtcaataaatttccttgacatttaaaccagtttgcattaggttttttcttatgtgaggctgaaagtatccaactgaagtagatcccaggggttaggcattactattctcttatatattacagatagtgaagcactaggtattattaacttcagagaggttaagtaaatggcccaaagttggtgaggtaagacgaagcagacctgacattcaaactctgattttttttaactctaagatctatattccaagctctctacaatgacaatgtgaggatacaagggaaaaacagccctccacaaatcaagaacaattccctcaccaaacactggatctcccagcacctgttcttcgacttcgcagcctgcagaatggtgagaaataaatttctgttgcttaagccaccctatctatggtattctgttataaaagcctgaactgactaagaaagtttccatggtcaccttaatccactgaagttagtacttctagagcaaaaaacaaacaaacaaacaaaaaaacaaacccaccacataaattcatgccttaccccataaaccagaagaaatactatatgtgaataacagattgtaaattacagaaagcagaataaactatttccaggtcttctgatagatgttaattttctaaggtttaaagcagaacatctcaaagaaaatgttgttaaatacataaaatttgaaacttcaatgcttataaacaacactaatacaaaaaagaatgcaacagagatgaaaaacatttgctctataaatgacaaaaggttaatacttataattttcaaaaaagttcatttaaatacagcagaataaaacaatattgaggtgctatcggtaaaaataacaaggatataaatggaaaatttaccataatgaacatatatattgtaaatagtaaatatttaaatatttatacccaatgtttttgaggttatggtaaaagtggtacactcatacattactggtaacactttaaattgaaaaaaaacttttagaatgtaacttgtcaattcattgtaagaatcataaaagtacctgtaccctttgacctagtaatcctactttcttaaacgtacaccaaaaaataattctaaacaagaaaaaaatcgggggtggaggcaagatggccaaataggaacagctccactctacagctcccagcatgagcgacgcagaagatgggtgatttctgcatctccaactgaggtaccaggttcatctcactggggagtgtcagaaagtgggtgcaggacagtgggtgcagcacaccaagcaagagccgaagcagggcaaggcatcgcctcacccaggaagcgcaaggggtcagggaattccctttcctagtcaaagaaaggagtgacagatggcacctggaaaatcgggtcactcccaccctaatactgtgcttttccaacggtcttagcaaacagcataccagaagattacatcctgcgcctgattcggagggtcctacccccatggagccttgttcattgctagcgcagcagtctgagatcaaactgcaaggtggcagcaaggctgagggaggggcgcccgccattgccgaggcttgagtaggtaaacaaagcagcagggaagctcgaactgggtagagcccaccgcagctcaaggaggcctgcctacctctgtagactctacctctgggggcagggcacagccaaacaaaatcctctgcagacttaaatgtccatgtctgacagccttgaagagagtagtggttctcccagcacgcagttggacatctgagaacggacagactgcctccccaagtgggtccctgacccctgagtagcctaactgggaggcaccccccagtaggggcagactgacacctcacacggctgggtactcctctgagacaaaacttccagaggaacgatcaggcagcaacatctgctgttcaccagtatccgctgttctgcagcttccactgctgatactcaggcaaacagggtctggaatggatctccagcaaactccaacagacctgcagctgagggtcctgattgttagaaggaaaactaacaaacagaaaggacatccacaccaaaaccccatctgtacgttaccatcatcaaagaccaaaggtagataaaaccacaaagatggggaaaaaacagagcagaaaaactggaaactctaaaaatcagagcacctctcctcctccaaaggaatacagctccacaccagcaatggaacaaagctgaatggagaatgacttcaatgagttgagagaagaaggcttcagatgatcaaacttctctgagctaaaggaggaagttcaaacccatggcaaagtagttaaaaaccttgaaaaaaaattagacgaatggctaactagaataaccaatgcagagaagtccttaaaggacctgatggagctgaaaaccaaggcacgagaaatacgtgatgaatgcacaagcctcagtagccaattcgatcaactgtaagaaagcgtatcagtgatggaagatgaaatgaatgaaatgaagtgagaagggaagtttagagaaaaaagaataaaaagaaatgaacaaagcctccaagaaatatgggactatgtgaaaagaccaaatctacatcgattggtgtacctgaaagtgaaagggagaatggaaccaagttggaaagcactctacaggatattatccaggagaacttccccaatctagcaaggcaggccaacattcaaattcaggaaatacagagaaagccacaaagatactcctcgagaagagcaactccaagacacataattgtcagattcaccaaagttgaaatgaaggaaaaaatgttaagggcagccagagagaaaggtcaggttacccacaaagggaaggccatcagactaacagctgatctcttggcagaaactctacaagccagaagagagtgggggccaatattcaactttcttaaagaaaagaattttcaatccagaatttcatatccagccaaactaagcttcataagtgaaggagaaacaaaatcctttacagacaagcaaatgctgagagattttgtcaccaccagccctgccctaaaagagctcctgaaggaagcactaaacatggaaaggaacaaccggtatcagccactgcaaaaacatgccaaatggtaaagatcaccaatgctaggaagaaactgcatcaactaatgagcaaaataaccagctgacatcataatgacaggatcaaattcacacataacactattaactttaaatgtaaatggactaaatgctccaattaaaagacacagactggcaaattggataaagagtcaagacccatcagtgtgctgtattcaggaaacccatctcatgtgcgaagacacacataggctcaaaataaagggatggaggaagatctaccaaggaaatggaaaacaaaaaaaggcagaggttgcaatcctagtctctgataaaacagactttaaaccaacaaagatcaaaagagacaaagaaggccattacataatggtaaagggatcaattcaacaagaagagctaactatcctaaatatgcatgcacccaatacaggagcacccagattcataaagcaagtcctgagagacctaaaaagagacttagactcccacacaataataatgggagactataacaccccactgtcaacattagacagatcaatgacacagaaagttaacaaggatatccaggaattcaactcagctctgcaccaagtggacctaatagacatcaacagaactctccaccccaaatcaacagaatatacattcttctcagcaccacaccccacttattccaaaattgaccacttagtcggaagtaaagcactcctcagcaaatgtaaaagaacaaaaattataacaaactgtctctcagaccacagtgcaatcaaactagaactcaggattaagaaactcactcaaaaccacataactacatggaaactgaacaacctgctcctgtatgactactgggtacataatgaaatgaaggcagaaataaagatgttctttgaaaccaatgagaacaaagacacaacataccagaatctgtgggacacattcaaagcagtgtgtagagggaaatttatagcactaaatgcccacaagagaaagaaggaaagatctaaaattgacaccctaacatcataattaaaagaactagagaagcaagagcaaacacatttgaaagctagcagaaggcaagaaataactaagatcagagcagaactgaaggagatagagacacaaaaaacccttcaaaaaatcaatgaatccaggagctggttttttgaaaagatcaacaaaattgatagaccgctagcaagactaataaagaagaaaagagagaagaattaaatagacgcaataaaaaatgataaaggggatatcaccaccgatcccacagagatacaaactaccatcagagaatactataaacacctctatgcaactaaactagaaaatctagaagaaatggctaaattcctcaacacatacaccctcccaagactaaactaggaagaacttgaatctctcaatagaccaataacaggctctgaaattgaggcaataattaatagcttatcaatcaaaagaagtccaggaccagatggattcacagccgaattctaccagaggtacaaggaggagctggtaccattccttctgaaactattccaatcagaaaaagagggaatcctccctaactcattttatgagaccagcatcatcctgttaccaaagcctggcagagacacaacaaaaaaagaaaattttagaccaatatccctgatgacaaatgggatctaattaaactaaagagcttctgcacggcaaaagaaaataccatcagagtgaacaggaacctacagaatgggagaaaatttttgctatctactcatctaacaaagggctgatatgcagaatctacaatgaactcaaacaaatctacaagaaaaaaacacaaccccaccaaaaagtgggcaaagcattcaaacagacacttctcaaaagaagacatttatgcagccaaaagacacataaaaaaatgctcgtcatcactggccatcagagaaatgcaaatcaaaaccacaatgagataccatctcacgccagttagaatggcaatcattaaaaagtcaggaaacaataggtgctggagaggatgtggacaaatgggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatacacacatatgtttattgtggcactattcacaatagcaaagacttggaaccaacccaaatgtccaacaatgatagactggattaagaaaatgtggcacacatacaccatggaatactatgcagccataaaaaatgatgagttcatgtcctttgtaaggacatggatgaagctggaaaccatcactctcagcaaactatcgcaaggacaaaaaaaccaaacaccacatgttctcactcataggtggaaattgaacaatgagagcacatggacacaggaagtggaacatcacactctggggcctgttgtggggaggggggagggatagcattaggagatatacctaatgttaaatgacgagttgatgggtgcagcacaccaacatggcacatatatacatatgtaactaacctgcgcgttgtgcacatgtaccctaaaacttaaagtataataaaaaaaaagaaaaagaaagaaaaaaatttacatgattgaaatgttaattgtggtatcatttattaaaataaaaaattaggaaaaaatctaattatcctataatagcagtctaggtacaaaaatcattacatatctattgaacataatattctgaatccattaaaaatccaatttttaaaactttaacaaaatggagatattaatgatatcttatgagctaaaatgtgagaagtaaaaatgtaacaattcttagtactccatagagctcccaaaatatttgcttggtagctcagatttgacctcatttctgtgggtttgactgcaaacaggacagggtttatgtttgtaattgaatgctgttttctgggcaactttcacagatgcaactgaagctagtttttaagggggactgaactgtaaagcacaacactcaatcaggaaaacattctgaaaatcattgtcgtgagttttttctaatggaaaagctagccagtcaaaaaaaaaaaaaaaaatacagctgaggcacaagaatcacttgaatctgggaggcagaggttgcaatgagccaagattacaccactgtatttcagcatgagtgacagagcgagactctgtctcaaaaacaaagaaacagaaaaacagtgtaaaaaatgattttgggtttcaaataattggcttaattttttagttttttttatttctatacatcaaacatgtatagaatgcttctgtcaagtttttatgagaagatattcttgtttccaacgaaggagacaaagcagtccaaatatccactttcagatcctgcaaaacgagtgtttcaaaacggcatgtgaatcctgcaccagcagctgaggtatccatgttctgtcattaggactgactaatgacagctagggtgacccacagagaggaaggaagaccagtgtggtgcagtggaccacctgagagccacatgggacaggggagcccccacccccagccaagggaagtggtgagtgagcatgctacccagcctaggcaaccatgctttttccactgaactgtgcaacccatggatcagaagatcccactcgtgagcacagactaccaggaccttggctcccaaccacggagccctgcagattctcaacagccacatggctagaatctgcctaagcctgccaagttcccaggggaaggcagccattaccactgccactgctgcctgctggctaagccagttgagctccttgggggaggggtggcagccaacactgcagcttcagggccaacaactccaaccaggggctcagggaccaaactctgatttcccagagcctgagctcctagcgggagtggtgccacagtctccatgaaccagcagacatagtctttcctcctgctagctctgaggaatctggacaacccagatgagtggggtccccccagcacagcacacactctccaccaagggacagccaaagtgcttcattaaacaggtcctgcttcctatgccatccaactaggtaagagcccccaacaggggttgccagacatcctgtacaggagtgttcctactggcatcaggtcggtgcccctttaagtcaggaacccagaggaaggagcaggcatccatctttgctgttctccagccccatcaagtgacatctccaggcacaggagcaaaataaatgaatagggcctggagcgaactcccagcaaaccacagcagccctaccgaagaggaacctgactgttgaaagaaaaacaaacaaacagaaagcaacaacaatagcatcaatgataaaagtcccccaaaaaatctcatgcaaggatcagcagcctcaaagatcgaatctagacaagtttatgaagatgagaaagaatcaatgaagaaacattgaaaacccaaaagctcagagtgcctcttctcctccaaatgattacaacacctctccagcaagggtgcagaactggacgaaggatgagatagatgaattgacagaagtaggcttcagaatctgggtaataacaaacttcactgaggtaaagcatgttctaacacaatgccatgttcttggcaaagaagctaagaaccttgataaatggttacaggagctactaactagaataaccagtttagagagaaacataaatgacctgatgaaactgaaaaacacagaacaagaacttcaagaaaaaatacacaagtatcagtagccaaattgatcaagcagaaaaaagagtatcagagatggaataacggaggcaggcaagactagagaaaaaacaatgaaaatgaacaaaccaaacctcccagaaatacggaactacataaaatgaccgcagctacaactgattagagtacctgaaagagaggagaatagaaccaaattggaaaacacaccttgggatattatccagcagaacttccccagcctagcaagaaaagacaacattcagattcaggaaatacagagaaactgactaagatactccacgagaagaacaaccccaagacacataatcttcagattccccaagctcaaaatgaaggaaaaaatgttaagggcagccagagagaaaggctacatcacctaccaaggaaagcccatcagactaacagaagatttctcagcagaaaccctataagcaagaagaaagtgtgggccaatattcaacattcttaaaggaaagaatttttaacccagaatttcatatctggccaaactaagcttcatcagcaaaggagaaataaaatccttatcatagagcaaatgctgagagaattcatcaccattaggcctgctttgtaaaagctcctgaaggaagcatcaaatatggaaaggaaaaatcaataccagccactgcaaaacacacaaaaatataaaaaccaatgacactatgaagaaatggcatcaactagtatacaaaataagcagctagcgtcaggataatggaatcaaattcacatataacaacattaaacttatatgtagatgggctaaatgccccagttaaaagacacagactggcaaattggatagagtcaaaacccaccagtgttctgtattcaagagacccatttcatgttcaaagacacacttaggctcaaaataaagggatggaggaaaatttaccaagcaaatggaaagcagaaaaaagcagagactagttttgtcctagtctctgacaaaacaggctttaaaccaacaaagatcaaaaaagacaaagaagggcattacataatggtaaagggatcaattcgacaagaagtgttaactgtcttaaatgtatatgcacccaatacaggagcacccagattcataaaacaagttcttacagacctacaaagagacttagactcccacacaagaatattgggagactttaacacccagctatcaatattagacaaatcagcaagatagaaaattaacaaggatgttcaggacttgaactcagctctggatcaagtggacctaataaatagctacagaaatctccaccccaaaactacagaatatacagtcttctcagtgccacatggcatttactgtaaaattgaccacataattagagataaaacactcctcagcaaatgcaaaataactgaaatcataacaaacagtccctcagaccacagtgcaatcaaattagaactcaggattaagagttctaactcactcaaaaccaaacaattacatggaaattgaataacctgctcctgaatgactcctgggtaaataatgaaattaaggcagaaatcaagaagttgtttgaaaccaatggaaaaaaaagaaaacataccagaatctctggaacacagctaaagctgtgttaagagggaaatttatagccctaaatgcccacatcagaaagctagaaagatctcaaatcgacaccctaacatcacagttaaaagaactagagaagcaagagcaaacaaattcgaaagctagcagaagaagagaaataactaagatgagaagggaactgaaggagatagagacacgaaaaacccttcaaaaaatcaatgaatccaggggctgttttttttgaaaaaattttaaaaaaaaaatagaccactaacagactaataaagaagaaaagagagaagaataaaatagacacaataaaaaatgataaatgggatatcaccactgaccccacagaaatacaaactaccatcagagaatactataaacacctctatgcaaataaactaggaagtctacaagtaatggataaattcctggacacatataccctcccaagagtaaaccaggaagaagtcaaatccctgaatagaccaataacaagttctgaaatcaaggcagtaataaatagcctaccaaccaaaaaaagcccaggatcagattgattcccagccaaattctaccagaaatacaaacaggagctggtaccattccctcagactattccaaacagttgaaaatgaaggacttctcccagctcattttatgaggccagcatcatcctgacaccaaaaattggcagagacacagcaaaaatagaaagcttcaggccaatatccctgatgaacattgatgtgaaaatcctctataaaatactggcaaaacgaatccagcagcaaatcaaaaagcttatccaccacaatcaagtcggcttcatccctgggatgcaaggctggttcaacatatgcaaatcaataaatgtaatccatcacataaacagaaccaatgacaaaagccacatgattatagatgcaggaaaggtctttaataaaattcaacatcccttcacattaaaaactttcagtaaactaggtattaacggaacatatctcaaaataataagagctatttatgacaaacccacagacaatatcatactgaatgggcaaaagctggaagcattccctttgaaaacttggcacaagacaaggatgccctttctcaccactcctattcaacatagtgttggaagttctggctatcaggcaagagaaataaataaacggtactcaaatgggaagagagggaagtcaaattgtcgctgtttgcagatgacatattcctatatttagaaaaccacatcgtctcagcccaaaatctccttaagctgataagcaacttcagcaaagtctcagaatacaaaattaatgtgcaaaaatcacaagcattcttacacaacaacaagagacaagcagaaagccaaatcatgaatgaactcccattcacagttgccacaaagagaataaaatacccatcaatacagctaacaaaggggtgaagaacctcttcaaggaaaactacaaaccactgctcaaggaaataagagaggacacaaacaaatggaaaaacattccatgctcatggataggaagagttaatattgtgaaaatggccatactacccaaagtaatttaaatattcaatgctattcccatcaaactaccattgacattcttcacagaattagcaaaacctactttaaaattcacatggaaccaaaaaagagccctcatggccaagacaatcctaagcaaaaagaacaaagctggaggcatcatgttacctgacttcaaactatactacaaggctacagtaaccaaaacagcatggtactagtaccaaaacagacacatagaccaatggaacaggatagagtcctcagaaataacaccacacatttacaaccaactgatcttcaacaaacctaaaaaaaacaaaaaatgagtaaaggattctctgtttaataaatggtgtgggaaaactggttagccatacgcagggcactgaaactggacccttccttacatcttatacaaaaattaactcaagatggattaaagacttaaatctgaaacccaaaaccatagacaccgtagaagaaaacctaggcaataccattcaggacataggcatgggcaaagattttattatgaaatcaccaaaaacaactgcaacaaaagccaaaattgacaaatcagtcctaattacactaaagagcttctgcacagcaaaagaaactattacagagcaaacaaccatcctacagaatgggagaaaatttttgcaatctacccatctgacaaaggtctagtatccagaatgtacaaggaacttaaacaaatttacaagaaaaaaacaaacaactccattcaaaagggggcaaaagatatgaacagatgcttctcaaaagaagaaatcaatgcagccaacaaacatgaaaaaaacacagcatcattgatcattagagaaatgcaaatccaaaccacagtgagatactatctcatcccagtcagaatggcaattatttaaaaggaaacaacggataatggtgaggctatggaaaaacaggaatgcttttacactgttggtaggaatataaattagtccaaccattgtagaagacagtgtggtgattcctcaagggtctagaaccagaaataccattcgacctagcaatcccattactgggtatatacccaaagaaatatagattattctactatgaaatacatgcacatatgtttgttgcagcactgttcacaatagcaaagacatggaaccaacccaaatgcccatcaatgatagactggataaagaaaatgtggtacatatatatcatggaatattatgcagccataaaaaggaatgagatcatgtcctttgcagggacatggatgaagctggaagacatcattctcagcaaactaacacaggaacagaaagccaaacacagtgtgttctcactcataagtgggagttgaatactgaaaacacatggacacaggaaggggaataacatacaccaggaactgcgtggggagggatgcaaggggagggagagcatcaggacaaatagccaatgcatgtggggcttaaaacctaggtgacgggttgataggtgcagcaaaccaccatgccacatgtatacctatgtgacaaacctgcatgttctgctcatgtatcctggaacttaaagtaaaaaaaaaaacaaaaaaaaagagaagaaacaatgatacatattttctaagaagggtaacatgggatgtttcatacattgactgccaaaaagtcatagaaaatagaaaattaatttatttgtgctaatgtggcaacatcactctgtaaaatcagttattcattaagcatctactatgtacccagggtctttgctaagtattaggaataagagagagacaagatagtgctcttgtcctcagtgacctagtaggggacacaaatatacactactcaaaaaaagagtctatattttacaaactctattcaattattgagttattaatttctttacataaggcttaacagcacaaattttagagtaagtgaaataaatcatttgttttttaactagtgccaaaatttttaatttttttctttataatggaactaatataagttaatttaggaaatatagaagatatgtataattaaaagtaaaggaaaaaagaaaaaataaagtaaaataaagtgaatccttcatctgtagataaccttcatgaaaattttggacgtactcacccacactatcttctaaaaatacataaacacatagagaacaatactgtcttagcctatttgtgttgctataaaggaatacctgatgctgagtaatttataaagaataaaggtttatttgactcttggttctgcaggctgtacaagtagcatggcatcagcatctgcttctgatgagggcttcagagagcttctactcatggtggaaggccaagggggatgaggcactacatactgagagaagaaagagaaggatgggaaggaggtactaggctctttttaacacagagatctggtgggaactatagagcaagaactcactcattaccctaaggatggcatcaaactggtcataagacatctgcccccatgacccaaacacctcccaacggactccacctgcaacattgggaatcaaattttaacatgagatttggagggaaaaaatatccaaactatataaaatacttgctgtgacacaatttttttaacttagttgttgtttttcttgtctttattttctacaggaatattcatgccctgatatattttaaaattaaaatttttgttaagataattatagacttacttgcaattgtaaatatgtatatatccattacttttaatagcaaaaaccgcaattacttttgcaccaacctataatatacagagatatcttatacactttacacagtttcacccaatggaaatatttcataaaactatagtacaatatcacaaacaggatactggcattggtaccacacaatgatatcactcatatttcccattttacttgtcctcatctttgtgtgtgtatgtacatgtatatcatgtgtatataggagaattttgttctatacaattttatcatgtacgtaggttccagtttctactatcggagtcaagatactgaacagctgaatcgcaaggacacctcttgtccttttataaccccacccacctcatctcatccccacctctatctctaccctctgataaccacaaatctgtcctctatttctaaaattttgtcatttcaaaatgttatgtaaatggaatcaatcatatattatgtaacctttttgttttggctttttctacgcagcataattccctgaagagtcatccaacttatgtatatattaatagtttcttcctttttgttgctgagtagtattccatggtactaatataccacagattgtttaactgttcacctactgaatgagctggttccagattttggctattaaaaataaactgctgtgaacattcacatataagattttgtgtgaccatatggtaattgcatgtttcgttttataagaaagtattcaaccttttcccacagcggctgtgctattttactttcccaccagcaatgaatgaatgacccagtctagttgcaagttcaggatctgctacatgttaaccaggtgaacttaggcaagctactttattacttttaggcttcgcttcctcagcattttttttttttttttttgagactggacagcctcgctctgtcgcccaggctgcagtgcagtggcttgatctctgctcactgcaacctccgccttccaggttcacgccattctcctgactcagcctcctaagtagctgggactacaggcacccaccaccacacccggctaattttttgtatttttagtagagacggggtttcaccatgttagccaggatggtctcaatctcctgacctcatgatgtacccgcctcggcctcccaaagtgctggaattacaggtgtgagccaccgcgcccggcctgtttcctcagcttttaatccgaggatcacaatatgtttttagggctgttactgggattaaaagagatatatgtgtgaaacaaaaagtcaaaaagtagtaacagagtatagagtaatggctaagaagacacattgcatattaaagagccttattttatgaataaatgtttgcagtaaggaggaaaatgcctggagttaagcaggaagactggatattagaaaggaagagaatataaagtatagattagtgccatttttgcttaataaggtcataaacgctagatagaggtattttattttaatgtgtaaaaatcctaggctctgaaatcagactgtctggatttgaattccacctctatctcttactatatggcttaggtaggttacttatcttctttgtgctttaatacttttatctataaaattataatatgactaatatttacttcatcaatctgttgtgaagattaaaagtgttgatacacataatgaagttagacttatgcctacaacaaaataattattaaccattatcatttttaaatgtctgctttgtctcccttctatgtattcgctgtatgaccttggataaatcatgtaacaattgctgtgtctcagtttccttatctgtacaaaagaataaaatattatagaactatgataaagattaaatgtgataacatatttaagatgtttggtacatagcaaacatgatataaatgttagctcccttcccttcctaatcatcaattatgtcactatattgtaaccagacatttttctcatttctcccaggagtaaggctgtcacctgtcacttttcccaagagtatgcctttgtacagctgcttaacttgctgcgtgaagtttagagtacagaagctttgcaccaaagtatactttaatagttcacaagtgtctttatgctcaatttctagtaatagactgtttttgaaaattcattcctaaaaatgtgtgtctctcaactaggacaaagttgctatagtgatgattacttattttttccagagggaaataaattaggtaaacacaaccatattatcatcttgtctaacagtatattaaagaagaaagactaggctctttataagtgggtataaagcacagcaggtagagtggagattcctggcagaacttataggctctggtgttataaattccatgaaacatggggcctaggcaaccctatgaagtagataatttgggtctgtaaactcaaaattaataagatctcaaatagacttcctctgagaagcatggtggtaccttgtcacgtccatttgactcagctgttttgattcaggagcattttgatatttgggcattttgacacctcctaaaagcaaacaattaagctttcagcttttatgataactgtgtaacttgtattaaaacaggaacatcatccctaagtcttaaccctttgtgatggggtcaaggatgagatggaggagagcttaaacatctcacaagagcaccgaagtatatattttattaagatttcttctgtatatcccacagaaagcacagctcaggagtcaaatctaaactcatcactttctcccctgatcccactctcatttctcccccttaccgaccctactctaaatatggttttccttatatttgtaaatggtaccatcatccacactttcaaccagaagttaactcctccctcttcataaccaatcctttataataggcctgagtcttctccagtatatttcctatgtgcttcttaaatctctcatttccttttcctcccttctgccaatgattttgttaaggtcctgattatctttcaactgatcactgtaatactctccaaattggtatctctgactccagtctcaatcaatgatcacttattcattcagtcaacaaatatttattattattatatgttaagctctgaatatacaacggtgagcaaggtagccatggttcccactcttgtggactttatagctttcacaaaaagagaattaaattattgatagcacaaagtgtggtaaatgctatgattcactcatctaaaaactactgttaggcagaatctactaatgtataaaggcactgttctagtccctgaggatataaaaatgaatgacagacaaggatcctgtccaggaataaatacataattttaaaaatatgatagtttcaagtaatggcgagtgctatttaaaacataataaatagtaatatgatagagcacaagtggaagatgtaaggatagctaagtagtcttggtggtaaaggaaggattttctgacttaagctaagaccagaatgatgagaagaaaaccagccatgaagagatccagaggaaagtatcccatacagaagaaaaaatcaatgtaaaagctgttagggacaagctgagacacaatgagcaaggaaataagtggcaggagatgaagtcggaaagctccatagagaatatattatgtatatctttacagaacatgtcaaaagatttggatttttatcctaagtgtagtagaatgccatttaaaacagagaaatgacatgatcaaacttacatttttaaagaagacttctgactgctgtggtaaaaatggataccaggagcaaaagtagaattaggaaggccagtaagtcaactcctaaagtactctaagcaagacatcatgttggcttggactagagcagtagcagtggcatatacaagaagtataaatatggtcaagttatatttagagttagagacagtgagacttgatgatagattagacgcggggatgaaaagaaagtggaatcaaaaatgactcatcagagtttagcatgagaaacctcggtatatggtggtgccattaccagggatgagaaagttagaaataaaaggatagcaaaagagaaattaaaagttttcttttgggtcaggtacaatggctcgtgcctgtaatcccagcactttggaaggccaaagaaggaggatggcttgaggtcaggagtttgataccagccttggcaacatagcaagacctgtctctacctaaataaaaaaaaataaaaaataaattaaaaaaaatagccagacatggtggcatgtacctgtagtcccagctattcaggaagctgaggcaggaaggttacttgaggccagcagttcaaggcagtgagatttcatcacgcgactacactccaaccttagcaaaagaacaagaacttctctcaaaaaaaggaagaaggaagaagaagaagggaagaagaagaaagaagaagaaggaggaagaaggagggaagataaaaaggttttctttttgaacaagttaagttgttaggcaaagtacagtgctatgacaatatacaacggggggaaatataacaaactaatggtgtcaggaaatgattccaatagaaaataagatgtgaaaaaaaagaattgaaaaaatcctccgtaatagtcagtgtaatctttataaaatacacatttgactagaacatttttcttaagatctgtcactaatttttttatctactacagcacgatttctctgaataccctttaagatgtcaatctcctccatcagactgtgagtcccttgggtgaagaattcattgttgttcattcacaatttatcacaataactagaaaatagtaattgtgacttcaacctaaaacacagtacttgttacattgaacatagaacatagccctgtgttaagtgggtaatctagctgtgtaattgtcaagtcgcttagtctctctgaggcttatttcttcaattatgaaagacagaacctctttaagatcacctccaactttaatattctatgtttctctgtgatatgtgaaaactttacgtttgaaagtcatttgcaatcaattagaattccaatccagacttgtgtgactcttaaatgtgctacacagtttctcaacacctctgtttcttcatgtgtgaaataaaaaattaaaatattgctccacttcatagaaaatctcattgatgacataaaccatatttaaatgtcaaatgattaaaatagtaagcaaaattctgcaaatgaaagaacattttttcttaaatgatttgtgatcagaaatgagacttgttgcctgctaaattatgccttactacatttggaaggaatatgttcataactaatgatttctctttgttttgtcttttatcaagctgttctttggtgtgtgtgaatcattacaagaacaacaaagtaagccctaattttttcaggagtatgtttgtgaaatacaacacaaatgtacaacctcttccagctctttatattcttcaccagccttctctattttgtttttaccattgtatcaaatctccaatttttaaatattcaccaatggcaaagtatgattttatgtagaaccaacttttcaagaacattatatcctattatatgatattcactctatgttcaataattttacttcattcacctactacctcaatgtgttttacagtggaaaattttaactccaacttaaaaaaatgctaccaaaatcaaaaatcttttggaaacacaacagaaatgaaacataattcaagaaatctaaaaatataaactggaaaaacgtatactgaaatggaatgaacaggggtaggaatgccagcactggtaggagttatccttgaccacgacatttgcagctatagctgagtaaaaaaaaaagttaatcccagtggaattgctctatggctaacaggcagtatgtaaagagtgttataatatcagtttgttttcaggataatacacccttttaaaagctagacacattttggtggaaactggctaacattcaccaatcctactacctttgcttccttaggcacagttagattctactaccaagatcctttggagctaggtgcagccagatgtccaaattgtggccagtggaatatggataaatcttctccacaaggcaacatgcatgccctcgacaagagctatgcccatctcttctggctgccaggccagtaaataaaagatctctggtctatgttcatgagacagctggtgggaaggaacacagcagctacctgttataggcttctgtctttgattttgcataactatgcttctaatacatttactagaaagttaagttggtacaaaagtaattgtggttcttgtagttacttttaatagcaaaagccacaattacttttgcaccaacctaatagtgtatattgcctttcttagcaaaaactgtacttgccagaaccattgctgagaagatttataactttgtttacaaggttaaaaataaaatataaccatgagaataaaaaggattaggaggttgaatttaaaacattaaaaccaaaaataaaataagagaaagaacagataaaacaacataaatctggggaataaaagtgtactaaaacaatgatagaccaacatctacaaattctaccaaaaatgctgtacctggtagatattaaatagcatatgctgttgaggaattcaatatcttgaaatcaggacaaatactatctgcaaagaggagtagttaaaagatttaatgtaaaggattttggatggtggggagaaacaattacaaggaaacaggcagaaatggactccagacatgtttttgagagggtttagactctcccatctcctggacaaatccagaagccatacctctggagaagagccacaacaaagcccattgtgataggagtctcaaaattgaaagcactggccgggcgcggtggctcatgcctgtaatcccagcactttgggtggccaaggtgggtggatcacctgaggtcaggagtttgagaccagcctggtcaacatggtgaaaccccgtctctactgaaaaatgcaaaaaattagctgtgcatcatggcctgcgcctgtaatcccagctactcaggaggctgaggcaggagaatcgcctgaacctgggaggtggaggttgcagtgagccgaggttgcaccactcctgtccagcctgggcaacgagagtgaaactccgtctcaaaaaaacaaaaagattgaaagcactaatcagaacaggcacacctcatttaaaaagagacacattcctaaaagtggtatagagttttaatttttattttttcttttaaacacacaatttccttttttagaacctaacacagtgggcactctataaaaattttgggattgatgaaaccattgatggaggaaaccatggaggctttccatccattactcacacattgctctatatattatgtacactgcctctaatctacagatgagaaattttaggcacagagatattaaacaacttgcccaaagccacaaatatgtctgctgactctaaaacccattgtttacaacttgtggctttgtttgttaaaagatcccttcctctttaagtaaaagagcaaattttaccttacaaaccatcagaccctaaattaatctacctgaaaaataaaatgttggtatggtgttttgagttgtttcaaagtgagacacattaaggacaaagtatttgagaacatttaaaggtcttttaacttcattagggattttaagtctgatagatttaacatgcctctacaaaatgtacaatctaatcatgttgaaagatcaaatctagaataagccctatcaattagcacaagaataacagtgccatttgttgccattggaggaaatggttttgttatagatttctaagagaaattagttagattttactttgaaggccataaaatgttgtttatattctttttcaaataacaattcttgtaataagataacaaagacatactgctttgtaattcttatgaaaataaatttgttaataatcacttaaaataatagcttccatttgtttagtaaatatcgatcaggtaaatgttctaggcactttataaacatcttatttaatccttgctacaactatttaagataaaatactatttttcacattttataggttcattaaggcttaaataactaaaattatgtagcgtgaatcatacaaccacagatgcatcttattctaaagcccatgctatctccattgtgtcctaactggagctaccttaaaagaaatattactcagtgacaactccagtttgaagggatatagtatatgtgtgtgtgtgtgtgtgtgtgtgtgtgtgtgtttatatattgatatataatattttaaaatttagaatgtaaatttgttttaaaatgaaaaacttctaagaaaaagctttgtatatcaaagacaataaatacattctgccatttgaataaaatcttttagtctaatgaatcacggcaattttacgttatttaaaaagagaaaggcaacacagtgtgcattggtcataagttgaaaatattccattgtaaagtcaaaaaatcataaatagaaccattataaattaaagaccaactgtacagaagttctaatctgccatttaattgactagttgtataactaatcttacaattttcactttaagtcttcaaacttcacccatactgataatctagctttcacttctttatttaacaaatactaaattctagaaacattgacagactccaagaatactatgatgaaaaacacatttgttatggactgaattgtgtctcccctgccccctgcccaaactaatatgttgaaattctaactcccagtacttcagaatgtgactatatttagagatggggtctttaaagaggaaatcaagttaaatgaggtaattagggtggaacctaatccaatatgactggtgactttataagaaaaggagaagattaggacacagatacagaaggaagaccatatgacaatacaaggggaagatagccatctgcaagccaaggagagaggtcccaaagaaaccaaccttgccaaccattgccaaccaccttgatcttggaatattagcttcaagaattgtgagaaaataaatttttgctctttaaacaattgaatttgtgatatttattatggcagctctagaaaactaatacatatttcatgatttatttgtgttccctcagtcattaccctaaacattaaagtaaaaatttgaagcttaaaatttctgaaaaaaaaattatgaaaaggtcaaatcccaagaaagcaaagaaaccataagtatttttattttggaactttaactgaaattagacttgtacatcaataaatttgagagggatgagatagacagaaaaggcaattgtttcccaaactgatcttaaccaatctctttgaaaatgttttcccaaaagtctaataattctaggaattctctgaacttggaggcagcttagagcaatggacagatcgttgaccttacagacagttaaatctcagtagctagctgactctgggcaagttatttagcatttcttagcctcgattgctaatatgaaaattaagaaactcatagtttgactcaaatgaaataatccaaattaaagcgatttttatacttgaaagtaccttacaatgttttcatgaggaataattttcctgctttagcaatctaaaaagccctatcagaaaaggatatcaatgaatttctaatctaaactagactattgctaagaaacaacattaagtttaccatttcctggaaactattcatttttaaaacactacattcagtattctggaattgcctcaattctccttgagcattcaaataatgagcagagaccttgagataagatttggggtgagaaagtaaaaataaattcagacaccaaaaatctgccctgacattcatcaggctggaataataggcccagataaagctggctggaaagttaaaaggaaacactatttcacccaaggatatgctgccattataaagtatcatcacaacccctttctttgaatgcctactgctttcttactgaaaaactttgttctataaaatcaaagacaatcagagactttgcttctgaaattctctcagtaaaaatgaaatatcccactcttgtctggagattctaagtcactttgacacagagaagtagcctctatttaggatccaggaaataccttcagataagggtttggggacccaatattcaacatctatcttatctttattgcttccaaggaaacaagtccattgccacatccacatctaaagcatttacacatagccttgctccttcctttcctttgagcctatcaaacactaatatatttaaagtagttcccattcttcatttctgactgtgcttatttatgcttctctctccctctccctcctcctcttccttccactctcttttaagtcaaacatggcagaagttgtttacgttaatcttatcaaatgaaactcagtcattattgatcctctttattctgtgttttgtttgttcaatcagtatcttctctattatttccttttttccattttattgaatttattctgtcctttttctaacatgttaaattggatacttggcttattaatttttttcctttcctttttctatttattttccttggttagaatttttatgcttcctgaaacagagaattatgtcttccatcaattctggaaatttttcatccaggacttaaaaattgcttctgccacattaattctagtctcttctggaactccaatgggtgatatcagctcttgtcattctaatgtccatgtcttttaaccactcttttatgtttttcacctctttgtgataatttctttaactctatcctttatttcattaatttataattttcttttgtataatcttctttttaaccatctactttttagttattataattttcatttttaggaggtctattttgtaatttttatttcctattctgccccttctttttaattatatcttattcctttcttatattagagagtacatgctttatttaaacattttaaacattatatgaagtgtttagtgatattttctggtaagtctcacttatagtgatttatttctcatgtattttgtagttttcattctcaatttatgttttattaaagctgtttttaggtaactccatgaagcctgggttgaagctacattcagtgaaagatgatatgcatttgcttctgccaatcacctgagtgctttcgaattggaactacctaaagtttttttttttttttagctctagactgctcagactacaaaaatgacgtaaattttgactaggcacagtgggtcacgcctgtaatcccagcactttgcaaggccaaggtgggtggatcacctgaggtcgggagttcgagaccagcctgaccaacatggagaaatcctgtctctattaaaaatacaaaattagccgggcatgatggtgcatgcctgtaatcccagctacttgggaggctgagaaaggagaatcgcttgaacccaggaggcagaggttgcatggtgagccaagatcgcaccactgcactccagcctgggcaacaagagtgaaactccgttttaaaaaaaaatgacataaattttaacttgaaagcgatatcagggcagcctttgtggttatcaattttcagagcagatatttctattgttttctatgagagcccaggctaacacataccttcttgccaagttgtcttgcttatcttcgttatttgacagggagacattttttttcacctctaccctcatattaatcatagagttaatttctggctttatgtgggttctcagagatatcttcacatctgtgtatatactaggctttttctcctccactgcctggtcattaaaacaggattaccataattagcaaatgccctctagatagctatgatatcagcaaccacctacaattctatttccaactcatcttcttttttggcccccacagacttcctttacttatttgtgagctcacttaggaattttaaaatattgttgctactccatcaagtaattgtaaatatcttatattagagattttttcaggacattttatctgcaattttgctggtaatgaaactcagttcactcttcaaccaaccccaatctggggcttttactctcatcattacattgaaactattcgcacaaagataaaacttagctataattttctatgaatctcaatttatttggcctctcagaagttttcggtggaattgaactatctttccttcttctcttttctcagcttccataactctatattctttttgtttcctcctacccatgtagcttttttctgcctcctttgcttgctcttcctccatatttctaaacattgaaaccactcagagcttgtttctaatcatctcctcaatctacattctcatcctaagaaatcttgaccacttccatgactttatattattcacatgccaacaactcttaaatgtgtatcaccaacccaaaattatcctctaaattccaaatccacatctctaactacctacatgtctgcctgtacatcgcatagggatctcaaacttcatcttctaatctaacccatatctgcaaatgatacatccatcaacctacttattattgtcaaaagtctaatggctagccttgataacttcttcaacttctctgccactaactcacaaccaaaccattaccaaattccataaatattacctaaaaatacatatcttaaatcaacccacttctctccaacagcagaccaagtcaccaacatttcttacccacaatattgcaacagatgtaactgatttaactgtttactcagtaaccagcaccctccacccccaatacacaatatctgtagtgatttgaaaatattaaactggctcatgctgctctctaaaccaaaaaaattgtgacttgctttattgtaatattcactttcttgcagtggtctggaactgaaatcacaatacctccaagctttgtttatatatgtaacttctcataagcttcttaactcttctcagactcaaattttgacatttattaaataaggatagtaaaaatacctaactcagaattattgtgacaattaaattagataatttagataatttgtatatagtacctagcacagtacctagcccacagtaagcccccagtacattcttttaatgcaacagggtctcgctgtgttgccaaggctggtcttgaactcttggccccaagcaatcctcttgcctcagcctcccaaagtgctatgattacaggtgagccagcatgccctgcccaatttttaattttgtttatttttatattgctctgtcatggaaattgagactagctggttttaattccttttatattctataaactcattcgaggcttttgcatgttgagtagctgaaatttcttttttttatttcagtataatactgtattttccaatgtattaaatgaaagccaagaaaatatcaaattaactttaaaagcaaatctttactctttaaagaaaaaatacaaactgtggtatttttataatagattatattttacataatataaataaaatcactaatgcatctatatgcttggtttccttaaactacaatgaaccatagaatgtgtggaaaatgggtttagtttttggtgaaaaacaaacatcttgggaaaaacaggtagttgtttttttttttaactgtctatgcacaggcactgacataaccaagccttaatggccaccacttccttttccttgtccaaagcagccatttccatagctctcccttccatatcctcactggcatctcccagatcctctgaaacctccactagaccttctgtagtctccaccagagctaccactatagccacctcagttatgtcctctatagtctccaccaccatctccaccatatccttcctgacagggtggagtagtgccaccatagcctccactactatagcctccatcactgtagccactgccatagcctccaacaccataactagaatgtaccctcctatatctacttccattgtcatatcaggccatcttgggaggatgtggaccatctccatactgtgtattgccaaccacaagattgataacaggagctaagggcctagagatttggtggataatgttcagcatatattaattaaaagggtccaactggctgaagatatcaggttgtttgttacttcaacaaccagaggttgttgaatcttcaactccaagatttcctggaaagcagtaatgcaggcagcagcttcatgggatatttgcagtttaattcagtcatctacaagaacaatctgcctatcacattatactttcttgaaggcaaagagaagcaacttcagggaggtgactaaggtcatgcctttagcagagatggctcagattcaagtacacctgatcaaagacagtatttgaacccgagccatctctgctaaaggcacggccttagtcacccccggcttttcaccaaacacaaagaaaagagaggagcactttttgtcttgctactaaaaaaacaattaacagacaatttgtggataagtgcattatgcccttcatggtgagaatatttctcttttccttctgatagcatcatttgggtacacaccaaaggccaagagggagataacagcatccaaattattatctggtccagtgttagtaaacacttgtgtcaataatcttctggaaatccagaattaatatgaatctctttgagctaaactttggcttcataagtcattcttagtgtagccctattgagtcttttgtgctcacaaaattgaatctgagtttcttctctacccgttctagaatcattccaggattggaatactgataaaagggacacataatcagaaaatgggtttccagcaaaatttcggtggatatatcccactttccttcatcaatgaaaacaggtagcagcagagatggtatagacaggatctctctcatagaaaatacaccccattatcatcgttttgccaagatgaggctcaatggagagtttagtcaggacccatcctagagaattaaacttatcattgccatataatgcatcaagctctccaagagtgtgctctgcctaaatcacaggatccaaaggtggaggtccttggattgccttggccagaaattagccaatttctcccagacacaggagtttcatactcaacataatcacccctcacttttgtctttttttaaattttatttgggtttaggggtacatgcacagaattgttgtataggtaaactgtgtcacaggggtttggtgtccagattatttggtcacccaagtaagcatagtacccaataggtatttttttatgctctccttcctcccaccctccacccttaagcaggccctggtgtctgttgttcccctttgtgtccatgtgttttcattgcttagctctgacttgtaagtaagaacatgtggtatttggttttctgttcccaggataatggtctctagctccaaccatgttgctgcaaagggaatgatctcattcttttttatggttgcatagtaatccatggcatatatgtaccacattttctttatctagtataccacgtgtataagcattcccctttctcctcaacctcaccatcatctgttactttttgagttttaataatggccagtctgactggtatgagatggtatctcattgtggttttgatttgcatttccctaaaaattactgatgttgagcatttcttattcttgttgaccacatgtatgtcttttgacatgtatgtcctttgcccactttttaatagtattgtttggtttttgcttgtaaatttgatcatgttctgtatcgattttgcatattgcacctttgtcagatacatagtttgcaaatattttctcccattctttaggttgtatctttattgatattatagtttctcgtgctgtgcaaaagctgtttagtttaattagatccaatttatcaattattatttttgttgcaattgcttttggcatcattgtcatgaaatctttgccaggtcctatgtccagaatggtatttcctaggttttcttctagagtttttatagttttaggttttacgtttaagtctttaatacatcttcagttgattttatatacggtgtaagaaaggggtccagtttcaatcttctgaatattgctagccagttatcccaccactatttattgaatagcaagtcctttccccattgtttgtttttgttagttttgtggaagatcagatagttttaggtgtgcagttttacttctgggcctcgattccgtttcattggtctatgtgtctgttttcgtatcagtgttttcattactacagccttgtagtatactttgaagtcaggtaacatgatacctccagctttgttctttttgcttataattgtttggggtatttggattcttttttggctctacataaattttagaatagtttctttctaattctgtaaagaatgtcattgatagtttgataggaatagcattgaatctgtaaattactttgggcaatatggtcatttttataatattgattctccctatccatgagcatggaatgtttttccatttgtgtatgtcatctctgatttcttggagtagcgttttgtaattgtccttgcagagattttacacctccctagttagctacattcctaggtattttattctttttctggcaattgtaaacgggattgtgttcctgatttggctctccacttagatgttgtttgtatataggaatgctacaaatttctgtacattgattttgtatcccaaaactttgctgaagttgtttatcagatcaagaagcttttaggcagagactatagagtttgctagatattgaatcatgtcatctgcaagcagggatagtttgacttcctcttctcctatttggatgccttttatttctttctcttgcctgactccttgggccaggactaccagtactatgctgaataagagtggtgagagagggtgtactggtctcattctggttatcaaggggaccacttccagcttttgcctattcagtatgatgtaggctgtgggtttgtcacagatggctcttattattttgaagtatgctccttcagtgcctagtttcttgagggtttttacataaagggatgttaaattttattgaaagcttttttgcatctattgagataatcatgtggtttttgtttttaagttctgtttatgtgttgagtcttattgatttgcatatgttgagccaagcttgcatcccagggatgaagcctacttggttatggtggattagatttttgatgtgctgctgagttcagtttgctactattttgttgaggatttttgcatctattttcatcaagatgttcagctttttattgtgtctctgccaggttttggtatcaggatgatacctgctcctcaacttttagaattagtttcactaggagtggtactagctcttctttatacaactagttgaattcaactgtgaatctgtctggtcctgggctttttttggtaggtaggctttttattactgattcaattttggaattcactattagtctgttcagggattcctggttcactcttgggaggttgtatgtgtccaggaatttatccatttcttttaggttttctggtttgtgtgcatagaggtgctcatagtagttctgatggttatttgtatttctgtggggttggtggtaatgtcccctttgtcatttctgattgtgtttatttggattttctatattttcttctttattagtctacatagcagtctatctatcttacttattctttcaaaaaacaaactcctggatttattgatcttttgtatggtgttttcacatctcaaattccttcagttcagctctaattttggttatttcttgtcttctgctagctttgagattggtttgctcttgtgtctctagtttctcaaggtgtgatgttaggttgttaattttagatctttcaagcctttcgacgtgggcatttagtgctataaacttccctcttaacactgccttagctgtgtcccagagattcttgtatgttctgtctttgttttcatttggtcaaagaatttcttgatttctgccatagtttccctatttatccaaaaatcattcaagagtaggttgtttcatttccatgtaattttacggttttgagcaattttcttggtattggtttctattttattgtactgtgatctgaaagtgtggttggtatgatatcaattgttttgaatttgccaaggattacaactttagagttgtgccatgtggtgatgagaagaatgtttttgaacagagagtactgcagggttttattaggcccatttggttaagtgttgagttcaggtcctgaatatctgttaattgtttgcctcaatgatctgtctaatactgtcagtggggtgttgaagtcctgtactctaattgtgtgggaatctaggtctctgagaaattgctttatgaatccaggcactcctgtgttaggtgcatatatatttaggatacttaagtcttccagttgaattaaaacttttgcattatgtaatgcccttctttgtcttttttttttttttttatctttgttgggcttaaagtctcttttgtctgaaattaggacgtcaacccctgcttttccatttgcttggtagttttccatttgcttggtaggtttttctccatccctttgttttgggcctatgaatgttgctgcatgtgagatgggtctcctgaagacagcataccattaggtcttgcttctttatccagcttgccactctgtgccttttaactgggggaatttagcccattcatattcaaggctaatattgatatatgccaatttgatcctgtcatcatatcgttagctggttattatgcagacttgcttgtgttgttgctttatagtgtcacttgtctatatgcttaagcatgtttttgtagtggctggtaatggtctttcttttccatatttagcactcctttcaggacctattgtaaagcagcaagtctggtggtaatgaattccctcatttgcttgtctgaaagggattttatttctcatttatgaagtttagtttgtctggatataaaattctgagttgaaaattattttccttaagaatgcttaatataggcccttattctcctctggcttgtagggtttctgctgaaaggtccactgttgacctgatgggatttcctttctagatgaacgtcccttctctctagctgcctttaacattttttctttcatttcaatgttgaagaatctgatgattatgtgtctcggggatggtccccttatttagtatcttgctgaagttctctgcatttcctgaatttgaatgttgacatctttagtgaggttggggaagctttcacaggtgatattctaaaatatgttttccaagttgcttgctttctctccatctctttcagggacaacagtgagtcatagatttggtttctttacataatcccatatttcttggaggttttgttcattcttttatattctttcttcttcatttttgtctgacaattatttcaacaagacagtctctaagctttgacattttttcctcagattggcctattctcctgttaacacttgtgattgcattataaaattcttgcagtatgtttttcagctctatcaaatctgtttggttattccttataatggccatttttatctatcagcctctgtatttttttaatgatccttagctttcttgcactggactttgacattgttttcaacctcaatgatcttcattcctatccatattctgaattctatttctgtcatttcagccatttcagtctggttaagaatacctgctggggaactagtgaggtcatttggagacactggctttttgagttgccagagttctcgcactggttctttttcatctgtgttggcttgtgttctgataactgacgtgtagtttcagtacagttagtacacttcttttctgggtgttttcagagggctgaggctttgtgcaaggtcttatttgtagttgaattctttttcttggtttcaaatattagtaaagtatttttggtattgaattttgggctgtgatccagtaggtggcacttacacatagtggcctgtaggcagccacttaatcaacagtgtggctcctctttatttcctcatgattgcagccatgcttcttctcagtgctttgaaagtatgggttcctctcccacttgagtgctgactgcaaatcttggcttgggactcttgggcagaaggggaagggatcttagcagtggttatggcagagagcctttcacttgcctcttggggttccaacccagagagatgtggacccattattaatcagtgcaattggccctggatggggcacctgtgctttgggctcaagctaggaaggcccgcctggtgatgagagggtgtcagggacaggtaacagggagacagactggcctcttctccctagtgcaagagcagcttgctggaggtgtggttaaagcactcagggtcttcgctgcttctccaattcaaggacagcaaggtcactaccactgcagtggcagtagcagagggccttttggttgacttcaggagctctacctcagaaaaatgtagagccactgctactgggaaaattcagccaggaggtgagacagttgttctactggctctgcttgttgaggagtgggggttcgagtgctcacagggatgagcgaccaggcttctctccatatggtgactgtggtgtattggaagctcaggtgaagccctcaggctcttggtttcttccccagaccaagggtagcaggggcagaaccattgctgtggcagtggcagagggtctgccagttgtctcagggagccccaccccagggaaactcagagacattccgtgggtatgcttagctgtggatgggtggctattatgtggtgcaaagccggggccctgcctggtaaagagtaaggggtgggagctcccagggaagacagatcactcctttccatatagtggctgtagtgtgctggagatgcccatgtagtgactggccctttgttgctttcacaccaagagtggttagggtgataccactgcagctgcaattccagaggggttgtgggctgtctctgggatttcctcctcagagtaatgctgaaccacctgcaactgaaatgttcaggttgaagcaagttagctgtgctggaattccaggctgagaggccctgcctagtaagaaacaagtaaggtccaggactcatgtgtagaacactctggccacttttccatgggatggctgtgctgtacaggagatctgtaccactccctaaacattaagtactctgcagagcctgaaggctatattggcaggggctgacagacgacaaaggtaaccagcctctctttctgggagctccatcccagggaagtgcagagctgctaccagcccaagagcacagacagggggtggctggagacccagaccactgggcctcatcctgtgaaatgcagtggaggtgaagcctggagtccactgctgctcagccctctggattcagccactttcctgggggaatgaagggagcccgacctctcctactgctggagctccagtcactaatgctgggatacctaggaattcatggctcccaggattccatgtgtgcctgggcagcagctctgcccagactccacacagctctcattgtcagtctggaagctctggtggggtaggcttatgcatggatcacctgagcccagggttgcaaaggtccatggcagaactgtgggtccctggggactctcactcactcacaatttcctggcagtgtgggagcctactctggctccatgccactcctgggtgggcagttgtcctgtctcactttgctccattctccatgggtcaagttgtttccttgatgaaccctaatgtttccatctagatgttccagttgaagatacagtagttaatcaccactttcttctctctgtgagagaggtgcacactagctactaatagccatcttggcctctcccatgatcacccctcacttttcaatattttaatcaatttgccttgtctttagtccaatttcttcacagttgttctccattgaaggatcctgaagagaagctctagtatcttgatctttgtagagcaagttcctgctttgaaaaactaagaccaaggttagacatcttgtaatttatgtatatttgtgaggtttatgtttgtcgatgatgctgttggttaggttttatttgggatgagggttgaggttttgtattttcatttgttttgccttttggcttatttgttggtttgatttgtggtggtgctcatttattggccttcattagaaaatgaagagtaatttctcaaagaaccactgcaaatatatgttttcatttaaaagcttctattcttaaactttaccattcatacagaaacagcaatcattttaactggacttggattcctacggaagttatacacaccagggaatccagcatatcaagataaacaggctgtagagtacatatatattaacatcatttcttcctacttattgtaaaacactcttctcatcacttttcctctcttggtttcctttttcagccttaagtttattatatactccatttgaatgtgtcaggatgcttgccaaagttaatagaagagagaaaagaatacagttgagggagaaaatagatatttctcttctttcaggtgtattgacaattgtgacaaaacttatttttacaaggaaagagaacacaagaaaactgacatttgggcaaaaaacagttatgcagtttcctggctgatctctaccatatttgagtctgactatgctgccatgagtggagtatatactgtagcaatactgagagtgagagaagtccttgagtacctgtgactgaagaggccagtgatgggaagtactcattcatttttttaacagttttaatgtgtttacttaggcatggggaatactccttgatctttatctttattatctctactatcttcacttccccaagccacatgcagcagcaaaaaaggagacggaaactgacaaagggagatgtcaatctagcatgtagtgaactccctattatggactgaataaagtaatggcaacaaaagccaaatttgacaaatgggatctaattaaactaaagaacttgtgcacggcaaaagaaaataccatcagagtgaacaggcaacctacagaatgggagaaaaattttgcaacctgctcatctgacaaagggctaatatccagaatctacaatgaactcaaacaaatttacaagaaaaaaacacaaccccaccaaaaagtgggcaaaggatattaacagatacttctcaaaagaagacatttatgcagtcaaaagacacatgaaaacatgctcatcatcactggccatcagagaaatgcaaatcaaaaccacaatgagatatcatctcacgccagttagaatggcaatcattaaaaagtcaggaaacaataggtgctggagaggatgtgcagaaataggaacacttctacactgttggtgggacggtaaactagttcatcctttgtggaagtcagtgtggcgattcctcagggatctagaactagaaataccatttgacccagccatcccattactgggtatatacccaaaggattataaatcatgctgctatgaagacacatgcacacatatgtttattgtggcactattcacaatagcaaagacttggaaccaacccatatgtccgacaatgatagactggattaagacaatgtggcacacatacaccagggaatactatgcagccataaaaaatgatgagttcatgtcctttctagggacatggatggagctggaaaccatcactctcagcaaactatcacaaggacaaaaaaccaaacaccgcatgttctcactcataggtgggaattgaacaatgagaacacatggacacaggaaggggaacatcacacaccggggcctgttgtggggtggggggagcggggagggatagcattaggagatatacctaatgttaaatgacgagttgatgggtgcagcacaccaacatgccacatgtatacatatgtaacaaacgtgcacgttttgctcatgtaccctaaaacttaaagtataatttaaaaaaaaaaatgaaaacctaacttacactgtggctacatttggagataaaacctctaaggaagtcattaaggttaaatgaggtcagaaaggtgggtcatcgatctgttaaaatcaatgtccttataagaaggttcacaagcaagctgtatctctcttcacacatgcataaagaagtcatatgagtagacagcgagaaggcagccatctgcccaaggggagatccttcacaagacaccaaccataccagaaccttgatcatggaattccagtgtccagaactgagagaaaataaactgttgtgtaaactacccagtgtatagtattttgttacgacagccctaacagactaatatattccctaagatggggaatcattttatttttcattgtatcctcaggagtatcaaggttggatacattatctcttttatgggtcccatgctaaattaattactcaataataactgcaaagtggttaaaaatgaaagttcaatcagaagaaaactaggcaatactgtatttttcttgaataatcctcagaattttgaaatatccttagcagaaaatgtctatgaaaacagaaagcatcaaaagattcacaataggttagtacaccacacaagaagaaggagagataaaaggaagataatagaaataagaaatgtgtagaatgaattaccaaaaaaacttgggatgggtgcagtggcttgtgccagtaatcccagctctttgggaggccaagaatggagaactgctggaggccaggagtatgagaccaatctgggctacatagtctataaaaaaattttttttaaattaggcaggcatggttgtgtgcatctataatcccagctacttcagaggctaaggcgggaggatgacttgagcccaggagttcaaggctgcagggagctataatcatgccactgcattctagtctgaacaacacagaaagaccttgtttaaaaatttaaaaattttaaaaaacctcgtcagatattggtattgagtacatgagagagaactgtgtcaaggactgaatgtgacaaaggagagcatttagaattatatcaatggcagacactactacctttgtagatagctactacacagcaagcactatactatgaatttaatatactgtactatttaatatatattatgcaccatatagacatacatgtacacacacacacacatacacacacacacacacacgccccccgagagagagagattgaaaggggagaagggtaggttgtatcatatacaaggtgctatatcatttgccagatatacagtgataaaacaatccctttctatctgaaacttaagtttagtttccaacactacatcatggtgcagaatcttgtacttatacatgttcttctaaaatattctatgcattttgtaatcaccagatggattcttcctgcctgctgcacagacaaaatcaatccactgagaccacagcattgcatgagagagagtttaactgctgtgagaccagccctcacagaagaactggagttaccactcagatcagtttccctgaaggcttggaggttatggtttttacggacaacttggtgggcatggggcaagggaaggggtgctcctgattgttggggatgaaatcataatggtatggaaaatgttccctgtgagcttagtccacctctgggtggagccacaggatcagctgagttacaggtcacaagttcgggtggcatcagtctgaaagatatttcaaaaaaacaatcttaggtactataacagcaaagttatctataggaacaattggaatagtcacaaatcttgtgacctctggtcacatgacccctgggcagtaaaggattatagaaactattcccattttagcagaattcaggcccttatcataatcctaatgttgtggcctttcattagatttttacaaaggcagtttagtttgggaagacagcttgggggtcagaagcatgattgaggccaggcgcggtggctcacacctgtaattccagcactttgggaggccgaggcaggtgaatcacaaggccaggagtttgagaccagcctggccaacatggtgacaccccgtctctactaaaaatacaaaaaattatctgggcatggtcacaggaacttgtaatcccagctacttgggaggctgaggcaggagaatcacttgaacctaggaggtggaggttgtagtgagccaagattgtgccactgtactccagcacgggcaacagtgcagaactctgcctcaaaaaaaaaaaaaaaaaaaaaaaaaaaaaaaaaaaaaaaaaaaaaagaagcaagatggagtcaacaatataagatttttttttttttgaaacagggtctttctctgttacccagggttaattgtcgtggcacaatcatagctcactggaaactcaaactcctgggctcaagcaaacttcccacctcagcctcccaagtagctgtgactacttcatagccactgcaactggctaatttttttttaattatactttaagttctagggtacatgagcacaatgtgcacgtttgttacatatgtatacatgtgccatgctggtgtgctgcacccagtaactcgtcatttaacattaggtatatctcctaatgctatccctccccgctccccccaccccacaacaggccctggtgtgtgatgttccccttcctgtgtccatgtgttctcattgttcaattcccacctatgagtgagaacatgtggtatttggttttttgtccttgcgatagtttgctgagagtgatggtttccagcttcatccatgtccttacaaaggacatgaactcatcattttttatggctgcatagtattccatggtgtatgtgtgccacattgtcttaatccagtctatcattgatggacatttgggttggttccaagtctttgctattgtgaatagtgccacaataaacatatgtgtgcatgtgtctttatagcagcatgatttataatcctttgggtatataccgagtaatgggatggctgggtcaaatggtatttctagttctagatccctgaggaatcgccacactgacttccacaatggttgaactagtttacagtcccaccaacagtgtaaaagtgttcccatttctccacatcctctccagcacctgttgtttcctgactttttaatgattgccattctaactggcgtgagatggtatctcattgtggttttgatttgcatttctctgatggccagtgatgatgagcatgttttcatgtgtcttttgactacataaatgtcttcttttgagaagtgtctgttaatatcctttgcccactttttgatggggttgcttgtttttttcttgtaaatttgttggagttcactgtatgtagattctggatattagccctttgtcagacgagtaaattgcaaaaattttctcccattctgtaggttgcctgttcactctgatggtagtttcttttgctgtgcagaagctctttagtttaattagatcctgtttgtcaattttggcttttgttgccattgcttttggtgttttagacatgaagtccttgcccatgcctatgtcctgaatggtattgcctaggtattcttctaaggttttatggttttaggtctaatatgtaagtctttaatccatcttgaatgaatttttgtataaggtgtaagggagggatccagtttcagctttctacatatggctagccagttttcccagcaccatttattaaataaggaatcctttccctacttcttgtttttgtcaggtttgtcaaagatcagatcgttgtagatatgtggcattatttctgagggctctgtcctgttccattggtctatatctctgttttggtaccagtagcatgctgttttggttactatagccttgtagtatagtttgaagtcaggtagcgtggtgcctccagctttgttattttggcttaggattgacttggcaatgtgggttcttttttggttccatatgaactttaaagtagtgttttccaattctgtgaagaaagtcattggtagcttgatggggatggcattgaatctattaattaccttgggcagtatggtcattttcatgatattgattcttcctacccatgagcatggaatgttcttccatttgtttgtatcctcttttatttccttgagcagtggtttgtagttctccttgaagaggtccttcaaatcccttgtaagttggattcctaggtattttattctctttgaagcaactgtgaatgggagttcactcatgatttggctctctgtttgtctgttatgggtgtataagaatgcttgtgatttttgcaattgattttgtatcctgagactttgctgaagttgcctatcagcttaaggagattttgggctgagacgatggggttttctagatatacaatcatgtaatctccaaacagggacaatttgacttcctcttttcctaattgaatacccgttatttccttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcatagatatctcttattattttgagatatgtcccatcaatacctaatttattgggagtttttagcatgaagggttgttgaattttgtcaaaggccttttctgcatttattgagatagtcatgtagtttttgtcattggttctgtttatatgctggattacatttattgatttgcgtatgttgaaccagccttgcatcccagggatgaagcccacttgatcatggtggataagctttttgatgtgcccctgaattcagtttgccagtattttattgaggatttttgcatcgatgttcatcagggatataggcctaaaattatctttttttgttatgtctctgccaggctttggtatcaggatgatgctggcttcataaaatgagttagggaggattccctctttttctactcattggaataatttcagaagtaatgctaccagcaactccttgtacctctggtagaatccagctgtgaatccatctggtcctggactttttttggttggtaggctattaattattgcctcaatttcacagcctgttattggtctattcagagattcaacttcttcctggtttagtcttgggagggtgtatgtgttgaggaatttagccatttcttctagattttctagtttatttgtgtagaggtgtttatagtattctctgattgtagtttgtatttctgtgggatcgatggtgatatcccctttatcattttttttttgcatctatttgattcttctctcctttcttctttattagtcttgctagcaggctatcaattttgttgatcttttcaaaaaaccagctcctggattcattgattttttgaggggatttttgtgtctctatctccttcagttctgctctgatcttagttatttcttgccttctgctagcttttgaatgtgtttgctcttgcttctctagttcttttaattgtgatgttcgggtgtcaattttagatcttttctgctttctcttgtgggcatttagtgctatagatttccctctacacactgctttgaatgtgtcccagagattccggtatattgagtctttgttctcattggtttcaaagatcatctttatttctgccttcctttcgttatgtacccagtagtcacacaggagcaggttgttcagtttccatgtagttgagcggttttgagtgagtttcttaatcttgagttctagtttgattgcactgtggtctgagagacagtttgttataatttctgttcttttacatttgctgaggagtgctttacttccaaataagtggtcaattttggaataggtgtggtgtggtgctgaaaagaatgtatattctgttgatttggggtgcagagttctgtagatgtctaattttttttaaatatttatagagatggagtctcaccacattgcctaagttggtcttcaacttgtgggctcaagcaattcttccgccttggcctccccaagtgctgggattacaagcatgagccactgttccctgcctgtcagatttctgacataatcttgcaaaggtggtttcactctttcctttattactccattcaatatatgtttattgagtgcacgtactcttttacctcaataaatggaacctagattcttccaatcgggcaagtcaagaaccatgaaagtattatcactgttctatttctctcatatccaatccatcagcaagtcctatcagctcctcattctaaatatagctcaaatatgactgcttcttaccacctttaccactttggtcaaaagagctatcatttctcacttgagtgatttcaagagccactttattggtctccttgctcctactcattccaactctggctccttgttgtgcaaataaaatcaatcagatatcagactttctgctacagtatttattgagagaactgcatagcaaaacaaatagtagcatatgtgtaagttcacctttgcccactgaattctgaaataacaaaaaaggatctaatgggactgaacatcaaactccagccattggattgtagggcttttaagctacctaatgagggaaacaccaaactactctggtatgatcacagaggcatccaactgtagtaattatgtcatggccaaaattgatcttcagtcctcttccaccacgttggcatccttcagttaaaggaacaacagcctttcacctggtgtggtcagtggattcgcatacaaggtttgtagttcttatttatgatgtgacagaccagtgatctacttcgccatttcagcatcctgtcagaattgattgccttaagtatttggttttccagggagctctaaaagaagccaatttctagtctaggaggccagttgaagggaatcagtattgaatatgatgatcctaccagctatccatctaaataacttaacacaagcagtaaatatgacccacctaaatcaaaactcatataatgcccttcctctattccaaggcctccagtagtttcccatttcactcagagtaaaatccaaagcccttactttagcctacaaggctctacaagatctgcctacctttctacttcctcttcattcttactattatccccatcactcactcctatccatccacactgttcctctgacaatctcaccaagcttttgcatttgctgttccttctgcctagaatattttctccctagataccaacaatgtaaaaaaaaaaaaaagtaactttggtgaaaaatcagaaagacatgaaaaccaaattaatctacttggtttttttttttaataaaaatccccccaatcatttaaaatagaaaaaaaaacaaaaacaaaaaaccctggcccattgatatcactaggacactcagaagaagccatagcaaaatcattttggatgacaatttttatgagctaggccacaaaggatttgcacagttggggtaggggtgagaaggagaagagttccactgaagatattatagtgagtaaattaatatttttggccaggtattgtggctcatgcctgtaatcccagcactttgggcggccaaggcaggtggatcacttgagatcaggagttcgagaccagcctggcccacatggtgaaaccccatctccactaaaaatataaaagttagctgggcatggtgttgcattccccagctactcagggggctgaggctgaggctgaggcatgagaatcacttgaacctgggaaacggaagttgcagtgagccaaaatcatgccacagcactccagcctgggtgacagagtgagactctgtctcaaccaaaaataaaaaagaatattttcatgttactagatggttctggctttctgagcaaattttaccagaagctaaattagaggccaagacttggaagttaaatgatgacagaatagacagtgagaggactttttagagatataccttcctggatgtttacatttcaaaggaggataagacacagagacattcaggcattgtaaatccagacgcaactgtcttatcttctgccttgcaacacttatttacattgcaaagtgtaagtacccaggactccttcttttctcttcccttatttacatttgaaagactaggtttctctcactctgaggtgggcaggatggcagatgtttaaactatcctatataaactgcccgaatcataatatcagagttccttttctgcagtatagttcctggtacatgtagaatgacttagactctcaccatattgttccagaggatgaaaaaattgggcaagaagaacgaatgcagttattgatgtaagaaataatacctttgatctctgcttcagaaacttcatgtttatattcaagttaagatatataaacatagattttttagacttattttaaaatctaaactcacaaaacacacaagaaaataatcccccatgaaaaatagccgacctatcaaatggaaggatgagcagcccaggaacttgaaaaaagggaacaatctgaaaaggactataaaatgatggtatttaaatgtttttaaaagataaaaggaggcacaaaacacgtaaggaacaagacagcatgaaggaaaaatagacaaatttaaagagaatcaaacataaattcttgatttgaaattaatagactcaatggcttaagtttgaaagctgttaggaaacactaaagagaaacaactagtataagattcccatgcagaatacaatacaaagagatagagataaaaaagcccaaaggaaggttaagagatacagaagtgagaatgatcaagcacaacatacttgtaagagcagtcccagaaagcaaatagcaacaatatgagagaagcaataatcaatgagctaaaggaagaaaatttttaataattgataaaaagacatgatttttttcatgttgactagcacaccaaattaaaaataaatagacaaatcctagacaccaatgacaaagaattatataagcaatcttagatttaaaaaaaagacccacaaggaaccataatgtgacttttagataataacagaataatatctacaaaattgatcacagcaggaggcagacaaattcctaggcagacaagggtgggtccctggtgaaacccgaccttcaaaccaaagacaaattaaagcctgaaaaccaagctgccagtctgggtgaagtccctgaccagggtgagaatttccttgatgccttttagccaatcaagtgatgctttttccagtgctgcccatggaccaattggcacacactccccattctgagcccataaaaacctcagactcagccacatgctgggactacctgccttcaggtaggggctacccacctcaggtcctctcaactgagaactgttttttgtttttgtttttgtttttgagacagagtctcactctgtcaccaggctggagtgcagaggcgtgatctcagctcactgcaatctccacctcccgggttcaagtgattctcctgcctcagcctcccgagtagctgggactacaggcacaccaccaagcccagctaatttttgtatttttagtagagacagggttcctccatgttggccaggatggtcttgatctcttgacctcgtgatccacccgccttggcctcctaaagtgctgggattccaggcgtgagccaccacacccagccgagagctattctgttgctcaacaaaattttctccaccttgctcactctttggttatccttgtaacctcattcttaaatgtgggaaaagaatctgggacccgccaaaaggcaggtgccaaaggagccgctgtaacagtatagcccccgtgtactccaccagcaccagacagccaccccatgcaacaggaaacaaggtgccaggccagcccagaagccacagcccagaatcgggcgaagggactgaatgagctgtaacacaaactaactgaaacccactccttctgccaattcactgtgctgctggaagcaagaagagaagagttgcaacccttctgggagcccagacctcagggctcctcaggccagagctgtgacatgctgtaacactgcctttggggttctgtggttgctggcatctccaagttttgggggcaccactgctttccccttgtctagacacgggcgtctaagatggaagcctcttgcagtacgtctggtctagctgcagcctcacacagagctggcacctgaagccgcctgccctgcagcagtagccggcacacctggcttgcccttggtgggcctgagatctaggccagtagcaaaagccaagcacagcctgctgggctgagtgggcggagctagctcagtcatcctgagtgaaacttgagcagaggcaccattggccacaaggtccccagctggcaaaacagccccccaaaaatcctgtgtcaaaatgttggaaaataataatcagttctggacttttgcccagttaaataattattcaaaagcagaaggaaataaaaacagcttcaaacagttttaaacaagcaagagcaatgtttatcattagcatatatgtttaaaagaactatattttttaaaaaatttaatgaagaaaaacattgaacatgaagagaccagagtgaagaaataaattagcaaatatgagtatatctgaaaaagtattgactataaatgtaaatttttaacataatgaccacttttaaaaggtttaaaaattaaggtgaaaataaaatattatacaatgtatcaaaaaatagaataaataaaaaagaaaaagtattctacagttcagaaacaaggtatattccctagaggtagacttgtagaaaaaaatacataaatattggttaaatttagaatttattgagtcaaatatgcatgttaaaaatgaaaaggtagcaaagaacagaagtagaagtcacaactttcaaaccagtaaaaggaagaaagaataaagaaaatttgatcaatctgatacaaagcaagaaaggaaataaaaggaagtataggaaaatacatatagtaaataaaaaccacaaaagacgatagaaataattccaaatatatcggtagcctcaataaatataaacagaataaacaactacttaaaatatagatagtcatgttgaactacaaaactccaactctatgtttcttacaacagatgtacctaaagtataacaatgaagaaatactggcagtaaaagtgtgaaaatgatgaaataaaaaaattaaccaaaatagttaaattgttaacaaccaaaatagactttaatgcaaagatcattattgataaagaagctatttatgtaatagtcagaagactaatttaccaaaaaaatagaacaagcctgaaactgtatttacttcacaacatagcctctcaatagataagcaaaaaattacagacatgaaaatttgaattgaatctgtatatatcttatcatatagactcaaaatccacaaacaagaacttaacaagattacaagaaaaaattaacaagtttccaaccatggtgagcttttaaaatatatttccattagtaattaatggatcaagcagagaaaaaattgaactgtgctgttctaaaggattagattttaaaatactaactatttgagaataaattcttttaaaaacccagcctatgaaatatatcaagaaaaagactgtactcttttgaggtcatttctcaattatagatatgctgatcaggagcaactgtatccaatagacctttcagcaataataaaattgttctctatctatgcagtcaaataaggtagcctttaaaatcaagtgtgattaaaacaactaaggaattaattttaattttagttttaattcatttaatttaattaaaatttacttaatgtaatttattaatttattctatttaatttaaatttaaatggccacatggttaccatattgacagtgaagttttagagtagtattagtaaaaagtttatatctttcaatgcttacattagaaaagaaaaattgtcaaaatgaacaagcaaagttcctaatttaaaaggcagaaaaatataaaatcaaagaacatagaaaggaaaaggtaacaaagagtagaaaataataaaatttctaaaaagttacaaaaattttaaagactaataagataagcctctggcaaaaataattaagaaaaatgaaatacataaatgtaaaattttgggagtgaaaaatgtacagcaaactttttaaacttaaccaagtacaataaatacaatttttttaagtttaaaaagaaacagaagaaataaatagatttaaacttaaaaagacatcaaagtagtagcaaaactgtaccaagataaaacagagcaaaacaaaaatcttcccagatagtttgaccaattctaccaaaactaaaaaattaatctctaccttctataaacattctaaaaaatagaaaaaaaattaaattctaacccatgtattatcctaatataaccttgaaaccaaaatcaaccagagtacaaaaaataaacattatatgccaattttatttatgtgtcaaaactctataaaataatattttctagcaatgtaatttttaattataccacataaaactatgaaagcaaggatgctttgctaatataaactctattgctgtaatttttccaatcaacagagtaaagagaaactaacaaaattatctcaaaagagaatactattagataataataaagactgctggctgtgttccatagttcaaagttctgcatctataaatttatttattctttacaacaacgtctgatgtatttttattttcattttattttcttattaggcattgtcattgactaacaaaataggcaataacaaataacaaagctgtggcagagagaagctcaatgtcatccagcttactagtggcaagtccaggatttgaaatcagactgatttcaacatccatgctcttaactacaacatatgttctttctcaagtcccagttgctatttttagggggaaatcttagcaaactacgaatagacgtaatatccaaagatctaagaaagtatctactaacaaacaatctatagttatgcattgtttaatgacagggatatgttctgagaaacatatcgttgggcaattttgccattttgttaacacaatagagtgtacttacacaaacctagatggtacaccctactacacacttaggctacatggtatagcctatcgctcctaggctacaaacctgtacagcatgttgctgtactgaatactgtaagcaactgtaacacaatggtatttgtgtatctaaacatagaaaaggaaaaggtacagtaaatatatgaaagatttttaaacgatacttctgtataggcacttaccatgaatggggcttacaagtcaagtctggaagttgctctgggtgagtcagtaaaggagtggtgagtaaatgtgaaggcctaagacattactctacactactgtagactttataaacactgtacacttacgctacattaaatttattttattttacaataataaattaaacttagcttactgtaacttttctactttacacatcttttaatttttttactttttgcctcttttgttgttacattttagcttaaaacacaaacacacattatagagcaatacaaaaatcttttctttctttatatccttattttatgagattttttctatttttaattttttacattttaaacttttttgttaaaaactgaaacacaggaacacacactaacataggcctacatgaggtcaggaatatcagtatcatagtctgccacctgcacatcttgtcccaattaaagctcttcagggacaataacatacatggatctgttatctactatgattaacaatgccttcttctagaatacctcctgaaggacctgtctgaggctgttgttcagttaactttttttttaataagtggaaagagtacactctaaaataataataaaaagtatggtaaatacctaaaccagtgacatgtattatttatcaagtattatgtactgtacataattttatgtgctatacttttaaatgactggcagtgcaataggttgtttacaccagcatcaatacaatgacaagagtaatgcactgctctacaactttaggaaggctacaaatgcactagttgataggaagttttcagctccattataatcatatgggaccataatcatacatgtagtcggctgttcaccaaaacgtcattatggagcacacaactgtacttcataataaaatgttgaacatcctatttaaagacacaaacaagaaaaaatgcatgcatgtttctagatagctggctatttttatgataaaatataaaatcacaccaacacctcgtatgtatacaaaattaattcaatatgaacttaagaccttggtatgaaaagcaaaacttactatagtagaacatgtttgtgacttgaaggtagagaaggatttcttaaatgagacacaaaaaacaaaaaccagaaaagaaatggtcaatgaacttgaccataggtaataaccatgtattctactactacggaagattacagacattagagaataaatagtggtaacagttattctacatttactaatctaatctttgccaccatttcttttttctggctagtgtttctgagttacttgtgttaaattgctgtatgttctttaggtaggggtatgtataatcagggctgatagcctctacctaaaacataccattttcacaaataacctctatgctatgagaaaagctccaaattattctatttctgtcatttaacactatcagagtgccaaaaaagagtaacatggaagatatttcaaactatctcatgagccttgacaggattacatcataaggacaatagaaagtatttttgaatctacctctagcactaatttaataatgtattcatagcgtttcttttgttctttcaaaaatatttcttattcatttgctgtccacaaggttcttagcacacattaagacaggtagaaatatttaaactaacagtttctctggcttggagaagttgggtattgggagggctgagtggaacaatagcacttttttttttttaagagacagctttcgttctgtcacctaggctggagtgcagtgatgggatcatagctcactgcagcctcaaactcctgggctcaagcaatcctaatgcctcagcttcccaaggaactaagactaaaggctttgtcaccatgccctactaacttattttatttatttatttatttattttgtagagagagggtctcactatgttgcccaggctggtcttgaattcctggcctcaagctgtcctcccacctcaaccttttaaaatggtgagatgacaagcatgagccactgcacctggacccaaatattttcaatagagtgtaattattctaatagaattaagtggcctcttccctttctctgctccaagccctcagatgacaatctttataggactgtcttgtgccaacacacagtatatttattcataaaaaaaatttctgaacctactatgttatcattcttgattactaaatttctcaattatctttgctttatctacaatgtgaaatttgtcagaaagaccaaagctcaaatctcaattctactacttgctaattatgtgaccttgaacaatttatttcactactctgaggctgagtttgcttatttgtaaaatacagataattaacaactgcctcccattgttgttaggatttcataataatatgtaagtagggcacagtcctgttatgatggtggttctacctctctcttttagggaaggaattatctcctgtagcattctatatattgctctgaacacagtatatgtaacaaataattggtgcttggttgtttaagcaattaaataagtcaacaaaaattgtgaatccttaatgcataaaaacaaatgccaaataggtttaagacctaaattttgaaagcaaaattttaagattcttagaagaaaacataaaaatgttacccttatggtctttgagcagaaaaactttgtaaacaagatatagaaagcataaacaatgaagaaaaagatttcttaagctgactacatgagatttttaattttctgcatcaaaaaccatcatttaaaagaaaacaatcataaaagactggaatttatacattcaacaaaggagtcagcatcaataatatttaactagtacatttgtcttagtccatttgggctactataccaaaatatcaaagactctgacttatgaacaataaacatttacttctcacagttctggagactgagaagtccaatatcatggcaaaggcagattcactgtctcatgagggcccgcttacttcttagaagacagctgtcttttccctatgtcctcaaatggcaaaaagggcaatggagctctctaggacctctttcctaaaggcacaaatctcattcatgagggttccaccctatcacctccaaaaggcctccaaataccgtcatattggagattaagtttcaacatgtgaattttgggaagacataaacattaagtctataacagtatccataaaaacattactttaaaataatataaacacttatgaatcagtataaaaaatagaaaacggattcattatgaacttttgaaatgatgctcaacctctctacttatcaggaaaatgcaaattaaaaccaaaatgagatcgcttttcatattcattgaattggtttgcgagaactacagtaattaagtacctgggtagcttaaacaacagtaatgtctattctcacagttctggagcttagaaatctgagatcaaggtatcagtagtgttggtttctcctgagagttgtgaggaaaggatctgtgccaagcctctctccttggcttgtagatggctgtcttctcccaatgtcttcacattgtcttctgttcaaatctttgttcaaatttctccttcttataagaataccaatcatactggattgtggcccaccctaaagacctcattttaatttaattacctcttttaaagaccctatctccaaaataccattacgttctgaggtactaggggtaggacttcaacacatgaattttgtgggggaggggacacaatacagcccataagacttaaaaaattggcaaataatttttcagtctggtaacaccaagtattggcaaggaatggggagaaaaagaaatctcatactttgctgatggaagtataaatcggcacaatcactttagagaacatgcagtaaacctgaagatagacattgtaatccagtaattccacaactatgtatttagtctagagaaacactggcaaatgtgactcaaaaacagttacaaaatattctagctacattatgataaacaaaatatggaaatatcctaattgtccatcaacaggagaaaacacaagtacattctggaatgtctttataatgatataccatgaagcaagaaaaaaaaagtgaacaggagctacaagtatccataaggatgaatctcatagatgtgatattgaacaaaaaaaggcgagctgcaaaaaaatgcaacatcataacatttatatgcaacttaaaatatgcaaaataaaacatatattgtttatggatatacatgtgtaatgagagcatatgcacacttaactatttttaaaccaataaataaattcccaaatgttaactatttttccaccagaacattcaataatataaattcttaattaggctccaagaaataagtactcttaccaaaagcacacacaagtcaattaaaaaacaagtgaactgtaaattcagtgacaattaaataaaaagaatctattctggagcctttaaggttctgtctttttcagctgcacacaggaaaaaaaactaaatgtcatgtttcaatagtgtttaaactatcctgcacacatgcaaaaaaaataccacatgcacatttaagtaaaactctttcaaaataggcaaaacaggatggtgtagcacaaagagactacatttactccaatctgtaatgaaatcctggttttgcctcgctggctgggtgggtttagcaagtcacttattcaacttatctcagcctcactttcttcatatgtaaaatcatataaacttcagttttctcatttgtaaattccctcactttcttcatatgtaaaatcatataaacttcagttttctcatttgtaaattccccattcagtttccttctggaaaggtttgtgtttatgttcggtatctacacataacgtgctcaaatggcacctgtacgggtagaatggtatttgatcagtacagtagaaattaagataaaagtgttattgagtatcagcaagatggcagaatagggctctctaatgcttgtctctcccacagaaacatcaatttgaacaattgtccatgcacaaaaatactttcacaataggtaaggaaaccaagagattacagcacctgggtacagcaccaaaataagaaaacatgcatggaagagggtagaaagaacagctttacattacccatttcacccaactccaggcagcacagggagagataccttccacttgagagaaggagagggcagtgagtacaagactttgcctcagattccaaagctaggcccacccccaataaagcctagcaccaggaagacccccaacagccccaaactccaggtctgtatagcaaattaagtatccaggctgccccatgaccaggctgaccccagtggccccagtctgtagactgcccccagcatcaggctagccctcacagccacaggcttcaggcctgccccagtaccaggccaaacccacatagtcctagtcattgggccagaacctatggacccagcccccaggccagccactgtggatggagactccaggcttgtccagtgccagaccagccccctgcagccccagactcctggctgctacccgcagactgagcttccaaacctgccccaacactatataggatcctgcagccccagggtccaggtctacagagcaaatttgagctccaagcctgccacagcacaaggctaagcccagaggccccaagctccagatcagacccagcagaagacatgacctgcagaatcaggctccagaccaaccccaaggccaggccagcccctgtggccccaggctgcagaccacccctagcaccaagctggatgccaaagtcccaagcttcaggcccacttgaccatcaggccaactcctgcagccttaatgaccaggccagaacccatggaccttgcctccaggaagacctctgtgaatataggatccaggctccacccagtccaagctagctcctatggccccaggcttctatcccaccccaatgccagcttggctcccctggccttaaacagcaggcaggcaccaagacctaagctccaggccttcccagtgcaaggccagtccccatggtcccatgctcaaggccagatcctatggtccaatgatgctacagtaacccagagtccaggagaccccagaagaaccagtccccacgaacccaggctctaggaccacctctgtgtacctactactcaatctggttccttgtcccaagacccaggctaggctttatggatccaatccctaggccaggtcctagacctgtgcctctaaggcaataccagcaggcacaggctccagacccaaagatcccaggctccaggccagcctaatggtcccaggtatcaggcaagtacttgtgatcctaagctccaaaccagtgcccacagacccaggctccacatggaccccagcatcaggctaaccccaggctccaggctggtcccagtggcccagactctagaaaacccagagtccagacctgttccagcagacccatggtccacccccagtcccagtctagaccttacagactaaggctccaagaccaccccttctgacccaggttccatgatagcctttgtggacccaggaaatatttgatatatatctgctatataagatatctgatatataggaaaatatacatatatctctctgatatataagatttcataaaggagaaaagaaagagaaagacaaagcgtagcagaaaacttttcaaatttggagaaagatataaatatccaagtagaggaacagatacaggcctccagtcagattcaacccaaacaagactacaaaatgacaatatgtcaaaaatcaaggacaaagagaggatcctattagcaagagaaaattagcacgaggatccttattagtgagagaaaataagcaaaccatatatgaataagttccaataaggctagcaacaaatttctcagcagggacgttacaggccaagagagagtgagatgatgtattcaaagtgctgaagtgtaaaaaattttttttaaaaaatgtgccaactaagaatactgtatctagcaaagctgtttttcagaaatgaaagagaaataaagactttcacagacaaacaaaagctaagggagtttatcaccaacagccctatcttacaagagatgctagagggagtattcaacctaaaagaaaaggatgctaattaataagtaacgcaaaaacaactaaaagcataaaactcaatggtaaaagaaagcagacaatcaaatccagaatactctaactgcaatggtgatatgtaaatcacttataactttagtatgaaggttaaaagacaatctattaagaataataggccaggcgtggtggctcacacctataatcccagaactttgggatgccaaggcaggtagatcacttgaggtcaggagttcaagaccagcctggccaacatggtgaaaccctgtctctactaaaaatacaaaaattagccaggcatggtggagggcacctgtaatcccagctactcaggaggctgaggcaggagaatcacttgaacccaggatgcagaggttgcagtgagccaaaaaaaaaaaaaaaagaataataatagctacaatactttattaaggtatatacaatataaaaagatgcaaattggcccgggtcttccaggagtcgggttgcttgggaatgcagcccaaagcgggtggtaaactccatttaaggctaaataccggcacgagaccgatagtcaacaagtaccgtaagggaaagttgaaaagaactttgaagagagagtacaagagggcgtgaaaccgttaagaggtaaatgggtcaggtccgcgcagtccgcccggaggattcaacccggtggcggatctttcccgccccccgttcctcccgacccctccacccgccctccctctcccaccgcccctcctcctcctccctaggcattaccattcaggacataggcatgggcaaagacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatattcgcaacctactcatctgacaaagggctaatatccagaatctacaatgaactcaaacaaatttacaagaaaaaaacaaacaaccccatcaaaaagtgggcgaaggacatcaacagacacttctcaaaagaagacatttatgcagccaaaaaacacatgaaaaaatgctcaccatcactggccatcagagaaatgcaaatcaaaaccacaatgagataccacctcacgccagttagaatggctatcattaaaaagtcaggaaacaataggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccgacaatcatagactggattaagaaaatgtggcacacatacaccatggaatactatgcagccataaaaaatgatgagttcatgtcctttgtagggacatggatgaagctggaaaccatcattctcagcaaactatcgcaaggacaaaaaaccaaacactgcatgttctcactcataggtgggaattgaacaatgagaacacatggacacaggaaggggaatgtcacactctggggactgttgtggggtggggagaggggggagggatagcattgggagatatacctaatgctagatgacgagttagtgggtgcagcgcaccagcatggcacatgtatacatatgtaactaacctgcacattgtgcacatgtaccctaaaacttaaagtataataacaataaataaataaacaaatagaaaaaaaaaagatgcaaattgtgacatcaaaaatttaaaatgtggaaggatgggtcaggatcactcattagaagcagctagtacacacctcctccatgaaaaggaaccagaatagtaaataaacactttgaatagatcatctaagagagacttagattcaacaaagaagtgatgagaagtactgaatgtgagtaaggagagggaagggggcagctctcttggctggggatcagctgggagccagaaaaagctcctggatgcagggaaagggtaaaagagaaacccccagggttctacactctcaccgcaggcttttgcattcttggctatgagagaacctcttggcccacagacctttggcctgacatgaggaacagactagagactgtaccaagatgtcgctccagacggggaacccacatggagtcccacaggtatctgagccctgagcagctgcttcttggtgccatcctgagaactttgctgcttagaatctgcatcctgtcctgaggcaggactgacacagccagtgcagctgccaccactaggctgggacgggaaaggggagactgggcactcccacagacaactaggatagtccacatcatcatgctagaggctactgtgaaaccaaagaatgagtagacttcactcctcatgtctacttgcccacagtgcgccatctgagaggggcccagccttccctggtggtaggcccacagctgacattttgacagtttagtcactggaggtctgcaccctacccttgagctgggctagggttgttgctgctgcagcagctgccagtccaaaaagggaaagaggagaccaggcactcccatgacccctagaaaagttcccactgccctgtgtgggctgctgtgagaccagagcaagagcagtatgcattccccaaagcttcttgcccacaatgctctaactgagaggggcctcatccttcctggtggtaggcccacagcacagccaccaaagcccacagggaacattccaccagtacactggaaatcaccctgcctctgcctatttcagccagtgcctaaacacactaccagggagcctgtgaacaagtctacttgcctaatcctatcccccaagtacttgagcatgccatccagaagcctggaaattttttagcccagtctaccaccattggcacctgattagtcctgccaagatttgaggtcaggctgacccaacctactgataccaccacagctgacacccacacacacatggtaccagcaggccaggggactggaatgcccacccatagcagtcaccaccaacaccagtatggatcacttggattccagtaggttgctttaccactgctactgccatcacccttatcacacctgctgcccagggcctgagtgcctgcccacaagcctggccccccctgctactaccagcatccaagcaagccacctggggatccaagaattggcgctccaggaccactaacaggtgcgagagtaatctgctctggggccttaaaagagacaccaccactgccaccaccaagacctaaacaatggtccaactagtgtcctagtcccatgcataacttcaccaacatctccactaataatcataccctaaaccaccgagaagttcaagataccactgaccctgtgtgctgattaaaaaaaaaaaaacagagatcacactacttgctgcaggccccaaaatcaaagccaaaaacttcctattcagccaacaatgtatatacaagatatatatatatcttgtatgtcttcaggaaaaatcctcccccatgaaagcaacttcagaaaaattggaagaagtgactattacaccagatatgtagacatgaatgtaagagcacagaaaacagcaaaaagcaaggaaatatgataccatcaaaggaacacaacaattccctgaaataaatcacaatcaaaaataaattcacaaaatcccagatcaagaattcaaaatactgattttaaagatgctcagtgagatacaagaaaactctacaaaataataccaaaaaattaaaaaaaaaaaaaaacctcaggatatgatgaaaattttaccaaaaagataggtatttctaaaaagaaccaaatagaacttatggaactgaaaaattaattggagaaaatacaaaataaactcaaaagttttaaaaatagactagagcaagcagaagaaacaatttcataacttgaagacaggtattttgaaataatccagtcagacaaaaatttttaaaaaaataagaaagaaaaaagcctttaagatgtttggcagtacataaaatgacaaaatttacaaattattggtagttccaagggtgaagagagatcaaaagacttagaaaaaataatagatgaaaatttcccaagtctagcaagacatttagacatacagatacaggaggctcagtgatccccaggaaaacaatgcaaagaagattttgccatggcacattataatcagactgtctaatatggtttggctctgtgtccccacccaaatctcatcttggactgtactcccataattcccatgtgctgtgggagggacccagtgggagataattagaatcatgagggtggtttccccatactgctcttgtggtagtgaataagtctcatgagatctgatggttttattagggatttttgcttttgcatcttcctcatttttctcttgacactgacatgtaagaagtgccttttggctgggtgcagtggctcacgcctgtgatcccaacactttgggaggctgaagtgggcggatcacgaggtcaggagtttaagaccagtctggtgaatgtggtgaaaccccatctctactaaaaatacaaaaattagctgggtgtagtgtgaggcacctatagtcccagctattcaggaggctaaggaaggagaatcgcttgaacccaagaggcagaggttgcagtgagccgagatcgcaccactgcactccagcctaggtgacacagggagactgcgtctaaaaaaaaaaaaacaacaacaacaaccacaacaaaaagtgtcttttacctcctgccatgattctgaggcctccccagccatatgaaactgtaagtccaattaagtccaattaaacctctttttcttcccagtctcaggcatgtcttcatcagcagtgtgaaaacggaccaatacactgtctaaattcaaactgagagactgaattctaaaatcagcaagagaaaggtatcaagttacctataaaggaaacccctttaaataaacaagagtattcccagcaaagccttatgggccagaagagaatggaatgacatattcaaagtgctgaaagaaaacaactggaagcccataattctatatctagcaagattaatgttcataaatgaaggagaaataaagtctttcccagacaaggaaatgatgacagaattcatcaccactatacaaaccctaaaagaaatgttcaatgaagtcccaaacttggaagtgatggaacaacattcaccatcaagaaaacacaaagtataaaactcattggtaaattaaacacaccaaagaggaagaaaaaagaatcagatgataccactatagaattctaccaaaccacaatgacagggaaaaagaaataaataatttagaaaacaaccagaaaaaattaacaacatgacaaagaaaagctcatatatcagtattaaccttgaacatatacaattacaggctccacttaagagatacagattggaaaaatgcatgaaaaaaatcatccaactatatactgcttataataacccaatcttacctagaaagaaacacatagactaaaagtaaagaggtagaaaagaatattccacacaaacaaaaaccaaaaacaagcaagaatagctacacttacatcagataaaatggtcatggacagtgaaaaaacattatgtcactatataataataaaggtatcaactcagcaagaggatataatcattctaaatatatatgcacccaacactgcagcacgcagattcagaaaacaaatattattagacctacagagagagggacagtaaaacaataatagtggggacttcaacacccccactgataacactagacaaatcatcgagaccgaaaatcaacaaaaaaacatgaaaccgaaattggactttacacaaaagggaccaaaccagaacattttactcaacaacttcagaatacacattctttacatcagcacatggaaggttctctaagatgaaccatatgttaggccacaaactaagtctcaacaaatgtttaaaaatcatatttttgaaaatcaaaatcatatcaagtatcttctcagatcatagtggaataaaactagaaatcaacaccaagagaaacttcagaagctatacgaacacatggaaattaaacaacatgctcctaaattatcactgtgtcaacaaataaattatgaaggaatttttttaatgttttcaacttttctttgaaaggacatgcaaaaaatgagtaaataaaaataaaaatatttttttcttgtccaggtgtggtgcagcactttgggagaccaagctataaggattttttgaagtcaggagttcaagactaccttggacaacaaagcaagatccttgtctctacaaaaacttaaaaattagccaggtgcagtggtatgtacctgtagtcctagctactctggaggctgaggtgagaggatcaattaagcccaagaatgtgagactgcagtaagctataatcatgccactgcactccagcctgggtgacagaataaaatcctctctctaaagaaaaacaaaaaataaatatatttgaaacaaatgaaaatgaaaacacaaacataccaaaccctgtggaacacagcaaaaataatgctaacagggaagttagcactatttttgtagaaaatagtgaaaaaatagtagaaagtagaaaaattacaacttaacaatctaacaactagttagattgaacaactagttcaaggaactagaaaagcaagaacaaaccaaacccaaagctagaagaagaaatgaaataacaaacatcagagcagaactaaatgacaaaaaaatcttaataatataatcaatgaaatgaaaaatttgttctttcaaaagaaaaacaaacttgaaaaaccatgagctagaataaccaacaaaaaaagaaagaaaactcaaataaacaaaatcagaaatgaaaaaggagacattaccagtcataccacagaaatacaaaagatcatcagagatgattatgaagcactatatgctcacaaactatatgctcaaaacttagaggaaatggataaatttctaaaatcatacaacctccccagattcaaccaggaaaaaatagaaaacctgaacaaaccagtaacaagtagcaagactgaatcactaatttaaaaaacttccaacaaagatgaattgtaccaaaagtacaaagaaaaactaataccaatcctcctgaaacttttcaaaaattcaaaaagggaagaattatcccgaattcaatctatgaggccggtaccatcctgataccaaaaccagacaaggatacaacaaaaaagaaaactatagaccaatatccctgatgaatatatacataaaaactctcaacaaaatactagcaaactgaatccaacaacacaataagaagataatacattatgatcaaatgggttttataacagaaatgcaaatgaattttatactagagatgcaacaaacgtgataccttatataaacagaataaaggacaaaagccatatgttcatttcaatagatatagaaaaggcatttgataaaattcagcatcctttcatgataaaaactctcgaattaggcatagaagaagcatacttcaaaatagcaaaggccatgtgtgacaaacctacagttaacattatactgaataggaaaaagatgaaagcatttcctctaagaactggaacaagacaaggatgaccactttcactcctgttcttcaacatagtactggaagttctagccagagcaatcaagcaagagaaagaaatagtcacccaaattgtaaagaaaaaagttaaattgtccctgttggcagattttcatgatcttacaaataaaaacactaaccacatcaaaaaaaactattctaattaaataaagttgcaggatacaaaatcaacacaggaaaatcagtactgtttctacatgctaacaagaaactatccaaaaaagaaatttatttaaaacctacttacaatagctacaaaaaataaaatacttagaaataaatttaaccaaggaggtgaaagacctgtatactgaaaactaaaacactggttaaagaaataatggaagtcacaaataaatagagagatatcctatgttcatgaattggaagtattagtattattaaaatatccatacaacacaaagctatctatagagacaatgcaatcactgtcaaaattttaatgacattttcacagaaataaaaaaatcgtaaaattcgtgtgaaactacaaaaggccctgaatagccaaaccaatattaagcaagatgatcaaagctagaggcatcacacaacctgactttgaaatatactacaaagctagaatatcaaaacagcaagatactctcataaagccagacacataaatcaatggtaagaatagttaacaatgtaatatattcttgaaaattgtttagagcaaattttcagtgtagtcactacaaaaaaagataactatatgaagtaatatacatgttaattcgctcaatttagccatgccacatatgcatatttcaaaacaatatgtacacaataaatgtgtattcggttggtgcaaaagtaattgcagcaaaatttgccattaatggcaaaaaccgcaattacttctgcaccaagctataaaatttgcatttctcaatcaaaaaattgtaattgctattaattacaatgaagccatttatctgcattttatatataactacaaaaaacaaaccactaatatagaggaagctgtctagatataccatggttttctaaaaaaaactgcagtgtaaactttcacattcaaatcagatagtcatgactaaggtaaccccactcatctgtatttctgttttcttttaacattaatattccatttatatttaacatttttgttttgctttttatcatctcaaattctttttggagaagtacagaaaatagatttatacaaataaaattaagtgtctgcttccctttattatgtcaaatgaatgcaaccggatatattagcatcaaattgggagggtatatttgggatggtctgacttaaaatataggttacatggcacactaaaattcatggagtgtccctagggaggtaccttaaaaggataaacaatgaacttcttctagcagctgaacctgaggtataatgagtagctcaaatgacggttgatagggagaaacatcatattgttaaggtataaaaagaaaaaataagttgcctttacatgccctaaattaaaagtcacaacatcagacatttcaagctgaagatgctgatttttgttggagtgacttttgaaggagttagcgctaagtatcatactccaagctataaaaaaaaaagagctttattttaaaaaccatggttaataattttcctgagtcatattggcaggctaactataagtaaaaatatgttgaaataaccagaaacaactagtaatcaggaggtttatgaactgagtactgatgagttgattaaagtacccaggaaggtttatatggtagtagtacatgaggtgcaatgtattagattaaaacaagcagattttaaatgcttttgaaagcattttcaaataagtagaagctgaataaacttacaactacactatactccaaccacactatcttgctcatttccatcttatggcctttgcaattgctgctctctctgcttttctccaagatcttttcaagccttactcctcatttcactaagtctctgcttaaatgtcaccttctaaagaggacttctttgacctcatccaaaataacgctgccttagtatgcttgtttgctagaacaaagtaccatgaactgcgtaatttataaacaatagaaatttagctgggttcactggcatgtgtctgtaataacaactacttgggagttgttattttggcaggagaattgcttaagcccaggagttcgaggtgcagcgagctatgattgtgcccctgcactgcagcctgggcaacagagcaagatcccatgtcagagaggagagaaggggaggggaggagaggggagagaaaaggaggggagggtaggagagaagaggggagggggagagaaagagagacagagaaagagagagggagggagggaaggagggaggaaggaaaggagggaaggagggaggaaggaagggagggaagagagggagagaaaagaaaagaagaaaggaaagaaagaaaaagaaaaagaaatttatttctcatagttctggaggctgggaattccaagatgaaggcaccagtaggattggcattcagtgagggctgctctatatttccaagatagtcccttgttgctgcatcctctggaggaaagaaaaatcatgtcttcatatgacaggagagaaagaagggtaacagagtgcttccttcaatcttgaccccttatataaggatactaatcccacttgtgacggcagagccttcatgacttaattacctcccaaagattacatctttaatactgttgcattggggattaagtttcaacatgactgttggagggaacaccatcacttgaaccacagcaaaccttactgtcttttattttactctgctttaatttcctttataacatgtattgatttttggtaaattacccatgctccaaacaaggtagaaaataattaaagccttagaaaagaaaaggaattgttcttaaaaaaattactgaacaaaatagctcagtgtgtctagttatatatttacagcccaaaatcttggttgatgtggtaactgggaaaaacaaaaccactatctttatttcatcaattgcttcagataaaaaagcatacacaaacaagattaaaaaaaaggaaagtaagcaatgttaaaatttggagtggcttttttttaatcttaaaagtaagacagtctcctggattatgctgctgacatacattttatatattacataagcttataaaatactcttggaaaatgccttccctgtgttttatctttaaagagtccaaagattaatgaatctcataaaaatgataaattagtatttcaaaagcacatttgcaaaagaaaccaataaagagttttggctttaaaagaaagttaagacgaaatatgaaagaagaaattatgaagctcttcaaagaaacatagaagatataattaaataacattagattgtagaatatttttttaaaagaaaacacaaaaagcaacaatcatgaagtaaaagtgataccataaaaaaaacagtgaaaaacatgctactaaatgagacatttatcccattaaacaaacaacaaaggcctcattcatggattttataacaaagtcccacacatcaataaggaaaagacaacctgttacaatagtggtcaagagacttaaacagatattttacaaaaataatatacaaatggccaatgaacatataaagagattattaacctcactaataactaaaataatagaaattaaaacagaaataagcaaatactcatccactacattggcaaaagtactgacaataaacgttttggcaaaaatgtagaacaatataaaatcactgctcttgaatgtttaagttggtatacctactttgaaagctggcaatacctacttaaatagaagaatcacatgctctaaaatctagcaattcatctcttagaaatatactctagaagtgaacaggcaacctacagaatgggagaaaatttctgaaatctatccatctgatgaaggtctaatacctagactctacaaggaacttaaacaaatttaaaagaaaaaacaaacaaccccatcaaaaagtaggcaaaagatatgaatagacacttctcaaaggaagagatttatgcagccaacaaacatgaaaaaaagctcatcatcactagtcattagaaaaatgcaaatcaaaaccacaatgagataccatctcatgccagttagaatggtgatcattaaaaactcaggaaacaacagatgctggtgaggatgtgaagaaataggaatgcttttacactgttggtgggagtatcaattagtttaaccattgtggaagacaatgtggcaattcctcaaggatctagaaccagaaataccatttgacccagcaattccattactgggtatatacccaaagtattataaatcattctattataaagacatgcacacttatgtttattgtggcactatttacaacagcaaagatttggaacgaacccaaatgcccatcagtgataggctgcataaagaaaatgtggcacatgattggcttccaagatggccaaacaggaagagctcagctctacagctcccagtgagatcgacgcagaagacacgtgatttctgcatttccagctgaggtacctgattcatctcattgggactggttggacagtgggtgcagcccacagagggcgagccaaagcagggcacggtgtcacatcacacaggaagtgcaactggttgggggatttccctttcctagccaagggaagccatgagttactgtacctggaggaacagtatactcctgcccaaatactgcacttttcccacagtcttcacaatcagcagacaagaagatcccttcctgtgcctggctcagcaggtctcactcccatggagcattgctcactgctagtgcagcagtctgagattgacctgggacacgggagcttggcaaagggaggagcatccaccattgctgaggcttgagtaggcagttttatgctcacaatgtaacaaagtggcagggaagctcaaactgggtgaagcccactgcagctcatcaagaccttctgcctctctagattccacctctggggacagggcatatctgaacaaaaggtagcaaacagcttccccatacttaaacgtccctgctggacagctctgaaaagaccagtggttctcccagcatggcatatgagctccaataacagacagactgcttcctcaagtgggtccctgatccccatgtagcctgactgggagacacctcccagtaggggccaacagacacctcatacacgctcgtgcccctctcagatgaagctctcagaggaaggatcaggcagcaatatttgctgttctgcaacctccaccagtgatacccaggcaaacagggtctggagcagacctccatcaaactccaacagacctgcagctgagaggcctgtctgttagaaggaaaactaacaaacagaaaggaatagtatcaacgtcaacaaaaaggacgtccactcagagactacagccaaaagtcattgactttaaagaccaaagctagataaaaccacaaagacggggagaaaccacagcagaaaggctgaaaattccaaaaaccagaatgcctcttctcctccaaaggaaaacaactcctcgccagcaagggaacaaaatgagatggagaatgagtttgatgagttgacagaagtaggcttcagaaagtcactaataacaaacttctctgagctaaagaagcatgttctaacccgtcgcaaggaagttaaatccttgaaaaaaggttagacgaatggctaactagaatagccagtgtagagaagaacttaaatgacctgatggagctgaaaaccacagtacgagaatttagtgaagcatacacaaacttcaatagccaatttgatcaagcagaagaaaggatatcagtgattgaagatgaactcattgaaaaaaacaaggagacaagattatagaaaaaggagtgaaaagaaaagaacaaagcctccaagaaatctggaactacgtgaacaggccaaatctacagttgactggtgtactggaaaatgactgggagaatggaaccaagttagaaaacactcttcaggatattatccaggagaacttccccaacctggcaagtcaggccaacattcaaattcaggaaatacagagaacaccacaaagatattccttgaaaagagcaacaccaagacacaaaattgtcaatttcaccaaggttgaaatgaaggaaaaaaatgttaagggtaaccagagagaaaggtcaggttacccacaaagtgaagcccatcagactaaaagctgatctctcggcagaaaccctacaagccaaaagagacagggagtcaatattcaacattcttaaagaaaagaattttcaatccagaatttcatatccagccaaactaagcttcataagtgaaggggaaataaaatcttttacagacaagcaaatgctgagagattttgtcaccaccaggtctgcctcacaggagctcctgaaggaagcaccaaacatggataggaacaactggtaccagccactgcaaaagcatgccaaattgtaaagaccatcgatgctatgaagaaaccacatcaattaacaggcaaaataaccagctaccatcataatgacaggatcaaattcacacatgacattattaaccttaaatgtaaatgggctaaatgccccaattaaaagacacagactggcaaataaaataaagagtcaagaaccatcagtgtgctatattcaggagactcatctgatgtgcaaatacacacacaggctcaaaataaagggatggaggaagatctacaaagcaaatggaaagcaaaaaaaagcagggattgaaatcctagtctctgataaaacagactttaaacgaacaaagatcaaaagagacaaagaatgccattacataatggtaaaggtatcaattcaacaagaagagctaactatcctaaatatatatgcacccaatacaggagcacccagattcataaagcaagtcctgagagacctaaaaagagacttagactcccacacaataataatgggagactttaacaccccattgtcaatattagacagatcagctagacagaaaattaacaaggatatccaggacttgaacacacctctgcaccaagcagacctaatagacttctacagaactccccaccccaaatcaacagaatatacattcttctcagcaccacatcgcacttattctaaaattgaccacataattggaagtaaaaacactcctcaggaatgtaaacaaacaggaatcacaacaaactgtctctcagaccacagtgcaatcaaattagaactcaggattaagttctaattaatcctaaactggctcaaatctgcacaactacatggaaactgaacaacctgctccagaatgactactgggtaaataatgaaattaagaaataaagatggtctttgaaaccaatgagaacaaggacaccatgtaccagaatctctgggacacatttaaagcagtgtgtagagggaaatttatagcactaaatgcccacaagagaaagctgaagagatctaaaatcaacacatcaaaattaaaacatcacaattaaaagaactagagaagcaagagcaaacaaattcaaaagctagcagaaggcaagaaacaactaagatcagagcagaactgtaggaagtagagaaacaaaaaaccccttccaaaaattaatgaatcctggagctggtttttttaaaagataaacaaaatagaccactagcaaaactaataaagaaggaaagagagaagaatcaaatagacgcaataaaaaatgataaaggggatatcaccactgatcccacagaaatacaaactaccatcagagaatactataaacacttctatgcaaataaactagaaaatctagaagaaatggataaattcatggataaatacaacccccaggactaaaccaggaagaagtttaatctctgaatagaccaataataggttctgaaattgaaacaataattaatagcctaccaaccaaaaaaagtccaggaccagatggatttacagccagattcaaccagagttacaaagaggaactggtaccattccttctgaaactatgccaatcaattgaaaaagagggaatcctccctaactcatttcatgaggccagcatcatcctgataccaaagcctggcagagacacaacaaaaaaaagataattttagaccaataaccctgatgaatattgacgtgaaaatcctcaataaaatactggcaaaccaaatccagcagcacaaaaaacagcctatccaccatgatcacgtctgcttcatccctggggtgaaaggctagttcaacatatgcaaatcaataaatgtaatccatcacataaacagaaccaagaacaaaaaacacatgattatctccatagatgcagaaaaggcctctgacaaaattcaacagcctttcatgcttaaatctcccaataaactaggtatcaatggaacatatctcaatataataagagctatttatgatgaacccatagcaaatatcacactgaatgggcaaaagctagaagcattccctttgaaaactggcacaagacaaggatgccctctctcaccactcctattcaacacagtgttggaattctggccagggcaatcaggcaggtgaaagaaacaaagtgtattcaaataggaagagaggaagtcaaattgtctccctttgcagatgacatgattgtatatctagaaaaccccatcgtctcagcccaaaatctccctaagttaataagcaacttcagcaaagtctaaagttacaaaatcatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaataaaaataaaataaataaataaataaataaagttacaaaatcaaagtgtaaaatcacaagcattcctctacaccaataacagacaaacagccaaatcatgagtgaattcccattcacaattgctcctaagagactacagtacttaggaatacaacttataagagatgtgaaggacctcttcaaggagaactacaaaccactgctcaaggaaataagagaggacacaaacaaatgcaaaaacattccacgctcatggataggaagaatcaatatcgtgcaaatggcattactgcccaaagtaatttatggattccatgctatccccatcaagttaccactgactttcttcacagaattggaaaaaaatactttaaatttcatatgcaaccataaaagagctcccatagccaagacaatccttggcaggaagaacaaagctggaggcatcacactacctgacttcaacctttactacaagtctacagtaaacaaaacagcatggtactggtaccaaaacatatatataaaccaatggaatagaacagaggcctcagaaataacaacacacatctaccaccacctgatctttgacaaacccgacaaaaacaagcaatggggaaaagattccctatttaataaatggtgctgggaaaactggctagccatatgcagaaaactgaaactggaccccttccttacaccttatacaaaaatcaactcaacatggaccaaagacttaaacataagacctaggaccataaaaatcctagaagaaaacctgtgaaataccattcaggacataggcatgggcaaaggcttcatgtctaaaacaccaaaagcaatggcaacaaaagccaaactagacaaatgggatctaattaaactaaagagcttctgcacagcaaaagaaactatcatcagagtgaacaggcaacctacagaacgggagaaaatttttgcaatctatccatctgacaaagggctaatacccagaatctacaaagaacttaaacaaatttataagaaaaaagcaaacaacccatcaaaaaatgggcaaaggatatgaacaaacacttctcaaaagaagacatttagctagccaacagacatatgaaaaaatgctcatcatctctggtcattagagaaatgcaaatcaaaaccacaattagataccatctcacaccagtcagaatggtgatcattaaaaagtcaggaaacaacagatgctggagaggttgtgaaaaataggaactcttttacattgttggtgggagtataaattagttcaaccattgtggaagacagtgtggcaattctgtaaggatctagaactagaaataccatttgacccatcaatccgattaccaggcatatacccaaaggattataaatcattctacgataaagacacatgtacacgtatgtttattgtggcattattcacaatagcaaagacttggaaccaaccgcaatgtccaccaatgatagactggattaagaaaatgtggcacatatactccatggaatactatgcagccataaaaaaggatgagttaatgtcctttgcagggacatggatgaagctggaaaccatcattctcagcaaactatcacaagatcagaaaaccaaacagctcatgttttcattcataagtgggagttgaacaatgagaacacatggagacagggaggggaacatcacacaccaggacctgtgtggggtggtgggctaggggagggataacattaggagaaatacctactgtaggtgatgggttgatgggtgcagcaaaccaccacgacacgacacgtgtatacctgtgtaacaaaactgcacgttctgcacatgtaacccagaacttaaagtataataaaaagaaaaaaaatgtggcacatatataccatggaatactatgcagccataaaaagaatgagttcatgtcctttgcagggacatggatgaaggtggaagccatcattctcagcaaactaacataggaagagaaaaccaaacaccgcatgttctcacttataagttggagctgaacaatgggaacacatggacacagggaggggaacatcacacactgaggcctgtcggcgggttgggggcaaggggagggagagcattaggacaaatacctaatgcacgtggggcttaaaacctagatgatgggttgataggtgcggcaaaccaccatggcacacatatacctatgtaacaaacccgcacattctgcacatgtattccagaagttaaagtaaaatttttaaaaaagaaatatactctagaaaaactcatgtgtacctggatacacatataaagatgttcatagcagcattgattttaatagcaaaggctggaaacaacccaaatgtctacacactctacaatggatacattacagcataatcctgcaatagaatgatatataccaataaaaaatgaacaaactaacactattccctacaatatagaagaaactcataagcatactcccgtatgaagaagaaagaaccaaaagaatacataaagtattattcaatttatataacattcataaacaagcaaactaaactatatattttagggatacctacagaggtgattaattattacactgtatagtaattacactgtaccattatattttatacttttttgcattcaagctttttaaggttaagttttaaaagactgaaggaaaatacttttcttgacacttcttttcttactcccctactttgagccatcgacaaattctaatgacaatatatatttagtatccagccacttctcaactctttgatctgagtcactatattctctttccttttccattgcagttgacttctaaccagtctccctgttttcccatataacctattcacaaagtatccaggatgggtgctatggtttgaatgttccctccaaaatgtaagttgaaacttatctccaatatgacagaattgaacagtagggtttttaaaaggtgattggataatgaaggttctgccttcatgaatgaattaatcctattcatagattaatgggttatcatgggagtggaactggtggctttataagaaaagaaacaaagaccaggaatggtgacccatgcctgtaatcccaacaccttgggagcctaaggtgggaggacagattgagttcaggagttcaagaccgagccaggtaacacagcaagacattatttctactaaaaatcaaaaaattagttgggcatggtggcacacacctgtagtcccagctattcaggaggctgaggcatgaggatcacttgagccctggagattgaggctgcagtgagctatgatcatgtcactgtactccagcctgggcaacacagtgagaccctgtctcaagaaggaggaggaggaggaggagggacagtgatgatgagcattttgtcatgtgtctgttggctgcataaatgtcttcttttgagaagtgtctgttcatatacttcgcccactttttgagggggatgtttgattttttccttgtaaatttgtttaagttctttgtagattctggatattagctctttgtcagatgggtagattgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaatttttgtataaggtgtaagggagggatccagtttcagctttctacatatggctagccagttttcccagcaccatttattaaatagggaaacctttccccatttcttgtttttgtcaggtttatcaaatatcagatggttgtagatgtgtggtattatttctgaggactctgttctgttccattggtctatatctctgttttggtaacagtaccatgctgttttggttactgcagccttgtagtatagtttgaagtcaggtagcgtggtgcatccagctttgttcttttgccttaggattgtcttggcaatgcaggctcttttttgattccatatgaactttaaggtagttttttccaattctgtgaagaaagtcattggtagcttgatggggatggcattgaatctataaattaccttggacagtatggccattttcacaatattgattcttcctatccatgagcatggaatgttcttccatttgtttcatcctcttttatttcattgagcagtgctttgtagttctccttgaagagatccttcacatcccttgtaagttggattcctaggtattttattctctttgaagcaattgtgaatggaagttcactcatgatttggctctctgtttgtctgttattggtgtattggtgtacaggaatgcttgtgatttttgcacattgattttgtatcctgagactttgctgaatttgcttatcaggttaaggagattttgggctgagacaatggggttttctaaatatacaatcatgtcatctgcaaacaggaacaatttgacttcctcttttcctaattgaataccctttatttctttctactgcctgattaccctggccagaacttccaacactatgttgaataggagtggtgagagagggcatccctgtcttgcaccagttttcaaagagaatgcttccagtttttgcccatttagtatgatattggctgtgggtttgtcataaagaggtcttattattttgagatatgtcccatcaatatctagtttattgagagttcttagcatgaagggctgttgaattttgtcaaaggcttttctgcatttattgagaaaattatgtggtttttgtctttgttctgcttatatgatgaattacatttattgatttgcgtatgttgaaccagccttgcatcccagagctgaagccgacttgatggtggtggataagatttctgatgtgctgctggatttggtttgccagtattttattgaggatttttgcattgatgttcatcagggatattggtctaaaattatctttttttgctgtgtctctgccaggctttggtatcagaacgatgctggcctcatgaaatgagttagggaggattcccgctttttcaattgattggaatagtttcagaaggaatggtactagctcctccttgtacctctggtagaatccagctgtgaatccatctggtcctggactttttgtggttggtaggctattaattactgcttcaatatcagaacctgtttttggtctattcagggatttaacttcttcctggtttagtcttgggagggtgtatgtgtccaggaatttatccatttcttctagattttctaatttatttgcatagaggtgtttatagtattctctgatggtagtttgtatttctgtgggatcagtggtgatatcccctttatcattttttattgtgtctatttgatttttctctcttttcttctttattagtctggctagtggtctattttgttgatcttttcaaaaaaccagctcctggattcattgattttttgaagggttttttgtatctctgtctccttcagttctgctctgatcttagttatttcttggcttctgctagcttttgaatgtgtttgctcttgtttcaccagttcttttaattgtggtgttagggtttcaattttagatctttcctactttctctagtgggcatttagtgctataaatttccctctacacactgctttaaatgtgtcccagatattctggtatgttgtgtctttgttctcattggtttcaaaggacatctttatttctgcttttatttcattatgtacccagtaatcattcaggagcaagttgttcagtttctgcctagttgtgtgatttttgagtaagtttcttaatcctgagttctaatgtgattgcactgtggtctgagagacagtttgttatcatttctgttcttttacatttgctgaggagtgctttacttccaactatgtggttaattttggaataagtgcaatgtggtgctgagaagaatgtatattctgttgatttggggtggagagttctgtagatgtctattaggtccgcttggtgcagagctgagttcaagtcctggatatccttgttaactttctgtctcgttgatctgtctaatgttgacagtggggtgttaaagcctccaactattactgtgtgggagtctaagtctctttgtagatctctaaggacttgctttatgaatctgggtgctcctgtattgggtgcatatatatttaggatagttagttcttcttgtcgaattgatccctttaccattatgtaatggccttgtctcttttgatctttgttggtttaaagtctgttttatcagactgggattgtaacccctgcattttttgttttccattttgttggtagatcttcctgcatccctttattttaagcctatgtgtgtgtctgcacgttagatgggtctcctgagtacagcacattgatgggtcttgactctttgtccaatttgccagtctttgtcttttaattggggcatttagcccacttacatttaaggttaataacgttatgtgtgaatttgatcctgtcattatgatgttagctggttattttgcttgttagttgatgcagtttcttcctagcatcagtggtccttacaatttggcatgtttttgcagtggctggtaccagttgttgctttccatttttagtgcctctttcaggagctcttataaggcagacctggtggtgacaaaatctctcagcatttgcttgtctgtaaaggattttatttctccttcacttatgaagcttagtttggttggatatgaaattctggattgaaaattattttctttaagaaagttgaatattggaccacactttcttatggcttgcagagtttctgccgagagatcagctgttagtctgatgggcttccctttttgggtaacccgacttctctggctgcccttaacattttttccttcatttcaactttggtgaatctgacaattatgtgtcttggagttgctcttctcaaggagtatctttgtggtgttctctgtatttcctgaatttgaatgttggacttccttgctaggtctgggaagttctcctggatactatcctgcagagtgttttccaacttggttccgttctcccatcactttccagtacaccaatcagacgtagatttggtcttttcatgtagtcccatagttattggaggctttgttcatttcttttcactcttttttctctaaacttctcttctcacttcatttgattcatttgatcttcaatcacttatactgtttctttcagttgatcaaattgctactgaagcttgtgcatgcatcatgtagttctcgtgccatggttttcagctccatcaggtcatttaaggtcttctctatgctgtttattctagttagccattcatctaatcttctttcaaggtttttagcttatttgcaatgggttcaaatatcctcctttagctcggagaagtttgttattaccaatcatgtgaagcttacttatgtcaactcgtcaaagtcactctccatccagcttgacagaggatctttttaaacacaagtcagatccctcctttgctcactctgctgcagccacagtgacatgcttgatgtttctccaacatgccatctacaccatgtacactcctgccacaaggcccttgcacttgctattccctctgcctgattaaccctatacctctctcaagtcattcggctctctaatcaatgtcactttattagaaatgcctttcctttctaccttaggtatgttctttatccccctactctgttttattttttgtggtgcttaccagctgacctattaaatactttatttattttacatctctgctcactaggttgtaagctccataagaacaagaatttcatctattttgttaactgatatatctctagtttctagaacaattgatggcaaattatacgcacccaatagttattaaatgaatattaaacaaaaacaaacataccaaagtgttaacagtagagggtaaaagtatttgtgttctttgtattttccaaatgttctactttgaaattgtattaagtttataaacagaaaaataagctattattccgagacagtaaaatagcacctagcttagcatctgacagatagtagacaagcaataaacatttattaacttgttatctaatctagatgagaaaggctaacaatgaccaacatatacatatattgactatgttgatgttgaagcatataaaaaagtaatagtatagtttatttcagtctttaatttatacatgctgcaactttcattgtttcctcctaaatcacaagagtgaatatgggtttttattgtgaaatgctgcccaagaaatatttactacatattactgattttgaagctcatgatttcacttacacagaaaatttcgcagtgagttttaggacttacagaagtaaatttcttttaatcacggttcaaggaatcccatgcctatctacacctgagtcctgaaaagaaataaatctaacagaaaccaagagtttttcttcaaaagattacctatatggaaattaaactactgcatgtaaaataaaccaaaagcttaaaatcatactctagaggctaatctcataaaagctatttcttattctaacatagatttttggaacctaaaggaattctcaaaagttgggcattactttaagaagtaagtgccttactacacagtacaaggcacattgactaacccgaatgcttgcagaggagagcaagcaaccaggacggtggagggctctggtttgtcagaggaaagacaatctaaggacaggatatgtatagccttttcttgtgaaagacaaacacacgttctagctgtctcaacattttttaaagaattgtcacattgaagaaccgatatcctccgatgtatctaaaatgcagacctattattatttttcattcattttattcaacaaatatttactgcatacctgccatgagtcaggtgctgtgataaatgctgatgatacatagtgaacgaaaatactgggatagaggttaaaaagacattaatctatgaatcactgatgaattaaaatcacaactgtgatataagctacaaagaagtacagaacactatgaatgcatataactggagaatttgatctaatgaggcagatcatggaatgcttcattgaagaaatgattgtgctgagatctaaaagacaaaggttagttcggcgctcacttcagcagcacacatactaaaattggaatgatacagagaagattagcagggcccctacaaaaggatgacacacaaattcatggagtgccccatgtttttaatcaaaaaaaaaaaaaacaggttagttttgtgaaagctgaaagaaaattaggaagaaagctacccaggatgaaggagagcaaaagaaaaggctctgtagaagagtaaaacaaagaaagaaaaactaaaagaaggccagtctggctagaagtgattggttaagaaaagaatcatacaatatgagaggctaaagaggtaggcagaagtcataccaggaagaactgataggccaggataagaaatatgtcttaatccttaggcatgggcaaggacttcatgtacaaaacaccaaaagcaatggcaacaaaagccaaaattgacaaatgggatctaattaaactaaagagcttctgcacagcaaaagaaactaccatcagagtgaacaggcaacctacagaatgggagaaaattcttgcaacctactcatctgacaaagggctaatatccagaatctacaatgaactcaaacaaatttacaagaaaaaaaaacaaacaaccccatcaaaaagtcggcaaaggatatgaacagacacttctcaaaagaagacatttatgcagccaaaaaacacatgaaaaatgctcatcatcactggccatcagagaaatgcaaatcaaaaccacaatgagataccacctcacgccagttagaatggtgatcattaaaaagtcaggaaacaataggtgctggaaaggatgtggagaaataggaacacttttacactgttggtgggactgtaaactagttcaaccattgtggaagtcagtgtggcgattcctcagggatctagaactagaaataccatttgacccagccatcccattactgggtatacacccaaaggattataaatcatgctgctataaagacacgtgcacacgtatgtttattgtggcactattcacaatagcaaagacttggaaccaacccaagtgtccatcaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccgaacaccgcatgttctcactcatagatgggaattgaacaatgagaacacatggacacaggaaggggaacatcacacaccggggcctgttgtggggtgggggaagagggaagggatagcattaggagatgtacctaatgctaaatgacgagttaatgggtgcagcataccaacatggcacatgtatacacatgtaacaaacctgcatgttgtgcacatgtaccctaaaacttaaagtataataataataaaattaaaaaaagaaatatgtcttaatcctaagaacagtaagaagacaatagatttgagttattaatttcaagaattcaatggcatctctcttagaacagagattataacattttaacaactgaacccatctaacaataaaatgggttgcctcagagactgaacatcccattactgcaagtaatcaagcagaacctaaatgatatctttcaagaatgcaatacaagggactatgcatgtcttggaaatttatcactgaggcttcatccttcattaagattaaatgtttcaattattcaaacaccaaataaggattttccaacacactgtaaatgtttgaagtttctttttttttttttctggttagagacactctgttgcccaggctaaagtgcagtggtgggattatagctcactgcagcctcaaactcctgggcttaagtgatcctccagcctcagcctcccaaatagctaggaccacaggcattaggactataggcacgtgccaccaagcctggctaatttcttgttttttgcagagacggggtcttagtatgttgcccaggctggtaaacctttgaagcttcaaaatgaaatattaattgttcataccaatgtgaaaaacaaaaatatttgactgcagttccatggtgtttctcaggaaggatcataatattatataataggagatccattttcagtgtggattacattgagggagtggctcttttcccctgtccattgccaaagaacaggtacagcaataagcacaggagaaagggcatcaaatgaaagatttctgtggaactagcatgaagggattcaaaaaatagcaataacaaagaactccaacctggtgcaaagcaaagattattttcttggccacactactaaggggttctcatcattcctttagcaaagatgtagatagaacacaatggataagtactttagttgaagtgactatgctgaagttaactgtagagtggaatgcatacagtttttattctaaaacaagggttgagatatttaaaaactaatatttgactatcttcatcaaataattaagtgcctttggatactgtgtctataaatattatattgtgacctttctctataaataatataaccctatttatagataacgtatcttgagttaaacagtgcctactttactgtcactgtcaaaaatggataaaaccatcatttaataaatcagtctcctagccaggtttattcttgctcagtgtgatacatgtcatactaatacaacttctttagtaacaactttttaataaaaagtcaaaaaataacagatgttggtgaggttgcagaaaaaagggaatgcttatacactattggtgggaatgtaaattagtttagtcccttggaaagcagtgtggagatttctcaaagaactgaaaatgaaattatcattcgacccagcaatcccattactggtaatataccaaaaggaaaataaactgttctaacaaaaaaactcctgcactcattttatttattgcagcactattcacaacagcaaaaacatggaatcaacccagttgcccatcaacagtaaactggacaaagtaaatgtggtacatatacaccatggaatactacacagccataaaaaagaacaaaatcatgacctttgcaccaacgtggatgcagctggaggccattattctaagtgaattaacacagaaagagaaaacaaaacacagcatattctcacttataagtgggagctaaacattgagtgtacatggccaaaaagatgggaaaaaataaacactgaggattctagaaggggaaagggagggaagggagaaagtgttgaaaaactacttattgggtaatacgttcaattagcaatgggatcattagaagcccaaacctcaacgtcatacaatatacccaaataacagacctgcatatgtaccctctgaatctaaagaaattttaaaaattaaaaatagagtttttaatatgaaccaaaagaaaaaaggtaaacattatggattttaaaaatcaagccagattttgtacttcaagagacaaattgagatgtcaatagtgagcaaaccaatactatgtcacatgaacttatcagttgaaaccttagagttaattagctctatgagttttggggttctttttatgtaacggtagtatcttcaatgagcacttatctttcactagtatatcttcttgcctccccatttaatcaccagcaaggtacaaacttctactttctaatagctccttccatgtcttaatctccattttgatctaccccacctttctttaggctcataccatttacttctcccaccagactggtcttgctgtcatgccattagaagtatctttttgttattcaaaaaaataacaacacctatttgatatgtcttatatttaacctattgatacttctaacagctgttcttcattatccaacaatctcccaaatcccccaaatctgattagttaccaagtcctattaattacctttctaaatatctttcaaggtcatcttctgttccccatcctcattgtttcttctttagttgaagtattcactagctttcttttgaacaatttagttttctcttgaacaccttctgggtgtttttccaactactagttccttctcccttgtaatacatatttcagacccttgcagagtaattttgtaaaactcagatttattcatgtccttcttgttcttatataatctataataattataggtatcatttcctgtgtgtgtttgttaggcactgtgccagatgcattataaacactgtctttaatcctcacatcaactttgtaagatagatactagtatccctgttaacaaatgcagaaatgtaaggctcctggtagttaaataatcttccaaagtttttacagctcattggtggatgtgaaacagagcccagatacacctaggtttaaagagtcagagaatatgccaactggcaatatctgtgaatgaaatcacataggagaaatttttgaatatgcttttattattttaccttacttttcaatacaattcaactttcatattttgacatcttctctaactttcctggtggaaagtgctttcatctctgggtataggtactttacagattcttacagcactttttggaacactgaataccaaacagttatcattcctctaacagattcttatagcactttttggaatagtgaatactaaacagtcaccattcctcatgtatttttacaacttgttttctctatgcattagctgttttgttttaaacagagttgttaaatagatgtttaaatctttaaaaatgtctctttaaaaatgtctctttctgttgcttacctttcttttcatacgctcttggtttcagtgtatctgagtttcaggaaggagtcactccccctacatactgggcagaggtttcatattgggctctctggaaatatatacttttgctgtacaccaataatcttcttgaattatttcactggaggaaaataaatcaagaaaatatactttcgttgtacatctatcatcttcttgaattacttggaggatttctgggagctaaggtaaaaattgagagttgggaactatagaatcatctatatttgtgagtgataaggtggactgtcaagacaatattaaaaataatttggtggatggtatggctgtagtcagataactggagttggtaggaaatataatttgattgttggaatataaaagacaaaaggagaagtcagagtcacgtttaactaactaattttgacctagtccatccagtaagagaattgttcagtgtacgcctagattattctaatttcaaaactatatcttgtttatacgacacagtaaattaatggaatatgagttctctaacgggggcagatactgtgagtagtggacctaaacattttatgatggcaagaacttgtgtaggtatgattaatacgtggttaaacttggacttttgtgtcaagcagacctgattgaatctctgttccacaacttactagctgtgtaaatttcagcaattcctaaatcatcacttttcattttgtaaacctcttagtcttaagacttgatttcttcagctgaaaattgaggatattaatagtgtctatcttaatgcttaattcataataccttgaatctagcaagtgatcaaaataatatgggttactaccattattattgattttcagatcagtctttcttgtgttcactctcaatgacataaagagaaacaacagggtaatataagaactgactagaagtggcaacactggttttgtttttgtgttatgataacatagctatcctgtttgctaggttctcattcatatagtagaaatttgtgaggttttatgaatcttctatccataaatggttatgagaatacaggatttgaagatctggtttgtgatgagtaaaagcatgatactaaatccttatcatagtctagatatagttcaagtctaacagaatatgacaagaaagaaatagaatcagttctccttgattacaaagtaaggttatgtaatttgtctccaaatagcactaaaaaattctgtaattcacagagtgaaatcccaataattgccctgattacattctattttccatttacttttcctaatcaaatacattgactctctctgctaaatcttaattatcatatcaagtcacttctcagaccacagtggaatacaactagaaatcaattctaagaagaactctcaaaaatatacaaacacatgaaaactcaacaatcttctcctgaataatctttgggtcaaggacaaaattaagatgtaaatttaaaaacttttggaaatgaataaaaagagacacaatacaccaaaacctctgggatataggaaaagactaagagggaagttttgagcaataaatttatacatccaaaggacagaaagatcacaaattaacaacctaacattgcacctcaaggacccagaagaataagagggaaccaaaactgcaactagcagaaggaaaaaattcaatgatcagagcagaattaaatgaaattgagaccaaaaaaaagaatcaaccaaatgaaaagtttgttttctgtaaatgtaaacaaaagtgatagaacactagctagattgaccaagaagagagacaattcaatcagaaatttaaaaaaggagacattacaactgaaaccacagaaatacaattgataatcagaaactactatgaacatctctacactgacaaactagaaatcctagaggaaatgaataaattcctgaacacatagaaccttccaagattgaaccctaaaaatacagaaaccctaaaaagaccaaaatgagtagtgagattgaatcagtaataaaaactttcccaataaaggaaaacccaggaccggagggattcacagctgaattccaccaaaagtacaaaaaaagaaacagtatcagtcctactgaaactgttccaaaaaattgagggaaggaaatcctccctaactcatcctatgaaaccagtaccaccctgatatgaaaggcaggcaaaaacataacaaaaaaaaggaaaaactacagaccagtatccctgatgaaaatagatataaaaaccctcaaaaaatatgagaaaaccaaatccaacagcacatcaaaaagatagtacaccatgatcaagtagggtttattccagagatgcaagagtatttcaatatatgcaaatcaataaatgtaactcatcatataaagataattaaaatcaaaaaatgatatgatcatctcaatagatgcagaaaagacattcagtaaaattcaacatcctatcatgatttaaaaaaaaaccctccccaagataggcatagaagaaacatacctcaaaataataaaagccatatatgatgaacctatagccaatgtcatactgaatgtggaaaatttgaaggcattccccctaaaactgaaacaagacaatgactcctactttcaccactcctgttcaacacaatactagaagtcctagccagggcaatcaggaagtagaaagaaataaacagcatccaaattgaaaaagaggaagtcaaatgatctcttcttggtgatgatatgatcatacacatagaaaaccccaaagctttgggaaacaaattcagtaaatgttcaggatacaaaatcaatgtattaaaaatcagtagcatttctttcttctttttttttttttaagagacagggtctcactctgtcacccaggctgaagtgcaatggcacaatcatagctcgctcactgcagtcttgaatctgggactcaagtgatcctcccaagtagctggtactacaggcacatgccaccatacctggtgacatggcttggctgtgtccccacccaaatctcatcatgaattcccacgtgttgtgggatggacccagtgggagataactgaatcatggaggcaggtctttcctgtgctgttctcatgatagtgaagtaagtctcacaagatctgatggttattataaggagagtttccctgcacaagttcttttccctttgcctgtcaccattcacgtaagatgtgacttgctcctccttgccttacaccacgattgcaaggcttccccagccatgtggaactgtaagtccaaataaatctctttcttttgtaaattacccaatctcaggtatgtctttatcagcagcatgaaaacagactaatagagtaaattgataccagcagagtggggcaatgctgaaaaggtacctgaaaatgtggaagtgactttggaacttggtaacacgcaaagttggaaaagtttggagggctcaaagaagacaggaaaatgtgggaaagttcggaacttcctggagacttcttgaatgactttaaccaaaaccctgatagtgatatagacaataaggtccaggctgaggtggtctcagatggagatgaggaacttgttgggaactggagcaaaggtgactactgttgtgttttagcaaagagattggaagcatttggcccctgcactagagatttgtagaactttcaacttaagagagatgaatgatttaggatatctggcagaagaaacatctaagcagcaaagcattcaagaggtgacttgggtgctattaaaggcattcaattttataagggaagcagagcacaaaagtttggaaaatttgcagcctgacaatgtgatagaaaagaaaaacccattttctgaggataaattcaagctgactgcagaaatttgcataagcaacaaggagccgaatgttaatccccaagacaatggggaaaaatgtctccaagacatgttagagatcttcacagcagcctctcccaacacaggtccggaggcctaggaggaaaacatggcttggtgggccaggcccagggaccctctgttgtttacagtctagggactttgtccctgtgtcccaggtgctccagccatgactaaaagtggtcaaggtacagctcaggttgttgcttcagagggtagaagccccaagccttggcagcttccacgtggtgttgagcctgtgggtgcacagaagtcaagaatttaggttttggaacctcctcctagatttcagaagacatatggaaagacatatggaaacacccggataccgagacagaagtttgctgtgggggcagggccctcatggagaacctccactagggcagtgcagaagggaaatgtgaggttggaggccccacacagagtccctactggggcactgcctaatggaactgttagaagaggaccaccatcctccagatcccagaatggtagatccactgacagcctgcaccatgcacctggaaaagctgcagacagtgccagcctgtgaaattagccaggatggaggctgtaccctgaaaaaccacaggggcagagatgcccaggaccataggaacccccttcttgcttcagagtgacctggatgtgagacatggagtcaaaggggatcattttggagctttaagatttgactgccaccctggatttcggacttgcatggggcctgtagcctctttgttttggccaatgtctcctatttggaatgtctgtacttacccaatacctgtacccctgttgtgtctacaaagtaactagcttgcttttgattttacatactcataggcagaagggacttgccttttctcagatgagactttggactgtggacttccgttaatgctgaaatgagttaagtctttggggaactgttgggaaggcatgactggttttgaaatgtgaggacataagatttgggaggggtcaggggtggaataatatggtttggctcatccaaatctcatcttgaattcccacgtgttgtggaaggggcctggtgggaggtaatttaatcatggggtcaggtctttctgtgctgtagtaagtctcatgagacctgatggttattataagggggagttttccagcacaagctctcttctcttgtctgccaccatgtgaaatgtgcctttcaccttccaccatgattgtgaggcctccccagccacgtagaactgtaagtccaataaaccccattcttttgtaaattgcccagtctcaggtatgtcttatcagcagcatgaaagtggactaatgcacctggctaatttttttttttttatatttggtggagatggggcctctttatactgcccagcctggtcttgaacttctggccccagcaatcaccccatctcagcttcccaaagtgctgggattacaggcatgagccactccacccagccagtagcatttctatacaccgataatgatcaaactgagaataaaatcaagaactcaatcccatttacaatagttatgaaaaataatgaaatatctaggaataccttcaagtagataaaagatctctataatgagaacgataaaacattgatgaaggaaataaaagagaacaccacaaaatggaaaaatactccatgctcatggattggaagaatcagtattgttaaaataacctttctacccaaagaagtctgccaggttcaatgcaattcttatcaaaataccaatggtattcttcacagaaacagaaaaaaatagtcctaaaatgtatatggaaccacacacacacacacacacacacacaaagaataaccaatgctacccttagtaaaaagaacaaaactgaaggaatcacattacttgacttcaaggtataccacagagctatagtaaccaaaacagcatggtattggcataaaaaaaaaacacatggaccaatggaacagaacagagaatctagaaagaaatcaacacacctacagtgaactcatttttgaaaaagatgccaagaacatacactgaagaaaggatagtctcctcaataaagggtgctgggaaagctggatattcatatgcagaagaatgaaattagacccctatctcttgccatatacaaaaatcaaatcaaaacggattaaagacttaaataccaaggcttcaaactataaaattactaaaaaaaaacatcagagaaactctccaggacatttctctgggcaaagatttcttgagtagtaccctataaggacagacaaccaaagcaaaaatggacagatgggatcacatcaagttaaaaagtttccgcatagcaaagaaactaataaacaaagtgaagagacaaccaacataatggaggaaaatatctgcaaactatctgatgtggtctggctctgtgtctcaaatcttatcttgagttgtaatcctaattataatccccatgtgttgggtgagggaccttgtaggaggtgattaaaccattggaatgattcccccatgctgttcttatgatagtgagtgagttctcacaagatctgacagctttgtgaggggcttttcccccactttgctctgcacttctctcattcttctctctcctgccaccatctgaagaaggatgtgtttgcttccccttctgccatgattgtaagtttcctgaggcctccccagccatgtggaactgtgagtcaattaaacttctttcctttataaattacccagtcccaggcggttctttatagcagtgtgagaatggactaactggtgccacagagagtggggtactgctataaagatatctgaaaatgtggaagcaactttgaaactggctaacagacagaggttggaacagtttggaaggctgagaacaagacaaaaaaaaatgtgggaaagtttggaacttcctagggacttactgaatggctttgaacaaaatgctcatggacctgctatatggacaattaagttcaggctgaggtggactcagatgaagatgaggaactttttgggaactagagaaaagttgattcttgctatcctttagcaaaatgactgatggcattttgccctgccctagagatctgtggaactttaaacttgacaggaataatttaggatatctggcagaacacatttctaagtggcaaatcattaaaaaggaagcagaacataaaagtttggagaatttgcagcccaacgtgacagaaaaaaaaaattctggggagaaattcaagccaggtgcagaaatttgcataagtaacaaggagctaaatgtcagttactaagacaatggggaaaatgtttctagggcatgtcagagagcttcacagcagtccttcccatcacagaccccaaggcctaggaaggaaaaattgtttcctgggttgggtccagggccctcttgctgtatacagtctcaggactgtgtcccagccactccagccatggctaaaaggggccacggtatcactcaggatgttgcttcagagggtggaagccccaagccttggcagcttccacacagtattggttctgtgggtgcacagaagacaagaactgaggtttggggaacctctccctaggtttcagaggacataaggaaatgcttggatgtccaggtagaagtctgctgccagggtggggccctcatggagaatctctgctagggcagtgcggaagggaaatgtggggttggagcccccatacagaatcccccctagggcactgcctagtggagctgtgagaagagggccaccatcctccaggccccagaatagtagatccaccaacagcttgcaccctgcatgtggaaaagccacagacactcaatgtcagccatgaaagcagctagggcaggaggctgtaccctgcaaagccacagcttcccaaggccatgggagcccaccgtttgcatcagcatgaactggatgtaagacatggagtcaaaggagatcactgtggaactttaaggttcaatgactgttctgttggatttcagacttctatggggtctgtagccctttgttttggccaattttcccattcggaatgggtggatttacccaatgcctgtacccccattgaatctaggaagtatctaacttgctttctattttacaggctcacaggcataagggacttgccttatctcagatgaaactttgaacttgaacttttgggttaatgctggaatgagttaagacattgggtgactgttggaaaggcaagattgtgttttgaagtgtgaggtcatgagatttgggaggagacaggggcagaatgatatggtctggctttgtgtccccacccaaatgtcatcttgaattacaatcccaattataatccccatgtattgggggagggaccttgtgggaggtgattgaatcatgggggaagttctcctgtgctattctcatgacaatgaatgagttctcacaagatctgatggttttgtgaggggctttttcccacttcactctgtacttctctcattctctctcccactgccatgtgaagaaggatgtgtttgtttcccctcccaccatgattataagtttcctttaatagcagtgtggaaacagactaatactctatccatctgacaagggattaataaccagaatatataaggagctccaacatctctataggaaaagactcaataatccaacttaaaaatgggaaaaagatctaaacagacatttctcaaaagaagacatacaaataggcaaacaagtacatgaaaaggtactcaacatcattgaacatcagagaaatgaaaatcaaactacaataagttatcatctcccccattaaaatggcttttatccaaaagacaggcaataacaaatgctgatgaggatgtagagaaaagggaaccattacacactgccagcgagaatgtaaattagtagaatcaccatggagagcagtttggagattcctcaagaaactagaaatagaactaccatacaatccagacatcccactgctgggtacatacccaaaagaaagaaaatcagtattttgaagagacatctgcactcccacgtttattgcagcactatttacaatagccaaaatttggaagcaacctaagtgtccctcaacagatgaatgaataaagaaaatgcggtacatatacacaatggagtactattcagccctaaaaaaaagaatgagatcatgtcatttgcaccaatatggatggagctggaggtcattacgtaaagttaaataagccaggcactgaaagaccactttgcatgttctcatttatttttggcagctaaaaattaaaacaactggactcatggagatggagagtagaacaatggttaccagaagctgggaagggtagtgaagtgttgggagggattaaagtagggatgattaatgggtataaaaatatagttagaaagcgtgaataagatctagtatttggtagcaaagcagggtgactacagtcaacaacaatttattgtacatttaaaaataactaaaagagtataactggattatttgtcacacaaagaagggataattgcttgaggtgatgaatagtcaatttgccctaaggaaataatttcacattgtatgcctgtatcaaaatatctcacatatgccataaacatatacatctaatatgtacccacaaaaattaaaaataaaaataaataaaaatgaaaatttttaaaattaaacaattttaaacagtatattgagttaaggagctaggctcaaaaagagaacttctctaattttatttcatttttttgagacaggatcttgctttgttgaccagggtggaatgcagtggcatgatcccagctcacagcagcctccacttcctgggatcaagcaattatcttatctcagcttcccgagtagctgagactacagtctcgcactgccacattcgactaattttgtttattttttgtagagatgaggtttcactacgttgcccaggtgggtctcaagctcctggactcaagctgtcctccaacctcagccttccaaagtgctgggattagaggtgtaagccactgtaccccactgctactctaattttatttatacaaagttcacgaacaggcaaactcaatctctggttattaaaaaaaagaaattattgtttcagggtggacacaagattgacagaaagagtatgagagaaacgtctggtatgatggaaatgttccatgtttgtgaatctcaatgggaatactggcatacatttgacaaatgtatatacctggtataacttccttccttccttcctttctcttgttctttcctattaagaaaaaaacatgtaaaattataacatttgtcaaaactcatttattagtacccttaacatccatttacactatataaattttacctaaaaaatagttaatgtaatttaccaaattaacagaataaaatttaaaatcctttgattatctcagtagatgcagaggaagcatttgaaaaagtacaacacaatttttttagtaagaaaatatttgcaacttaggagtagaagagaacttcctgaatgtaatcagtgacatctacaaagaacttttaaaaattgtatttgatgtaaaatgttaaaacctttcccagtgaggtcaggaatgaaactaaggttttcattatcattatctatccttgtctgttcaatatttaccatatatcctagctagtgtagtaaagcatgaaaaagaaaaataaagaatgtaaagatttttaaaggaatatacgaaatacttattagaacagaaaatcctgacaacttttcttccaaatatgtacagactcctgagagatttctactatgaaacaggatggagtaacagatacaaaatttactatctaaactgaaacaagtaaaaatatgagcaaaatatatgaaataataattttcaaggcattggaaaaagcacaaaggacagtaatgcctgagatgtggtaaagaaatgaggtaagccctattctcacagattactgccaggagaatattttcaggccacagcacagaaatagagaactcagtttatgcatgtagtctctctgagaagatgaagctgggaatctgcagagatcaaggcagtgagaatttaaaggacagagactagacaggagagatctcagagagtaccggagatctacagaggatccgcctttagtctttagcagagcagttatcagtacatgaacgagaggaaactatctgaagctgtgaaaagaaccacccaaaaggattagagaaaacagtacttaaggctgacacagatctaggaatatttcctcttcccactagccaaaatgtaaaccttcttaattcactaggcattgggtagaatgcctgagaagtgtattgtttcactagtggggaagaattagccctagactaactgctactctagtcttgtttaacaaagcacaagagcaaaaattaaaaggataaaacagatttcatgtaactgaagtatcatgaagaaaactatacagagcacttcataattaaattgcttaaaatcagtgatacagagaaaaatcttaaaagagtcagaggaaaaaagacaccttatatagaggaacaaagataagaattacatcagacttctcatcagaaaaatgcaagccagaagacagtagtgcaacatctttaaagacctgacagaaaaaaatgtgaacctagagttctatatccaaatatctttcaaaaatgaacacaaaataggacattgaaatgctgaaagaattcattaactgcagaaccacacaataagaaatgttaaataaagtcattcagaaagaagaaaaatgacaccatatgtaaatctggagttataccaagaatgaagagcattagaactggtaactacatgagaataatagttaattttatgtgtcaattttactgtgctaagggaaactctgattgctagtaaatagtttttctggatgtgtctgtgaggatgtttctggaagagattagcatttgaatcagtagaccaagaaagaagatcaccttccttctctaatgacaatagcctttttgttacctagagacctttgtacttgtttttttctgtaattgggagcaaaaaaggggcccaacataaatactaaaggtcaaaacacaacatgtgaatataataatattcattgactctaattttaggcctctgcattgataggatgtaaatcactttttcaatgaaaaaatttaaggctcacaggagacaaccaaaatgtgtatattttatccattgtttattctgtagttttcctaactgacatggtcaaaccaacttttaaaatgggcaagagtcttgaatacaaactttcacaaagaagatgttcaaattaacaacaaacacatgaaaaggtgctaaatttcttggggttttttgtttgtttgtttttgcctaaaggatgtttttatttttttttttttttattttactttaagttctgggatgcatgtgccaaatgtgtgggtttgttacatagatatacatatgctatagtggtttgctgcacctatcgacccatcatctaggttttaagccccacatgcattaggtctttgtcctaatgctctctctccccttgcgccccacccctcaacaggctctggtgtgtgatgtccccttccctgtgtccacatgttgtcattgttcaactcccacttattagtgggaacatgtggtgtttggttttctgttcctgtgttagtttgctgaggataatggtttccagcttcattcatgtccctgcaaaggacatgcactcattattttttatggctccatagtattccatagtatgtatgtgccacattttctttatccagtctatcattgatgggcatttgggtttgttccaagtatttcctattgtaaatagtgctgcaataaacatacttgtgcatctgtctttatagtaaaataatttataatcctttgggtatatacccattaatgggattgctgggtcaaatgacatttctggttttagatccttgaggcatcaccacactgtcttccacaatcattgaactaatttacactcccgccaacaatataaaagtgtttctatttctccacatcctcaccagcaacggttgtttcctgactttttaatggtcaccattctaactggcatgagatagcatctcattgtggttttgatttgcatttctctaatgaccagtgatgatgagcttttttgcatatgcttgttgtcttctttgagaagtgtctgttcatatcctttgcccactttttgatgggattgtttgtttttttcttgtagatttatttaagttctttgtagattctggatattagacctttgtcggatggatagatttcaaaaattttctccaaatctctaggttgcctgttcactttcatgacagtttcttttgctgagcagacgctctttagtttaattagatcccatttgtcaattttggcttttgtcacaattgcttttggtgtgttagtcttgaagtctttgcccatgcctatgtcctgaatggtattgcctaggttttcttctaggattttcatggttttaggattttaaatataagtctttaacccatcttgagttaatttttgtataaggtgtaaggaaggggtccagtttctgtttactgcatatggctagccagtttgcacagcagaaaaggtgctaaatttcattcatcattaggaaaatccaaaataaaacacaatgagatgttaagttaatgttaataatatgaagcagtaggaaatctcatacactgttggcagtagagtaaactggtacaacactttggaaaacagtttggcatttaatcctgagttgaatttatgcataacctacaaattagcaattctattcctggcactcaaatgggttatgcttcatgaataaataaatccccaaatcagagtagttacatgagtatgtgacccatgcaattgcacagggccttggacttagaaggaccctgtgcttagtttaattatctgctatagttgtcttgaaattcttaataaatgttgaacaacagacttaacattttcattttgcagaaagacgcacaaatattcagctggccctgtttctaagcatataactaacagaaatgtgtacaccaagggaaatacagaggtgtgcctatacaacaaaactagaaacaactcatgttattcaccaatagactgaacaaattgtggaatattcataacatgaaatactatacagcaatgaaaattaatgaagtatagctgtatgcaactacattattaatctcacaagcataatgtcaagaaaaagacgaatctacgtgtattttagaatcatcttgccagtttcacacaaatatatatgcacacacaattgttgagaggtcgtttgcaagttgtcatatccctcattcctgctttgagaaatgtaggagcatacagatggaactctccttcacctacattcctgagtgaggtccacgtaaagagccctaccatcaccacctgttccccgacaaattatgaacatgtaacatgaacaaaaaataaacctttggtcttctaaactactgagatttcagaaattatttattgctgcaccattatccagccaaatctgactagtgtacaaattcatctaatgaccaaataagattatcaatctttttaaatccatcctagaaatatctattttttatcttgttcacttgctacaagaataaagtcctatggcatctagtagtcatctgatagaaaaatgttcccttttattttcctaaaataattttcatcatgctttaaaaagttccccttagttctagtattcttgactttggtgaacaagtctactcagactcttcatacactttacaattttaatgactctgatcatacccaccatttacctttccatttctatattaaagtttcttaatctcagatataactttgcacataaaatctccatgcctttgattattgtaccaactttcctttcctcaaacactttaggtccagtgtctccaggaccaccaaatacagttatatgttttacataaaacaacaaaggctcccagacaaggagatgagtttgtctttatctactagtcatgttacacatcctcacatgaaactatggcaggaggattgtaaaccattttctttaaaccaatttaccactttctcttctagccaagtaaacttaggggtagatctgcctagagagggtttgtttttttttttttttttttgaggtggagtttggagtttcactcttgttgcccaggctggagtgcaatggcacaatctcacctcaccacaacctccacctcatgggttcaagcgattctcctgcctcagcctcccaagtagctggaattacaggcatacaccaccacacccagctaattttggatttttagtagagatggagtttctccacattggtcaagctggtcttgaactcccgacctcaggttatctgcccacctcagcctcccaaagtgctgggattacaagtgtaagccactgcgcctggcctttttttatttttattttatttattttatttatttttttttttgagacagagtctcgctctgttgcccaggctggagtgcagtggcatgatcttggctcactgcaacctccgcctcccaggttcaagcgattctcctgcctcagccttctgattagttgcaattacaggcacatgccaccacgcccagctaatttttttgtatttttagtagaaatggggtttcaccatattggctaggctggtcttgaactcctcaccttgtcatctgcccacctcggcctcccaaagtcctgggattacaggtacgagccaccacacctggctagggtgtttttctaatgcttttttatagactaatagagtttctgagtttgcctattgctcaaagtattctgcaccccaggtactaagacaataaggtttgctttggttctgctttgttttggctaccattcttacacttccttttggggcctcaacagtttattgccaagatcagcttcctgagtctattggcctaatgccttgtggttagaagtagagttaaaatgctttgtccctctgtatattacatagctatcacacactactttcaaagccacttactttgacttagttgtataataatttcctgaacttgagcaggaagagttaggggaccactcagaacttcttagaggctttctgccctccccctatttccctcgtaaataaaataaaattttaaaattagactgggatttcttaaaataagtaaatgaaaatagaagaaactcttaatacaatgtattcttacattattccctttccttactggtcattaaaagtatttataacaactaattcaattatttttaaatgccaagagtatgaaatcattatagtgatatcaaactttaaaacaataattgtaaaatgatgagtgttgttattcccttatcctacattcctaaataagcttgctgttggagaggctctttcaagtgttgcagcatatacatcatcaccagatgttagtacaggagcatgaagcaagaccatgccaaacagggtgatttaagaataactgctaccccgaatttctacaacctcagatgctcaagccagtatttaactcaattcaatacacatgtttttatatctgctttgtgccagcactttggggtattcaaaaataaatcacaactgaaaaattagagcctctcatccaagacgtcacaaaccaatggaattttaaaatgtagactgattgttgctacaggaaaggagttttgaaagaggaatgaaaaaacttgagaaggctagaaggaaaagagctagtgggaggaagagaccagctctgagcctatctttgacaggaagagaagtgggcgtagacacctgtgaaggcatgatacaataaagtgagcctgtgactgaatcaggttacacagcggtggaggggtggagaaagacacacgctgcaagataaaattagaaaagaaggcttctttcttaccctggagttcatagcaataacatattaaataatctgaatagattataaatctcccaataaccctgtgagaaagatgctaatatgttccctattttattgacaaataaactaaggaacaaaaatgttaagcaactttctcaaagtcacataactggaattttgagagacccaggataacaaaatccaaaacctaggcatttaaccatataattttatacccattattatccaaggagagatccaatataaagaaaaaagttgtttaatacatttaggtatagtttatatgcaataagaaaaaatatttcaatatcataatccctcgcttttctaggttctcacttacatagtcctctacactacgcagtatatacaaaagaaaaagtggtcttacgtatgaaatacaagcacatgttaaaaagcaaactaatgtttatatgtcttttaattattatttattcataataactagatggaaacacctagtaatgaacaaggacagcagaaaactagagggaactggctctagcagagcttcctggaagatattttccaagactagtttccctcatctttgttccatatgaggagcaggaaggctttaggtttagtgattctgccacagatcacctgctgctatcctctatacttccttgtagaaatactgattcagaaatatgatgtattcatttgttgttattccttttctatgcctttgaacagaaatcaattattggctaagttacatgagtatcacagagcacaccaactattgttacctatatgtatggtctacagatagaacagatcataatttccagtgcagtaatatttggatgggcagtgctgtcatatgtcacatcctttctttttaacttaatctgttaatagctccactggaagagaatactcttccaacttagacagtaaaaggtaagaattctcttatatactaatgatctgcccatagaaaaggctctgagtagataactaaccctggtttttaatttctatcagtaaggattgcaagtaaattgtcctgaaatcaaagctattttttttaatgtcccacacctgttccttatcttatgttaaaaattccacgaaacaaaaaacaatgcattttgttaaagtatacattttagaaacaggttatcttagaatatatgaaaagaaattttgtgactcaaaattagagatgcctaaggtgtttttgttgttgttgttgttgttgttgttgttgttttgagacggagtctcagtctatcactcaggctgaagtgcaatggcatgatctcagctcactgcaacctccccctcccgggttcaagcaattcccctgcttcagcctcccaagtagctgggattacaggattacatcaccacacctagctaatttttgtatttttagtagagatggggtttcaccatgttggccaggctagtctcgaactcctggcctcaatcgatccacccacctcagcctcccaaagtgctgggattacaggcatgagccaccacacccagcctcctaaggtgttttattgtgattttttttaactggctaaggtgtgcctttggttttacttgctttttaaaatacatacacacactatatacatattgaaatatatatatgaaatacatatatatacataaaatacatatatatatatatatataattctttttaatagctgaatagcattccagggtgtatacgtactacattttctttatctaaatccatcactgatggacatataggttggttccatgtctttgctattgtgaatggtgctgcaataaacatgcaagtccaggtgtccttttgttagaataatttattatagatatagatagatatacacatatatatcccacagcatccagtggcaggcacttctttccccttattggtttgtttgatctacctcttgtaagaatctatctggattgtgaatcggaaaacattctttaggttcagcgctacgcctgagagaagggaatactaatgtagctgagctaatcagaagcctccacaagtttatacagctttagaggaaaagctaaagaataagattagctaagaaggctgtttacaaatgtttaaattccatttaaggaaaactctaggtttattttaatagaacaatatatgcccactaaaatgttgctctctggttttttgttttttgtttgtttgtttttgagacagagtctcattctgttgcccaggctgaagtgcaatggcgctatcccagctcactgcagtccccacctcccaggttcaagcaattctcctgcctcagtctcccgagtagctgggactacaggcaggcgcaaccatgcctggctaatttttgtctgtctctaactcctggactcacatgatccacccacctcagcctcccaaagtgctgacattaaaagtgtgaaaggtgcgcctggtctactctcagtattttagaaagcaattcaaattaaattaaattaaatttatattaactaaaaaaaggtcttttttatttcatttcctccatgaaatataattttttttaattttagatttgggggtacttatgcaggtttgtcacccgggtatattgtgtgatgctgaagtttgggcttctaataatcccattacccatacagtgaacaaagtacccaacaggtagtttttcagcccttgccccactccctacctccccacttttggagtccccagtgtctattgttcccatctttatgtcaattgtgtacccaatatttagctctaacttataaataagaacatgtgatatttggttttctgtttctgcattaatttgcttaggataagggcctccagctgcatccatgttgccacaaagaacatgattatagctgaatatcagtattccatgtgtgtatatgtaccacatttcctttacgtattccatcgttgatgagcatctagcttggctccatgtgtttgctattgtgaatggtgctgcaataaacatatgagtgcaggtgtctttttggtaaaataacttattttcccttgggtatgtatgcaataatgggattgctgcgttggatggcgattctattttcagttctttcagaaatcttcacactgttttccacaagggctaaactaatttacattttcaccaatagtgtattagcgttcccttttctccacaacctcaccaacacttgttattatttgactttttaatatagtcattctgactggtgtgacatggtatctcactgtggttttgacttgtatttctgtgatgattaggttttacttgcttttgagtagaggttagaaaaagtttatgactcatagcaaagtatgataggaagaggaaaggaaaatatagggagatttgtagaccatggtaaggaattttgtttgttttgcagtgtggtgatgcggagtatttagctgactttgaggagaaaaaagaaaaaaataatttcaaacattgtaggtattataaatattacagtattgctagtaccatataatgtttacttccataaagattataccaatttgataggtcattggatggggtcaaaataaataaataaatatatatataaaaataatgtcagtgcgtagcagtttgctcttaataatttttgttgaataaactgaatgaatgaagagatatattttttaaattccatcattaaaaagtttaaatgtggagaaggtagaactctcatgtattgctgatgggattgcaaattagtgaaaccacattgaaaaacagtttggcagttctcaagaagttaaacagagttaccatataaaccagcaattctactcctagatatatgcccaagagaaatggaaacagatgtccacacaaaaatctgtacacaaatgttcatagcagcattattcaaaatagccaaaatacgggaataacccaaatatccaacaatcaactcatgaacagataaataaaatatgatatattcatacaaaagaataatatccagtcataaaaaagaattaagtactgatacatgctacatggatgaagcttgaaaacattatgttggtgaaagaagctagtcacaaaaggccacataataatgtaggattccatttatataaaatgtttaaaatagtccaagtgtggtggctcatgcctgtaatcccagcactttgggaggccaaggcaggcagatggcttgagctcaggagttagagaccaaactgggcaacatggtgaaaccccatctctaccaaaaaatataaaaattagactggcaaggtggcacacacctgtagtccagctacttgggaggctttggtgggagggttacttgagcctgggaggcagagggtgcagtgagccgagatcacaccattgaactccagcctggcaacagagtgtgaccctgtctcaaaaaaaaaaaaaaaaaaaaaaaagttttaaataggcaaatccatacagacaatgtcaggacttagaaaacaatacccccaaagtacagtaccttggcatgctgcatcctttaaattgaagcactttgggaggaccccagaagcagactctttctaaacttattctcctgccctcctttctcctcctttcctcctctaaggtaggtcatagaaactagaactagaaccctattgagaggtgacaacgtgctagcagccctcactcgctcttggggcctccttggccttggcgtctgctctgccagtgtttgaggagcccttcaccctgttgctgcgctatgagggcccctctctggggctggttgaggctggagccggctccctctgctcacagggaagtgtgaagagagaggcgcaggcaggagctggggctgcgtgcggtgctcacaggccagtgcgggttccaggtgagcgcaggcttggcaagccccgcactcagggcagcgggctgatgcctgctgggcttgatcagaggctgaatcccatgcatggaccgccattcccttttcacgggatgattggccacaataccaggtctccatctctttctcgcttcccctcttttcctcttgattgtctgggacgagctccctctgggctgccagagtgcccagactaggtgccgcaaagtcccacagtgaatgccagtgagaggtgaagctgattgggcttctgggacaggtggggacttggagaacttttctgtctagccaaaggattgtaaatgcatcaatcagcattctgtgtctagctaaaggtttgtaaatgcacaaatcagtgctctgtgtctagctaattgggtggggacttggagaacgtttgcgtctagctaagggattgtaaatgcaccaatcagaactctgtgtctagctaaaggtttggaaatgcaccaattagcactctgtcaatatggaccaatcggctctctgtaaaacggaccaatcagctctctgtaaaatggaccagtcagctctctcaggaggatgtgggtggggcaagataagggaataaaagcaggcgaccagagccagcaggggcaactggctcaggtcactttccaggctgtggaacctttgttctttcactcttcgcaataaatctcgctgctgctcactctttgggtccgcaaagcctttatgagctgtaacactcaccatgaaggtctgcaggttcactcctgaagccagtgagaccaccaacccaccaggagggatgaacaactccagacaggagggatgaacaactccagacgggagggatgaacaactccagatgggaggaatgaacaactccagacgtgccacctttgtgaactgtaacactcaccacgaaggtctgcagcttcactcatgaggccagcaagaccacgaacccaccagaaggaatgaacaactccagatatgccgcctttaagagctgtaacactcactgtgaaggtctgcagcttcactcctgaagtcagtgagaccacgaacccaccaggaggaagaaactctggacacatctgaacatctgaaggaacaaactgcggacacatcatctttaagaactgtaacacgcggccaggcgtggtggctcaagcctgtaatcccagcactctgggaggcccaggtgggtggatcatgaggtcaggagattgagaccatccaggctaacacagtgaaaccccgtctctactaaaaatacaaaatattagcagggcgtggtggcaggcacctgtaatcccagctacttgagaggctgaggcaggagaatggcgtgaacccaggaggtggagcttccagtgagccgagatcgcgccactgcactccagcctgggtgacagagcgagactccgtctcaaaaaataataaaaaattaaaaaataaaaaaagaactgtaacactcactgtgagggtccatggcttcattcttgaagtcagcaagaccaagaacccaccaattctagacacactatcccccaaagccagtcataaaacctagaaacgttactgtaacctttctatgtaagagctggccataaagacattctctgatctggcaattattaaaaagtcaagaaacaacagatgctggcaaggctgtggagaaataggaacacttttacactgttggtgggaatgtaaattagttcaaccattgtggaagacagtgtggtgattcctcaaagacctagaaccagaaataccatttgacccagcaattgcattactgggtatatgctcaaaggaatataaataattatattataaagatacatgcatccatatgtccattgcagcacttttcacaatagcaaagacatggaatccacccaaatgcccatcaatgataaactggataaagaaaatgtggtacatatacaccgtggaatgctatgcagccataaaaaatgatgagttcatgtcctttgtagggacatggatgaagctggaaaccatcattctcagcaaactaacacagggacagaaaaccaaatactgcatgttctcactcataaatgggagctgaacagtgagaacacatggacacagggagggaaacaatgcacactggggcctgttgagtggaacaggggaaggaggaacatcaggataaatagctaatgcatgtgaggcttaatacctaggtgatgggttgataggtgcagcaaaacaccatggcacatatttaaatatgtgacaaacctgcatgccctgcacatgtatcccagaactcaaaattaaattacatttttttaaaaaaacaccttctcagatccaccttgtctgaaagtagagcattaagaccttcattgcagaagacctgctgccctatacctgaaaggaaggaatgccacacatggatcaagaggcatctaaataggtaggccttgctgggtttctccactcaagtctattaccattagatcattccctttttttatcctatcacatttctgaatgcagtgccttagactgctcggtcatcctgacacatgatacagctgtcactccatttaatctaagcataaaaatggacagctgtcccttgagtctctggatctatttctgaagtttcttgggctgcataaaactttgattaaatgaattgttatgcttttctcccattaatcttcctttgtctgttttatttcaaacctagccaggaatgctagaagaattgaggaaatatttcctcccctatgacagaaagtataataatagtttccaggtactaaggagaggaagaattagagttactgctaatgggtatgagctttctttttgggattatggaaatattctggagctagttactgatgatagctgcataactctgtgaacatatttaaaaaccaccaaattgtacactttaaaagagtaactatcttatgttactctttttcatgatttttcaaaaaatcatcattagaaatgagtttaaccgataaatatatacacttactgtgtacccacaaaaatgttaaattaaaaaaagtttttaaagagtttgacgtgtctgtagtacaggggttacaagagctaaggcaagaaatatagattgaagctgatgaaggaaaatggaaatggtttagtcaaggcacctaaaatagagccaggaggccatttcagctggggcttcaggcacaccttaagcaatgaatactcaaccctagaggtcacaacttcctagtttgcgagtgcaaaaacatctgctgtcttatcttctgctatttcctgctgagctgagaagtccctgaccatgggcccacctttcaaagtgctacaaccaattccctgactccaatactgctttagatacaatcatactgataaaggggcaaagcggcaggggggtggtgcaggaagggaaatgctgggtagagaaggccagggtccctggtgagggatccacccttgggcctttgcccacggacataagtgaggacagccactcttgtttccgtacccaaatgttgcattttccaagaccactctggcccaccacatccccccatcctgtgcccataaaaaccccaagaccctagcaggcacagacacacgagcagctggacatcgagaggaacagaggatcagaagagcacactgacagacaccagcagatgctgacaggccatcaatggtgggaccatgtggaatttggtcagtagtgatcagaggagatgcctgccgctgggcagcccaaactccagggaaacaccaccatcccattccatccccctctggcctccccattcacctcactgagagctacttccaatcaataaaactttgcagccatcctccaagcccacatgtgattcaatttttctggtacaccagggcaataattcaggatacagaaagccctctgtccttgtgataaagcagaggctctaattgggcggattaacacaagctgcctacagacagcaaaacagcaaagctaaaagagcacactgtgacacacacccactgggacttcgggagctataaacactcaaccttagacgctgctgtggggtcagagcccaaaaactgcccatgacctgcccatctgtatgctccccctaggggtttgagcagccaggcaccaaagaagcaagccacatccctgttgcacgccctgcgaggaggataagaaaactcctcccatttcaatacaaattataatagttggaaaacaacttttgttaccaccctcttttctttaaaagttcacaattctcttttgttccctggaacacttcccaggataacttggaagtgtttcctgggctgcagtcatgcaaatctgactcaaataaattctttagtatttaagctctgcctcagtttctttccaggtccataaggcggtcttacaaaaagcataattgctctaatgtgccatcctaaggacttttaactttaccctgtgaatgatggaaaacaaagtaatgatataatcacatcagattcaaaaaataattattgagaccactgctaatctgagtataaattatttaatacttatgtatttatagttttaaattacaatggatcacttctatttatatactaggtcatttctttcatttttaatgacttcatataacatacagctggaaaaaaaattagaaataagcaagtccaatttactaactttacaggtgaggaaactaggcctaaaaaagttaacttgcccaatgtcatacagataatgagtattattatttatgaatgttttatctttaataaatatatattattataatatatactaatgggccctatatgaaagttgggtcaataaatgacttagaaaacatctccaaaccctttgagatggcttacaaaactactactgatttgacttttgctgattgtttatggaacaattcatagagtgagtgcaaaaaaacacagatttgaagtcatagaaaattacttctaaggattaaaattttgatccaccaccttctaattaaaagaaaaaaacacttcagccaaattctgcatcatgaattcagtgcctttttactcctctgcctccctttctcttgtaattattccctatctcctaatactaggcttcctgttgaattgctaacaaaatccaggaaatgcccaaggaatttaattcaaatgcaaatggaattatttgtgttattcctgtctctgcttttaaaaaataataatatgaaacagtgtgctattgctgaaagcctcacagacttctcagcttgacacctgaagtaatttagaagagtaagggggaaaaaaatctgtaactggtttacagctaatttatttacaacaactccagaattgagaaaacccacccacattcgtgtgcccacagagaaagagaaatgaattctttacaaagcagtagcactttttgtcctgctggtccttttttctcatttatttttcttttctttcctcctcatttcaggtaacttcaatgagattttagttacaattcttgtgaattcaacctaagtagaaattacaccaaaagaaatggggcaccaccttcattgttaagcaatctcttggaaatatattatgttggagaactcccccacggaccaacaaaaaatgtgtgtacaaactgagtggcaaacaaatgatattatacctatgcatttgattaatctgggaattatggaagatattcaaaggatctgggaatcctttgaagataaaataggacaaaatacattttgtttatgaagtaaatttaggagtaaggcttcatcttttaaagtattaatagataccatatcttcaatatcagcatttttttccttttaaagtttgcataatatatgacaacatgaacaatacaaagaatcctgacttgttggctctgggttttaaaggagattttaatattctcaaaggtctcttttagatcttaaattctattattctatgattcttcattctctgttcctatgtcatagcataatcatttgacatgacatttcataggcaaaaatgtcaaagtaaatacttgcaacactgaattaatgtttcaaaaagtaaaagtcagtcctagcccaagggcatttatttaaaaacaaatgaaaacagtcaattatatcaataagataaatataagttgtatgtagtcatatgtgtttatgtgtgtgtggatttaaatgattttggaaggatatacatcaaaatgttactatttctaggtaatactgttgctaggtgtagctatacaaaattgattctcttttttttaattataatttaagttccgggatacatgtgcagaacttgcaggtttgttacataggtatacatgtgccatgggggtttgctgcacctatcaacccgtcatctacattaggcatttctactaatgctatccctcccctaggcccccatcctcaacaggctctggtgtgtgatgttcccctccctgtgcccatttgttctcatcgttcaactccgacttatgagtgagaacatgcaatgtttggttttctgttcctgtgttagtttgctaagaatgatggtttccagcttcatccatgtccctgcaaaggatattaattcatcattttttatggctgcttagtattccatggtgtacatgtgccacattttctttatccagtctatcattgatggacatttgggtgggttccaagtctttgctagtgtgaacaatgccacaataaacatatgtgtgcatggatctttatagtagaatgatttataatcctttgggtatatacccaataatgggattgtcgggtcaaatggtatttctagttctagatccttaaggaattgccacactgtcttccacaatggttgaactaatttacactcccaccaacaatgtaaaagcattcctatttctccacatcctctctagcatctatagtttcctgactttttaatgatcaccattctaactgtcgtgagatggtatctcattgtggttttgatttacatttctctaatgaccagtgatgatgagctttttctcatatgtttgtcgtctgcataaatgtcttttttggagaagtgtctgttcatatccttcattcactttttgatggggttgtttgtttttttttcttgtaaatttgtttaagttctttgtagattttggatattagccctttgccagatggatagattgcaaaaattttctcccattctgtagggtgcctgttcactctgatgacagtttcttttgctgtgcagaagctctttagtataattagatcccatttgtcaattttggctttagttgccgctgcttttggtgttttagtcttggaagtctttgcccatgcctatgtcctgaatggtattgccaaggttttattctagggtttttgtggttttaggtctaaaatttaagtcttgaatctgtcttgagttaatttttgtataaggtataaggaagggatccagtttcagctttctacatatggctagccagttttcccaagaccacttattaaatagggaatcctttccccaatgcttgcttttgtcagctttgtcaaaaaatcaaatggtggtagatgtgtggtgttatttctgaggcttctgttctgttccattggtttatatatctgttttgctaccagtaccatgctgttttggttactctaggcttgtaataaagcttgaagtcaggtagtgtgatgctaccagctttgtcctttttgcttaggattgtcttggttttgtggactcttttttgattccatatgaaatttaaagtagttctttccaattctgggaaaaaagtcaatggtagcttgatagggagagcactgaatctataaattactttgggcagtatggccattttcacaatattgattcttccaatccatgagcatggaatgtttttccacttgattgtgtcctcttttatttccttgagcagtggtttgtagttctccttgaagagatccttcacatcccttgtaagttggattcctaggtattttattctctttgaggcaaatgtgaatgggagttcactcatgatttggctccctgtgtgttactggcgtataagaacgcttgagatttttgcacattgattttgtatcaatcaaactttgctgaagttggttatcagcttaaggagactttggggtgagatgatggggttttctaaatacacaatcatgtcatctgcgcacagaaacaatttgacttcctcttttcctaattgaataccgtttatttctttctcttgcctgattgccctggccagaacttccagtactatgttgaataggagtggtgaaagagggcatccttgtgttgtgctggttttcaaagggaatgcttccagtttttgcccattcagtatgatattggctgtgggtttgtcataaatagctcttagtattttgagctacgttccatcaatatctagtttattgagagttttagcatgaagggctgttgaattttgtcaaaggccttttctgcatctattgagacaatcatgtgattttgtcattggttctgtttatgtgatggattacgtgtattgatttgcatatgttgaacaagacttgcatccccgggatgcagccaacttgatcgtggtggataagctttttgatgtgttgctggattcggtttgccagtattttattgaggattttcgcatcaacattcatcagggatattagccggaaattttctttttttgttgtgtctctgtgaggttttggtattaggatgatgctggcctcatgaagtgagttagggtggattccctctttttctattgtttggaatagtttcagaaggaatggtaccagctcctccttgtacctctggtagaatttggctgtgaatccatgtggtcctgggctttttttggttggtaggctattaattgctgcctcaacttcagaacttgttattggtctattcagggattcaacttcttcctggtttagtcttgggagggtgtatgtgtccaggaacttatccatttcttctagagtttctagtttcatttgcatagaggtgtttatagtattctctgatggtagtttgtatttctgtgggattagtggtgatatcccctttaccatttttttattgcatctatttgattcttctctcttttcttctttattagtctggctagcagtctatctattttgttgaacttttcaaaaaaccagctcctggattcattgattttatgtagggttttttgtgtctctgtctccttcagttctgctctgatattaattatttcttggcttctgctagcatttgaatttgtttgctcctgcttctctagttcttttaaatgtgatggtagggtgttgattttagatctcccctgctttctcttgtgggcatttagtgctataaatttccctctacacactgctttaaatgtgtcccagagattctgctaccttgtgtctttgttctcattggtttcaaagaccatctttatttctgccttcattttgttatttacccagcagtcattcagaagtaggttgttcagtttctatgcagttgtgtgatttttgagtgagtttcttaatcctgagttctaatttgattgcactgtggtctgagagactgtttgttatgatttccgttcttttgcatttgctgaggagtgttttacttccaattatgtggccaattttagaataagtgtgatgtggtgctgagaagaatgtatattctgttgatgtggggtggagagttctacagatgtctattaggtctgcttggtcctgagctgagttcacgtcctggatatccttgtaattttctgtgtcattgatctgtctaatattgacagtggggtgttaaagtctcccattattattgtgtgggagtctaaatctctttgtgtgtctctaagaacttgttttatgaatctgggtgctcctgtattgggtgcatatatatttaggatagttagctcttctggttgcattgatcctttttccattatgtaatggccttctttgtctcttttgatctttgttggtttaaagtctgttttatcagagactaggatataacccctgcttttttttttttttttttttttgctttccatttgcttggtaaatatttctccatccctttattttcagcctatgtgtgtctttgcatgtgagatgggtttgctgaatacagcacatcaatgggtcttgactcttatccaatttgccagtctgtgtcttttaattggggcatttagtccatttacatttaaggttaatattgttatgtgtgaatttaatccctccattatgatgccagctggttattttgcccattagctgttgcagtttattcatagcgtcgatggtctttacagtttggcatgtttttgcagtggttgatcctttccatgtttaatgcttccttcaggagctcttgtaaggcaggcctggtggtgacaaaatctctcagcacttgcttgtctataaagggttttatttctccttcacttatgaagcttagtttggctggatatgaaattctgggttgaaaattctttatgagtgttgaatatcagcccccactctcttttggcttgtagggtttctgcagagagatctactgttagtctatgggcttccctttgtgggtaacctgacctttctctctggctgctcttaacattttttccttcatttcaatgtgaatctgacaattatgtgtcttggcgttgttcttctcaaggagtatctttgcggtgttctctgtagttcctgaatttgaatgttggtctgccttgctaggttggggaaattctcctggataatatcctgaagagtgttttccaacttggttccattctccttgtcactttccggtacaccaaacaaatgtagatttggtcttttcacatagtcccagatttcttggaggttttgttcgtttcttttcactcttttttctctaatcttgtcttctcactttatttcattgagttgatcttcagtcactgatatcctttcttccgcttgatcaatttggctattgatatttgcgtatgcctcatgaagctctcctgctgtgtttttcagctccatcaggtcatttatattcttctctaaactggttattctagttagcaattcgtctaaccctttttcaaggttcttagcttccttgcattgggttagaacatgctcctttaactcagaggagtttttattacccaccttctgaagcctacttctgtcaatttgtcaaactcattctctgtccagttttgttcccttgctggcaaggagttgtgatcctttggaggagaataggcattctggtttttagaattttcagcctttttgtgctgttttctccccatcttcatggatttatttacctttggtctttgaagtcggtgatctttggctggggtctctgagtggatgtcctttttgttgatgttgatactattcctttctgtttgttagttttccttctgacagtcaggcccctctgctgcaagtctgctggagtttcctgaaggtccactccagaccctgtttgcctgggtatcactggtggaggttgcagaacagcaaagattgctgcctgttccttgctctggaagtttcgtcccagaggggcacccgccagatgccagcctgagctctgctctatgaggtatctgtcatcccctactgggaggtgtctcccagtcaggatacacgggggtcagggacccacttgaggaggcagtctgtcccttatcagagcttgaatgctgtgctgtgagatccactgctctcttcagagctgccaggcagggatgtttaagtctgctgaagctgtgtccccaaccgccccttcccccaggtgctctgtcccagggaggtgggggttttatctataagtccctgactggggctgtgcctgtttttcagagacgccctgtccagagaggagggaatctggagaggcagtctggccacagtggccttgctgagctgcggtgggctccccacaatttgaacttcccagtgtctttgtttatactgtgagggtaaaaccacctactctaccctcagcaatggtggatgcccttccccccaccaagctcgagcatcgcgggtcaagctcagactgctgtgctagcagtgagaatttcaagccagtggatcttagcttgctgggctccgtgggggtgggactgccaagccaaaccacttggctccctggcttcagccccctttccagaggagtgaactgttctgtctcagtggcgttctgagcaccactggggtatgaaaaaaaaactcctgcggctagttcagagtccgccaaaacagccgcccagttttgtgctggaaacccagagccctggtggcttgggcgctggagtgaatctcctgggtccgcaggttgtgaagaccatgggaaaagcatagtatctgggctggagtacatggtacagtccctaatggcttcccttggatagacaaggtgttccctgaccccttgcacttcccggatgaggtgacgccccaccctgcttccactcgccctccttgggctgcaaccactgtccaaccagtcacaatgagatgaaccggttacctcagctggaaatgcagaaatcacccgccttctgcatcaatctcaccaggagctgcagaccggagctgttcctattcggccatcttgccagccaattctcttctttatacttttcgataatgtctaaatatttcccaatacaattgtaaattgtacaagtatgaaaaaaagcatttccattcaaaaatataaaaacgtcagaggcatttgagccagagcaactccatcttgtataggggctaggtaaaataagactgagacctactgggctgcattcccaggaggttaggcattctaccaggatgagataggtcagcacaagatacaggttacaaagaccttgctgataaaacaagttgcaagaaagaagctgatcaaaacccaccaaaatcaagatggtgatgaaagtgacctttggtcatcctcactgctcattatacactaattataatgcattagcatgctagaagacactcctgccagagcgatgaccagtttacaaatgccatggcaacatcagaaagttaccctatacagtctaaaaaagggaggaaccctcagttctgggaattgcccacccctttcctagaaaactcatgaataatccatcccttgtctaccataaaatcaaaaattaacaataaatataagcagctgagcagcccatgccaccactctgcctatggagtagccattcttttattcccttactttcttaataaacttgctttcatattactctatggatttgcctccaattctcttgcacaagatctaatcaattcgttcatgtaacctcacttctcctggatgccagacaagagctcaggagccacaagtatgatacaaaaggacgtcatactggccctttgccctcactggcagaggacagccacctagcatgaaaaggtggagggcccactgagctgttaacacctaagccatagtggatggcagagctaaaagagcactgtatcacatcacctggggctttgggagctgcaggcaccccaactggacgctgccacggggcctgcatggagtttgtgctgccagcgcgcaaaggtgcttactctggttcctgcacccactcacctgcgtgctccctcctgcaaggggtggaatgcagcaggtccaagtgagtggggtttgatccccctggtgccactggtgccgctggtgctgaagtgcctggtggattcaagcactcatgcacgccagttcccaggaggagttgagagcggcaggctgagtaaaggaggcacccactgttgcaagtcccatgaaggggtcagggaaatatcttgcttcaaaggcagaaacatctgcatggaacttttcctaacaaaagtggcaactggctagtttgggtacggcatattctacccctgctattctgcactatatgagactttctctggctaactctccagttcaagaacagttcctctttactgtaattactaagaatactttttctagagcctgtcatatttaaggccatggcctctggcatgatgaacattagttgctgaatgccgtatttccaaaggaaagaaggaacaagttagccacctagatcctaagaaagacttttcagaaacaattgtgtctaacagtcaagaaagaaaatacagaaatagaagtggcacaatattgctcaaaatcttcagtagcttcttgttaattttaggataaaatcctgacaccattatcaaaatatgaggtaaaggaggaagtgaggtaaaccagatatatgtgttttgaaaacactttcccagatgattccgatatattagtgcccatttctatgaagcatttttgagatagacaacatcatctctatatactgagtagatagtatacatacttcaaaggtcaatttgtattaggtgtagaaatatgagaagcagaatggttaagccattatgttcccccaaaagatgaccaaatatgaatatataatcagcaataaacatcgagaaaaaaaactgagttcaaagtaggtgccatcactttctaaatataatttttttctagtcatgattagcccagtttttctcagacttcagtttttaatgtaaaaataattataattgtaccaatgttgctttaaatactcatattttaatgccatataaatacatactaacaaaattagatctaaactattatgcatataactcctttataactattaaattaatataaattcacaaattaaatatatttaaaaattacaaaaacattgacattcaaattaataacattaatttcataagaaagatgatgtttagctgaaatggtattgatgttgcatgcaaataatatcaagttcacatataaatttaattattttctgaatttttgtttcaataataagagtattcctgttcaagccttccagagtaacaatgtgccacaatgagtagctgatgttatcccactactaatatatacagaatgctggataaaatatagtccacaaatactaagtacatatcaaaactaaaaagaaaaaagtagaaatcctcaggcataagaaaaatggaggtaactcaagtcataacaataagcagagaaactaagaattcagtgggaaaagagagtatcaggtccaaatatatatacccctaaggccttgagatcacaattttaatggtaagcaggaactgaggcaggatctgaaaataaaactcctttcactggaacctgaaaggttcctattcatgaaatgggacttaaaagaaaaaaaaaaaaaaaaaaggcttcagcatgcagcccaaggcagtagcaagaatgttcatcttttctgctgagtgctgtgagtagaaaagaaaagccttctgtgagaaatcaaaactccaatctcacaacgagtggtgctacaagaatctcaaaccaaaatattaacaaaaaaatggcctcataacagtggaactcctggaatacccaaaagaaataaatgcaaaactcatttctaggtatatttctacaacacatatggctgttacagaaaaacagacttctgctgaaaattaactcacaaagtttacaaatcacctgaggacttttcacttaccaaaagggagtatcagtagacacaacaaatggttaaaacagcaccctcccaaaaaaaaagtttagaaaaataaaacaatctgatatttttaaataattattcttgatattatttaaaaaataaaagaaatacagttatactgaaagaccttccaatgaaaaatagtgacttaaataaaataaatagaacttctaaaaaggcattaacatttttaaatctcaatgtatagattaattagcaaattagatattgctgaagaaaaaactattacatgggaagatgagcttaagaaaattacccaaaatccaatacaataaaaaaatagaaaatataatgacagaatgaatgttatggaggatagaataagaaacattcatctatctatttaaataggagttccaagagagaataggaaagagaaaatattgaagagaaaatcgctaagaatttgcccaaaatgataaaaaacatgatcaaattcaggaaacaaatctcacgcaaaaaattaaaaagaaatccacactggatacatcattgagaaacttcagataattaaagacaaaaataaaatactaaaagcaacctcagagaaatgatacattgaatgcaacagaaaaacaattacatggagaatgccctaattataatttcatttattcacaaatatttattgaatgccaggcactgttttagttcctgaggatatagcagtgaacaaaacagacaaaaattcttgccttcatggagattacatactggtgataggaatagaataatatctgcaaaaaacaaacataaaacaaatgtgaattctaaattcacttttttctttcattcaataaatacttattaggtactttttatatgccaaacactgttttaaggtgttgtgatgcattaatgaaaaaggggacaaaaattcctaacttcattaagcttacatcatatgtaaatatataaataatagacataaaaatagtttttaaattatcatatgttggactataacaagtgctttttttttttggaggtacacaacaccatgcccggctaatctgtttgtatttttggtagaaatggggtttccagctaaactacattgaagaataaaataagtacatttgcagatgaaaaactgatattaattgattcttactgaaagagattaaatgatgtgtggaggaaactacatacaaaggagtggaatataaaatgaaatgttaataatcaacattcctttcatgtacacattatacatttataaaaattatccatataacagatcacactcatctctcaacaaatactaaataccaagaataagtttacagaatataaatcaacaaaattggagaacaaaagtaaaaagaaaatcaatttaagaattacattaaatttccacataaaaattatgttacattcagcatcttctgcttgctaaaaagtaaattatattacataaaaattatactgctaaatattcatagtttaagtttccattttatatggatatacagaatatttagaaagtaacagcatgacatataaaaatatgtgggtcgcagataaagtagtacttaacagttatagccaaaaacttaaaagtcatagccaaaaagtatatatttgagaagaaaaaatactgaaaacttctatccaagatctcaactcaagaagtttttaaaaggacaatagagtaaaataaaagaaagtagaagaaaaaagaaataatgggaatcaaatttaataaaatagaaatcaaagaatagtataaagcaaattaacaaaaaaaattgagtatttgaaaacaatagtcgtcgtcaaacttctgatagtattgaacataaaaaatattagagaaaataatattagaaatgaaaaataaacaattacaagtagagatttaaaaatcagaagataatattatgaactaacttaagccaagaaatttgaaaacagacaggctgggcaagttgctggaaaaaatataattgaaattgccttagcaaagattatgacagtgaaagaagtctaacatggctgactccatttgattctaacatcacaagctggctgtcctcactcattcctaaatacaggccaagctaactatgggaagaatttagttcatagcttggctttgaaggaaggaagacaacagtccctccctaaaactaaccctctccttgcttaaggaccaaaactgcctttgtaaaactaatgaaagcccaagagattaggactggggggagctgaattctgctaagatgtagacgcagtttgcccttctatgatcgtttattgcaccagaggtcacaagatttgcaacttccccaattgctcctataggtaacaccctattttagaacctaaggttggtctttgagattttttttcggacttttgcatcctgacaactgactgactctacctggacctgtgaatcatggctcaaccagtcccatggcccccacccagaggctgacagtgcacaaggatcattttccacacacatatgatttaactttcaaccagtctgctgcacccattccctagcccccctgcccaccaaagtatccttgaaaaacctaacctctaagcctctggggagatggagttgagtagtaactcctgtcctcccacttggctgcctcatgataattaaactctactgcaataacactgtctcaagtgcattgggtttgtctgtgcagtgggcaagaataacccatcaggcaattacataatttacttaaactgactaaaaggaaatatactacttaaatagatctatacccatttaagatattgaatcagaagtcataaaattgacctccagaaaaaacatcatgcacacatggtttcacaaaaacttttactgcaccttcagacaactgagatctcctatcttatacaaaatgtttcagggagtagaattctttataaagctcatgtaacctcaatgcactaatttataaaactttgaccttcacattgttgaggtgcagagaatgataccccaacatatagtgctttggcacactgaccactcctaattaaaagaaatcagaaggccttagaagctgcctaattttctaagcatctcttgttttttcccacccacctccaagtacgaggagggactctctctggaattttatgactaaggaaacttctttccaaaagataaccaattgtcttcttgaataaccaggaaaaaaattaaccactggagaagagactaaaagtcatcaccatacccagagagacttttcatctgttccatggagtaactccaagagattatctagggaactctgtctgcataataagacaacctttgttcacaggcccctcatttttctgccacctccctcagagatgagaggaactttgctccaggcgagtgccctttgggtttatttatttcccctgaaagttatcaactatttcatcaaaattgtctatacctcccatttctctctgccctgggaagaaggtatttgagcctcaaccatctggcccctctttgaattttacatctgtggggactctcatgtccatgtatacataaatcaatttgtaagcctttttttattgatctattgtcagtcatttcaataaaccttcactgagcatggaagggaagctttccctccacctctacaacataaagatgaggtttacattgagatattgttgaaattggcattatatggttatctaatacaatgttctaggaatcaaatacaagaagtctactcattgcgtgtttactattacagttatataaaatcttattatgtaatctacttcatttgaaatttggatggagagcctaagcacctcactggtttagtaccctccctcctctgttaatgctcacgcactgactctaggaccctgcaactaactttgaaagccactagaattaattagaattacttttaaacaggattatattgtagtttcttcataatttataactttccttggacatacccaagcctatcataaaggcattatatcaaacagactttttctttacaaagtcgattattattttgcatgtattcttctagtgtttacaaattaatttaatgttataaatatatcacaaagccttttgactgtaaagtgtttcttcagataaatagaggtttgtcttactttttatataactaatttacttattaagatcattttcctaaaatccaaaagcttaagggaatctaagcacagatgtggcagcagatgtaatgaattggacaaatcttttaagcccacctatgttcaccaggtaatcagaatgacagtaacagcaaaatgcctcacaatctcacagtagagcctacagaatttttctttaaatgaccaacttcaatcaaagcctcatacaaagtttattctctcttctagttatccaaatatagagatgaaaaaaatatatgtcattagatgattaaatttctgtgatatttgtctcttgaaaagtaagtttgaggaagtcctagccactgcaatcaggcaagaggaagaaataaaaagctccaaataagaaaataagtcattatctctcttcactgattatatgattccatacctagaaaactctaaagattctaccaagaagctcctggaactgataaacaacttcatgaaagtttcaggatacaaaatcaatgtacaaaaatcagtagcatttccatgatgagaacagtaataataataaccaaactgagaaacaaatcaagaactcattcccctttacaataaccacactacacatacataaaatacctaagactacatctaaccaaggtggtgaaagatctctgcaaggaaaactacaaaacactgctgaagaaaattacggatgacacaaataaatggaaaaacattcctgctgatggactggaaaaatcaatattgtcaaaatggccatactgcccaaagaaatatacagattcaatactattcccatcaaactaccaacatcatttgtcatataattagaaaaaactatcctaaaattcatacagaaccaaaaaagagtctgaacagccaatggaatcctaaacaaaaagaacaatgccagagtcatcacattacccgacctcaaactacaccctaaagctacagtaccaaaacagcatgttaatggtacaagaacagacacataggccactggaacagaataaagaactcagaaataaagccacatacctgcagccttctgatctttgacaaagtccagcaaaaacaagcaatggagaaaggacttcctattcaataaatagtgctggcatagctggctagctatatgcagaagaatgaacctagacccctacctttcatcatacacaaaaattaactaaagatgaattaaagatttaagtgtaagacctcaaattagataaaaatcctagaagaaaaccaaggaaacaccattttagacattggccttgggtaagaatttatgactaagtcctcaaaagtaattgcagcaaaaacaaaaatagacaagagggacctaattaaaccaaagagtttctgcacagcaaaagacactacaacagagtaaacagacaacctacagaatgggagaaaatattagcaaactatgcatccaacaaaggtctaatatcctgaatctataaggaacttaattcaatgaacaaaaaaccaataatcccattaagaaacaggcaaaagacatgaacaggcacttctcaaaagaagacacacaagtggccaacaaacatatgaaaaatgctcaatatcactaatgatcagagaaatgcagatcaaaaccacaatgagatgccatctcacactagtcagaatggctatttttaaaatgtcaaaaagcaatagatgttggcaaggctgtggagaaaagggaatgcttatacactgtttatggtaatgcaaattagtttagcagtttggagatttctcaaagaacttaaaacagaaccaccatttgacccagcaatcccactactgagtatatatgcaaaagaaaataaattattataccaaaaagatacctgcactcacatgctcattgcagagatatttaaaatagcaaagacacagaatcaacataggtgcccatcaatagtggactggataaagacaatgtggtatatatacaccgtggaatactatgcagccatgaaaaagaatgaaatcatgccctttgcaataacatggacagagctgaaggccattatcctaagtaaattaatacaggagcagaaaatcaaataccccatgttctcacttatacataggagctgaatattggatactcatgggcataaagatggcaacaatagacattagagactactgtgaggaggtaaggagtcgggcaaaggttgaaaactaactactgggtactatgcccagttcctgggtgacgggatcaatcatacctcaaacctcagcatcacacaatatactcaggtaacaaacctgcatatgtaccatctgaatctaaaatataaattgaaaacatttttttaaatgagaagctaaaactaacgtgcagaactaaagggaagaaacccctatagtatgtaagctgtgagaagccctgaaattcaatttagaaatagatagtggtgatgttatgaaatgaattgtcaaaatggaatatagggttccaaaaagaatccatttagttcacatattatatggcttccattattattattattttttttttttttgagacggtgtcttgctctgtcacccaggctggagtgcaatggcatgatctcggttcactgcaacctctgcctcccgggttcaagtgattctcctgcctcagcctcccgagtacctgggactacagggtccaccaccacacccagctaatttttatatttttaatagatacaggatttcaccatgttggccaggatggtctcgatctcttgacctcgtgatctgcccgcctcggcctcccaaagtgctggaattataggcatgagccactgcgcccggccacatggcttccattattgctaggtctcttcaccagatcagaaagcaaaccgaaaacagtatctcacttcaaaaccattaatttatatatgtgctattcttaaataattaaatatattaaaaatttgtaaatattaatatctaacagaagacttttgttaacctaaaaaaattctcaaaaaaagtaagtttgatataatggaaattcaaaatttgggcaaattatttaagacaggtaaataccatgtaaaaaaaaatttaagcactgaagttgctgttcatgtagaaaactaacaacaaaaaagcgaggtatcttaaatctcaaaatctaaaatacacacacacagatagatggtgattagttagatgattgatagatagatagatagatagatagatagatagatagatagagataaatatccctggtgtaaagtgtgttaatcagccccaaatcctaatatcaaaagtggaatgaagcagaacactcaagaaaataaaggataaaattattgataggatgttatgaactagtagtaacacaagctatgagaaaaccatttattataaataaattaaaaccacaataagataccactaattccctagaatagctagaattagaaagatagacaataccaaatgtttgcaaggatatggagaaactacatcatacattgctaatgggaatataaaatgacactgtcattatgaaaaataatttggcagttcttgaaaaagttaaacataaacttaccatacaacctagaaatttcccatctaggaatctaccaaagacaaaagaatacacctgtctaaaccaggacatttatacaaatgtttacagcaacagtttatatatttaaaaactggaaacaacccagatgtccaccaaccagggaaaggaacttttttaaatgtgatatgtgtatattatggaatattattcagcaataaaaaggaatgaactactgatataggctacaacatggatgaacctcaaaaacattatggtaagtgaaagaaactagacatgaaagataacatattctaagattcaacttatatgaaatgtccagaaagggcaaatttatacaaacagaaagtaaatcagttgtgggctggggctggaagtgaggatctttttatgatgatgggaatgctctaaaaccagattgtggtgatagtttcacaactttgtaaatttactaaaaattgttgaatgatacacttataatggataaattatataatatgtaaattagtcctctataaatatgtctttttaaaagtgctgtgagctggctaggcacagtggcttatgcctgtaatcccagcactttgggaggctgaggcaggaggattctttgagcccaggagtttgagactagcctaggcaacatagtgagatatcgtctctacaaaaaatttaaaaattagccaggtgtgatggtgtgtgcttgtaatcccagctattcagggagttgaggtgggaggattgcttgagcctgagaggtcaaggctgcagtgagctgtgatcattccattgcactccagcctggatggcagagtaacaacatcctatgtcaaaaaaaaataataaaaataaacactgtgagctgtgtaaggccaggcatggtggctcaagcctgtaatcccagcagtttgggaggccaaggcaagaggatcatttaagggcaagagtttcagatcagcctgaaaaacatagtgagactccatttatacaaaataaataaataaacacgattagccaggcatggtggttgagacaggaggatctcttgagcccaggagttcaaggttgcaatgagctatgatcatgccaatgtactccagtctaggtgacagagcaagaccctatctcaaaaaaaaaaaaaaaaaaaaaaaaaaaaaaaaaaaaatagctgtgtaaactttcatttttctttactttaactgagagtaaatgacaaaaatattttcaaaaaccctgcacttcctaccagtattacaaaagggaaactatattcataatttttcaaattaaagcttaagcaactgttcatcaattttcaaaatttccctcgcattagcacttaaaaatctgaagtaatagtacaatgaaggcaagaagcatgtttggcaataaccaattatttgaatagacaaagcataaaagtagacttgtcaaatcaacctcataagaagttttagcaagcatggttctatagagatataagacattgtatactaacttcattatgctataaatcttacaaccgttctaatcacaaactggtacagttctctcagatctctaagtcttctcactgaaatttctctcttaaataatttaataatgatgtttatggcaacaatttgattgaacacttataatatgccagttactatgctaaccattcacatttaaaatcgcatttaatccttgcaaagatctttttatatattcattgatcactccattttacagatacagaaagtgaggctcagagagatagagtaaaggcgcaaggttacacagccagtaaattacttatctgcaggttgagttagtggccaatatacttaaccacagaactatgttttctaactttcaaaaaagcaatactgtacctttgcttgaaaaaggaactgtaccaccagaaaatgtcactgtaggtttctggttacaaagcaagaatgcccacctgtgctggagttaattctactgtcacttttggagtaaagtgtaagagtcatgagcagtgggtgaaaataaagttgatccaggcaacttttatattacttagaactactttcaccctagagtccttgtaaatctgaaaagaacaagttttaaattattatttaatttagagctaagaattccttgggtatcagtgagaagagaaaatgagagaagggaaatgtttaccatttgtattgaccattcgattttagccagaaaatttgctacactcttcatgtatatattttatttcatttatcctcaaaacgaactccttaaagtattagtatcttcaatttgcatattaaaaactacagacttctgagaggtaaggtgaattgccccaaagcacacagttaataagtggcaaagccaggatctaatccagaagctcatgttttcactataccatgctcacagtctagtattctattgtttatttcagaattgcttttctccagttcaaaaatggccttgtctcatgcctttcatcaaacagtaagtattccctaaagcccgatcatggacttcccatctattcattcattcattcattcccatctgctgagcccttttatgtgccagtcagagctaaacagtgaattagaggaagctccttcctttagaaaatggcagtctggtagtacataattttaaaaattaaaatgtgattttaaaatgacagcattaagctcaagacacaatgcaaacatagagaagggagtgcctaagttatttctccagttcttccagtgtataatatcttcaggattaaatatatattctttggctcacctttaaagcctttaattcctctggtcacatttatactcaattcaatattgactgagcacctgttgtgggtattaaaaggctgtatgccataatggaaagaggacagacatagagtcagataggcatgagtttatcccattctctctcgcttactagctatgtaaacttgagcaagcagctttacctcctttagcctcagtgggattttttaaatcaagtttattgaggtataatttacataaaataagatgcttccattttaagtttacagtttgatgcattttgacaaatgtctatagtcatgtaaccaacacaacaatcaagatatagagcatttccataactccaagagttgcacagaaatatttatagctttttcatagtagcctccatctggaccccaaatgtccattagtaaatgagtggattaaaaaaaaaaaagttcctttgtgccacttcccagccaatctgtccttccactcctggactccaaaccttaggcaccactacctgctttctgtcaagacatactagacttttaagtagaatttcatataaatggaatcatatagtatgtactctttcatatctggcttactttgttcagcatagtgtttttgagattgatttatgttgttgcatgttgtatagtttaatgaatttcattcctttttattgctggataatattcctttatatggatataccaaaactggtttatctgttcaccaagccatggacatttggaattcagtctggggctactacgaataatgctgctataaacattcttatacaatgctttgtgtgatcaaatattttcatttcccttaggtaaatatatacaagtggaaaggtaggttaaaataataagtttaacttttttaaaaagtaccaaactgtctttcaaagtggttgtaccattgtacattcccaccagaaatgtatgggttcctgccaacatttcgtataagctttttaaattttaagctatctagatttgtctagtagtatctcactgtggttttaatttgcattttcttaatgtctaaagatggtaaacacattgttagtgcttacttgccattagaatatcttgttttcaaaaagttttttccattattacatggtttgccttctacagttgtaagacttctttataatacaagtcatttgtcagatgtatacatcacaaatatttcctctcattctctggcttcccttttcattttcttgatggtgtcttttaaaaggcagaagtttttaactttgataaggttcattttttcctttttactttttttcatgcactgggggccctgaaaaatctttgctcattccatggttgcaaggattttctcctatgttttcttctggaggttttatattttcagttcttgtgcttaggtctgtgatccattttgagttatttttcaacatgatatgcccaaagttcactttttccacattctagttctactggtgctagaactcaatgttctagcatcacttgttgaaaagactaccatcctccccattaaagtattttgccacttttgtcaaaaatcaattcaccctatacattgaatctatttttggtctctctactctgttccattgatctatatatgtatcctatgtcaataccacattttctggattattttagctttataataagtctcaaaatttgtacttgtccaacttctccttctttttcaaaactgctttcattattctaggcttttggcatttataggaattttagaatcagtttgtcaatttttttaaaagcagagattttggttgacattgcatagaatttatagagcaatttggggagaactagcatcttaacaatattgaatttcccaagcaatgaacaaaaaatatctttctatttattcaggtcttatttaatttctgatagcaaagttttatagttttcagtgaacaggtcttgattttgttaaatctatccctaaatatttcatattttgatgtgtggtaaattgtactgtattattttaatttttgttatcaccagtatataaaacaattgatttctgtatattgatcttgtatcctgtgatgtttctaaactcacaagtttcatgagcatttttgtagattccacaggattttctacaaaactaattatgtgagctatgcattaaacagttttacctctttctttacaatatgtatgttttttatctctttttcttcccttactacactggctaggttctctagccagtgatgagaagtgatgaaagtggttatccttgtgttaggggaaaagcattcaatatttgatgattaagtataaatgtaagctgtgggtagaggggttgagacaaaattcacataaaatgaaattcatcactgtaatcattttaaagtatataatttagtgatttttagtatattcacaatattgagcaaccattaccactatataattccaaatttcagaacattttcaccaaccccatactcattaagctgtcactccccattcccctgacccttagcctctagcaaacactaatctactttctgtctctatagatttgcctacagcagacatttcaactggaatcatacaaaatgtaagtgacctttagtgactggttctttcacttagcataatgttttcaagttttagccatattgtagcatgtatcagcacttcattcctttttatagccaaatgggtactccactgtgaaaataccacattttctttattcatcagttgatggacatttggattttttccactttttagctactatgactaccgctgctatgaacattagtttacacatctttgtgtaaatatatatattttcaattctcttgggtatataccatgaagtagaattactggatcatgtggtaactctatatttaattttttgagaaactgccacacagtttttcacagcagctacattttacattccctccagctatgtatcagggttccaatttttaccatgcctgccaacaattattattttccatttgtttttatcatagccacccaagtgggtgtgaagtgatatcactttgtgcttctgattcaaatttccctaatgactaatgatgttggacatctttccatgtgcctattggtcatttgtatatctttttaggaaaaatgtcttttcaaaaatttgccaatttttaattgggttgtcttttttatgttaatccatagaattctttacatattctgaatactagacccttatcagatgcatgatttgcaagtattttctcccattgtgtgggctgccttttaactttcctttgaagcacaaatggtgaagtccaatttatctcttctttcttttcctgcttgtgcttttggtgtcatagttaagaaatcatggccttatccaaagtcatgaagattgtcttagtcaatctgggctgctatagcagaataccatagactgggtggcttaaacaacaaacatttatttctcaaagttctagaggttggaagtctgaaatcagagtgccagcatggccaggttctgatgagggctctcttcagggttgcagatgctgacttatcattatatattcatatggcagaaagagggcaagagagttcccatggtcccattcacaaggggtctgtcctcatgccctaattaactctcacaggccccacgtcctaataccatcactttgggggttaggattttaaaatgtgaattttgtggggaacgctaacattcggcccattgcaaagatctacatctatgtttccttctaagagttttacagttttagctcttatatttaggtctctaatcccctttgagtcaattttgttatataatgtggagtagggacccaaattcattatttttcatggagctagctatatgtcctggtagcatttgttgaaaacacttttctttcccccttgaatgggccttggcattgttgttgaaaatcaggtgaccacacatgtatggttttatttctggactctcaattctattccattgatttatgtgtctatctttatgctagtgccacactgtcttgattactatagccttgtaataacttttgaaattgggaagtgtgagtgctccaaattcgttctttcttttcaagattgtattagctatttgagacgccctcataattttgtacgaattttagaatcagctttttcacttcttcaaaaacagctattggtattttgatagggatatattgaatctatatcaatacaggaagtattaccatcttaaccatattaagtcttccaacccatgaacataaaatgtctgtttatttaggtctttttcatttatttgagcaatgttttagagttttagtctttcacttccctgtttaaatttattcctaaatactgtattctttttgatgctattgtaaatgaacaattttggattgctcatgactgatgtaaaactagcttttgtgcattgattgcttttgtattctacaatctttctgagcttgtttattagctctactcatttttttgtagattctttagagttttctaaatacaagatcatgtaatctgggaatttatttttactccttcctttccaatttttttggaaagaattttcctaattttcctagctggaatttccagtacaatgtttaataggagtggcaagagcaaacatcctcatcttattatcagtcttaggaggaaagctttccgtctctcactattaagtatgatgttaactgtgggttttttgcagattcccttttgcaggctgaggaagtatctttttagtcctagttttttgagtatttgtattatgaaaatgtgttagattttgtcaaatgctttttctgtatccattgagacaatcatttaaattttttcctccattttataaatatggtgtattacactcattggttttcacattgtaaaccatctttgcattcttggaataaatctcaatccctcatagtgtaaatttttttaatgtgctactagatttttttttttttttttgagatggagttttgctcttgttgcccaggctggagtgcaatggcgcgatcttggctcagtgaaacctctgcctcccaggtacaagtgattctcctctctcagcctcccaagtagctcggattacaggcatgcaccaccatgcctggctaatttttttgtatttaatagagatggggattcaccatgttagtcaggctggtcatgaactcctgacctcaggtgatccaaccacctcagccttccaaagtgctgggattacaggcgtgcgtaaccacacctggccactagattttgtttgctaacattttgttgaggatttttgcatctgtattcataagggatgttggtctacaattttcttgtactgtatttggctttggtatcagagtaatatggacctcatagaattaattagacagtattctcccctcctcaattttttggaataatttgagaaagattgctcttaattctttaaacatttggtagaattcaccattgaagccatctggtgctgggttttttgtggttggaggttttttcattattaattcaatatctttacttgttatcactctatccaaatatttcctttttattcagttttggcaaattatgtgtttctaaaaatttgcacatttcaactatgttgtctaatttgttcggcatacaattgcttatactattttcttataatccttatttctgtaagatcattgtaaagctcacactttcaatcctgattttagttatttgagtcatctctcttttttttaatagtctagctaaaagtttgtcaattttgttgatcactttgaaaaactggtttcggtttcattgattctctctgttgtatttctatttcccgttctgtttatcaccactctaatctttattatttccttccctgtttgctttgggtttagttcattcttctttttctagttcttaaggtggaagattgggtcatttatttgagatcattcttctttcttttttgtttgtttgtttgtattttgagatggagtctcgctctgtcgcccaggctcaagtgcaatggtgtgatctcagctcactgcaacctccacctcccaggtttgagcaattctccttcctcagcctcctgagtagctgggattacaggcacccatcaccacacccagttaatttttgtatttttagtagagacgaggttttgccatgttggccaggctggcctcaaactcctgacctcaggtgatctgccctactcggcttctcaaagtgctgggattacaggcatgagccaccacacccagcctcttctttcttaatgtaagtatttatagctaaatgtttccctctgagcactggtttaactgcgtaagtttggtatgttgttctgttttttctttattcatcttaaagtattttctaatttcacttgtaaattcttctttaaactactggtaatttaagagtgtattatttaatttcaacatatttgtgatttttccacatttccttctgttactgattttcaatttcatttcattgtggttgaagagcacactttgtatgatttcggcctttcaaacgtgaaaaaatgctcattatcattaatcctcagagaaatggaaattaaaaccacaatgacctaccatcgtacatgagtcagaatgactactactaaaaagtcaaaaaacaacagatgctggtgaacctgcagagaaaaggggaagcttatatgctgttggtgggaatgcttatacaccgttggtaaattagttcagccattgtggaaagcactttggagatttctcaaagaactcagaagcacatttggcccaccaatcccattactgggtatatacccaaaggaaaatagatcactataccaaaaagatacatgcactcacattcatcactcagagcacagatggacataaacaaagggacaataggcactgcaaactactagagggaagagggggacgtacgaagtggggcatgggttgaaaaactacctagtagttactacgctcactacctgggtacaacatattcatgtaacaaacctacatatgtgcctcctgtatctaaaataaaagttaaaatgttttttaaaaaaacaaattttgaaaaacttgcatcacccactgtaagcttgatagttttcctatatatgagatggatgatgatattaataaatgtggttatctgatattatataatgaaatatgtcaacatttggaagatctgaaaaaaattcattgagacttattttgtggtataatctatggtctatcctcaagaatattccatatggacttgagaaaaatatggattctgctgttattggtggattgttctatagatgtctgttaggtccacttggtttacagtgttgtttggtgtcactatttctaatgagaaatcaatggttaatcctattagactcccttgtactaatgagttgcttctctctttcttcttttaaaattctctttggctttggcttttatcagtttgattatgttgtgtggatctctttgagtttactctacttggggtatattgagcttcctggaagtgtaggttaatggtttgcatcaaatttcagaagttttcaattattatttcttcaaatacttcaaatgtctttcaaatacttcaaatttccatttctctgtctctttctctcctctcttgataatttcattatgtgtatgttggtacacttaattgtgtctcacagatctctatggcactgttcacttttttcatttgtttcctctctgttcctcaaattgcataatctcaactgatttatcttccagtcgctgaatttttttctcctacctgttcaaatgctgttgagcctcttcagtaaatctttcgattattgtacttttcaaaccagaattcctgtttgatttcttataatttttaatattcttattaatactctttattttgtgaaatattgctctcatggttttctttagtttttttaacatggttcaatttagtctttgaacatatttaaaacaaccgatttaaaatctttgcctagttaatccaatctctaggctacctaaggacagtttatattcattgttttttctcctgtgcatgggccatgctttcttgtttctttgcatgtcttataaatttttgtttaaaattggtcacttaaaatataatgtggcaacttgtgaaatgagattttctcacccttccctaggatttgttgtttcaggatgttcagttgtttttgtgtatttgtttagtaaccttttatgaactaattttgtaaagttttttgtattctttgtcatgtgtggcctctgaagtttcttttccctttgcttagtgatcagctgatgattagacagagatttccttaaccattagaaaccacaaatcctcctgtctttgcagaaaaactcttgtgtatgctaggatacaccttcaaccctcatgcaagcagttacaactctgccttagccttcatattctgattctgcagaggctcaaagtcagccaacaggaactttgaacttgctcagattaaacttgcttaggtttcttgggcatgtgcacagccatccatacacatgcatttggtctcccaatttcataagaaaaagtcagaacttttcaaagcctttatccccaaagtatcttattacgcagcttcttcccaagaattttagttagtcttttgctcacctgaagtgttatctattgcatccaatgaaagcaactaaaatatttgcttataaatgcttttgactaatgtaccagtactgggtttactattttagtactgtgtaagttctgagttaggtgagataaagataaatcttttgagctggtctttcaagaagctaccagatatatttatctgttttaatagatatacccgtagcagaaatgcaggttttatttccaggggtaatgctgatctgggaaacataagatagaaccagattaagttttttttaatccataaaactcactgtccttacagagattcagcttctttctcttgacaaagtgctcttctaatcgctacaagcttttggttaatttccaaagtgctgagaaagttgattctgaaagttttggccagttttttatttgcttttatggaggggtgaacttttaaaagtccttactctgccatttttccagctgtaggttttcataatgtttctatatttagggttcactgagcttctgcgatctagagatttatagttttcatcacatggaaaattataataactattgaacactgttgttgcaaggcttatcaatagtttacataaggagcccacaacaagaccttgcagatggcactcaatgaaaattattattggatgtatgccagacacacagtgagaaaaagaatcacaaaatttgctttctgggaactcaaaatgtatttcatttttatttcttccaaaaaattcccatgttttccttgtcacagtttgttttatttccattccttattttccccaaatatctatattttcctccttgtcccctatgcatttatctttctttgcataccaagaagttgtatcccattcaagtccctattcaagatttccttctgggaagcccacccacaattttctttgtaagaaacatgagatgaatgcaggaaactgcacccatttgaaccaagtaactgagaaatacacaaaattcacacatgcacgcaactcaaacctactaacttcctaagttcactgcatgtgttagggacacattcatccacatctgctattaagtttctgtctgatttcaaataacctttgatatagtttggatgtcctgcccaaagctcacgttaaactgtaatcctcaatgttggaggtagggactgatggaaggtatttggatcatgggggcagatccctcatgaatggcctgggccattcccttggtgataagtgagttctcactctgagttcacacaagacctgatcatttaaaagtgtgtggcatctccccttcccgtacactctctcttgatcctgctttcgccatgtgacatgcctggtcccatttcaccttcagccatgagttaaagcttcctgaagcctctctgaaagctgaactatgtaggtgtcatacttgtacagactgaagaaccataaaccaattaaatctctctcattataaattacccagtctcaggtatttgtttatagcaatgcaagaatggcctaatacaaccctccttccaccacttcacaataactcacaagctacaacgtttatggcacctatttttacaagcaaacttcagttctttttcaaggtaaagtgctttatttacatatttattaaacaggcaaggacttttaccctccacagagtgaattaggagtactgggatggtcaaaaataattcatggtgactatagtagaatcaagagtgtaaggcactgtgataagtgttaatgagtcagagtccagtagtgtagtggctagtagccactggtgacagccaagtgccagtgtgccagtatcacactctttctgtggagaaatcttgactgtgctttgtgtttcttggttcctattttctgagtctgatctccagccctcctgtagtttctgtcaactaacttatatccccccaataaatccaataagtcccgtttttatttaaattacatagtttcgttctgctatttgcagtcaagaactctgacaatttcaaaagtcatctatttctagccctaatctctgtcacattagcaatgatcttgataaatcaattccagaagactcaaaagctaaattcatgtgtgttaataaatcatgtagaaccttaaaatgcttgaataacatgacctcttttaaatttgaaattgaatcacatattgctactatttacagaaattagagctcaagtcagttagactaaatttcttatctagaaattgacattttcaagaaattgggagattaattttttaatttaaaaaaggtaaaagctgataaaaaaaagcagtgctatattcaactagctggtttcaaatgaaatattaatgaaactattttgcataacatttggcaagaaaataatgttaactacctcagttgtgaatattatcaagcttcagagaatttaataaaaatttttcatattattgcgcatttcatgacctcttctccttcaaatatcatggttttaaaaacactgatactctgccttttctcccaaatttaaatttctaaccttgatatctccctggtaccccaaatttctatatcaaactacttacttaatatagcctgattttctaccctaccccccaaatatgctgctttcctacacttctccatctctgaaaataagaatgccatacctctagctgctcaggcaaaaaaaaaaaaaaaatgactcctccttgactcttctgttattcttatacctgccacccaatccattagcaaactccttagctcagatatagtttggatatttgtccccaccaaatctcatattgctatgtgatccccaatatgggaggtagggcctagtggaagatgtttgtgtcatgggatgaatccctcatgaatggtttggtgcccttcctgtggtaatgagttactgcaagatctgattgttaaaaagagtctgggacccacccctcgtctcttttgctccctctctcaacatgtgacataccagctcctctttccctctgccatgactaaaagcttcctgtggcctcaccagaagctgagcagatgcgggtgccaggcttgcacagtctgcagaactgtgagccaaataaacctcttttctttataaattacccagtttcaggtattcctttacagcaacacaaaacagactaatacagtccctatcttcaaaatctagaatctaaccactctcactattcccacttctcccacaccctaatctaaaccataactatttctcacctggaatattacagaaaacctccaactcctctcctacattttcttccttgcatcctctcagtcaattctaaatatataatgcagagatgatcattttaaacataagtcagaccctattattattattctcaaaatctggattcctacctcattcacaaaaaaaaaaaaaaatctttataatggccaagaaattccataatctgtcttcccaccaaaactaagcatttcctactactgtttctcaatcaggactgattgaggtcaagtgcagtggctcacacatgtaatcccaacactttgggaggctgaggcaggaggatcacttgagcctgagagttggacactagcctgggcaacatagggagaccccatctctatgaaaaaattaaaaattatccaggcttggtggtgtgcgcctgtggtcccagccacttgggaggctgagatggatgggaggattgcttgagcccaggaggtagagactgcaataagccatgattgcaccactgcactccaacctacatgacagagtgagatcctatctcaaaaaaaaaaaaaaaaaaatagtgactgagtacatcacagtgtgctcctggtattcctggaatgatctgggcatactactacctttgcatttgcattgcatttgcatttgctttctcctttgcagataactatacaactcactgtctcagctccctcaagtctttactcaaatgtcttcttaaataggactttaataattactctatttaaaacagcaactcttcttctactttatggtgctccagattacccttcctggccctatttttctccatactatacatttgtatattgctgatatctaccatgtaactacaaatttcataagagcaggaatatctgtctgactttaacatctagaacagcatttggcacactataggtgctccataaatatttgttctattaacaagcaaattaatgaaaagcttagaaaaatataatgaataattgcatcaataagaatactttttaatgatagttttacatttgttgagacagctgagattcagtcaagaattctaaaagaaaatgttcaaatatgtaagaaaaaatgtatctcagaagtcctctagattaaacactagaagctaagtcatactattaaaagagatccatatttttattctgtcaaattgtcatagtattgcaaatatcatatttttatattatcagcagtaacctcaaaaaggaacagaacatgtaaacaagtaaaatttgcatactttaataggtctatcaattttaaatgatgctgttttgattgttgcataccagcaaactccaagagattgcctagcaatgcaatagcataattaacctgatgtactttcctgacctcataaatcacactttctgatcctctgagctcttggcacaaagaccctggaaagaatataaaatttctactgaattaactataaatttttgtaaacccaaagatccattttaaatggattttttgaacatagtacttttcacaaagaatctaataattttgatttaaaagaaaaagcaaaaacaaagcaactgttaacgtacttagcttgtcaaaatttaaaagtcaacagtcagtaggaaattagcttttccctcagtcacaaaattgtatcagcttatgttatagtccatgaactctgctaagtgttaggattaaaagagtgaacaagacaaccaagttctttccttcaagaagatgacattacagttgggagggaacacatcacaaataaatataaatatatatgttgataagtacaataaataaaaattatctagagtaacagaaaaaagagtaacgggagaagggtggctattttagatggaagtaaggaaaggcttaagatggcaattgagcagacacataaactagtaagaaagtgggcaaagaattccacacagaggagacagcatgtacaaatgctctgaagcagaaagtttattcaaggaaaagttcaagtccaacataattggagaggagtaggcaatggggggcatgttagtagaagaggtgggagaagtagctaggattcagattatgtaaggccttagagtaataaggactttgattttgtttagaaagtgacaggaagccagtgaaagatttttaaaatactgagataaactaacttttgctttaaaatatcactctgtatgctatgcagagaacagattggcataaaagtgaaaacaaatggatacagttaagaggctactgcagtagaccagataagagactatagttgctcaggacagtatggcatgatggagatagtaagaaatggtaggattccggacttaactggaaattctgccaacaagatttgcaaatagattgtattggggtgcaaaaaaaagagaaaaatcagtgatgttgcctgtgttctgagtgtgagtaaactggataaatgatgatatttattgagatagtgaagactaggagaaaagcaagttgagtgtgagcaaagggaggaattaagagtccagttttggccatgataagtttcagaatgctcgacagacaaccaagtggaagatgctaaataggcaatagtatatatacaggatacaagtcagggatacagatataaatttgggagtcataagccaatagatatttaaaaccatgggattgaatgaacctacctaagtacagagtataatttttttaaaaatgaggtaaggaaatcagagattacataaacaaatagaaaaacattccatactcatgctcatggataggaagaatcaatattataaaaatggccatactacccaaagcaacttatacattcaatggtattcctattagactaccactaacactcttcacagaactagacaaaactactttaaaattcatatggaaccaataaaaagcccaaatagccaaggcaaccctaagcaaaaagaacaaaactggaggcatcatgctacctgacttcaaactatactacaggcctagagtaaccaaaacagcatggtactggtataaaaacatacacacagacaagtggaacagaatagagaacccagcaataagagcacacacctaccacaatctgatcttcgacaaacctgacaaaaacaagcaatggggaagggattccctaatcaacaaacagtgctgtgataactggctagccatatgcagaagactaaaaccaaaccccctacttatactatatacaaaaattaactcaagatggactacaaacttaaatgtaaaacccaaaattataaaaaccctagaagacaacctaggcaatgccattctggacatgggaatgggcaaataattcatgataaagatgccaaaagcaattgcaacaaaagcaaaaattgacaagtgggatctaattaaactagagagcttctacacagcaaaggaaactctcaacagagtgaacagacaacctatacaatgggagaaaaattttgcaaactatgcatctaacaaaggtctaatactcagcatctataaggaacttaaacaaattcaagaaaaaaatacattaaaaggtgggcaaaggacatgaacaggcacctttcaaaagaaaacatacatatgccaacaattatataaaaaaaggctcaatgtcactgatcattagagaaatgcaaatcaaaactacaatgagataccacctcacaccagttagaatggcaattactacaaagtgttaaaataacagatactagaaaggttgcagagaaaaacaaaagcttatacactattagtgggagtgtaaattagttaaaccatcatggaagacagtgtggcaattcctcaaggacataaagacagaaataccatttgacgtagcaatctcattactgggtatatacccaaaagaatataaatagttctattataaagacacatgcatgtgtatgctcattgtaacactattcacaataggaaagatatggaatcaacctaaatgcccacagatgatagactggataaagaaaatatggcgtatatacaccatggaatactacacagccataaaaaagaacatgattatgtcctttgcaggaacatggatggagcactggaggccattacctttagcaaactaatgcaggaacagaaaaccaaatattgcatgttctcacttataagtgagagctaaatgatgagaacacatggatacatagagggaataacatgcaatggagcctttcgaagggtgaagggtaggaggagggagagaataaggaaaaataactaatgggtactaggcttaatacccaggtgatgaaataatctgtacaacaaacccccatgatacaagtttgcctatctaacaaacctgcacatgtatcctcgaaatcaaaataaaagttaaatttaaaaaaaaagagagagacctgaggacttagcctaaggtgcttctacatttaggttagaagaaaaaagtgaacgaagtggtatgtacaagaaggtggacacgatcaggtatgtcaaatgctcctgaaaataaaaattcgccaatgaaatttgaaacatggaggtctctataaccttgataagtatgtgcaactttacttgtaccttgggtggagagtgaaggacacaaaagcatgatatggggtagcttcaggagaaaataggagatgaaaaggcatgaactgtgaggacaaacaacttttttttttgagacagagtctcactctgttgcccaggctgaagagcaattgtgcagtctcagctcactgtaacctctgcctcctgagttcaagcaatccacccacctcagcctcccaaagtgctgggattacaggcgtgagccactgtgctcagccataaagaactttgtatgcattttgctgtgaaggggttcacagaaataggagagaagcctgatatggtttggctgtgtccccacccaaatctcatcttgaattgtaactcccacaattcacacatgttgtgggagggacccagtgggaggtaattgaatcatggggttgggtctttctcatgatgttctcatgatagtaaataagtctcacaagatctgatggttttataaagaggagtcccactgcacactctctctctctttgcctgccaccatccatgtaggatgtgaattgctcctccttgccttctgccataattgtgaggcctccccagccacatggaactgtaagtccattaaacccttttttcttcccagtctcaggtatttctttatcagcagcataaaaacggactaatacagggccacatgacaagaactgtggctttatgtagaagaatgcattcactgccaaatcatggcccagaagtaaggcagccaggagaagaaagatcccaacttctctttcttcccactcactaatgacccactagtaccttgcattggccaaactcaaacagaagtcagagaacaacagaagacaaggtaaagggagatgatagatgaagggaatggattttaaagatgacaatagtagcaaacacttattgagcatttattatgtgctaggcacagtgagaaatgcaatacacatattaatttatttttcctgacagcaatcttattaggtgaatacttttattatcatccccaatttacagaaagcaaaactggggcatggaatggctataaaactttcctaaagtcatacaacttgcaagtggcagaggagccagaacacaaacccaggcaatctggctccagaatccatactcttaacccttacaccaaactgtttaacagaagatgtttgtgtgctaatgaaataattaaataggaaaataaaaattaatttcaaatagaggaagaatgatattctttgagtaaataaggagaagtcaggacataacctgccatggttcttctccatttgtccttacagattatgtttcttccattatctaccctgttctgtgccccaggaggctgacctcaacagactgtatcatctagctcccttatcctctggcttccaactggggtccactaatgggggggcaccagcaggaaatcagggaagggaagaaataggggttgggatgttcattcccccagctctcttcctaccgggccctgatttagcagtggctgtgctcctcttcctaaagccatagcttctgtcaggcagccccttcaataatactgtactgtgttacagtaacagctcgctctccatgctccttaagcagtctcaccgttcctagcccaccagtgcttccatccctggttggctcccttaactccgctcatacctttgtaatagatctttcacttaaatctctttgagaacgccttctctggccaggcacagtggctcatgcctgtaatcctcgcactttcagaggccgaggcagacagattgcctgcactcagttgaagaccagcctgggcaacatggtgaaaccccatctctactaaaatacaaaaaaaaaaaaaattagctgggcgtggtggcgtgcacctgtagtcctagctactcgggaggctgaggcaggggaattgcttgaacctgggaggtggaggttgcagtgagctgacatggtgccactgcactccagcctggtgacagagtgagactccgtcttaaaacaaacaaaaaaacaaacaaacaaacaacaaaaaaagagaaggccttctcttacctgctaggactatgactgatattctaaccaggtggaacatttgacagataagaggagagaccatttgttcactttaataaaagggaaggcagagtatatggatgcagatgtaggtaagttggtagattgagtcgtgagacaatgagaaagttctcttttgtttgtttttattgtctcaataaaataagaagaaaggtcagcagctaatgttgaagaaggtgaggtatattgcatttgaggagaaagaatgtacgaaaatgttccctgggagaacaagtggactgtctgaggaagtgtaataggcatttggtcataaatttaaagtgaaaacagttaacagtatttctccagctatatttgtctgccttgatgtaggcatagaggagacatacacaggttgatgaagaggctgatttttgccccccaatgaagagaaaaacaaagaaattgaagatgcatgcaaattgagtaatcacagtaatgaaccatgtattctaagtttggtgaggtaggacatgaagacttacggtagctaacaggcatgaaaatgtgtagagccaatgatttagtagtagttgtgggatcaatgattgatatgggaactatagaaatgaactgggtcaataagaggaagtggtaagtggtggtcagagagtgggacgttttaaagtgagatgttagagcctatgaacaatagtaagatatagcataaaacataagagtgggtggctaagatgctgtggaggaagaaattattactggataggcaatcaaggaacagatccaaaaactacataatccacaaagacaaaataatgatgataatccaaatttgagagtataaaatcatgtagaatattagtgtccaggctgggcacggtggcttattcctataatcccagtattttgggaggccgaggcaggtggatcacttgaggtcaggagttcgagaccagcctgggcaacatggtgaaaccccatctctacaaaaaaaaaaaaaaaaaaaaaaaaaaaaaaaaaaaaaaaaaaaaactcgtgcagcaactatttctgaagcacaaggcttattttggaaattatttttgaataacttttttttcaaaactcaaggctttgctgaaagcatttaatatgcagtataatttgtttctgtgtgttttaaacttttagggactcatgattaaggcattttgtaaggactggcataccctctggagtttgctggctctaggtacattagatgattcaatttgcaaatatatattcctgcaaagagagttctaaccttatgattttgtgaaggcttattgttttgacagcaaactagaaacaatatcagctagaacctggggaatcaagaactagaaaccaggggaaaaaaaaaatatatatatatatatatataatatatgtgatgtgtgtgtgtgtgtgtgtgtgtgtgtgtgtgtgtgtgtgtgtatatatatatatatatatatatatatatatatatatatgttttgtttgtttttaaacagggtctcactctgttgcccaggctggagtgcagtggtgtgatcagagctcactgcagcctcaacctcccaagctcaaggaatcctcccacctcagcctcccaagaagttagaacaacacacatgcatcaccatgaccagctttttgttgttgttgttgctcctgttgttgttgttgttgttgagacagggtctcacaatgttacccaggttggtcttaaactcctggcctcaagtgatcctcccacctcagcctctcaaagtgctgagattaggggtcttaaccaccatgcctggactgaaatatattctatatggtatatctgtaggttattattgaaatgtttggaattcctaacacagtctaagaagttctgtggcttctgagcagagagcactttctgatgtaaaagtgaaatgtttccttaagaaactcttaggactggcccttatagatgaatactcctcattctctaactcttctatctttcgctaggagccagaactgacaggataaaggagaagcctatgagatactcatgagatactttctcttccactgctctttcttttggttggtccttttagtcaatacccaataccaaattggaaaggagtataaaggtgaaaaccagcattgagatctacatgcctcagtgtattggggttgcaaatctaagttgcgtcacaccacatatctgcaaagaaaatgtggttttttaatgtgtttatgatttttttagatgcttcacaagctctcaacccctggttaattgggaaaagtaaccatctaatccagtttatttttttctaattttaatttttgtttttctttcaatagttttagagaaacaggtggggtttactgcatggaaaagtaatttagtggtgatttccaagattttggtgtacccattacctaagcagtgtacttgggtacactgtacccaatgtgtagtcttttttccttcaccctctgccctcttgatgcctctccatccttgtagcttggttcccacttataaatgataacatacaatgtttggttttccattcctgagttacttcacttagaataatggtctccaaccccatccaggttactgtgaatgccattatctcattccttttatggctgagtagtattccatggtgtgtgtgtgtgtgtgtgtgtgtgtgtgtgtgtgtgtgtgtatcacattttctttatccactcgttggttgatgggcatttaggctggttcacagttttgcagttataaattgtgctgctatagacatgcatgtgcaagtgtctttttcatataatgacatcttttcctctaggaagataaccagtagtgggattgctggatcaaatgatagttctacttttagttctttaagaaatcttcatactgttttccataatgattgtactagtctacatccccaccagcagtgtaaaactgttcccttttcaccacatccatgtcaacatctggtactttttaaatatggccattcttgcagtagtaaggtggtatctcattgtggttttgatttgcatttccctgatcattactgatgtagagcattttctcatatgtttgttggtcttttccatatcttcttttgagaattatctattcatatccttagcccaccttttgatgggattacttgttttcttcttgctgatttgttttcattccctgtagattttggatattagtcctttgtcgaatgtatagactgcaaagattttctcccactctgtgggttgtctgtttactctgctgattatttcttttgctatgcagaagctttttagtttaattaagttccatctatttatctttgtttttgttgcatttgcttttgggttcttggtcatgaggtctttgcctaagccaatgtctagaagtgtttttccaatgttatctcctagaatttttatggtttcaggtcttagattgaagtctttgatccatcttgagtggatttttatatacgatgagagatgaggatccagtttcattcttctacatgtggcttgccgattatcccagaaccatttgttgaatagggtgtcctttccccaccttatgttgttgttcgctttgtcaaagatcagttgactttaagtatttggctttatttctgggttctctgttctgctcctttggtctatatgagccctacctaactttttaattccaatttggatgccctttcttttttcacttgtctgattgctctaagtaggacttccaaaactatgttgactagaagtggtggaaatgggcatccttgtcttgtttcaattctcaaggggagtgctttcaacttttccccattcagtataatgtttgctgttgatttgtcatacacagtttttattaccttaaggtatgtcccttctgtgctaattttgctgagagttttaatcataaatgagtgctggattttgtcagatgctttttctccatctattgagatgatcatgtgatttttgtttttaattctgtttatgtgatatatcacagttttttttttttttctaagatggagtctcactctgtcacccaggctggagtgcagtggcatgatcttggctcactgcaacctctgcctcccaggttcaagctattctcctgcctcagcctctggagtagctgggactacagatgtgcaccacaatgcccggctaatttttttgtatatgttttttgtagtgacagggttttgccatgttggccaggctgatcttgaactcctgacctcatgatccaccctctcagcctctcaaagtgctgggattacaggcgtgagcctccacacccaacctgtatcacatttattgacttgcagatgttaaaccatccctgcatcctggtatgaaaaccacttgattatggtgtatgatccatttgatatgctcttagatattgttagctagtattttgtggaggatttttgcatctatgttcatcagggatattggtctgtagttttctttttttgttatgtcctttctgggttttggtaaatcccagaatgatttagggaggattccgtctttctctatcttttggaatactgtcaataggactggtaccaattctttgaatgtctgatagaattcagctgtgaggccatctggtcctggacttttttttgttggtaactttttaattactctttcaatttcgctgcttgttattggtctgttcagagtttctatttattcctgatttaatctagaagggttgtatatttcttggaatttatccatctcctctacattttctagtttgtccacataatggtgttcagaacagtcttgaatgatcttttgtatttccgtggtatcagttgtaatagctcccatttcgtttctaattgagctcatttggatcttctctcttcctttcttggttagtctcacagtctatcaattttgtttatctttcaaataaccaggttttgtttcatttctcttttgtatttttttgttttgatttcatttggttctgctctgatctttgttacttattttttctgttaggtttgggttggtttttctttgtttctctagttccttcaggtgtgactttagattgcctatttatgctctttcagactttttgatgtaagcatttaatgctatgaactttcctcatagcactgcttttgctgtgtcccagaggttttgacaagctgtgtcactactattgttcagttcaaagaattttttaatttccatcttgatttcattgttgacctaaagatcattcaggggcagattattgaatttccaagtatttgtatagttttgagggttccttttggagttaatttccaattttatttcactgtggtctgagagggtacttgatattattttgattttcttaaattaatattgagacttgttttgtggcctatcctatggtctatcttggagaatgttccatgtgctgatgagtagaatgtatattctgcggttttggggtagaatgttctgtaaatatttgttaagtccatttgttctgggtatagtttaaatccattgtttccttgttgactttctgtcttgatgacctctctagtgctgtcagtgaagcattgaagtcccccactattattgtgttgccatctatctcatttcttaggtctagtaataattattttataaatttgggagctccagtgttgggtgcatatatatttaggattatgatattttcttgttggatggatctttttatcattacataatgtctccctttgtctttttcaactgttgttgttttaaagtctgttttgtctgatataagaatagctactcctgctcacttttggtttccattttcatggggtatctttttccaccccattaccttaagtgagttcttatgcgttaagtgaatctcttgaagagagcagatacttggtgggtggatttttatccatgctgccattctgtattttttaagtgagcatttaggtcatttacattcaacataagtactgagatgtgaggtactgttttattcatcgtgctagctgttgcctgaacatcttgggttttttctttttgttagtgtttaataggccctgtgagatttacactttaacgaggttctattttggtgtatttcgaggttttgtttcaggatttagatctcgttttagcatttcttgtggtgctgacttggtagtgatgaattcactcaacatttgtttgtctgaaagatgaccttatctctccttcatttatgaagctcagttttgctggatacaaaattcttggctgaaatatactgtgtttgaggaggctaaggatagaccccaattcacttctggcttatagggtttctgctgagaaatctgctgttaatctgataggttttcctttataggttacctgatgctttcgcctcacagctcttgagattctttcctttgttcttgactttatataacctgatgacaactatgtgactgggtaatgatctttttgtgatgaatttaccaggtgttttttgagcttcttgtatttggatgtttagttctctggtgaggccaggcaaggtttcctcaattatgtttcccaaacttttagatttatcttcttcctcaggaacaccaattattcttgggtttggttaacataatcacaaatttcttggaggctttgttcatttttttttctttgtcttttttggattaggttacttcgaaagccttgtcttcaagctctgacattctttttcctactcattcaacatcattgttgaaactttctggtgcattttgtatttctctaagcgtgtctttcacttccagaagttgtgattgttttttctttacaatatctatttctctgtagcatttttcatccatatcctgtattgttttttaaatttgtttaaattggttttcccctttctctggtatctccttgagtaacttaattatcaaccttctaaattctttatctggcaattcagagatttttttttattggtttgaatcaattgctatgaagctagtgtggtctcttaggggtgttgtaaaacctcatcttgtcatattttctgattccttctcatttgggtagactatttcagtggaaaaatctggaactcaagggctgctatttagattcttttgtcccatggggtggtcccttgatgtggtacactgccccttcccctagggatgaggcttgctgcaagccagactgcagtgactggtattgctcttctgagtctagccaccgagtacggctaccaggctccgagctggtgctggggaatgtctacaaacagtcctgtgatgcgatccaccttcaggtctcccagccatggataccagcgcctgccctgttggaggtggcaggggcgtgaaatagactctgtgagagtccttggttgtagatatgtttagtgtgctggctttctcaaatgctggttatgctagcagtgacactgtcacgtggacagatttaggaccactggttagccaggatgttgcagggcacacggaattagctgttgttttcctcttccttggagcagcgttattctgtcattgagttgctgcaacgtcctgagttggtcagactacaggcagaaggtggtgctttcaagagagcaccagctgtgatagaagaggggggatataagcttgccctaagttgaccaagataagtgttcaggtttctcaagtaatgggcggggtcataaagctcccaaaagtttatgtctttcatgatccactactgggtatagagaaatactgtcaagtcagggcagggttaggcagatctgagctcagactccccttgggtggggcttgctgcagccactgtgggggtgtgggaggggtggttctcgggttaaattccaaaggggattatggctgcctctgttgccaggaaagtgagggaaagccagtagcgataggccccacccagcttttacccagttggtgaggcctgtctcactcccactgtgccatctaaaaccactgagtttgtctccaggcagcctgcacatgggactcagacctagccccaagttataagtttcccagctgagaaagcaagcagggctttcaggttacacccctccccatctgcccacattgtcccccatgactcctcctctcctttctgccgcagttcctgcttgcccccacattctgctcaagagagtttgtgcccagtcaaaattattgtaaaaatcacaattacttttgcgtagtatctaaacattttttaatatagtataataatatgaatttgatcagctcaagaaacttctaatgattttaactgtttaatccaaataaccatttacttcaaaggactcatcacaattatacttatttaatatcttacttgtttaatgtagtagacaatgagctccatgaaaacaaggtgtacatctctctcatcactaaaaccccagagcctaatgtggtgtctctttgatagtgggagatcaaatgtattttttcaaatgaaagaaatttaatgaagaactgttcattccatgccagatttggctgaattagaactggtccctgcattcaagaagctcacagtctgctgagggagagcaacatgtaatcaataaacaatagtacaatataataagtgctgtgccagaaatataaacaaataccatagaaacataagggaagaagtgattaattctgcttaaaggtagaaaatattaagaagtttttgaccaagtaataaatactcatttccttgggatggatgtttatactaagaaataatgtctatatcacattctattaacttgattagttccacagttcagtaaaacatattctatattgaaaaatttttttagatattactacgctatttcaggacatcttgaaagggcttattcctaaaataatcttttagaattttttttatattctctctctctctctctctatatatatatatataaattccctgaaagtagttcaacaacaaaaagtaaaattcaaggctataatattaataatactagtttgcttgctataggaaaacctagatgagaaagcctattgcttttttgccagctaccacatattagttacagtgatcatcaccaaattttcacttattatgtacttaacagaaatcaccagatcctttcacactcccaacaatagctttggggtttcactatctcactatatagggaaatctcatatgcactcaaaataaaagatttttttcctatattagctacagcacaaataatagcatccttcatttagaaacaaccagcctcatactcatctaaagcacataaatttagttaaatggtgccatctggtgacataaatcttgcagtaaatataaaagtcctgagtcagagtccagaatgatacccaaccctcttgatggcatccaatccaaagtgtctaatttaacttaagaaatacttgatcctgcctgacatgaaacacacaactaatcacactcagtatatggccgtttaacaaagggaattataacaattgtttgagccacattttatgctcaccactcttgtttctcaactctttggaagagacttgtatctaacaggatgccctatacaactcctagaagacattttaaaagcataaatatcaaggacattttgaatccctgttccaggcagatccatttcctcactctcctttgaacgtacatcaatgtgtataattttcaacacttcaaaatgtcacttccttaagaaagctgtcgaccaggtgtggtggctcacgcctgtaatcccagcgctttgggaggccaaggcaggcaaatcacaagctcaggagttcaagaccagcctggtcaacatggtgaaaccccgtctctactaaaaaaaaatacaaaaattagctgggcgtggtggcacatgcctgtagtcccagttactcaggaggctgaggcagaagaatcccttgaatgggaggtggaggttgcagtgagccaaagatcaagccactgcactccagcctgggtgacagagctagacttcatctcaaaaaaagaaggagaaagctgtccctgtttctactgttaaggttaagcctctcattcatagccaactctacttcttctttgtatataaactcttgacgaaattttgtttaatgcttgtctccccagtgtgtatcatagcgtttggcaaagtgttcaataaatatcctgtgaacgaattaatgtgtaaatggatggtgaaaacatccttctctactctctcttctaatgcaaatcctattaataacaaggctcagctcaagtttacattttatataaaaccttctctagcaacaacaatgtacaataagcccatgcttctcctatgccattttagtctagccccaaaaatttagtcctccactatatgatgttttgtattgtttttcatgtacataaatattactttcttaattgaccttaagctccttaagtgtaggcatttggtcttaatagcatccatctgcataagtctatgtaaataagtaaacacttcataaatactttgataactattattattcaattgcaataactaaaacacttgtactctttttatttaaataagtattgtaaacaaataagtagaaacataatagaccttagcaactaagaatttcaccttcactgttttgaacagtcaagacttatttaaagatccatgatatgtaatttgtttgtttcaactgaagcacatgctttgagattgtgagtggcagcaagcattacctaggaaatgcctctctcacatgggccagcaacaacatatcaatgtagctttatccatagagatacttattgtaacagaattctatccatagaataattattgtaacataagtagaaactatcttgtaacataaatagaaactatcattaattatccaaagagaaaaaaatcccttaaatgttttagatattctattgtaaggctgggtgtggtgcctcatgcctgtaaccccagcactttggaatgccaaggtgggagaatcacttgagcccaggagttcaacaccagcctgggcaaaatggtgaagtctcctttccgcaaaaaaaattcaaaaattagccaggcatgactgcgcataccagtagtcccaggtaccagggaggctgaggtgggaggattgcttgaccccagaaagcagaggttgcagtgagctgagactgcaccactgcactctagcttgggcaacagacaagactgagaaaaaagaaagaaaagaaaaaaaaagaaaagaaaagaaaaaagaaggaaggaaggacggaaggaaagaaaggagggagggagggaaggaaggaaaataaaaagaaaattaaaaataaaaagatatgctactatattttaaaaagaaaattggacaccataatgataattgtgagtttatggattacaaagtactcaagatatgtcccagaatgataatggctcattatagtcgttacagattaaatcagatcctataaaacacaagaaggaaaaaatgccactgtcatattctcccaagtttagtaataatattcacacactgttaatatattactttccctgaatggccaaatacctaaccatttagaacataggttttcaaattttaacatgcctcagaatcacctgaaaggattagtaaagtaccatttgctgagccctacttccagagtttcttattcagtcagtaggtctagggtgagaaccaagaatttgcaattctaaccaagttcacaggtgactagtgctgaggtccaagaaccacatcttgagaatctctctttttgaagattacagccaggttgtttcaccattaatctttaaatgggttaacaaaaaaagatataaataaactaaaagaataataaatacagccaagttgctccaaattcacacaactgtaggggccttcacacccactatttaaataatccttcacttccttatgatcagatggcaaaaaatacacattatgattaataattaagaccaaaatagccgtgatatattcaaagagatgttattttgaaataaaattactacattcgaattactattaggaaaatatgtagggttttttttactcaaactaaaactcttatacatatttattttatagaccttaccatcattataattgaataataattaattgtgtgtttaatgtctcttttcccctacttgtccataagggtattgactgtcctctatagcttactgttgtatccctattgcatagcacaatgtccaacacataactggtatttttaaaagaagtgttgataaatgaataaaaatttattaaaagtctattataattattaaaggtccacattatggggatataaaaaggggcagaagtatattcgatttaccataaggcaatgtgataaatgctttttagtaatatgaaaaaaatgctatgagatacaatgaaagggctagttaaagctgccagcaagtaggaatgtgttagaaggcttcaacaaagagatgataaatcccaatatgtaatacatctgctgtatcacccctattgctagtaatctccaaaatccacaaggttctctgttaagatttatggaaatgaaatgtactctattctaacacaaagtctaacatgtaaggtttaactgcctccattaaacaagataagcccttttctaagattttgccactggtagagtttttttaaagtatcatttaccgcttgttctcctctaatttccctctaattcctctccaaaaaattccccctcacacactgggaagaaatataaggcaataagttagataaacaagactaatatgattttagaaggggttgaaatctgtgaaatatatctatagttatttccatactttataagtaatgactaaagaataacacataattttcaataagttacaaaaaacatttgtgttacatatctaaaatttaactaacccataatattatttatttaaagtcttcaaaaacaattatggtggtaatatagttgtttaaaaattaaaagtcaatttagaagtacaaaaataatttttaaaaatgattcaaggccgggcacggtggtgcatgcctgtaatcccagcactttcggaagccaaggccagcagatcacaaggtcaggagttcgagaccagtctgaccaacatggttaaagcccgtctctaccaaaaataaaaaaattagccaggagtggtggtgcatgcctgtaatcccagctactcgggaggctgaggcaggagaatcgcttgaaccaggaggcagaagttgcagtgagccgatatcgcaccactgcactccagcctgggcaacagagtgagactctgtctcaaaaaaaaaaaaaaaaaaaaaagataaatcttgcttctttatcacctaactgaagaactgaagaataaataacctaataaaagtgccttgaaaatcttaatgttttatatattctaaataaaagagatttacatattctaaattaatttgtaaaatatcacagaattccaattccatctaaatgtgcagcttctagtatattgccattttaggtttgttttgttttggaatattaatgaacactgattattattattttatttagctattctaaacaaagagacataaattaatcataaaatattatggaattccaattctcttatattcaaattctggaaagtgttgatgctgtaatcatcttaaaactttattcatttggataaatgtttccttagtattaccacaagatgtcaccctaagcctagcatctaaatgtgcagcatctagcatattgctgtttcagggttttttttattttttgcatttggtttgggcacactaatgaacaccaattgctgtctttcaaaaaattaaagtgactttttctactctcagttattggcaaataaaaaatcaaaataaataatacagggactctagaagaaaggaggaagaaagttaatcaaacagttcattctccatgcttatcaggtatcttgttacttaccataaaagcaatgtatttaaccattgaattttatatgattttactttattttcaaaaatattaaaaattaataaatgttacttttataatcaaagttatgttacaaaataccagtcacagttatgtacacagaattcctcaaagaagataccatttaaaacatgctagtatttttttaagcatatgatgaaggaccacaaaaggaagacattattcattttatggtgatgcttttcagctgggggcagtggctcaagcctataatccaaatactttgggaggttgaggtgggaggatcacttgagcccaggagttcaagaccagcctgggaaacatagcgagaccccatcgctactaagaattgaaaaataagggtcaggtgcagtgattgacgcatgtaatcccagcactttgggaggctgaggtgggtggatcatgaggtcaggaaatcaagaccatcttggtcaacatggtgaaatcccatctctacaaaaaatacaaaaaattagccaggtgtggcagcacgcacctgtaatcccagctactcaggaggctgaggaaggagaactgcttgaaccgggaggcagaggctgcagtgagcccagattgtgccactgcactccagcctgagcgacagagcgagactccatctcaaaaataaataaaacaaaataaaatagagtgatgattttcatctgtagagagagggactggcttccttgtcacatgtaaatattacagcatgttctgcagtaatggtattttattatccatttgtgttttctacattatgattctcttctatttctacagctaatgagagtcgtgcgaggtactatttcaatgtgttggctatgtattggccagaataatgggtgaaaccactatcttgcactacttgtaacaggaaaaaaaagggtaggatggggtgggggagttggttcaaacagaatgcaaattatagaccataacaatgcgctatatttcaatggctccctacctatcctttacaaagatataaatcttctctaggatgcacaagtctacatggcttttcttcttttgtgtccttaaagaaaatgcacagtaagaccgcccaaacattcaataataatagattactaatcagtacataggtgcccacattgaattcaaaagaaaattatgttttgttgtataatgttgctctcttgtttgcactctggtttatcctaaaatgacttttaacgaccagctgaagtaaatctatccattcaaagctgggcactgggattacttacataacagctttttacagattattgttgcctctaattttactagagaaattcaaactacattattggcgttaagccaagatatttatcattcacttaaaataatggcaaaatacaattgtcactcatttgtctttgtattccctgggtaatggtgttacattatcaaatgattatattattaaaaatatagtagagttatctaaattatccaacaataccctttctaaatcaagttctcaaaaatgcaaattctcaaaagacttagccagtcttaagtaaacacatcatacaagtctgttaagatacattgccatttagttaatgacctttactaattatcaactattaataaatattaattttatcaaaaatttgatgtttaaaaatgttctcaaaaatattatctttgctgaatataaggtttattcaaattctgtaggactccatttagagtttttatttaataccagctaagatgattacagttatgtcattaattcttgctagccacaataaaatattttttaaaagttaatccacaggcaaaataatcctgtaaagctttacacttctatttttattcaatagaccgattttcaaattttcaaaattgaataatttttaaaattacattcaaactataaagttggagtttttatcaaaaagtacagatatttataatgaaaacaaagtattttcataattaagccttataagttcctattttttgattttatatcaataataaccagcatgaaaaagcaatgaaaatatctaggagactcagttatttctttaaaattatttaaaatcagttatttatttaaatctggcaaaatatattgtataattgagtgggtttttcattgtttagttagttggttgtttttttgggaaaagtatttgtttatttatatattttgttaatttattttacttcctaaaatataaaaaagaattaaaagctatttgcacaaatataagagatgtatataaaaaaaaatatataaataaaccatatccttaattttctttacaatctttaataaataggagaataaacataagtttaaacattatatggttagcttcatgacaaattgctaagaattccaaagcactgagattttcatcaataaacttttcaattctggatcataaactttcctaagacaagcaagaaagatgaaaagatgtttttatttttgttttaagaagagagtaaaagtgtaactttgattctgagtagaatgtgaaccatcatttttatgttacacaattccttccctgaaggaagacaacttccttctttagcatatttgtcctcaatgttttataacacactactcagggttttcttctgtgtaaacttttcttcctttatgaaacattctttcaatatttatatctttcaataacctctttttatttatattttcaaacaattcctttctaggttaaccttatataaggaaaaggaaaacaaaaaacaaaataaaacaaaacaaatcttcccttccagtattaaagaaaattatcccagtttgaaacttggttaacatcaggttctttgaccacattattcaaactatcaagcccaattctgaccattaaaatgatgaataactttcataatacatacctagcaaagcttggaataagctgctcttaaagatacccatcacctttttaaccgcatttttcaacagctgctcctctggtttccttaattttttgcagtattcttccagtaatgataaagctcggtcagtatctgaaaaacatgatattattattatattttatggtcttagcaaaatagaaaactaacattaaactattctataattgtgttcctaacttaatgacatgaaataacttaataaaataatcataatttctataaactaccatatgaaaataattatactcaatggccaatttcaacaatccagttttatttctatagtcttgtcttccaaaagaatccctaactgtaaaacaaaacaaagaattcaatcctggccacgatgttcaagttagatataactctctcttgtcagagacactgaccttaaaattgatgacttcctgcaaaataatatccaacttccttaacatgacccttgaggcctccctcccatgatcaaatattttcagccttatttcccactatatagtccacactctccaaacacacatacagtgcctaagtcatactggattactcacttttcccttccattttcctctacacgcatgcatgcgcagacacccacatacatacacacacgcatgcacgtgcacacttgctctctcccccacctctctctttctctctctctctctctctctactttttctcacctctgtacttttctttgctcctactgttctctgtgctggtatttcttcccctataccactgtatatactccctagaatcagcgtgctatcttgaaaaggggttcttgtcaggcaaatctaggtatgacccagatcttacttactagctgtgtgtgacctttaacacgttccttaacctctctgagcttcagtttcctcacaggtgttatgattagacaatatatgcacaatccctagcacaatatccagcacacagaaaataatcaagtaagtcaactgaacacctactttctcttcattcagatctaactcaaatgctctctcttccataaagccatctctgatggttaaaattaatcatcattccgtcttcttctaaaccactttgcctatacgaatttgtcggcagtcttaaacccatatcttattattttatgacttcttgaataatgtcttcatccttcacaagacaaaacatccttgaaaaagtcactagagttatacaacctttgtgtttaggtgataattgtctttgaatttaaaagccctccttcccttccaatctatcactttcaaaaaagcctaaataccaattataataacaatagcttatatttattttctatttcctcctttctcttgaaccttccaactcttcttcctcatggccattctcagctgatggtattacttcctattacatggaaaatcagaaggcagattccacaagctcctaacataacatctactgacttacctgtaactgcacccacatagtctgccttcccttatattactatgaataaagaatttgtttctaaggtcaactcctctcttgagcactggaatatatcctctcttgcttactcaaggaaattgttccattatcaattgctttcttttccactcaatcatcccatcattactaaatccagcagtcaattatcaatcatttcatttggcccataagcatcatttgatattgtcacactcttgaaaacacttttttcactaggcttccacacaggtgtgctggtaaatacttaaaaactagttcagataaaaaggaaaacatgggcacctacacgcacatgagtttgttataattttactgacacaaggatgtatagcaaccagtctacaaataataataagatatacaacctttaattgtaaattccattagtcagttgattctcaataatatttttattggtttttaccaaattcttgtattcatagccaacttagggttataactgatgaatgagtagttccaacatatatgtggtttgattatgttgtcatattaataaaatgaaaataaaacaacaaagatagtttttgtgaaaacctcactcaattatgttatttgtttactgaatcagataataatttttgaatagtggacaaatatttcctcaatttctgtactaatatcaatgtaacagcaacagacacaaaatgcttttaacttgcgcttaaattattagtatttactttatcactttcttatcagcaaaacaataaatcaagcccaaatttgtagcatttgcaatttccaaagtctaaatattcccaccatggccaatttcaaggtaccaacatgatgtctctgaacatggatctgagaaaagatgcacagcagcataccattatgtagcttatccaccgcacaaatacaatcaatgtaaataactcaagagcagagatggtatgaaaatgaaaaataattaagaattgatgactgttgagtatttattactttttaatataatttagttaagtttatgtgtaattatttttgttagtgatggggtctccctacattgcccaagttagtcttgaactcctgacctcaagcaatcctcctgccttgacctcccaaagtgctgggattacaggcatgagccaccatgcctggtccatagtttatgcataatttttaagtggttgagtttaactttttttttttttgagatggagtctcactttgttgcccaggctggagtgcagtggcgtgatctcggctcactgcaacctccgccttctgggttcaagcagttctcctgcctcagcctcctgagtagctgggactacaggtgtgtgcaaccacacccagctaatttgtgtatttttagtacagacagggtttcaccacgttggccaggatggtcttgatctcttgaccttgtgatccacccacctcggcctcccaaagcactgggattacatgtgtcagccaccgtgccaggctttaacatttttgaaatggctgtattgtcttgcaaatttgctgaaaatttaatgataagctcttgcaagctgacatgagccgtctccagcacaccattatttccagggcagcactctctcccagattgttttcccacttcatggatgccctttctcaatcacatttattagttccctctaatttctcaatgagggcttaagatgtttagaatacctctgaacatggtaagacttctttaatcttactccctggataatcttacccagtttccttgataatcttatctaattccgtagttttaaatattaccagcaccctcaagacttccgaatgtatatctgtagctcagaactttactctgaattccagactcatatccagctgaatgctcaacatttccatttggatgtctaataagcatctcaaacttcacttgtcaaaactgaactccagatcttatccacccaccctcagtctgcttctcctccaatgtatctccatctttcacccttccaattattcagacccaaattcctgaagtcagcattcattcttttctctaattctctacatctatccatcagtaaatcctgtgggctccaacatcaaattatatgcagaatcccatcacttctccctacctccagtgccaccaccctggcacaacccatcatcatctatcccctacattactgcaatgttctactagtttacatgctgtcacctttgccctcctacagtcttttctcttttttttcttttttctttctgtctttgtttgtttgttttgttttttgttttcttttaagcaggatctctctctgtcacccagatgggaatgtagtggggcaatcactgcacatttcagcatcagcctcccaggctcaagtgatcctcccaaatcattttttgaattctgatttttttgtagagatgaggtctcactatgttgcccaggctggcctacagtcttttctaaacccaatagccaaaaatatcctttcaagtcatcaactagattatgtcattcctcaactcaaaccctccagtgtctccccatcccactcagagcaaaggcccacctctctgacttcagctcttagacctctcctcttgctcaatctactccaaccacagtatgctgtttctcaaatatatcaagaactctcctatatcatggcctctatacttgtgattctgcctataacactcttctctcaggtatccataaagcttgctccttcacttctttcatatctctgcttatatatcatcttagtagtaaggccttccctaatactcctatataacatagcaaacttcaagcttatccccttgaaggaaatgagaatttcaattgggcaataagagatggaggaggacattgcgtaactactcctcttctatctagtaagattagaaatatagaaataaatgtggatgaacagagagctcactccaatttatattaacaaagaatggtgatataaatgtgtgctaatatatttgcataaactttaatttttaaaaatgatttcacactttacttgcgtaatgttttaacaactctgaatcaaggacaaatattttaatccccattttgtcaataattaaacaatcagcagtttccccaaaatgatggtggctcactttctaacccatccctacacactatttacaaatataaatagttactttacttaccactgtaggtgatcaacaatacaataattatactatacctctctctctacttatatgtatctgtgggctctaatcacgtgattacctctagtgcccaaagctttagtctttttcatttcctcattaaagtctgccgacatttttcgggaaacctacaagtgctgagcacctttttcttttctctctctttttttttttaatacaattataactaaagcctttttttttaagcttctgtggcattgttgtaggtattaccctagtcgtttattcttttaaagggcaattcttggccaggcacggtggctcacacctataattccagcactttgggtggccaaggtggaaggatggcttgagaccgggagttcgagaccagcctgggcaacagagcaaaaccctttctctacaacaaaattttaaaattagccaggtgtggtggtgcacgtctgcactcccagctactcagaaggctgagatgggaggatcatttaagcccaggagttcgaggcttcagtgggccaccatcctgctactgcactccagcctgggctacagagtgagaccctgtctctaaataaataagtaaaataccctgtctctaagtaaataagtaaaattaagagcaattctcaaaaatgtattaacaatattcccacaatcacatctacaaatataattagataagtaaggggaatttcactcactcatttagcatatatttatccaataactataaagggaaaatactgtattgattcaaaacagctagatgttttctaaaccagcagagcttactatgcctctcatcgctgtaggataaaaatttgacacataaaaaatgctaaaatatttttaaaaggtcgtatataatcaagtctccaagttaggctttcacacaccagcatctagggctggaattgtggctgcccttttatgctgcttttgattattgagaatgatcatcacctggagtcaattctattatgctcttcaactctctctactcaaatccttatttctggttaatgaaagtttgaaggtaatctaaaaatgacaaattaaacaaatgagacaaatggcaaggatcttttcatacaaattaaaaatccctaacctaatctccataaattgaataaagtggaaagctgagataattatccaagcaagtcaagattcatattttaattgatgttcaaataaccaagtggagaatttttcatctaaattgcctcaattctcctgttttcttcattaaactctaccttcataagactcctgagtctacaggaaaaaaaaaaagctaaatttggattacttgagggcaggcacaggaggaaatgggggggaagggagaatcactttttaaaataagaaatttttgcatgaaatatgcaaccaagggatagtgaatgttacataattagaactgtaggtaatcatgtgtctgttaattaaggttcaactctatattgtacatggtttaagaatagcatcaccagaaagttataaataatttgggacaggtaatttaaatttgaaacagtgattggcaatagtgctaacaaatgaacttttagagaaaagaaaatgatgatacataaaatcatttgccatggcttaaaaaatgaagaattacagaacatacagtggtatcattaggaaaactcagatcaaagtataatagagaaaaggtgaatttaacaggcaaattttggaaaataaagcatttagaatagtgaaattattttacataaatctattcaacatttttacagtttaaaaagaacttttaaatgcattatcttatctgattctcaccactgagaagtcatacctattttacatgaaactgaaactcagagtggcttgtccaagatcacacagctactaaataacagatttggagcttaatccaaaagcttttgattccaagtatagtgttctctccacaataccacccttaatcctccagaaatggagatgagcatatttttatggaaaaaataaaataaaacttgaccaatcagacataaatcgtatcactgaattttagaatctagggttaaatgttgaatcacaaatgttcaaatttagtcttttaatttgtatttgtaacatataaataaaaatggtcctacctttataagtctggtagatagagaaaaaggttatttcagccattaatcaagtatttattgactatcttactatatccagacactgggaacacagtactgaacaaaataggcaatagtctaccctcacagagattttagtctcaaaataaagataattaactaggaaattccaacaaagtgaaagattaaaacagagtataagaatgctatcacggctgggagcggtggctcacgcctgtaataccagcactttgggatgccaaggcaggcagatcacctgaggtcaggagatcgagaccagcctgaccaacatggtgaaaccccgtctctactaaaaatgcaaaaattagctggacatggttgcgggtgcctgtaatcccagctacttgggaggctgaggcaggaaatcacttgaacccgggaggcggaggttgaagtgagctgagatcgtgccactgcactccagcatgggtgacagacagagattctgtctcaaagaaaaaaaaaaagaatggtatcataaggtaccaggtaccatgggagtagagaattaagttgatggcatacgtacaatgttaacaagtttggccttataccaagggtagaatgtcaagtcatggaagatttttaactgaagaggaatatgaccattttttagatttagaacgattaactatagtatgatatgtatccattaaaacaagcaataacaattagacatttttcatattttaaatatatacaaaattgaatgatcacaattttatcattacttattagacattaggactagaaaatgaaagtgagaggtgaagccggctggcttctgggtcaggtggggacttggagaacttttctgtctaactaaaggattgtaaatgcaccaatcagtgctctgtgtctagctaaaggattgtaaatgcaccaatcagtgctctgtgtctagctaaaggtttgttaatgcaccaatcagcacttggtaaaaacggatcaatcagcactctgtaaaacggaccaatcagcactctataaaatggaccaagcagctctctgtaaaatggaccaatcagcaggatgtgggtggggccaaataagggaataaaagcaggccacctgagccagcagcagcaacctgctcaggtccccttccacactgtggaagctttgttctttcgctcttcacaataaatcttgctgctgctcactctttgggtctgcgccgcctttatgagctataacactcactgcgaaggtctgcagcttcactcctgaagtcagcgagaccataaacccaccaggaggaataaataactccagacgcgccacctttaagagctgtaacactcaccgcaaaggtctgcagcttcactcctaaagtcagcaagaccatgaacccaccagaaggaagaaactctggacacatccaaacatcagaaggaacaaactctggacacaccatctttaagaactgtaacactcaccacgagggtccacagcttcattcttgaagtcagagagacaaagaacccaccaattctggacacattttggcgaccatgaagggaccatcacctttcgccaagcagtgagattatcgcctatcgccaagtggtgagtaccattggaccactttcacttgctattctgtcctatttttccttagaattcaggggctaaataccagacacctattggccagttaaaagtgactagcacagccgccggactaaagacacgggtgtcaggctttctgggaaagggctctctaacaaaccccgactcttcagagttgggagcattggtttgcctggaaccagcttctgcatttcccgtacttctgggctgagccaagggtcgacagaggggaaagtcattcaactccagggtcccgacaacaagttggttgaccctgcagccatgagtgaaactcaaagtcatgtcgcccaagcaagactcatccatctatcttgatccttgcccccgggtcctaacgcctgccagataaacttcctctcacctgtcttctccaaggctagtcccgcttataaaaaccactcgctctctctggtgcttttctagtttctcctataagaatgatttctagtataaactccaggactctgttaccttcttttggcacctgggctcaccaatcaaaaagacataatttttgcccaaagccccgtcataggggagactatctggaattttaggatccctcctcagacaagcaggcctaataaaggctattcctacagctaggatatggggagcctcagaaattgtatccttcctattcatataagtgaagataaaaggcatcagtcttccaattctggagatccctcccctccctcagggtatggccctccacttaatttttggggcataacatctttataggacatgggtaaaatcccaatactaacagaagaatgcttaggactctaacaagttttcgacaatgcttcagtaaaggtgactacattggatttttctcggtcctctttgtggtctaggaggacaggcaagggtgcaggttttcgagaatgcatcagtaagggccactaaatccgaccttccttggtcctccttgtggtctaggaggaaaactagtgtttctgctgctgtggcggtgagcacaactattctgattagcagggtccagggaccgttgtgggttcttgggcatggggagaaacaaaccaaaaccatgggtggttttgtctttcagatgggaaacactcaggcatcaaaaggctcacccttgaaatgcatcctaagccattgggaccaatttgacccaaaaaccctgaaaaagaggtggctcatttttttctgcactatggtctggccccattattctctctctctctctgatggggaaaaatggccacctgagggaagtataacttacaatactatcctgcagtttgaccttttctgtaagatggaatgcaaatggagtgaaataccttacgtccatgctttcttttcattgaaggagaatacataactatgcaaagcttgcaatttacatcccacaggaggatctttcagcttaccctcatatcctagcctccctacagctccccttcccattaaggataagcctcctctaatctccccggcccagaaggaaataagcaaagaaatctccaaaggaccacaaaaccccccaggctgtcagttttgtccccttcaagctgtagggggtggggaatttggccccacccaggtacatgaccctttctccctctctgatttaaagcagatcaaggcagacctggtgaagttttcagatggtcctgataggtacatagatgtcctacagggtctagggcaaaccttcaatctcttttggagagatgtcatgctattgttagctcaaaccctggcctttaatgaaaagaatgtggctttagctgcagcatgagagtttggagatacctggtatctcagtcaagtaaatgatagaatgacagctgaggaaagggacaaattccctactgaccagcaagccatccccagtatggatccccactgggaccctgactcagatcatggggactggagtcataaacatctgttgacctgtgttctagaaggactaaggagaattaggaaaaagcccatgaattactcaatgatgtccaccataactcagggaaaggaagaaaatccttctgccttcctcaagtggctacgggaggccttaagaaaatatactcccctgtcacccaactcactacggggtcaattgattctaaaagatacatttattacccaatcagctgcagatatcaggagaaagctccaaaagcaagccctgggccctgaacaaaatctggaggcattattaaaccaggcaacctcagtgttctataatagggaccaagaggaacaggcccaaaaggaaaagtgaaatcagagaaagaccacagccttagtcatggccctcagacaaacaaactttggtggttcaaagaggtcagaaaatggagcaggccaatcactcggtagggcttgttatcagtgtggtttacaaggacactttaaaaaagattgtccaatgagaaacaagctgccccctcgtccatgtctgctatgctgaggcaatcactggaaggtgcactgccacagagtgcagaggttctctgggccagtaacccccaataagaagacccaacaacaggactgagggtgcctggggcaagcaccagctcatgttatcaccctcactgagccccggatacgtttaaccattgagggccaggaaattgacttcctcctggacactggtgcggccttctcagtgttaatctcctgtcccagacgactgtcctcaaggtccgttaccatccggggaatcctgggacagtctgtaaccaggtatttctcccacctcctcagttgtaattgggagactttgctctcttcacatgcctttcttgttatgcctgaaagtcccacacccttattagggagggatatattagccaaagctggagctattatttacatgaatatggggaacaagttatccatttgttgtcccctacttgagaagggaatcaaccctgaagtctgggcattggaaggataatttggaaggaaaaaaatgcccgcccagtccaaatcaggctaaaagatcccaccacttttccttatcaaaggtaacatcccttaaggcctgaagctcataaaggattacaagatattgttaaacatttaaaagctcaaggcttagtaaggaaatgcagcagtgactgcaacaccccaattctaggagtacaaaaactgaatggtcagtggagactagtgcaagatcttggactcatcaataaggcaataattcctctatatccagttgtacccaacccctataccctgctctctcaaatatcagaggaagcagaatggttcactgttctggacctcaaggatgccttcttctgtattcccctgcactctgactcccagtttctctttgcctgtgaggaccccacagaccacacatcccaacttacacagacgatcttgccccacgggtttagggatagcccttacctgtttggtcaggcactggcccaagatctaggccacttctcaagttcaggcactctggcccttcagtatgtggatgatttacctttggctaccagtttggaagcctcatgccaacaggctactctagatctcttgaactttctagctaatcaagggtacaaggcatctaggtcaaaggcccagctttgcctacagcaggtcgaatatctaggcttaatcttagccagaggggccagggccctcagcaaggaatgaatacagcctatactggcttatcatcaccctaagacattaaaacagttgcaggggttccttggaatcacgggcttttgccgactatggatccccggatacagcgagatggccagaccactctatactctaatcaaggagccccagagggcaaatactcatctagtagaatgagaaccagggtcagaaacagccttcaaaaccttaaagcgggccctagtacaactccagctttaagccttcccacaggacaaaacttatctctatatgtcacagagacagcagggatagctcttggagtccttacgcaggctcatgggatgaacccccaaccagtggcatacctaagtaagaaaattgatgtagtagcaaaaggctggcctcactgtttaagggtagttgtggcagtggccatcttagtgtcagaggctatcaagataatacaaggaaaagatctcactgtctggactactcatgatgtaaatggcatactaggtgccaaaggaagtttatggctatcagacaactgcctacttagataccaggcactactccttgaaggaccggtgcttcaaatacctatgtgtgcagccctcaaccctgccacttttctcccagaggatggggaaccaatcagcatgactgccaaacttatagtccaaacttatgccgcccgagatgatctcttagaagtccacttagactgatggaagttcatttgtggagaatgggatactacgggcaggttatgccatagttaatgatgtaaccgtacttgaaagtaaacctcttcccccagggaccagtgcccagttagcagaactagtggcacttacccgagccttataactgggaaagggaaaaagaataaatgtgtatacagatagcagatatgcttatctaatcctacatgcctatgctacaatatggaaagaaagggagttcctaacctctgggggaacccccattaaataccacaaggaaatcatggagttattgcactcagtgcaaaaacccaagggggtggcagtcttacactgtcgaagccatcaaaaaggggaaggagaggggagaacagcagcataagcagctggcagaggcagggaaagaccagcagagagagagagagaggaagagacagagatatagagagagagaaaaagagagataggaagtcaaagagagagacagagaggaagagactgaaagtcaaagagagaaggaaagagaggaagatacaaaggagtcaaagagacagaaagaaatagaagtagtaaagaaaaaacagtgtaccctattcctttaaaagtcagggtaaatttaaaacctataattgataattgaaggtcttctctgtaaccctatatcactccaataccaccttgttgtcagtgtcaacaagggcatagcccgaaagcactgaggccactgacaacccatagccttcctatcaaaaatccttaacccagcaggtttcccaacaagggatctaaatcttaactaattatcatacgaaggtctgaccagacctaggaggaactcccttcaggacaggatgatagatggttcctcccaggcaagtaaggaaacaaagacacaatggatattcagtgaggaaactcttgtagaagcagagttaggaaaattgcctaataattggtctgctcaaatgtgcgagctgtttgcactcagccaaactttaaagtacttacagaatcaggaaggagccatctataccaattttaagttaatatggactgaacgaggtcttactaatagcaaagaataattgaaatcccaaacttacaaggttttcaacaaaagtaaagtttgctaaaagtttacagtgtaacatatattatcctaacttctaatcttatgaaaatcagaccttatcagtacccctcaaagctcaagtccatcagcgcagagccatacaactaatacccctacttatagggttaggaatggctactgctacagaaactggaatagcaggtttatgtacttcattatcctactaccacacactctcacaggaattctcagacagtttgcaagaaataacaaaatctatccagtaaggatagtaaccacaaccccaaacagactctttggcagcagtgactctccaaaactaccgaggcctagacctcctcactgctgagaaaggaggactctgcaccttcttaggggtagagtgttgtttttatactaaccagtcagggatagtatgagatgctgtccggcgtttataggaaaaggcttctgaaatcagaaaacgcctttcaaactcttaccaacctctagagttgggcaatatggctcctcccctttctaggtcccatggcagccatcttgctgttactcgcctttgggccctgtatttttaacctgcttgtcaaatttgtttcctctagaatcgaggccatcaagctaccgatggtcttacaaatggaaccctaaatgagctcaactaacaacttctactgaggacccctggactgacccaccagtcctttcactggcctaaagagttaacctctggaggacaccacaactgcagggccccttcttcaccccatccagcagaaagtagctagagcagtcatcggccaaattcccgacagcaattggggtgtcctgtttagagatgggattgagaggtgaagccagctgggcttctgtgtcaggtggggacttggagaacttttctgtatagctaaaggattgtaaatgcaccaatcagctctctgtgtctagctaaaggattgtaaatgcaccaatctgtgctctgtgtctagctaaaggtttgtaaatgcaccaatcagcacttggtaaaaacggaccaatcagcactctgtagaacagaacaagcagcgctctgtaaaatggaccaatcagtaggatgtgggtggggccaaataagggaataaaagcatgctgcccgagccagcagcagcaacccgcttgggtccccttccacgctgtagaagctttgttctttcgctctttgcaataaatcttgctgctgctcactctttgggtatgtgccacctttatgagctgtaacacacactgtgaaggtctgcagcttcactcctgaagtcagcaagaccacaaacccaccaggaggaatgaacaactctggacatgccacctttaagagctgtaacatgcaccgcgaaggtctgcagcttcactcctgaagtcagcgagaccatgaacccaccagaaggaagaaactctggacacatccaaacatcagaaggaacaaactctggacacaccatctttaagaactgtaacactcaccacgagtatcagtggcttcattcctgaagtcaacaagacagaatccactcattccagacacaaaagtattttactaagaagtattcacatatgcttaattcttattgttgatgttattgcttttttacaaatcaaggacactcatgagaaagtaataaagtaatgaatagcaacagaaaagttagtcttgaaccaggtttttttttttttttaaaaattaacattaaaatgtatagttcggccgggcatggtggctgacacctgtaatcccagcacttgaggaggctgaggcaggtggatacctgaggtcaggagttcaagaccagcctgaccaacatggagaaaccccgtttttactaaaaatacaaaattagctgagcatggaggcccatgcctgtaatcccagctactcaggaggctgaggcagaagaacagcttgaacttgggaggcagaggttgcagtaagccaaaatggcgccattgcactccagcctgggcaacgagagtgcaactccatctccaaataaataaaacaaacgtacagttcaaggtgataccacaaaggtgtcattttattactaataatattagctagcatttgtggaacaatgctaggcattctgcactgatcaccttatttaatcttcaaaagaatcctaagaactactactatatacattttcacaaatggggaaattttagactgagggaaatagagtacatttgcccaaggctacataacagtaagtgctggaaccacaatgcaaatgctgatctatctgccaccaaagcccatacaaagcattatgccatattgaaacttgatttactaggaaaggatcacaatgcttctttcttctataattattctttgcaattatactttaccctccctaaaaaagaattgtttgaatatacttcaactaacacctgttgatctggttattttccctgttgaaacaagaagatattattaatagtataaaacggtaaatttatatctctcctttcagacaagccatgctttcaaattttctataaacttgttaaaggggaatgatagaaaatgtgcaaggctacgcagcagtaaacagaaagtaagaaaacaacgaattggccaggcatgtggctcatgcttgtaatcccagcattttgggaggccgaggcagacggatcactttgagctcaggagttcaagaccagcctgggcaacatggcgaaaccccatctctactaaaaatacaaaaattagctgggcatgtggtgggtgcctgtaatcccagctactcaggaggctgaggcaggagaatcgcttgaacccagaaagcagaggttgcagtgagctgagatcatgccactgcactccagcctgggcaacagagcaagattccatctcaaaaaaaaaagattaaaaattgcatcttcagctaaatactgatttttgcatcattccagatttatttatctagaaaaataaataaataaataaaatttggaatttaaatagtgaagaatatgtatggcaagacttaaagcagacctgaagactgcaatcattttgtatatattagatgatttacaaattactttagcatctttggaggagaaataatcttaataagaaatgttataacctgttttttttaaaaacacgcatggcatctcctatctgtgatcaaatgcatcattgccatatctggacaggcttgttccagaagctgaccacgaagctgaacccaaaccactgatggaaggggactctgacatttctcctccttgaacccacccacccccctaaaaaaaaatgcattcagatgataagcttttgtacagcagtttcttatctacaaaataatttttatatggtctaggtctcttgatttgatcctcacaataatcctaagaggtattagtactatacttaagttttaacaggaaaaatttgaagctctatctgttgatttgcttaatgtagtcaactgatggtaaaagctagattccaatcctgggctctcctctactgcactatgatgccattcacttgttcaaagactaccacactcatacagtaaaaaggaaagcatcagacaagcttctggtcctaattccatcactaactagctttgtaaaagtgaagttcatgaacattatcatatttgatgggaaaaagaaacagtatatagtaagggggaaaaaagcattaaatcccttttttaaaaggaaacaagttcagaaggattacatgattttcacaggatcttggtggcatcatcataagaaggcaagtaacctgtattttacacatgggagattggtactttgagatattaaaacttttttctacctaaattttcccatttccttttttctcattccagcgacaactggttccctactttattgcctcaggggcgctatatgccaggacaaaacccagaaggaatttttcagtaattccagttttgctttctaaaaacctaagccctcagaataaaataagagtttgtcagagatgaaaaagagattctcgggtacaggcagagaaagggacttctcctagccccttcacagcgtagaaaaaaattttcccagctgaagaaaacataaaaaagtctttggatctcaagggatcagggatctaggctcttgttattggcaacattgcttggaaggcagcaagacccaagaggaatggcattgtaacgcatctaggcaaacagaaacacagacattctagaaaaaggtaaaagtccatgactcggacatatcaaatatctgtcaaaccagacgagaaagagctatctagacacaacaactcatatgtcagaagtaagctgttttatatagatgatcaacaaccagaagacactcccattccaggcagaaccccaccttaaccccagggaagtggggaaaacttcaaaaaggataagttattttgtctgttactcagttactaagagtaaaggtgaattacagaaaataaatggatacttctaacatacctaaatttacagaccaagtccagctcacggattacctgatcctgtcccttcttttagtagccaaatcttctgactactgttctaggttttttccaccatgtcactgctatcgatgatgatgataacacaggatgtgattatatagttcaaggccaaaaaacaagaaaaataaataatgatctgaaacagcctcttgccatttcccacattgtctggtaaacttctattcatcttctgtatctcatcttaaatattacatcttccctagtgggattgagtgttccttgtctgttttcttgacaaagagcgttaacctcaccacacagcattgaaattgcctgtttttgcatctgtcttcctaatatattttaagattcatacaggcagagattgaatatcatttgctacttcaaacatgcatctggcactatgcctggcacatagcaggcactcataatacacctttgttgaatggataaatgattgaataaataaatgaaagtagagtcattgccttaaatatatacaccagtttacaccatatatacaccagtttaccttttaaaagaattttagcttgtttattacctatgagagatgtttaaatagaacagaacttaataggtttattccaagtattaccatgcttttaatgataaagatgtcacagtccttcaaaatgataagcccctgatagaagcttcaaaattgtatcctaaattagggcctcagtggctagcaaaatggtgttaccagaagaaatgggttacaaaaatcttacccataatctttgaaagtttaaatttaataattcattttcacaggattttctactttattatactataccattcctcttgatcttaaatcctaaaataaaggaggtcaggagaatcgtttcataatgaaggtgatttggccataattcttgaaatagctttgaaaacttactaaaaattgaacccatgcggaaagcttattagttggaattcagaatgactaactggacagaagagactggataaaactcatgatcctttgctgacaaagcaacctacattgaggatatagaaatacttgtgtcttgactgccataaattcctgggcaagaattgtagctggagaacacattcccttatcccaatcaaaaaaaaaatctctcccttatactaaaaaatattttgtaatcactgacatggtaacatagtattaagaaataagcatataaggagaatatatatttaagaaagtatagtattcgtatagttcagtaaatgtattttacagaacagtgagaaatttacttattgacaaaggcatgaatgaacagaatgccttaatccaacattttaaaaacccaatgtttatcccaggcaaattaacacagaaacagaaaacaaaataccgcatgttcttacaagtgggaactaagaattgggtatacatggacataaagacaggaacaatagacactacgcaagggactagtggggcaagggctaaaaaaccacctattgagtactatgctcaatacctaggtgacagaatcattcatatccaaaacctcagcatcacacaatatactcatgtaacaaatcagcacatgtactcactgaatctaagaaaaagttgaagttttttaaaaataaataagtaaaatccaatgttttgtgcatacctcactgactagattcttctacccacaaaagtaaacaataataggcctaagggagaaatcaaatattctatcataaataaaaacacttgagcagatttccaaaaacccagaagttcacacattttctagtatcaagtcattagcatatgctttgtactctcccaatagatatgtaaaataaaatcaattaacagatcattttatctctacgtcttcctcactaagttgcttcatagcaaactcctaatcagtagttaaacacaaaaagtattcttctatttctcattctggaattcattctatttatgcctcctggattaattaatattttacaatatcaagagtctatagcttatccaaggtcaaaattgtccctacggggaatttcttttaaaataaaaaagatatgggatacccaggctggagttcagtggcacaatcacagctcactgcagtctcaaactcctgggctcaggcaatcctccagtctcagcctcccaagtaactgggactataggcacatgccaacaagcccagctaatttttttaattggggaattttaaattaaaaaaaaaaactttagtaaattgtctattttactttgacttacagaaaatgcaaaagtttgaaaactgtgttttcccatctttctctaggatgattcagtgcttaattcttttgagttttatggctgtgaagagattaaaaaaaaaacttgaagttttggaaaacagaaaaaacatgtgcagccatatgcagtggctcatgcctgtaatcccagcactttcagaggtggaggcagatgaatcacctgaggtcaggagtttgaggtcagcctgcccaacatggtgaaatcccctctcttccaaaaatgaaaaaattagccaggcacagtggcaggcgcctgtaatcccagctactcggcaggctgagccaggagaatcgcctgaacccaggaggtggaggttgcagtgaaccgagattgcgcaactgcactccagcctgggcaacagagcaaaactccgtctcaaaaaaaaaaagacaagctctccatatattactggtatggcaaacatgaaaattcaaatacaaatttggtaaaatgcttgcaaaaggaataaaataaccacacaaggccactcaatgaagtcaggtacaggcatagctcattttattgcactttgctttactgcactttgcagacaacacgtttttcacaaattaagtttgtgacaaccctgtgtcaaacaagtctatcactggcaattttccacaggatatattcacttcatgtctctgcgtcacattttggtaattctcacaatatttcaaactttttcattagtcttttatttgttacagtgatctgtaatcagtgatctttgatgttcattgtaattgttttggggcgccacaaatcatacccacataagacagcaaacttaatctgtaaatgttgtgtgttatctgactcctctaccaactggtcattgccccatctctctccctctcctcaggtccccctattcctggagacacaacaatattaaagttaggccaattaataactctaccatggcctctcagtgttcaagtgaaaggaaacgttacacatttctcacactcaaagctagaaaatgattaagcttagtgaggaagttatgttgaaagctgagataagccaaaagctaggcagccctcttgcaccaaatagccaagttgtgaatgcaaaggaaaaactcttgaaggaaattaaaagggccacttcagtgaacacacgaataataagagagacacgcttactgttgatatagggaaagttttagtgatctgaacagaagatcaaaccagctgtaattcccctcaaaccaaagtctaatccagagcaaggccctaactctcttcaattctatataggctgagagaggtgaggaagccacagaagaaagctggaagccagcaaaggttggttcatgaggtgaaaggaaagaagtcatctttacaacataaaagtgcaaggtgaagcagcaagtgctgatgaagaagctacagcaagttatcaagaagatctagctgagataattgatgaaaatggctaaacaacagattttcaattcagacaaaatagccttacatcagaagaaaatgctagagagaaatcaatgcctcatttcaaagtttcaaaggacaggctgacgcttcttagaggctaatgggtgaatgtagctggtgactttacgttgaagccaatgctcatttacccttccaaaaatcctagggtctttaagaattatgctaaatctattctgtccatgctctaaaagtaggtcaacaaaagcctgggtgacagcacatccgtttacagcatggtttactgaatattttaagctcactgttgagaactactactcagaaaaaaaaaaaaaagattcctttccaaatattactactcattgacaatgcacctagtcacccaagagctccaatgaacatatacaaggagattaaagttgttttcatgcctgctaatagtacatccattctgcaggccacagatgaaggagtaacttcaactttcaagccttattatttaagaaataaattttgtaagactatatctgccacagtgattccctgatagatctggccaaagtaaattgaaaacctcctggaaagaactcatcattctatatgccattaagaacattcttgattcacaggaggaggtcaaaatatcaacattaacgggagtttggaagacattcattccaactttcatggatgactttgagggattcaagtcttcagtggaagaagtaacttcagatggaatggaaatagcaagagatctagaactagaagtgaagcctgaagatgtgactgaattgctgcaatctcatgataaaactggaatgaatgaggagttgcttcttatggatgagcaaagaaagtggtttcttcagatgaaatctacttccagtgaagatgttgtgaacattgtttgaaatggcaacaaagggtttagaatattacatacacttagttgataaagcagcagcagggtttgagaaaaccaattccaattttgaaagaagttgtactgtgggtaaaatgctgtcaaacagcatctcatgctacagagaaatctctcataaaataaagagtcaattgatgtggcaaacttcattgttgtcctattttaacaaattgccttagacatcccaaccttcagcaatcatcaccctgatcagttagcagccatcaacaacgaagcaagatcttccaccagcaaaaagattactactcgctaaaggctcatatgatcattagcattttttagttgtaaagcatttttacttaaagtacgtacattgtttttagacataatacgatcgcaaacctaatggactatagtatagtatatactgtactgtatacaacaaatattttggtttcccagtgcatatataccgtagtatacaatatattgtatatatgcatcagaaaaccagaatatttgtgtagcttgcttcattgtgataataggccttatttcagtggtctggaacctaacccgcaatatctctgagatatacctgtacatattccccctcttattgattctgaaaaaaaaatgattttaagaacttaagaaaaactagagatgaaaacagagtatacccgataacaaaaagcaaatgtaaattagtaagatactataaaacaagaagtggagccataatgtgcaggaaacaacaaaagaagaaaactttgaatagggaaaaaataagcaggagagtcataaggtcctcttccccagaggaaaaaaaaaaaaaagaaatgacacttttatgaagtatacagtcaaccaaaagcaaagagataatttaagaactgtgagtccaggaaactgtaatctcagtttcaagggtgcctatgagatatatggcaatatcatgtcttaagattctaaggccaggcgcactggctcatgcctgtaatcccagcactttgggaggccaaggtgggtggataacgaggtcaggagttcgagatcagcctggccaacatggtgaaaccctgtttctactaaaaatacaaaaattagccaggtgtggtggcacgcacctgtaatcccagctactcagaaagctgagtcaagagaattgcacgaaccccggaggcggaggttccagtgagccgagatcacactactgcactcccacctgggctacagagcaagactctgtctcccaaaaaaaaaaaaaaagattccaattatataacattcttcagcttcctttgaaagctataatgtcaaaacatatacatataaaaaagataggacttagctttcagtacatgataaaaatgtttatatatatattatatcactgagaaccactgcaaaaaaataattcaaaggaaataaagggtcatataaataaataatttcagacaaacttctacaccagtttaaaagaagctccgaagacaataggacaatttttttttttttgagacgaagtctctctctgtcgccaagttggagtgcagcggcacagtcttacctcactgcaacctccacctcctgggttcaagcaattctcctgcgtcagcctcccaagtagctgggattacaggcacgcaccactatgcccagctaatttttgtatttttagtagagatggggtttcaccacgttggccaggctggtcttgaactcctgacctcatgatccgcccgcctcggcctcccaaagtgctgggattacaggcgtgagccaccgcgcctggcaataggacaattttttaaaacactgaaatgaaatgaacatttatctcaaagtaataaaggcattgatttcttccacatatttaatgacaatgagaacaaaaagccattcaaaaaagaagctgcattgtactagaaaattctgttaaagcatatttttatctttaaaacagcaactttctgctgtaaaacatggcaaatgacgtacctatcattaacttttatttcttatgttaacacagtaggaaatcatatcagatcaattcaagaagacttgttaaaacagacccttataacacactatggtcttgcatcatatcagagaatactaatacaacttatcctgaattggtcctaaattttcacaaattaaaatatgtccaagattgtcccaagggctcacctgggagcaaataaagttactactatagataagaaaatcttgaatgaaaagcaactgctgaggaaaaaaaaccttctatgaggaaacagaagagtcttctgttgataaaactgagatctgtaaaaatgcgaagagactagagtgagagaagtagaaagtaatgtcataaagcaaacgagcagttaatatggggtttgaggcacagtagtttcagcttatccaagggcagtccagaatggcacctagaaatgggcttagtgagatgtcacacccattcccaattcccaccatggttgcatggtatcagtaaaagaatctcctctctctttgacaaaaatatactaactaaataccaaatgaaaatccatcttatgaaaatttcatactttaatgagaatatgttcaacaatgaataaacacttggctcagtgaggatagttattgtttagaatcacattaagtctagctttttcgtcatgtctaccacatgaaacaatgaagagagaaaaagactcaaggtgacagaggacagtgatccctgcagaataaatctaggttaaacttaaaaatactgttcttatattatataaacagtagagatagtaagcatagccaatgaaaaatacaatatacacataacttgtttggctagttgtctataatattcaagaatatgtatcataatactagcagttttaagagattaaaagcaagatacattgtttctctagatcagtttataaggaaaatatacaacatatactctggtatcatagaaatataaactggtttttctaataagaacttgttgattcctttaaaaattcaatccattagtcaattcattattgaagaaggaaagaagaaagggaaggagggaggcaaaggaagagaggaagaaggaaagaaaggaaattcttctaaagtattataatttcaccaatgtatcagcaatttctgtaacagttctttaaagggaagaacttttaagaaactcggtttatggggtttagaaacattaagttctaaactttctaactaaacctgcttagttaagttatacctagaatatcaattgaccttcctcctcttccttcccacatacctttttatctctttctctgtctctcctccttcccattctctcttcctttcactcttttcctctctgtctctctctctctcacacacacacgtaatgtgtttaattccattattagttcaaaataaggtaatccaaaagaaactctctagagaaatggtagaaagaataaaaacacacatcaacttaaatatgtcaaagagccatatcatttattggctacattcccaaaaccattcttgttctagataaaccaattgtgtctggtctggacaagtgtggctccaaaatctcaggcagtttacttctgtcagtggtattattagaaacagcagggggaggaaacaatcccaatcttaaatcccagtgtgcaaatatcacagttctaggtgttccaaaagttttatatatcattgtccatctctacaaatatcagcttggataaggcatctcagtgattataagtttcctcaacatccctaacaaatccacaggtagaagaattaaacaccatgcagagataagttccactttaacctgcaattcacccagagctttagtttcagattgtagcaactcacataactggacaacatttggatctatattagtccagtatagcagagttcaaggctgttcatataagttttgattcaaaactcttgagaaactctttacagttgatctcaccttccatataatgtcaaaacaaaacaaaacaaaaacagtcccaaactaggatcctttggaacaaagttaacctggggtgcatctaagctaaactgaatccccaagttcagaatataatcaactatgcttcaggaattcactagatcttgatcaattccaataataaaagttgttgaggagggaggaaaaaaacaggtgtttgccccatttggggaacttgacaatcatgttattggataatgcatatatctggaaaagcacaatagtcacgaaagttgtgctttatcacaaaagtgaagatttacactagaataaatccaaataataagtctattttttaaccaaaagataaattataaagctgtaattttgttcagtgcaaatgaaattactttgctacctttcacaattctgtaattagtttgataaatattaaacccatgaggaagagctccactgcacaagtttcttttttaaagactgcttaaaagtaaccttcaacaagctaagaaaacaagctaaaggagactccaaatctgcggtactgaatctattcttattaccaacggtgatataaacaacctgatttatgaaatcataaatatctatcaataaatactatagtcttgcttccttttactttagtaaaataatattactgaattatgtaccactgaaactatattacaataaatatttcccccaaactgaagcaaaactttactctcaaatggaatataatttaaattacaagtaccagaaccaacaaaagggagaaatattatatagcaaccttatggcccacctgtcttcttgactggcattcttgggtctttccactgccacaggagtcaatatctcttttcaggtctcagtttgatccagctggattgaggccaagagccaggtaactgttgcaaaccacttcagtgttcagttttgaaatccaggctgagtcttctatgtcagacaaagaaaataatgatgtattttttccacaactaaactttttacaccgcccacagagtttacagcaacgtaattttttagtttttcaagtttttcaattttcagaaaatatttagactgtttttacaaactgggaaaattattgtaaacatgaagaacgttactgaaattcctcttcaggcagcaacatttttggaagttcaatgactaactcaattaaggcacaaaccaaatttagacaggtctcattactttatacatggtcaaattcaaagatgatgataaagatactcaaatctgtagagaaaaatgtaaccccacctccccaaaaatacttttaaaaatctctttgactccagtctctaaaaagataggtgagtttgaacagttttctgtggcagaacacacattgaaaggcccccttatatttactgatcagaagttccggatctcaccccctcagtaactcagaatccagcttgctgtccctttcatttttttcttctgt

SEQ ID NO: 637 - DNA, 14895 bp, Homo sapiens
cgtcagtcccatggggaatgtcaacaggcaggggcagcactgcagagatttcatcatggtctcccaggccctcaggctcctctgccttctgcttgggcttcagggctgcctggctgcaggtgcgtccggggaggttttctccataaacttggtggaagggcagtgggcaaatccaggagccagcccgggcttcccaaaccccgcccttgctccggacacccccatccaccaggagggttttctggcggctcctgttcaatttctttccttctagaaaccagcatccaggcacaggaggggaggcccttcttggtggcccaggctttggcgggattatttttcaaagaactttaggagtgggtggtgctttcctggcccccatgggcccctgcctgtgaggtcggacaagcgcagggagtctggggcctctcagagtgcaggaagtgcgcacagggtgctcccaggctggggagcacaggtaggggacggtgcgtgggggatggcgcctggggcatgggggatggggtgtgggaaacggcatgtggggcgtaggggatggggtgtggaggatcgggggtggggatggcgtgtggggtgtgggggatgggccgtgggggggtggggcctgggaaacagcatgtggggcatggggtgtgggggtgaggtgtgggaaagtgtgtggggtgtgggggatggggcatggaaagggcgtgtggggtgcaggggatggggcatggaggtgtgggggatggggtgtgtggggtgtcggggatggggcatgtggggtgtgggggatggggcatggaaagggcgtgtggggtgcagaggatggggcatgggggggtggggatggcgagtggggctggggcctgggaatggtgagtggggcatggggatggcgagtagggggtgtggcgtgaggatggctagtggggcgtggggatggcgtgtggggatggcgagtggggggtgggctgtgagggacagtgcctgggatgtggggctgcagccctagctcacagcatggccttatgaccccggccaccttcctgccccaggcggggtcgctaaggcctcaggaggagaaacacgggacatgccgtggaagccggggcctcacagaggtgagcagggactgccactggttttgtcctggggcccagtgggggccaacatcacctccttcccctcccatggcaaagagccagcccgcggggtggctactgcagtgccccccaaggagggtgttccctgctcgagaggaagtgaccgctccagcttggccttccctgggactggggtgcaggcgattttatcttctttgctccattctgttccttccagataatcgtgtgttcttcatcaggttttcctcagttcttgagagcttttctgatgcaaatctgctttcaccccagggcggtcaccggctctgctcacaccagcctccaagggtgtgggtgtcccgggagtgtgggtgtcccgggggcgtgggtgtcccaggagtgtgggtgtcccgggggcgtgggtgtcccgggagtgtgggtgtcccgggggcgtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagtgtgggtgtcccgggggagtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagcgtgggtgtcccgggggcgtgggtgtcccgggagtgtgggtgtcccgggggcgtgggtgtcccgggagtgtgggtgtcccgggggcgtgggtgtcccgggagtgtgggtgtcccgggagtgtgggtgttccggaggcgagggtgtcccgggagtgtgcgtgtcccgggggcgtgggtgtcccgggggcgtgggtgtcccgggggcgtgggtgttccggaggcgagggtatcccagaagtgtgagtgtcccaggggcgtgggtgtcccgggggtgtgggtgtcccgggggcgtgggtgtcccgggagtgtgggtgttccggaggtgagggtgtcccgggagtgtgggtgttccggaggcgagggtgtcccgggagtgtgggtgtcccgggggcgtgggtgtcccgggagtgtgggtgttccggaggtgagggtgtcccgggagtgtgggtgttccggaggcgagggtgtcccgggagtgtgggtgtcccaggggcgtgggtgtcccgggagtgtgggtgttccggaggcgagggtgtcccgggagtgtgggtgttccggaggcgagggtgtcccgggagtgtgggtgtcccgggggcgtgggtgtcccgggggttgtgggtgtcccgggagtgtgggtgttccggaggcgagggtgtcccgggagtgtgggtgttccggaggcgagggtgtcccgggagtgtgggtgtcccgggggtgtgggtgtcccgggggtgtgggtgtcccgggagtgtgggtgtcccgggggagtgggtgtcccgggagtgtgggtgttccggaggcgagggtgtcccaggagcgtgggtgtcccggaggcgagggtgtcccgggagcgtgggtgtcccgggggcgtgggtgtcccgggagtgtgggtgtcccgggggagtgggtgtcccgggagtgtgggtgtcccggaggcgagggtgtcccaggagtgtgggtgtcccgggggcgtgggtgtcccgggagtgtgggtgttccagaggcgagggtatcccagaagtgtgagtgtcccgggggtgtgggtgtcccgggggtcgtgggtgtcccgggagtgtgggtgttccagaggcgagggtgtcccgggagtgtgggtgtcccaggggtgtgggtgtcccgggggcgtgggtgtcccgggagtgtgggtgtcccgggggagtgggtgtcccgggagtgtgggtgttccggaggcgagggtgtcccgggagtgtgggtgttccggaggcgagggtgtcccgggagcgtgggtgtcccgggggcgtgggtgtcccgggagcgtgggtgtcccaggggtgtgggtgtcccgggggcgtgggtgtcccgggagtgtgggtgtcccgggggagtggatgtcccgggagtgtgggtgttccggaggcgagggtgtcccgggagtgtgggtgttccggaggcgagggtgtcccgggagtgtgggtgtcccgggggcgtgggtgtcccgggagtgtgggtgtcccgggggcgtgggtatcccagaagtgtgagtgtcccaggggcgtgggtgtccggggggcgtgggtgtcccgggggtgtgggtgtcccgggggtcgtgggtgtcccgggagcgtgggtgtcggggactgcagggacatgggcctcccctcccactcctgccgcccagggcacctcctgtgaggactcggagtccgtgagttcccacctccttgagcccgattctttggtgtccccgcctgcatcctcagcctccttccaaaccagaccagttctctaggggcgtcgacgtgtgaaactgattttaaagaaaacaggcagtggcctttctctcggccccacgtggcccagtagcgctcaccttccgtcccttcttccgcgctcagtaaccaatttaggccgctcctgcagaactcgggctcctgcccaccggcccacagcgtccacctgaggcctcgtcctcccagcaaaggtcgtccctccggaacgcgcctcctgcggcctctccagagcccctcccgcgcgtcctctcagccccgctcgcctcctcccggggcctccctctcccgcctgcccccaggcccgtctcccctcgcgggctgaggcaggttcgggcagcacggccgccccggggcgggggtcactctccaccaccgcgtggtgcccacagctcacggcgctcccgggtgacggtcccctcggctgtagggcgtcctgaagagcggcctgctcggagctgagcgcacggggttgcctcgccctgggcgtctctggccctcaccagccccgtcttcccatgggcaaaacggcggtcctgtttgtccacaagtaaccgtcggggttacggaggggccaggagctgcggcggggggctgtgctctcaggaccggccccaggaggatccgcgcgaggtctggagctctcaggggtcgcgggggacagaggggccccaagcggaggcggggaaggcggcagaagcccaggaccgccaagagctggcgaggaagcccggggctcgctgtcgggggagccgggcaggggccgcgcctcggaccaggacggaggcctggggaaggcggatctggccgccggagacgcggtgcgggtggagacgagggatttggatttccgcgggcggctgtacggatttccacgcgcggttcacgtgggccccagggggttgcccggcacccggggccgcgccgccttctcctcgccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgacgggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagcggcgcccgcgcggcgctttctgcgggggtcgctttccgcccggggtgactccgctttcctgggcgatgccccccacccccaggcacgcgctctccccgtgcggccgcaccgcgcatgccggttttcacatcagaaaatacgatttgcaaagcacacttagggtgtcccccttaacttcccaagggagtccccccagtccccgaagggtccagggcagcctgcgcatcgcagacgcgcgcggctcgcagaagggacgtggtgagaagctggcccacagcatgccaccagcggcacctcctcagggcacgtgtcggggagaaacaacacttagggacctgggactttctccagctcacgctcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacactcagggcgcacttcacactcacgggtcacctcacacccacaggacacctcacagaggtcacctcacacaggacacctcacactcagggtgcacttcaaacccacaggtcatttcacctcacactcacaggacacctcacacaagataccacacggggcacacttcacactcacaggtcacctcacactcacaggacacctcacagaggtcacctcacacggggcacacttcacactcacaggtcacctcacacccacaggacacctcacagaggtcacctcacacccacaggacacctcacacaggacacctcacagaggtcacctcacacccacaggacacctcacactcataggtcacctcagtcttacaggacaactcacactcacaggtcaccttactctcacaggacacctcacactcacaggtcaccttactctcacaggacacctcactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcacctcacactcacaggacacctcacagaggtcacctcacacccacaggacacctcacagaggtcacctcacacggggcacacttcacactcaggtcacctcacacccacaggacacctcacagaggtcacctcacacccacaggacaactcacagaggtcacctcacacaggacacctcacaaaggtcacctcacacccacaggacacctcacactcataggtcacctcagtcttacaggacaactcacactcacaggtcaccttactctcacaggacacctcacactcacaggtcaccttactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcaccttacactcatctcacactcacaggtcgccacacctcacactcacaggatgcctcacactcacagaaccacatctcatatgcacaagacacctcacactcaggacacctcatgctcaaagaagcctcacactcacaggaggtccagctgtctgaggcaaaggctaacatgaccctttccagacaaattgaggatggtcatgcctagcatttttatacacctagttttgaaagcatttctcatctgttgtattctcacagcaccccgtgagtttaagttcaggtggccaacagtttcttcagcaatcacttttttctgtggagtgcttttgctgtttgtggaatattttgcatctgctactgcaccctctccccgtatgtgtggccaccctgtcagaggtggagctgtggctcagagcctgtgtacctcgtcccaggtccacagctcagcgacagaagagtcagggttgaacctcgggtgttctgacttgggagcaggaaatgtgtggtcacccatagttccagatgtcctggggaggggccaagattagaagaaacctacctcagctccagaggaaagtctggcttcctgagcccaccccgccagacccaggtccaagtcccccaaccccagttcatggtgtgtccagtgcttaccgttgggtgctctggtgaaggtgcatctcacgaggcttgctctcttgttccttcagaagctgttctggatttcttacagtggtgagtggatgatcaccaccagtcctgcctgcaacccttctcagcttactgacaccagcccactccacagatggggaccagtgtgcctcaagtccatgccagaatgggggctcctgcaaggaccagctccagtcctatatctgcttctgcctccctgccttcgagggccggaactgtgagacgcgtaaggccccactttgggtcccatatttgcagagggccctggggagctggtggaggtggcctggccaaccgggctgcagggtgcacaacctggtggggtgtgtaggccgggcattcagggctcagccccagttggaaattggtctaggtgaccttgaaatcccttccagtctgaggtctttgacagggacccaaggttctgattatcagactcagtggccccttgggctcccggccctgggcaattctcagccctcgagatggcccagctgagagtccctgtgtccctgtcccacttccacatcccaccacgcaggaccgcttggtaaacttccccttctctactttccattacaaaggtttgaggggtttgttttttttttaaccatctgaatattaaattatcacaaagtttgaggcccccaacctcccttgggttcagtaattcactagaaggactcatagaatccactgaagtggatacactcacaggtaccgtttattacagcaaaggatgcaggcttaagtctgcagagggaccaggcacaagcttccccttgtcctctccctgtggggtcatgtggacagtccttaattctcccagaatgacgtgtgacgagacgtgggaagtactgccaacttgggaagctctacgagccccggtgtccagaggttttatcagggctcaatcacatagacccagctgaccacccgcatggctgacctcagtctcagcccctccagaggctacgccgatagtgcggcccaaggccccaccatacatcacattgtcagctagaccatccagcatggctcaaggcccaggtaaacaccaacattccctcaggcaagaccttccaagggcttagcggtcatttcccaggagccaaggcaaaggctaccctttctctggcacagcagttcatccttgaccacccaagaccacattcttacactgaatgagctctcctgtgcagcagccattttcttctctaagcagaagagagcccagcaagctggaggaggctgaagagagaggcttcctgctggtcatctgggtccagaatgcctggagatctctgctcagccctggtgcccagcagccctggtgtgcatcctgcagggcaggccttcccgccggagtcctggacttgctcagggccactccccttgcccatgtcaaccaaagtcaggctgccggttctgcttcttctgtctgagcccatgaccagtgctgggactaactgtccccaggcgggctcacggtggtacgaggccagcttggagaactgtctcagctctctggtcctctcgtcagttgggtctctgattggaaagtcccttggacacttttaccatccccattggactttcactttcccccaggctcccatcagctgctcggaagagtggtcaccctggaggccactgcccaccagccaggcaccccccaaatgcaaccgcagccagcactgccagccactggcaaggctgttcagacatgtggctcctctgatccacgccttgtcctttggatcagtccacggagcaggtggtgccaagctcaggctctgtcacccacagctcagtgccaccttccaggcagaacaccactgctgacccagggcatggccaccccgggggctggctctcgctgacccccagaagcccctctcagggtgtccccttcctgtccccagacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacaggtgaccaggcttcatgtcccagtcccagatgacaccagtccctgtcccactacggattatcttactggacaaaagacgggtgggagtggcttcacatctactgagcactaactatgcactgaccaattgtgaggtgggatctgggcaccaagggtggcacaggccagagcgacagtgactaggatgggcaccctgggggcaatccctgaatggcctcaggccccctgccaattctaggcagaccaggggagccaagcaaggcactatctcacgtccaactcccactcgcaggacctccgccagggttcatgaatctacttcggcacagccaatgtctgtactgactgctgcccactctgcattccaaaactcgtaaaggctcctgggaaaatgggatgtttctccaaaccagcctggaacgaatgggctgcacttccaaaagcagggacaccccacacccactgtgtctcaaagaggcggacgtgcccaccctggccacacagcctgggactcagcctgccacctcctcgggcttcctttctggcccaagaccttgattgaagcagatcaaaactaagcatgggatcaaaacaacacagtttgattcatctttaggtagaatttcattcaccttctactaaagtcaaacaacacatcttctccctgaaaagtgagcagagggcggttttaagacgtaagccctctgtttcctccaaaaccagccctgaccattgtctcctcagccagccacttcttcaagggcctctcatggccgggccccaccagtcaggcccagccgaggccctgccttccaccacccctgggccctgggagctcctgctcctgggggcctcccatagcctcggcctcaaggcctctcagaggatgggtgtttctgaatctttcctagtggcacgttcatccctcacaaatctctgcatctttctgacttttgttttacacagttgaatatccatgtggaaaaatacctattctagaaaaaagaaatgccagcaaaccccaaggccgaattgtggggggcaaggtgtgccccaaaggggagtgtccatggcaggtaaggcttcccctggcttcaggattccaagccctgagggtcttgaagccttttgaatgtgaacaacagctctggaagggaaaatgggcaggtcagccccaagcccaccaggctccaagtcagcacacctagcacctccagctcgcggcacccccatgcttttagtggggcaaggaaggagaaaagaaaacgacactcactgagggtctaccctgtgcagagaaccctgcgagatgccccatccgagttgtcacgtcgtcctcacggttactctttgaggtgggatctttgcctgatctttgcaaaatcaggagcattggatcaaagctatgtgaagatcctgtgaggtgaacagtgaaatctcacagcgacatttgtattcttgggccgtgcccaagagcacgtctcggctagagaggggcacagcctcccagagccaggtctgagcagctttgcctgggagggatctgcaaagaccccaggatttcagaaagaaattgtgcaatgccagaggttccttggcatgcccgggagggcgagtcatcagagaaacaatgacagcaatgtgacttccacacctcctgtccccccgcccaggtcctgttgttggtgaatggagctcagttgtgtggggggaccctgatcaacaccatctgggtggtctccgcggcccactgtttcgacaaaatcaagaactggaggaacctgatcgcggtgctgggtgggtaccactctcccctgtccgaccgcggtgctgggtgggtgccactcttccctgtccgaccgcggtgctgggtgggtgccactctcccctgtccgaccgcggtgctgggtgggtgccactctcccctgtccgaccgcggtgctgggtgggtgccactctccgctgtccgaccgcggtgctgggtgggtaccactctcccctgtctgaccgcagctctcaagtgtctcaggggctgtggctctgggcttcgtgctgtcacttccacagacagacagacatccccaaaaggggagcaaccatgctgggcacgactgctgtggccaccgtgctctcagccactttcccatgcccaaataaaacgataaaagactgggggcttctgcccatcctgcctcacttgaccaagagcccagaagaggatgcgacacccagggcctcatgggaccaccggctggcaggggttctgctcactgggtttatgggtgagacgagcactcccaggagggccactgggccgggaagaactgtggagaatcggggcacgccctgtcctcccagctgccagggcacagcatcccttccccacctcaacacccagaccccagattcaccccagttcacttgtccccacacgagccacaggctgccacctggggcaggctggccccaccttggggttagatgcaggtccccttgccccagaaggagactgcagcccctgcagacctagaaatggccacagcccatccccatgcaccagggggtgaggtggcaggtggtggaaagggcctgaggggggcttcttccttccaggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacaca

SEQ ID NO: 638 - DNA, 14895 bp, Homo sapiens; identical to SEQ ID NO: 637

SEQ ID NO: 639 - DNA, 14895 bp, Homo sapiens; identical to SEQ ID NO: 637

SEQ ID NO: 640 - DNA, 14895 bp, Homo sapiens; identical to SEQ ID NO: 637

SEQ ID NO: 641 - DNA, 2679 bp, Homo sapiens
taagaaactgaagcctctacttcggtctcttggtagccttcctcctgggaagctctttcttgaatctagtcaccattccattccaccacgccacatatgtcttctccaggcaacagccaacatctattgtcagccatgtaagtgagtttcagatgactgtggccccggctaatgtttgactgtagcacatgtgagaggccccatgcagaaccacctagaaacatggagagcagtcaccctgcagaaccatgagtaagttaagcttaggggtggttaattacgcagaaataagtaaacagagcactccaccaggtattaaagattattacaaagattatgtaattaaaacaatacagaacagaccagggttgactacaagatcaatgggacagaataaagttacatatccaatgcctgctgctgaccacagggatttgtcacagatctcatcacttagaaaccctacagtggtttccctggtcaccttccagtcaccactacaccttggctccttttagcactcctccctagcttatcactatatgaaattgctttatctctttgtattgtctgtcacctgccaccataatgtgaatttctagacctccatagcatgcaaagctctagaacagttctttgaacacagaaggtgcttgacaaatattttctgaaagaaaaagaagatacttcaatacctcagtttactaaggacgtggggctaccatatggctgcctgaacaaatacagcttgacattcactttcttgctactgattgaagtgtattaacttgtgtaatcacacaactaccctatggggtaggtgcccttatttctccatttggcagagagggactaagtatcttaaccaaggtcacacggctttcaagtgccagagccacgactcagatctacacaggtctggctccagagcccccaatctaacctcttaacctctctgctttactgggctaaaccttcaccacctatcatatggaaaaagaaattcaatagaaagttatatggaaaaaatacaaccctgtgttaatattagaaaatccatagtaacatgtagaatgaggaagcttcctcaagcccaactatacaggtcagatcggttgaaaaaataaaactaacaaatttttacatgtcaaaatatgcaatatttgaaaatccaaggctaatatctttaaataggcaaagatttattaataccccttgacacacaaacaggaagtgagaaaatgggcaactgacacaaatcgataattaactgtgaggacataggtggtggagtctctcctaatcctctattcttggagatctgaatgcctgccattcccgtatgggaagaacagagacggtcatggaaaacagcatttaatctagaaaggaccacaatgaggtcaaagggcggtctcagggcagtcttaagagctccccatccccaaagaactggcaaggactctccaggtgctcgtatgcgactgctgcccaactcccatcacgaactcagaagacctgtcattttctgaaattttcatgacttctaagacactagttattggggaaaacttcaaattatttaaataatgagaggcgaaaaacattgctaaactcatgaatactctgtatttaaaacctccactggcgatcagggcacatagaatctctactactgatccctgacgctggccatcccccaacccgtcggcccacggaccccagccctgaccccacctcctcccagcatcttacacaaggattctcaccacactccccagagactcgcctgcccagggcccctctctaaccccatatagctcaggtctctgatccagagactgcatcaccgacctctccgactacctatttccagattagagtccctgatcccagaggcattgtctaaaataactagctcttacaactacgtccacttcaggaaccgccctgtgatgtcagaactttgaggccgcccggccagggctgcacatgctcagtgaggtcggcgcccgccagtaacaaacatggctccctgaagccgctcaggctcaagagcaacaaggaggtctgcacttaatcgctcctctccgggggcggccataccgaggaggcgtctcttccgtgcaggcaggctctcctggggacctcagagattctctccagcggcagcggaaaacgggcaatgggtggattcgggtccagattctggcaggagggagtttgggatcgagatctggaaaaaagcactagactggaagaggacgcgatggagtcggagccgctggcggggacaaaaaccagaggccggggaaggcgccggtgggaggcaaggcgcgcatagactttacctgcgcacgcgtcgcagccatctccgcccacagtggtggccaccgccactggtgctgaagtgtcggcgtgtgccgggcgctccgctgggacccgggttgctggccctgagtctcagctttctcatctgtacggttgggacaagtacagtaaccctcgcccgtcaagacgggccagggctgtggcgagggtccacgccttagagcaggcacctatcttgtgcagggccctgagatggggtctgactcagttcctgcggggaacttcaccagtgacccagtcagtgcccttcagttaaagactaccaggggcacacttgtaattaaatat

SEQ ID NO: 642 - DNA, 20714 bp, Homo sapiens
gtcatttattcaaaatatgaaattttattataattgatgtttaatgcaattcactttacgaaggtttttgtggttttccctaaaatttctgttttaatgaaggctcctgatcatcctggatgtcaacaagttttcttcttcatgtgacgtctctgatgcacaataaactgattagtttttctaaaactgattatattcatagggtttcatctcactctaacataaagtttaagctaaactacgtccatttaactaataagccaaatttgtaagagcttaacagactataaacttaactcttgctttaaagcaacaaaaacaaaaccctgatgaagacctggaagtgaattgttcgtttttcagactctagcttccttgaccttgtgctttatggttttgaacacacaggacccaagtttgctgcagaaataacctccaaatccatattatgaaccaggaagactgtgagggtttttcttttttttttttaagggccaagagtaaatgtaatatatatcattagcaccatatcccatggtcagccccacctgaataaacggcatattgggatttttccacaaactatgagcctaatgaaaaaggaaatggataagggaaacaagttcccagcctatgtcacatgagtttctgcactacgtgttatgtggtaaggtatgcattccctcaggacttcccaaatccattacatgctagggttttctctctggtatgcattctggtgtgatgtaccctaagagctgccttacggacaaaagttttcccacattcatcacattcatagggtttctcccctgtgtgaattctctggtgtactctgagagttgaattttgggcaaaagctttcccgcattcattacactcatagggtttctcccctgtgtgaattctctggtgtgcactaaggtgtgatttctgggagaacgttttcccacaatcattacattcataggatttctcccctgtgtgaattctttgatgtactctgagggttgaattatgggcaaatggcttcccacatacattacattcatagggtttctcccccgtatgaactctctgatgtgcactaacatatgacttctcagagaaggttttcccacattcactgcattcatagggcttctcccctgagcgagttctaagatgtgctctgagatgtgatgtcttggagaaagtcttcccacagtcattacattcatagggtttctcccctgtgtgaattctgtgatgtgccctgagggctgaattatcagcaaacgttttcccacattcattacactcatagggtttttccccagtatgaattctctgatgtgcacagaggtgtgttctttgggagaaagttttcccacattcgttacattcatagggtttctcccctgtgtgaattctttgatgcactatgagggctgccttatagacaaaagttttcccacatacgttacattcatacggtttttcccctgtgtgaattctctcatgtccactgaggtatgatttctgggagaaagttttcccacacttgctacattcatagggtttctcccctgtgtgaattctccgatgtgtactgaggcgtgtcttctggaaaaaagtttttccacattcactacattcatagagtttctcccctgtgtggatattctgatgtgctctaagggctgaattatgggcaaatgttttctcacattcattacatttatagggtttctcccccgtgtgaattctctgatgtattttgagggctgaattatgggcaaaagttttctcacagtcactacattcatagggttttctacctgtgtgaattctctgatgtgctctcagggctgaattgtaggtgaaagatctcccacattcattacattcatagggtttctcccttgtgtgaattctttgatgtgccttgagaacagaaatatgggcaaaagaccttccacattcattacattcataaggtttctcccccgtgtgaattctatgatgtgctctgagggctgaattatgggcaaaagttttctcacagtcactgcattcatagggcttctcacctgtgtgaattctttgatgtgctctcagggctgagttataggtaaaagatttcccacagtcattacattcatagggtttctcccctgtgtgaactctctgatgtacactgaggtgtgtcttgtgagagaaagttttctcacattcaacacattcatagggtttttcacctgtgtgaattctctgatgtgctctgagatgtgatgtcttggagaaagttttcccacattcaatacattcatagggtttctcccccatgagaattctctgatgtcctttgagatgtgatgtcttcccatattcactgccaccacagagttccatctctgcatctgttttctggtgtcctatgaggggtgacttgtaagatctcccacagccattgttatcacaaggtttctcttttgtgtgaattctcagatgtttactgaggtttgaattctgacagaaagctttcccacattcattacattcataaagtttgaatcccacataagttccaggatgctgaataggatgtgaacttgaacaaaaggattttgcacattcctcatattggtaagttttctctcctgagtggggcctctcatgctgaatgaggtgtgctttccagtaaaaggattttctgcatttcccatgttcatcagaaaggtagaatttctgatgtgctgtaaagtctgtgtgaattctctgatgtgctgtaaagtctaatttctggtagagggcatctgtacattcattatgttcaccaaatttatctccagcttgtgttttctgatgtactatatgggctgagctctggctaaaattttcttcacatttattgctttcaaaagcactccatcctgtaatagttctctgagattgagtgaggggtgacttcctactgaaattaatccccctttcattacactcatagtgtgtcatagccatgtgaactttattgtattcaacagcggtggttttgtcacaggatgtcccatattcattaagatcagagcatttcccccttttgtcagttctcatgtggttaaataaagtggttttatcaaagtttttttctaaattcatcatccttacaggacttttctcctgttagaaaactctgaggtgtaatacaaattgtcttatcatataaaccttgtccagatccatcacattcaaaagattcctccaaagtttgaaatttccaatgctgacctttcttataactgaaagctttagcattttcaccatgttcataagatttctcttcagcatgagctttctcatgcttaatatcaagctgcagtttctcacacacattcatgtattcagtcttctttcttgaatattttctttcacttataattaattgagaagcaactggcaaattcattctgtgtgagtcacatttacaggatattttttctgaaagctctggagctatttccagattaaatagtttttctaaaactttctgtccttctttactcaatgttttgtcagcatcactgatgaatatttcttgccacagaggtttttcttgtttttcccggatccctttgatgtgatcaactttaaaatatcctaaaatgagaaaaattgaaaatatagtataaatcttacatttctcatggagaagaacttatactcatattttggttttggttttggtttttgaaatagggtattgctctgtcacccaggctggagtgcagtggcatgatcatagctcactgcagccttgaactcctaggctcaagtgatcctcccacttcagcctccctactagatgggactacagggatatgccaccatgtcctgttaattttttttatatttagtggagagagggtcttgctacattgcccaggctgatcttaaactcctgagctcaagcgatcctcctgccttgacctcccaaagtgctgggattacaggcatgagccactgtgcccggcccctgttttgttatgtattttattctattgtttctggtcatgtttccaaatattaaatacttcatgcacacagacagattctctcctcatccatgctgtttataaaacaggtattatttccggggccagtcaaggtggagtagtaacccctttcttcccacatcttccctcttacaattaaaaatccctagagaaaaaacaaaacaacaaaaaaagattaacaaatatacaaatatacgaatactacaaaatggaaagaaagtggacttcaggacttaagaaatgacacagtatggaattccaaggctattctatatcctagactgggtgctgaagaaacctacaatcctgcactgacaggcacagacaaaaagagcacaaagaaaagcctgcttcttccagccagaggtctgagaaaatggtggtctaacagaacaggaaacacttttgatgttttctcatgctcaggccaaaccaaaatgatacaatcctgtggttccatggaggctgagcagggagctaatgttccctgccgtagatacacaggatctgcatgctcttatatgttttcttccatgagccatgaagaatcctgagaaagttccattcttaggatatgctgggagacggtcacagcagccactaccaaaattctgcctagaaccaaattattatctaatttatggaacaaatgtcttaatctgcaagggcaagaatatagtaagttgttttagggcactgacaggaactcatagcagctatgggaaggaaacaagaaaaaaagaagcacagaagtaagaggagaggcaggaatacacagtagacccaatactcaagcagaagagataagataaagtagcacttgcaataaccatggcttcaaacctgaagacacaatgcattcaacagctgaattcacattcttctgaaatgcacatggaacaatcatcaaaacagactatattctagactgtaagacaaaccttcagaaatatagaagaaataaattatacagaggatgatcttgggccacagagaaattataccagaaatcagtaaacacaaatttatctggagaaatacaaaagaactgtaagttatacattcctaattaacccatgggtgaaagaattctcaaatgagatattttgaagtgaatgtaaacaaaacaacttagaatacagaaatttgtggatgcagctaaggcagtacacatagataaatttggggcttaaatttttttggccagatgcggtggctcacgcctgtaatcccatcactttgagaggctgaggtgtgtggatcacaaggtcaggagtttgagaccagcctgaccaacatggtgaaaccccttctctactaaaaatacaaaagttagccgagtgtggtggtgcacacctgtaatcccagctactcaggaggctggggcaggagaattgcttgaactcgggatgtggaggtgcagtgagccacggtactccagcctgggtgacagagtgagactctgtctttaaaaaaattatatttgaaaagaaagatctccagtcagatgcttgtttcccccttaggaaactagataaagacaggacattaagttgaaagaaagtagaaggatgacaaaaaagtcaaaccaaaagcttaattttttaaaaagtttttttaatgataaaaaccatcagagagaaaaaaagagaagacacaaattaccaataccaaaaattcaagagaggactaactactaacagacattcaagagataataaaacaacattaacaataactctgtcttagttcgggctactacaacaaattaccatagactaaatggcttaaagaataaacatttatttttcccagtgcaggagactggaagtctgagattagggtgccaacatgactgtgttcttgtgaagacctcttctggtttacagaccactcacttcttgttatatccttacatggtgaaaagtgaagtagctagctctgacaccgttttgtaacagcattctagtctctctctctttttttttttttaactataaaagcaaactaactttatttggacaatctaagtggaaagaagaggcaggtgaatgtgtattgtaaccacagggaatatattctatgtcaaatgttaaaacataatggcagaataatctaaaagacatttttttctaaaggagctgtcggtgaaaaggatatttacgacaacatattaacttacttcattatgatggaggatatgttaactgaatgtctaatttactcaaattttaactatgtttgcatatgtaaataaggcttaagaatgtaatgaaatcttcctctatatatgtgtatgtgtgtgtgtgtgtgtgtgtgtgtgcaattccaaagaacaacttctggaccaaatagttttaactagtaaattttaccaaacatccaaggaagaaataataccaatcctacacaatgtcttctagaaaataaaagatggaatatttcccaaatcattttataaggcctgcctcatcctcatagcaagattaggcaaatactattcaagaaaagaaactttcagaccaatatctcccataacataaatgcaaaaatgtcccaaaaagtacaccgaaatatataaacatagataatgtatcagtgaaatttacctcaaaaatgccaaacagttactacactgcaatactataaaaactatagtttttatgctgcatttcaggtcaatgtaatctcctatcattagtctgaagaactaaaatcacacactacatcaatgccaaaaattttaacaaaattcaaaatccatttgttaatttaataaaagtaatctataaaaagcctatcactaacattatactcaagagagactgaatgtcttccctctaagatcaggaaaaagacaaagatgcccactaccagtagctttacacaagattgcactggaaggaccagccagtgcaaaaaggtaagaataaaaacacaaagatacagagtaaatttacacagaaaatttaaaatcaaaaaagttccttgaactaataagtgtttttagcaagggcagaatctaaggccaatatacaaatctatgcctacaaacatacaatgatgaattggaattttaaatcacagaaacaatattacagcaccaaaacaaaattaaaaacaaaaattaaaaaagcctcgttatctgtgttctaaaaactaaaagacattgatgaaagaaatcaaagaaacagtaaataaatcagtagggatattttgtgtatggactggaagactgtacattgttaagatgtcaattctcctaagttctgcagattcaatgccactccagtttaaatgccaacatgtttcctttgtaaagattatgaacctcatttaaaaatttatacacaagatgaaaactggagaagtacttgacttcaaaacttaataagctagagtaatcaagttaatgtggtattggcataaggaaagacatgtagatgaatgaaaaggaatataaactacaaaaatagacccccaaatgtacagccatctgttttctaagaaaggtggaaatgctgttcagtggagaagtaacagtcttttcaaaaagtgatgctggaataactggactccctgttccaaaaacatttaacttgacacataactcatactttctatagaatttaacacaaaatggattatcaactaagtgtaaaaactgaagctgtaaaatttctagaagaaaataggattcctaaatctgttactttgagtttcaaggtttctagatagaacaacaaaagcaggttctgtaaaagaaaacaagtaagttggactttatcaaaattaatattcagttttagtgagcctcctctaaagttatactagcgggagtgaggtgcagcatcactgcctgctacgtggggaaggaagtccagttccccactgatctgacgccctgggggtggaagaggaggcttctactttttttttttttttccttccttttgagacagtttctctcgtcgcccaggctggaatggagtggcgcaatcttggctcactgcaacctctgcctcccgagttcaagcgattctcctgcctcagcctcctgagtagctgggattacaggcacctgccaccacgcctggctaatttttgtacttttagtagagacggggttttgcaacgttggtcaggctggtctcgaactcctgacctcaggtgatccacccgccttggcctcccaaaatgctaggattacaggtgtgagccaccgtgcctagctgaggcttctacattaaccctgggcatgggtgaaagatcaggagccccacaaggactctgataacactaaccaccttgtattttgtcaggtgccaagacccctagtgcatcttcattcttctttccacccttcagtagtgtgatctcagctcaccataacctccacctcccagattcaagcaattctcgtgcctcagtctcccaagcagctgggattacaggcacgagccaccatgattggctaatttttttgtatttttagtagagacagggttttgccatgttggctaggctcgttaaactcctggcctcaagtggtctgcctgcctcggcctcccaaggttctgagattacaagtgtgagccactgtgcctggctagatattgcattctttacaaactgaaggtttgtggcaaacctgagttgggcaagtctgttggtgccatttttccaacagcaagtgctcactttgtgtttgactcagcagtttttagcaaacaaatattttaattaaggcatgcatactgttttttagacatgttattgcacatctaaaagactaaagtatagtgtaaacataaaacttttataagccctaggaaaacaaacattgtgtgtaacttgctttattgtgaaatttgcttcattgtagtggtctggaacagaaactgcaatatctctgaggcatgcttctatatacagatatttagctgcacttagtgggtagagtagaaaggaatacatttactccatccttcccctgggtaatgcattctgtattttattaaatccttccctaagaagagtcattaacctattctatatgatcttctagaatatttctacttttgttttgataattaggtcttaagccaactgaattcgactttttgttttgttttgatctatatggatacctcaagatcctttcctcattgttctccagtgtcatctatctaagatgtctatcaagtatatgttttttcttttctctttttttttttttttttttttgagatggggtcttgctctgtcgcccaggctggagtgcagtggtgcaatctcggctcaatgcaagctctgcctcctgggttcacgccattctcctgcctcagcttcccaagtagctgggactacaggcacctgccatcacgcctggctgatttttttgtattttcagtagagacgggtctccatctcctgaccttgtgatccacccaccttggcctcccaaagtgctgggattacaggcatgagccaccacgcctggcctcatgtttttttctttaactttctactctgtttcactaatttactaaatcatcccaccccccagctccatgctacttagctacacagcactttacataaagcctcaatatctggtagagcagcaaatcctcctgtatcactcgtttttatgaatgggattgtgtttggtatagcgttacctctttacagatgtatcctgacttgaatttattatataggtgtttcctctcttttttctttgatagagttagctgaagtttaattcattttatttttcttgtaagaaacattccatttctgttttccattttatttttaattttacttttaaattcttctgttttcactattgtatttttgatgctgttcttgcttaattaatgagactacgaacttccttctgtccactactttagctatacctgatggtttctaacttgcagttacaattatttcattacagaaatcaaatccaaaattgcattacacttttttgtatattgtttaaaagagatactaaaattttttcaagtggatttttttcattttattattaatttctagatttatcaaactaggttcagagaatactgtttgtgtttattctaatttgttagatttattgaggttttctctttagactaatagtatactctattttatcattattcaattaaaacatgaaagttttgttttttgcattagcatacatatacacaaatgtatggttcactttaatacaaatgtaatttatagcctctctaggcatatttatttaatgtccactgtacctactgtttaatcagatgagacattatgatgtcctaattctaatgagttttaagttcttagaactccattattttatgttttagaaacattgatattatattatttggtgcactcattcaaatccttaaaggttttcatttccctgtgctcttgaatgagagcttttcctactttaatgaatttcttgcctgaattcaaatctgaatgatatagaacatgaaacctacattattttatctttattgactcaacaactttactgattttttttttttttttaattttttgggactgagtctcgctcttttgcccaggccggagtgcagtggtgctatctcggctcactgcaagctctgcctcctgggttcacaccattctcctgcctcagcctcccaagtagctgagactacaggcgcctggctaattttctgtatttttagtagagacagggtttcaccgtgttagccaggatggtctccatctcctgacctcgtgatccgtctgccttggcctcccaaagtgctgggattacaggcatgagccaccacgcctggcccaactttactgatcttttataatgatctttctatgttacttatttagggatatcctttttagacaatcaatatgatccaataatttacatttagtgactcagcaacatacttgatctaaattatgtcactctttatgtgatgctatttgttggtatggcttcaaacaaaaaccttaattgtgcttcacttctaataagatgattttacctttttattctaaaaatgacattgaaaactataactttttaagatttctggaatcatttatttgtacaaagcctaataggcatataaaaagatgcctgatatcattagtgaccagggaaattgttatagacttatttgtgtccttcccaaattcttatcttgaagccctaacccccagtgtaactgtatttgcagacaaggccttcaaggaggcaaaaagggtaaaaatgaggtcacaggaaaggaccctaatccagtagtactgatatctttataagaagcggaagaaacaccagagtattctctctctcccactgcatgtgcacagaggaaaggccacatgaacacacagcaagaaagtggctgtcttcaagccaggaagagacgcttcaccagaaaccaacttattagtactttcattttggactcccagcctccagaatcatgagaatttctgttgtttaaactacccagcctatggtattttattatgatagccctagctgactaatacagaaatgtacatcaaaaccacagtgagatatcagttcacatccactggggtggctagaatcaaaaagtcaaacaataacaagcattggtgaggatgtggagaaatcagaacccccatatgctgttgttaggaacagaaaaatgctgcatttagaaaaaccgtctggtggttcctcaaacagataaagacacagataccatatgacccagcagtttcactcctaggaatatacacaagagaaataaaaccaattgtccatgcagaaacctgtaaataaatgtttatattagcattatttgtaggtggaatcccaaatatctactgactgataaatggacaaacaggtggtacatccatacaacgggacattatttggccataaaaagaatgaaacatgtattttatatcagttgtaaacattatgctaggcaaaataaaccaatcacaaaagaccacatatatgatccaatttatacaaaatgtctaaaataggcatatttatagacacagaagtagactgtggttacctagggctgcagagggcaggggggatgggacagtgataactaaagggtacacgtatgtttgaggtgatgaaaattaactgtggtgatgtctgcatatacagtcatcccctggtatccatggggaattggttccaggattctcttaaataccaaaatccacaaatgcccaagtccttgatacaaaatggcatagtatttgcatataacctatgcacatcctcttgcatactttaaatcatcaccatattaattatgctacctaatacaatgtaaatgccatgtacatagttgttatactatattgttcagggaatagtgacaggaaaaaaatgtctatacatggtgaatgaaagtgcaatatttcttccctgaatagttttgatctgtggttgcttgaagtcactgacctgtacactttaaaggagtgaattgtaggcatgtgaattatatctcaataaagctgttccaaaaaaactttcaaaggtgctctccctctaaagactaagtacccccaggtacttctgttaatgcccactcacctgggtacctctggttcaggaattcatcttctaaagaccatggctcttctcctttctccaacttggagatcaccttgggtttagtaatgcaatatcctgtaaacaaaataattgacatggaccagattcacaggcttttggatttccaaagggaaaaaaaagatatggcagcaaagcattaactgagggtgttcatttgaaatttttaatgggaaagtaatgacatgttgcttttgtttctgtaaaggtttcaactacttcagaccttttaatccaaagccctttaatctctataaagggtccatgtgttttgatagtttttaaaaagggacatgtattctcgagagagccccatggtaagctatgctcacccactgagacgaggtggctgtagttctccagcatcacatctctgtacagcgtcctctcgacagggcccaggtgctgccactcctcccgggtgaattccacagtcacgtcctggaatgacactgatgcctgtaacaacatttatcacaacaaatataacaacggtttgttcaagggttcagaattgggtgacacagaaaatatctttgagagctactactaaaatgaatggttataaaggcctattttagacccaaaattgtcttaacatatgtaactcaaaacattttttaacttgccataatttctctatgtatttatgaattctaggtttttgtaagacaaaaaaaaatcaatgtaaaacaacttccttccaaccacctccttccttcttccacatctccgcaaattatccggggtagtctctaggacattcacaccctccctggacatcatcactgtaaattctgggggctaaggaagagatatatgtgaagtctggagataccctgaccaaactttatatagggtagagcaggtgaagagcagagaacagctacaatagttgtaaccaaagagactggcacaaaagaacactttctacactgaggtcacagcaatggatgtaagaatagggatataatcacagaagagaagcaacacccatttaatacaatactttattgtacagctactcaatctagctgtatgagaagctccttttaaaaaaattttgtttttaattgacagaaagacaaatatttcaaattatagtcacttatatgtggaacctaagaagttcaaactcatagatgtagacagtagaatggtggttaccagaggctgggggtgaggggtgaggaatggggaagcattggtccaagggcacagagtttcagttacataagaggaatagtttttgagctattgcacaggatgatgactagagtgaaaaataaagtaatgtatatttcaaaataagcagctgcttggtggtgccaaaactggtatctgggaaagaagaaaacgtgttagaagattcagtgagagttctgttcatgttgatacgtagctagaactgttcgttcaaccaggatacatatgattttagaacacagaaggtaagatggggatgaagataagcatttaggatttactagcaatttaggtggtgagtaaaattagcagagacagacagctccttgagcacacagggattgaagaaagaaaagaaccaaaaacaacacctgaggaaccacaaagcagaaaaagtacaggccacaaagccagagatgttttccaaaaaataataacagaatcaggagggggcagagtcttagaaattgagaaaagagaaagtttccacaacaagaagacttcaaattcaaattagcaagtgatgacggtgaagatactgaagatccaagaaaattccttcttccataaaagcaacgagaaaccggcaaaaactgcagaatcaactttttcagaactctagaagctaccaaaggcttacagcaatctgcggaacattgatatgagaaaaacagctgcatcacagtaagaacaatgatcttgtgtcatttcaacctgccctatatccatccctctcactcccactcggcattagctttgagaaacatctgaaacaacaggagaatccagcggcctggtatccactggatgaggcagactgggtcacaggttggccaaagcctcactcccagaaaaccctcattatctgacctaatctgtggttccctggaagagctgacttgaaaggctgattgaattaagtcagagttccccagtgtgaaaagccttattcttgaaggcatttgccaaaaacattcaaaggcaattgtttaactcagcagctaactgaggcggtggataacacctgacataaataacagcctaattgaaaagctttttagaaaggaaaaactggagaatgggatgttcataaagcttttgaaaagctcctatagattctagagactctaggtcacctacatgcatagagctgagcatatgcccagggctgtgattatgctctggaaagatgtgagaaggccctaaactgtcaccctgggtgaccctagggtttggggtgaactggaagtgaaggaagtgaaggttaacatggggttataaattgcctggatgtctgttgaaggaatgccccagcactcatgaggctctttggcaaagactgagagccttacttaaggtttcaggcatttaagaaaatttctgcagacttctgcggccacacatgacaataaacacaggctctactgaatcaattaaaaagtcactagacaaatttcaacaacaactcctgcaaatcaagaaagttttctagagttgccaccgtatttaaaatgtatagttttcaacaaaaaatgcaaaacaagaaaagaaacaacaagtaagacccatatgcaggaaaaaagtacaatcaatagaaactactcacgaggaagcaggcattggacttaaacagacgatgactttaaatcaactatgttacatatggtcaaagacttagaggaaatgatatgtaaggaccaaaggaaagtattagaataatatctcaccagataaaggatataaatagacagaaactataaaaagggaccaaatagaaactctaaagttggaaagtacaaaactaaaacaaatattttaccaaaaacacctgttcaacagcaggtctgaacgggtagaatgaagcaactggacaacatgcccactgagattatgcagtgagaaacagaaggaaaaataacaagaaatgaacagttggacagcatcaagcttatcaacatatgccaaatagactaacagaatggagacagaaagggtctaaaacaatatcagaagtagtaatggccaaaaaaccccacaaatctgaaataaatgataaatctacatgcccaaaatgcttcacaaactttaagtaggataaacttggagaaagaaatccacactcgctgggagcagtggctcacacctgtaatctcaacactttaggaggtaggcagatcacttgaggccaagagttcaagatcagcctggccaacatggtaaaaccccatctctactaaaaatactaaaattaaccagacatggtggtgaatgtctggaatcccagctacttaggaggctgaggcacaaggattgcttgaacccagaaggtggaggttacaatgagccgagatcatgccactgcactccagcctgggtgacagagcgagagactgtctctcaaaaaaaaaaaaaaaaaaaaaagaaagaaagaaaagaaaaagagaaaagaaaaaagaaaagagaaatccacacctggacatgagaatcagagtgttaaaaagacagacaatcggaaagctgtaacagagaaacaagtcatcgtattacaggctgatttataatgagaaactatggaggacagagggcaatgggatgacatattcaaagtgctgaaacaaagactgtcaaccaataacctctatatccaggaaaaatagagaaactggaattttcccaggtaaacaaaacctgagagaattcatcacaggcaagactgcctataagaaataataaagggagtggttcagcaaaactatggagatagaggagtaggttagtggttgtttggggctcagagggaatcaaatggtagttacagtgtacacagcttctttctaagggaataaaaatgttctaaaattgactgcagtgatattagcacattatctgagaatgtactaaaaaaaatcactgaattctacactttaaatgggtacatggtaagatacatgaattgaatctcaaaaaaaagcagttttaaaaaaagaaaaaaacaagggaagacaaaatcatttggagacaacagagaagactaaagagccaaggacagaaactgaggctgagccgagtgacaggacaaggaaggtggctccatgaagacatcagccggggaaggaccagtgaggggcaagtatcactaacggaaatgttccaggacagagtgagacattgaggcaagtgctgcggaaaagccaagcaagttaaggaaaagaccacgtccactggatttgattatactatgggtagggacactggaggtcccaggcaagtggcaagaaaaaatcaaggcatcccatggagagttgacgttaaatgctaagtgtggaaatatctgaaagagaacaattttggaccatctgctgagcaacctgaatatcatgggtactcaaaatatttatggagagtgattttaaagatattcagttgattcatcagaaaaatgttaaattcaacccttgcactggagtacttgaaaaatagtactgaacgtgttcaaatttagcattacaatttctacttctattgaagaagtaatattctgttatttggcaatttattaactaagtcacctacttgaagaacaataaatacattttgttatctttatgtttatattccatgataaatcagttggctttatctttctcatcaatgtaaacctttaagtattgtctgtctgacactccaccatgactgtcaataacctcagaaataaatctgaagcttaatttggtaaatttgtaacatcggaggatctgcatctatccacatgccactttgctctgctattcatctgcatttctacatcttctaggaatgtgtctgatccatctctatttctacttttccatgttaatgtacggacacataaacccttacaaaacctattgtaaaataaaccggtttttaaaaacctaactcacctgagacatgttcattttctgctgctcctggaagagtgtagaggactgtggaggttcagctggggaggaggaaagagcagtggggtcatgagagacctggtctgcctctcagttcttacagagatggtccctgacatgagatggttcgacttgataatggttttactgcgacataaccccactgtaatcaaggagcatgtaatcctattcatgtgcctaaaaaaaaaatcatcgcactcagctggagaaaaggattcccaatgcagaatgtccctttgattcttgaaaaggggcaagaaagaccactcaaagatagccacacctgaatatgtgcatctctgatacgattatgtgcgcttaaacttacattttcactgagtaaagtaatactgttttttgttgatttactaataattatgttgatttattaacaattatgttcccttttgactaagaaaaaagtaaaaataaaacaaaggattaagcaagttcaggtacacagagatgaagctgtttaccttcattaaagctaatgtcaaagaactattcagccgggtgtggtggatcatgcctgtaatcccagcagtttgggaggccgaggggggtgaactgctggaggccaagagttcaagaccagcctggtcaacatggcgaaatcctgtctctactaaaaatagaaaaaaatataaaataaataaattttaaaataatttttttaaaaaagaactactcaggctgacttaatcaagttcttactgcctttacacccagaattagcacttccacggaaaaaataaagataggatgttttatgcaaggaatttcaggcccaatatttttgggcttccaatataggaaattcttcctctactacccggaaagaggcagcattagtatcactctaaatgccacatgtggtgatgaacacggtgtgagagggactcacaatgtggaagaagtgaaggcagaaaggaaactaggctgccgtttgggatctggacagctgattacatcttccctggatatcatgacctaaccagccctccagtaaagtgtctttttccacccagcttgatagtcactcatccctctcaacccctgggaattgccttctgcaagttagtccacagcaaagtcacacggtctgtgatggcttctggatgtggcaacatcacgaaatctgatgcatatataaggagtcaacaactgcctctggggaagcaatcaggacctgctcctttctagaatcttctgcctctgctctgacgctctagaagaggtctccgtcatatgggctgttcttctatggcagtaggccctaggactccctcttgactgcctcataggagctgctttgctccagaggggctgggacttaggcctgagaaacaaactcaattgaaaccttcacctaataccctaaacctgactcttgagattcactagaaatgtgctatccagcactgcagccatcagccacatagaaccattgaacacctgaagtttggccagtgctacaagtcgaatatttaggaagtaaaataaagcagtaaaactgactttgtctgcctcttctttttactgtagctactgaaaaattctaaacttttttttcttttttgagacagagtctcactctgtcactcaggctggagtgcagtggtgcaatctcggctcactgcagcctccgcctcgggttcgagcgattctcctgcctcagcctcccaagtagctgggattacaggagtgcaccaccacgcccggctaatttttttatttttgtagagatgggcttttgccatgatggccaggctggtctcgaactcctggcctcaagtgatccactggcctaggcctcccaaagtgctgggattacaggcatgagccaccgcgcctggccaaaaattctgatttatatttgtgttttgccttatctttctattggacagcacagcaccagaatatcaatctgtgcctttgaggagacagcgggaacagtacaagaggattcaggagcctcagcctgaatcagagacccgacaaatcgcagaatgtatctaccacttggtgagattctgtccacatttacttcacaatcatctacacagatctggtgacaggccactctgcataagcgctctgaaggctttaggcaggtactggcaagtctgggtttcaggcagacagcatgttagaacgagcaggacagggagtcctgcatttgcatctctcagcatttgcatctcacctctctcacctactagtgtgtgccctggggtacccatccccatgaactttcgtccatttttttaaaatggcacgtttataccaaagaggtcgttgtgagggtcaggtgaaataccaaacgatgagaataagtgtctcataattgtgagagcagcttacatttcacatagtgactattacagacacttaacaaaatgctttacaggtgacaacttatttaattttcagaataggaacacgagttgctagtaacctcctcctgttcgccgtcaacctcatccacgcacattcctcttcccggcccgcaaccccgcggggcccggcagcccctacacctgcggacaggactcggcctgggcccgcgcactgggccggggaggagaggggagggccatcctggggactcctgagactgcctgctgctgtcctccgcacacaagcccgcccgtccccaggttcctgggccgcgcggagccctgtcaccgacgctctcaccccaggtgcgcagcctgggctcccgcgcagacctaaagactcggacaccgtgtccctttcaggcccgggagggcagacggcaggaggtggggctgggtttacacatgc

SEQ ID NO: 643 - DNA, 215538 bp, Homo sapiens
cttcagttaagctatttttttaataaattgaaaagatgttctgtacaacataatagagtcataggaaatcaaaagcatatcagtaacaacttttagaaaaagaaatgaatgataaagaaaaacagatatgacctctcaatatcttggggaagtaagttaggatgatgtttcattcacgtcttaatgatataaataaaggataactctgtgtaagaagtattgtttgtatctggtggtaaatttagttaaaaacataatcacaagttacaaaaactgtaattacaaattacaaagaaaaacaggcagacaatcttgtattgacatcctcttgcatcttgttacctaccaatgttctgttccattataaaattcaatactaaaatttcatagctaacattcaatattaatttcaacattaaaatgtatcaaaatcattaaaaacagtcaattagaaaaagcaatacaccaaaaataatggtagtgtttccaggcttcaactgtgttgtattaaccatcacacaggagaataaaagggctgtgaattttagataggccacttggctctggattccaggactatggaaatgccagtgaaggtagtccaagaagcatttcttgttttataaatatcagcagaggaccaaaaaaagggatcccagatatgttttcaagtaacaaaaaacattaaagtgcaattttgtcttttacatctgaacaaaagttctgtcatttttaaaaaataaagtagggccacagctttatagccattttctcatctaaaaccccacaattattaacacagatcaaactgcagttttggaagagagcctttggacggggaaactactgaacagtgatgaatggccatacctaattcattgtttggaaattgatgtggaggactgtgtttcaccgagggagaaagggacctcccagaggctccgaggctgcaggtcttcagccaggtgacagcactgcacctgcttgtgtgcaccctgatggcaacagcagggaagtccacagtcacgatgatagagacagccacagctgccaatcagaagactcgctctttctggttttcatggactgcgttttgcacatcgagctcactgtttagagctgtcctagcactcttctttttttgagacttttgactcattttctttgcgtaactttctctgttgatagatgcgtatggctatggcagtgatgcaaagcaaaataaatatcaccactgctatcacacctagggagagaaaagaataaaacatcataattttttttcttttttctttttagagagagggtctcactctgtcgcccacgctggagtgcagtggcatgatcacagctaactgtagccttgatcctcccaagtagctgagactataggcccactccaccgttcagcttatttttttttttctttttacaattattctttgtagagatggggtgttgctgtgttgcccaggctggtctcgaactcctgggctaaagtgatcctctcaccttggtctcccaaattgttgggattacaggtgtgagttaccgtgcctggcctcaatgtcagagtataaatggtgacttttggtccaatcagaggctttgcagacatcattgctttttaagtttggttaaaataaaccaaacacctattatattataaattgaaaacaccaaaactcagaaatgctgaggtcaagtaattttataacatttaacatacttctgacggactatgacttttggatatggctgtgttaggctttttccctacaggtatatgatgattgggttttagataatgctttcagatttaaaagaatagagacatacatgtctctaagaccgcgtacatccttcagttaacaagtgggaaatgttaaatcattttacaagtatagagtgtttgcatcatcatagatcattacatgttattgttagtacaatgaaatggatacattttaatgaaattgttttcaaatacttttatgataatacacttttcttttttttctgagacggagtcttgctctgtcgcccagtctggagtgcagtggcgcgatctcggctcactgcaagctccgcctcccaggttcacgccattctcctgcctcaggctcctgagtagctgggactacaggcacccgccaccgcgcccggctaactttttgcatttttagtagagacggggtttcaccgtgttagctaggatggtctcgatctcctgacctcatgatccgtccgcctcggcctcccaaagtgctgggattacaggcgtgagccaccgcgcccggccgataatatacttctcaaacgcagtagtgtcttatatatgtaatcaatccctattaccaaaaatattgcaggcatatttattcattttttttttacctggaatgtggattatttgaaagacctgggcaaaatgttttaaaatattgaaaccattagcagtgtccatgattctcgactctagctgcacactaagtcagtaaatcagaataaatgaatggaaggcctggataccagtatctttataaattgtttcaggctttaattcagagccagagtgctaaagcatgaagccatgccacagaatgctgtgtactgaagcaatcatattagtgacaaatgaaagtaaaatctaccctaaaagaaataaatgtgtataaagacaagcttctgaaggtaatcagaatatgtcacccccaaatatgcctttttgacaaatattttgaagtaaaggcaattaagaagcagccaatggaggaagagctctctagatcctcccctcttttcatctaaagacaggatgtaaattctcttttaccggagaccattcttaccagctcagggatgtcagcagaagaatgtacaaacacacgtattccactagtttcttcccatatatttatcttcccacggtttcttgccttcggacacctaaaattgctttccattgtcctgtcatttctccacaaatgtattgttgaagatgagccagacttctaagccactgcgctttgagtttcactgaggtttctcccacgtgctgtgggctgcatgccttagtaaacttgcttgtttttctcttgttaatcagaggtctgtcccaactacaaagttaggaatgatgaggagaaattatatttcctcccccacgcttttactgcctacatcgtacatttaaagtacttcacacaaatattaatttatatcttcagccagtccctattagaaaatgcaaactgcctctgggaaagcccaggggaagccttccacagactccttttcatcccctcgttcaggctaagaatttctcagcggaagagaacactgctaagatgtttccttacgtttactccgtcaatcttgccagtgatatttgaccaccagcaatataatacaattccaaagataagagctggttctatgatcaacttgcccatttccttctcaccaaaagctgggtactaaccctgacattgtgtaaacgtctgtaggacttggaaacctagcgtgaaaatgttcggcatgttgaaattgcttttgcattgcaatgaaaaaaatctcctaaaaaggcatgattgatttaggattggatttgatttaaaattgaacacgaaagtacaccttttagatatgcattattgaccacattcccactggaaactgtttaaaacagtttttgttcatcaggtcatgtatttttaatttacaccttactgatttctaagagaaaaagaattgagatagtgatggaaatgtgaatatcctcaactgaaatttagtcagaactttattatgtcgaaattgttttctgtcattttgaaggaaacaaacacaactagtttactcttgtatgtgctatggagagtctgcagaataagaatacaattaagatttcaataactcggccgggcatggtggctcatgcctgtaatcctagcactttgggaggccaaggtaggtggatcatgaggtcaggagatcgagaccattctggctaacacggtgaaaccccgtctctactaaaaatataaaaaattagccgtgcgtggtggtgggcacctgtatccccagctacttgggctgctgaggcaggagaatgggaggcggagcttgcagtgagccaagatggcgccactgcactccagcctttgcgacgagcgagactccctctcaaacaaacaaagatttcaataattcactcattaattaacaaggaaaggtgaatgcttattttttgcaccagctctaaataaattatattttagaaaaaaagttttcattgccaaaacatatttttaagctatgcttaacttcacttttcttcaattaaaaataaccagaaaacattcttagcctatgagattagttctttccaaagtatgattaaaagtgaaacatacaatggctactgctgcacaacattgtaaatgtccttaatgacagggaattatacactttaaaataacaacacattttaaataatgtgtgcctttaaaacttcttaaataatcacgcctgtaatcccagcactttgggaggccgaggcgggtggatcacgaggtcaggagatcgagaccatcctggctaacagggtgaaaccccgcctctactaaaaatacaaaaaatagccaggcgtggtggcgggcgcctgtagtttcagctactcaggaggctgcggcaggagaatggcgtgaacccgggaggcggagcttgcagtaagtcgagattgcttcactgcactccagcctgggcgacacagcgagactctgtctcaaaaaacaaacaaacaaacaaacaaacaaacaaacaaaaaacttcttaaataagtgaaacactgtcatgggagtatctaaatcatactatttgtcattgaagaaaagtaccataaagtgtatgctctgataattagctgaggtttccattgctttgaacataattacttcaggtccgtccaacagttgtcattaccgtgacaaatatcccacatgtcctagggaatacagctattttcaaattaataacttttcagtattagctttgtaactgttcttcaaaaaaaattgtttcggcagaattcttacatgctgagaacccccagggaagctgaaatcagcaaatattgccttagaaaatcaacgaaggccgggcatggtggctcacgcctgtgatctcagcactttgggaggctgaggcgggcagatcacttgaggccaggagttcgaaaccagcacggccaatacggagaaaccctgtgtctaccaaaaacacaacaaattagccaggcatagtggcacactcttataaccctaactattcaggaggctgaggcaggagaatcgcttgaacccgggaggcagaggttgcagtgagtggagatctcaccactgcactccagcctgggtgacagcgtgaggctcttgtctcaaatagaaaaaaaacaaagaacaaaaaacaaaaaaccaccaccaaccgcaatacatagcacccctctgacctcaccattgagtattgattcttacatatatttcccattgtgctaagtaatggtatcattatctaaagcgataatgacaagcaccaggtcattcagggccttgttacctccgatgacagcagagtctcttctgtctgcattaaccaagggctctccctcatccgctggtccagaacgacctacaacagggaaagggagaatgatgtttattagcttgatttaatcacgccacaatttacacatagcaaacttgtcaattaaaagtgaattaaaataagaacatcacaaaaatgtattttaaaaaaggaaaaaaagaaggatgacagagacggagaaaagaaggcttttgagaaattcacaaacatttgagagaagcgcagtttcaggtgcgcaggggtggagggccacacacctgcgccccccgcgagtcggggagccagttcccgcgccggggagccggacgccgcccccgctgcgcagcgggccataggggccacgtggccgcggacggtgacccgggaggggccgctggggcgcagcgccgccttcaggggagcagcgcggccgaagcgcaccgccgagaggcagccagtgaagccactagtcgccgcccgccttgtgtccgggtccgcgccggcagcctctgaggacagaaggggaacacacagttagggcgcagcggcggagatgggggcgcaggcacaccccgcatctgcaagacagcgaccctcgttccttcactccaggagaggtccctccgaacccctcgttccttcactccaggagaggtcaccgtgaatctttacctgtctggcaactatttccattgtcagggttatgaaaggcaggtttttaacagattcgttcaagtgcagatggctggctctctgcaagtaacagagcttcataggaaagcggttacatggcataaatttaagaaatcctctgccatttaatttttaaaatatagcattaaaataaaattttaatggcgctcacagccaataatccggaggattacagaaaagcgactcttggagatgagggcagagctctggaaatccttcatactatagttgctattttgtatgatgactttcatattatcttaataaactgtatcttttgtcatcagataatatccctctttatctcatttaagattcgattatattccaatcttaaattcaatcttatctgaaagtagtgctgcatttcttaaatttatcagctgttgcctgctagttcttggcatgccccttcattttcaatattgtaagagcatttaactgttaattttaaagctagtttgacagaatttagtccatttgtctttagagtaataaccactatatctgattttattttttatcttacactatttatttcacattatttctttttttccttttattttgctggtttaatcagtttccttcttatttcctgctttcccttttgtgagtttgagagctcaacttccctagccctcacaatcaaaatcatgccttcacactgttatatgaaaacaagatcctctttttccaactttcccccattcccaacagtgagatgagcgattgcatggttctttctccccaccctccctcccacaccaccgcggggttccccacaacagttcttccctaaatgagaggcttgggaaatttttctttttcttctctcacttttccctttttactcttctttggttttactctagtacatttagatcctgaccagaatgacaatttctcttacatttctatttttctatgatgtttccagttcaaggatctttacataatttattttttccaagaaagaactttgacatgatggacaaagattctccctatgaccagatgttggtcaggctactctaagctctctgctcaaccagcctgacctttggtctttcatcgtccagcttagcaagaatcctgccaatttggttttaacccaaatctcccaccctcaatatctgatcactctcaatatctaatcacctttctcatccctctcaccaccccgcaggtgatgtctgacaacactggcctggcatcaccaggaaacctggtgagtcagtttagcaagaattactctcccattttgtagttttccactcagacaccccaccccagccactctgctccttggctacgaatccacacttctccttgttgtatttgaagttgagctcagtctctttccccaactgcaaagctccattccagtaattcctatacctattgccatagtcctgaataaagtctgccacacgatcttaacaagagtatttttatcttttgacatgatacaagatggttttacattaaataattgtagtttagagaagaatcacataattttagggcagaccttttttttttttttttttttgagatggagtctcactctgtccccaggctggagtgcagtggcgcgatctcggctcactgcaacctccgcctcccaggtacaagcgattctcctgcctcagcctcccaagtagttgggactacaggcatgcaccaccacacccagctaattttttttgtgtatttttagtagagacgggatttcaccattttggccaggacggtctcgatctcttgaccttgtgatctgcccacctcggcctcccaaagtgtcaggattacaggcatgagccactgcgcccggccagacttctctttaaaaccctgaataaaaaccttgagcaattgtttaatttggagctgatgaaacagagaactttcttacatctttaataaatgacttaattagaaaatgatcaccatatatactttgtttaagctggaaaatctgaaagaaaggcattcctttgcccactctgaagtgtacctggcaatcacaccacaatccaggaagaaactcgtgattctgtactcccagattttagccagcactactatttattgtttatcagttaaccaatattcagtagaactcaactcttaactgtggtgacatgtagatacagtttcctgtctattaccttgacatggcaacatggtcaaaacccttcacttttgcttctcttagctgaatagctctaatcaaaaatgtatggtgacctgtctgcctccctttctgggctttctcaacttcggggtcctgcacccagcccccttccaattctctattctgttccatcaaagcctgctcccgagtaaattcacgtttgcacaaattcctggtcatggcttttgataacactttcaggggcatatgtattttggcagaagagtcaaaagaatggatctctaatacagaatttgaaatactggcacttgacgttgtgggaaaaaaaatatttgagatagggttgtcttcccagcccactgaagtcatgccaaatagacagatgtctatccttacaaaagggtgccacttggttgaactaaaggaaaaaacgactagataagtggacagtcttctacactgtgcaatacggtagacactagccacatgtgaccattgagattcaaatcaggccaggcacggtggctcatgcctgtaatcccagcactttgggaggccgaggtgggcggatgatgaggtcaggagatcaagaccatcctggctaacacggtgaaaccccatctctactaaaaatacaaaaaaaaaaaaaaattagccgggcatggtggtgggtgcctgtagtctcagctacttgggaggctgaggcaggagaatggcgtgaacccgggaggcagagcttgcagtgagccgagttcacgccactgtactccagcctggatgacagagtgaaactcgatctcaaaaaaaaaaaacaaagaaactcaaatcaattaaaattaaataaaatgtaaaatttagtccctcagttatactagccacatttctagtgcttaaaaactcatttatctcaagtgagtctggggactaccacataggacagcacagactttacacgttttcatcatcacagaaagttctattggacagcattagttttgttgacttatactttcaaagatctcaagacatctgtgatgcccactgaatcctggttaatggaccaagttagaacaatcttagaattttctatcgaagagaatcttgatgataacttagtgcagcctcctcattttaccaataaaggactaattgatataatcattgctctttcttggaaaaaaaaacccacaaaatctcctatcttcttgactttttatagggtttttaggtgttttcattctgtaatgttgaaagaggcaatccaccattggctctgagtgtctcctcatgctttgctgggtttgccaagaagtgcaagatgctgacagcactttactcaggccacttctcaaggctataattgaagcaagcaacattgagggataaggtcatgaccccctccaggacaaagaacagacttgcttagtgcttgttacaaaatcggtggattccccaaactcagtgttcctctgctgcagtggaaacctggccacaggtgcagccttcatctgcacccatcactgccccgtaaggcttcagggccaagggaaaacaatgcaaatgaactgctgctcacgaggcttgctgtgccatgagtagtagggtcctttgtctctgtaccaggacagcatccacaaaacagttaaaagctgttaacttcctagctcgtaaatcaggtaaaatcaaatcccagacccaacataaaacatttcttctaaatgagacaaacaccatagcacagaagtaatataaaatacataggttgatgaattttaaaatgttaaaactgtatgtcttatgtgacatctccttacaaaactcaaaaggcaatttccagaaatatttaattaccaaaactatttggcattcttacatatctagagctctatttgaaatatagtccttcagtgggttttcttttcttcagcctagaatgtatacctcctaaggtatataagctcagctgtattcatatgcaactgtttacaggctaatttttttttactttttgggagcagacaaaaaggcatcttccatttttgcactctgtttttttgatatatatatgtaatttttaagatagtgtttaaggggccaggtgtggtggctcacacctgtaatcccagcactttgggagactgaggcgggtggatcacaaggtcaggaattcgagaccagcctgaccaacatgatgaaaccccgtctctactaaaactacaaaaattagccaggcgtggtggtacatgcctgtaatcccagctactcaggaagctgaggcaggagaatcgtgtgaacctgggaggcggaggttgcagtgagccgagattgcgccactgcactccagcctgggcgacagagtgatactcatctcaaaagtgtttaaatacatgtgcacatgtacacacacaaagcaaaacagaaagaatacaataataccaaagtatctaaaaacaaatcttaatttatgatggatcatctttactgaattataaagtattttaggtgtctgcattctttaaagctacctcttggataaaattcaaagctatatagaaaattcaaaatctaaaaagcttatatttaaataggtttactctgaattgatcttgtgataatcaatctgaatggtcttcattcactaagactactcagaaatggcaaaatcatattgaggtgctcagaaacagcatcttaattatgatggattttggaccatttttttctaaggcattgttagggtgcataataataaattaggctggatatgagcattattttattagaattgctcatatattagcctatgtacctattaacatgtgagtgtagtgagggtgggtaggtatagtgtttcattcagaggctttctcagtgcttaataaactgttcatagcagatgctcaccaagttttttttttttttttttttttgagacagagtctcgctctgtcatccaggctggagtgcaggatctctgctcactgcaagctccgcctcctgggttcacgccattctcctgcctcagcctcccgagtagctgggactacaggcgcccgccaccatgcccggctaattttttttgtatttttagtagagacggggtttcaccgtgttagccaggatggtctggatctcctgacctcgtgatccgcctgcctcagcctcccaaagtgctgggattacaggcgtaagccaccacacccggccactcaccaaatatttttaaatgaagggatgaatcgaagatttacagggactcaagagaaatatattggtaacttagaacagagtgttttgggtaactttctttgtaaaattagtggcttctctattagccaacttgttggtctattttactataagttaaggaaagcacttcctatataattccaaatttaaagataaaattgtagttttggtataattactaaatgatgtgagagtggcaaaaaatgtatagcagaaccaatcctaaaatacagttgttcaaagtataaagtgttttattaatgtttgatgattatctctacctccaaggacaggcaaaatgaatatttataattttctaagatcaattgcttctgagtatatacttcattgctgaatttcaatgtagatttttataccgtaagttacatgcctttgaatataccatccttgaatgaaaacattaacaccttcaattccatgtctcctttatttggaaggaaacaaagatgtatataataaatattattcaactttttgatcctaatattaaagtatagttcattttcttaattgagttacataagatgggtttttttaaaaaaagattactttcctcagttcctttattaaatgtaaagctaactgtgcttttacaacagattatgatagacaatatgatagacaattactgtaactttctaccttgcgtaacagatatttatgaatatgcctccccattcctgttagatactaaagtcaaaaaggatggaaacaacaggcaaagcagggcttgagagaaaaataaaactgtattcatctgctgtaataagattaccagttttttctcttgtgttcaactcaaacgtagttttatcattgaatgatggtctccggagttgatgttgattaatacatacataatctgtgaacttcgtgtcagctttgacaacatttcacttttcaagaaggattagaaaaataccgtgattcattatgcatgattgccaagtgagaggttaagtgtggaggtatttttccaggaacgcccttgcacatctcacaggtagcacttagtcatgattatatgtacactcaggcaagagtacagtttgcaccttgattgtcactcactgtgaaattattattcaagtaagacaaggagcttctttcagcatgatgaatgcttccagagtttgtgacatgacacttatttgggaaaaagctctttctcctacttacctaaaacctttcccaatatgagagatttgacggcgttgaattctgtccctgaggacaagatgacttgtttctttgtgctctggttaacctattagatgtcccatgagaagcaaacatcaacagaaagtacaattttaatgataaggaagcaaaggaagatgaggaaaggaaagatgaaaataaatcacttttaagtaccattacaaaagctcaagaagccaccttcaaataattaatcatttagaaagagaagctattttataagcaattcctatgatgccatcagctaccactctatccacgatgtacccacttgctggctttactcttcttcataatggaaggatctataattggcagaatccatgaaaaagatggaattggttgttttaaacttaaatatgtactcattctgtggagaaaatctgaaacataaaaccaagcattgttgttctctatacagtatattttccttccaatgccgatgacaatgtgtaatttacttcctctgtggtgactcaggtctattttcttacttattcccattttaataactatgttgtgtgcttttaaaccgtgtttttaagttgctaaagtatttgttcttttataatcagaataagacaagttcccactgcagtatcaatgaatagattccaccagcagtcactatgataaactagagaacattcccctattgagtaaagtaaaacaaatagatattttgatattttaaatagtaaaatattaataatacctttgacagaattgcattgctaaacaaacaaaacaaagcaatacagaataaacaaccacctcctctctcccagatcctggccatatttggcttcttcttgacttatggaagagcagcactgaatgggttgctcttctattaatattatcaaattttttcattagattatttgttcttaaaataataatattagttagtttgacttttgcatttgtgggattacctctaccatgaccacagcttcttctctgttaatcttcacttggtgaagttgcccatcagccatgtttttaaaatcaaaggtaaatgcatcaggattttgatgtctatctagcttgtacctaatctgcaaacttcctaaaaagaaaaataaatggcatttaaaattaaagtggtattttataaaactcttgatacagattctagagcacttttattattatttacttacagcacttttgaatctatttagcatcaatttagatgcacccaatagttatctttcccggaacagtgattacttaagtgctattcctgtgccagactctgagtccaatgatgctatttgaaaagtcaagactaaatgtgttgttaataagcagtctccccaaaccttttcatttaaaaatgaaaaggtttaaattatgcatatgagcttggaactcagatctaaattcattatgactttgatatttatgaaatgatgaaactctatgcaatattgtatcaacattcagttcctgtaattataacttctaataaggctcattttaatgtatcactgatatgtgcataaagatttttttatagccagattattttaagtcttctgccataatccaaaaatgaggacaagaaaaggttttgtcaggagacaaggtttccatagtatctacatcttctaatatacatacccctctcctacacagatgtgccctcattatctgtaattctcttttagtttatactaagatcctgttaatcggagatttttttttttgtttgtttgtttgaggtggagtctcgctctgtcacccaggctggagtgcagtggcgcgatctgggctcactgcaagctctgcctcctgggttcacgccattctcctgcctcagcctcccgagtagctgggactacaggtgcccaccaccatgcccggctcattttttgtatttttagtagagatggggtttcactgtgttagccaggatggtctcgatttcctgacctcgtgatccgcctgccttggcctcccaaagtgctgcgattacaggcgtgagccaccacatccagcctactcagagattttgtagatttttttctaggcatgaaatttttgtgctgtgtacctaacagacttaaagcttggtcttcttgttcaactgtaaaaaccttgcaatgccccaactaccactgtttgagaggttgtcattacacttttcttctataaaagtgatataactagtttttcagccactgatgagataaagaacagctgtacttatctgttgcttataggaattggcttttatatagttgtactataacatccacataaatgctcctctattttgcttagaatgaggagggaatgtatgtcatgtatctagatatcttatttcaaaatgaactgcaaaaccaatttgagtcatcatgtactattaaagtcatcctatcaataataagaaatataactgcatatcaactccgtaaaattatcaaacatgtaatgggagaaaagcatcttaatttaatcttgaaatgctagcttttatacataaccattaaggcaggcactgaaaaaccaaacccattggagggcatacagttttctctcatcgtttgtagtttgactgctgaaaagacccatgtcattacagtcctatttttctaactcagggttctctttttctttacacaaaagatattcaccattgttggcgaggataactgaaaggtattcctcatagaaagagctcacatacagcaataagctcggagttcgtgtggttcggaagctcagtgtgatcatttctctggtcaatgttacatctctgtgtaatgaagaaacgagagagctggagttttcacttaaagtgtaatgttcttgaaaatggtatgtcattgaggagccagttgcaaaatatgcggaaatctctgaaatgataaatacatttttgttatgttaacaaaatgtaagtccaacggtcttgttttaagtacatttagagaatgagaccaaaccttaaatatcctgggagataaagtaatagtgaaatcctttcctgtttttttatttttcactttttaaagttttttaaaaactacaacttgaagaaaaagtagcaaactccaatatactcataacccaaaattgactaacacttaatagagattttaattctccaaatcatcctcatcttatatttacatataactaattcttcagtataaatgtataatttataggtgacttatctcatctttggtttccaattttttcccaaattattaatttttaaacatctttattcagatataatccatatgccatgtaatagacccaattacagtgtaaaattctatgtcttttagtatatttgcaggcatgtgcaaacattgccatgatcaattttagagtattttcactcccctcccccgagcaccttcttattccctcctacaaaaacctccataacctctagcagtcattctctgtttctccccaacaccccagcctaggcaactactaatttactttctgtctctgcagaggttcctattcaagagatttcatatcagtggaatcatataacgtgtggtcttttcaatgtggcctctttcacttagcatggtattttcaaggttcatccatcttgtagcatgtatcagtattttatgcgttttattgactaatatttcattggatgtaaatagtaatggatgtgccacattttgcggatctatttaacagttgatagacatttgggttgtttctactttttgactattataaataatgcttccatgaaaattcacgtgtaagtttttctatggacacgtttttatttttcttaggaatatatacctaggagtaaaattgttcaatcttatgataacaccaactttaaaattttgaggagctgccatattttttccaaaatagctataccattttacattccaaacagcaattatgagggttttaatatctccacatcctcaccaacatttattattatctttcttttaaattacagctatacctgtctgtgtgaagaggtatttcattgtgactttgattgcctactggctaatgttgccaactattttttcatgattttattggacattcacacatatttgctgaagaaatatctatttataagctttacctattatttaattgggttaaatttctttttcttattcagttgttggttttttgtttttatttttgttttcttgagacagagtctcgctctgctgcccaggctggagtgcagtggcgtgatctctgctcactgcaagctctgcctcctgggttcacaccattctcctgcctcagcctcccaagtagctgggactacaggcgcccgccactacgcgtggctaattttttgtatttttagtagagatggggtttcactgtgttagccaggatggtctcgaactcctgacctcgtgatctgcccacctcggcctcccaaaatgctgggattacaggtgtgagccaccacgcacagcatcttattcagttgtaaaagctctttaaataatttgaatactagacccttataagagacatgatttgcaatactttcttccattctgtgggttatcttctcttttgttctcccatgttttaagagttttatagttttagttcttacatcgaggtctatttggtacatttttatgtatgtgtgagatagaggtctaatttcattcatttgcatgtgcatgtatactcagtagtctcagagactacttcttcccattgggttgtcctggcactcttgtaaaatccattgaccataaatggcgaggtatctatctggactttcaattttatcccaatgagctatctgtttagtcttaggccagttatatactgctttacagtaagtttagaaattgggcagtgtgaatctatcaaatttcttcttcttaaagattgttttggctattctgcatcatttaaattttcatatgaaatcagcttgtcaatttcaggaaagaagccagctgggatattgattgaaactgtactgaatctgtatattactttagagaacactggtattttatttatattaattattcaatccatgacatgaaatatctctccatttatttacctttaatttctttcaatgctttatagttttcagtgtgttttccatttcttttgttaaatgtattgctatgtatgttattctttttgatgctattgtaaataaaattgttttactggttttattttcagatggttcacagctaatgtgtagaaatacaattgattttgtatattgtttttgtattctgcaattttgctgaacttggttttagttttaatagttctaagtagattctttgggatttttttatataaaaaatcatgtcatcctcaaatagagatagttttatttcctttctaatttggatgtttttcttcttctttttttttttttttcattttcttgcctaatcagtctggcctgaacctctagtacaatgctgaatagaactagtgagagtatacattcttgtctcgttcttgatcttaggaaaaaaacattcagtctttaaaactaaatataattttagctatgagtttttcaaaaataccatttgttagactgaggaagttatcgtctataattagtttactgaatttaaacaaaaatacatgaaaggatgttggattttatcaaatgacttttctgcatcagtagagactatcatgtgtttctgtcctttattctaagatatagtatattatattaattgattttcagctgttaaaacaactttccatttctgggatcatttccactttgtcttgatgtatagtcatttttatatgtgactggatttgctttggtaatactctgttcagggttttcacatctatctacttaaatgatattggtctgtagatttaaaatatatatacttgtatatctatgtctggctttggtattagggaaatactgaccttacagaataagttggaaaatgctcctttctcttttattttttggaagagttttgaagaatacttcttatttaaatagttgatatatttttaaatagttgatatattctgatagttgatagcatcaattgtttgaaaccatctggacctgggctttactttgtgtggtattttaatattattaagacattccttttattgttataggccaatttatattttctcctccttcttgaaacagaagtagtagtttgtgttaattttgtagttagtgtcatcctaggaattcgtccattttatctaagttacgtaatttttttcaacatacagttgtttatattctcttgcaatccatgttatttctgtaaggttggtagtaatatcactctttcatatgtcattctagtaatttgaatcatctcttttattcttggtcagttgtactaaaggtttgccaattttgttaacaattttaaaggactgacttttggtttggttaattttttctgtcacttttatattatccatttgagaaatttctcctgttttatttattatttcctgtttctccttacattagatttagtttgctcttcttttttcagtgtcttagggtggcaggtcaggttttttatttgggaaccatttttctttttgaatattgatgtttacagctttaaaattccctctaaaccctgctttagctgtgttactatatgttttagtaatgttgtatttttgctttcatttatctcaaaaccttttctaatttcccttttgatttcggagtgtatagtttaatttccacatatttgtgatattccacaatttctttatgttattattttcatctcattgtgttttaaaaagacccttcatatgatttcaatccttttaaatgtgttgaggcttgatttacaggtagcatgttgtctaacctagaatatgttccatgaacacttgagaagaatatacattctgctattgttaagtggtgtgttctacagatgtgtgttagaatgattgcgtttttatttttttcaactctattttcttggtaatcttctgagtaattatcctttattgtaagtgaagtattgaatcctccaggttttattcctagtttttctatttctcttttcagttctgtcaggtattctttatgtaatttggggctatattattaactgcatataagtttgtaattgttatatctttttgagggagttaactttttatcattataaaagtttccctgtttctagtagcaccttttgttttagagtttatttttttctggtattagtatagtccctttggctctctagggttactctttgcatggtacatgttttcccttcttttattttcaactaaattacccctttcaatctaaattgtatgtccttagacagcatatagttaagatttcttttgttatccattctgacaatatttgtcttttgattgggttgctcaatcgatgaacatttaatattattattgatacagttagatttacatctgccattttctttttctttttctatgtgtttcatttgttttcttttcactttccttctgacttattattttgtgttggtggatattttggagtgtaacattttaatttctttcttgatttcactatactttggggtaaaatatataaatatataatttgccacttaaccatttaaaatatgaaattcagtagcattaaattcacaatgttgtgcaattatcacctcttttgatacccaaaatttgtcatcatcccaaaattaaactgtattcattaagcaataactctccattgccccctcatctcagctgctggtatccttgaatctactttgtctctacaaatttgtctattgatatctagtaaacatggagttatataatatctgccctcttgggtctggcttatttcacttagcataatgtcttctatgtcaattaatgttgtatcatgtatcagaacctcattccttttaatggctgaacaatataccattatatgtatatactacattttttaatcaattcatgtgttgatggacacttgtattatttccactattgtgattagtgctactatgaacatttgtatacaagtatctgcttgagttcttgttttcaattgttttggttatatatgtagaagtggaattgctgggttcgaaggtaattctatgtttaactactttgagttaactctaaatcaatttctacagtggctgtggcatttactttcccaccagtaacaaaagagagttccaatttctctaggttcttgccaaaacttgttattttctgtttttatttatttatttatttttattgtcaatctagtaggtttgaagaggcagctcattatacttttcgtttgtatttctttaataactaatgatgttgagtatcatctttccatgtgattattgactctgtatatctttttggagaaatgtctcatcaagtcctttgtccaattagactttttgttgttaagttgtggaagttattaacatattctagatagtaaacctccatcagatacataatttgcaaatattttatcacattctgtggattgtctttttactctcttgatagtgttctttgatacacagaagttgttaattttgataaagtccaaataatctatttttattgttgttgttgcccgtgcttttggggtgatttttaaaaaaccactgccaaatccaagatcatgaagatctgcctatatatcttctaaaaattttatagttttatcttttagatttaaaactttgattcattttgagttaattttggtaagggtctaacttcaatctttgcatgtgaacatccacttttcctacctttatgttgaatagactgttacttccctattgaatgatcttgacaaagactatgttaaacatcaattgactgtatgtacgtaggtttatttctggcctctcagctctattccattgatttataggtttatcctcattcagtgccacattgttttgaataatgtagtttatagtaagttttgaagtcaagaagggtgaatcctccaactttgttcttttgtaaaattgttttgcttattctgggctttttcaaattttatttaaatattgataggggctttttcatttgtataaaaagtgctttggggattctgataagaattagattgaatctgctggggttgtattgtcattttaataatcttaagttttccaattcatgaatatggaatgtctttccatctatttagttctttctttaatctctttcaacaacgttttatagttttcaatgtctaagtctttcactttctcggttaagtttatttctaagttttttattctttttgatgatattgcaaatggaattgtttccttaatctcactttcagatttttcattgctagtgtagagaaatacaaccaaatttttggtgttaattttgtatcctgcaacttcgctgaatttatttattttctcttaacagcttttatttcctgaagagttttctacatataagataaggtaatctgagagagagatagcccttctattgaaatttggatgccttctatttcttcttcttgcttaatgactttagctggaacttccagtactatgataaatagaggtggtaaaactgggcatacttgtcgtgtttcttattttacggaagctttcaccattgagtatgatgttaattgcaggtttttcatatatggcctttatcatattgagaaagttcccttctattcctagtttattgagtgtttttgtttttcaatcatgaaaggttactggagtttgttaaatgtttttttttcagcaacaattaagataatcatgttttttttcccctctcattctattaatcttgtgtaatatgttgactgattttcatttgttgaaccactcctgaaatcctgggataaatcctactacgttttggtatataggtcttttaatatatttcacgacaatgttttattttctttagtgattgctctaagcttgcattatatatatcttatcaataatctgcttcaggtttacattaacttaatacaagtgagatttagaaaagttatttctacatagctctatttcttctgttttggaactatttttatgcataccaaacccattattattttatataatttgttctctttttaaaaaatctgagaaaaaaaaagatcaagtaaatatttatagactttgtctataaactctcttatttaccatttctagttctctttctttgttcctctgactcatgttaccatttggtgtcattccttatttcagtacagccttgctcccatctgtctcctctgtgctgtttttttgtaatatatttctataggcccaacaatgaaaatatatacattatatatttgtatattctctattatagttttatacattgctttttaaaatagttaagcactgaaaagggtaagaaatatgacattatactttcttttataattacctgcacacttacctttattagtgctatttgttttttgtgtgtagattcagattattgtctgggttatatcccttcaacctgaaggaacgttctttgttatttcctctaatgcaggctaatagcagtgaattctctgttttttgtaagtagggatatatttactatcttttttaatttttagtttttatgaatacctaatagttgtacgttatttatggggtagaggtaatattttgatacaaccaaacaatgtgtaatgatcaaatcagggtaactgagatatccatcaccttaaacatttatcatttctttttgttaggaacattccagttccactcttctagttattttgaaatatacaataaattattgttaactatagtcatcctgtgctactgaacatgaaagacggttttgctgggtgtaagtttcttcatgacaatagttttctttcatctctttgaatatgttatctcactgtcctgtggcctccattctttcagattagaaggtagctgttgatcctggcgtttccttgtatatatgatttttctcttactgcttttaaaatttccttcttgactttggctttcaaagtttttaataagatgtgtctggatataaacttctttgtgtcatctgtatttcactgagtttctgtatcttagattaatgatttttattaatttgggggtgttttcaaccattatttttcaaatatttttttctgatcctttctctctctcctggtattttcaattacgtatatattggtgtgcttagttatgtctgatatttctctgatgatctatttttttcattattatttctctgtattcttcaggatacataatctctattgatcttgcttcaagtttgctgactcttttttcttttctctgttaaacttccctggcttaactcattactctcttggagttatcaaaattctcttaattgcttactgccaatatcttcataccactatgcttaaacttatccatcctctgttccaaatagaaatcagttcacttggggagggctaccaagctgtgtattttcatggcctccctctacctcttggttgaatgtgcctcactgctctgaagctgtggggagtgagagtggcctgctcctttgtagtaaaacctctgcttacaagtagggcacagggtgggaaaggtaacttcttgccttgcctctcctggtggagaaactgttccttacaagtaagctggagtgagggcaattgggacacaggattttccagctgccacacctgaagaccttatgtcctggaatgaggagttggtgtaggaaggaaaccccagacttctcagctgtttctgcgtggacagagcttctgtcctacaaaactggggatgacaagaaatgctggcacccaatcttggggtaatgcagtatctctggagtaggacctgggtagagaggaaacctctggcttcttggctatatccatatagagtggagcttccgtcatactgagctagggatggggaggtgctgggagagggtcttggcttaaatgcctcaaactctcactattattactgattaataaatgtttcttcatttgatgtatttccttaggacatcttctaaagactttcaatagttgttttttaaaataataatttttactagttatgcttgtttcgtatgagagagggtttacagagctccttatgtggccagcctggaaatgccagagtaccaggttttttatttgaatgttacctcctctttaaaaatcgatttgctttgtaggaagcatgaaacagagctcctgaagtaactagagaaaaggtgatttgaagaccaaccctccttcaaggtcagaatttagaaatgttcttttatgccaaagatgtttctcaaatttactgtctggatagaaaggctaatccaaagtggtatctacagtattctgagagagaaaagttgaagggctttcagattctcttaaaacactttatgaaaggttgatattttaattttatatcaagttaattccaaaaatgtgtttagtacacacatacacatacacacaccccccaaatatatctgtaaataaaaagacaatgttgggtgatgatcattgtcttggaatactactccactctttccatttccataaaatataaagaatttactgaaaatccagatcattcttattagattaggtaatctaactataacatatgccccagccactggaggaccattttccatttacttactatataatgtctatccttaagaaaattttgggttataaaataacattcaaattgcacttagcaaatgtggattgggaatgatttagaaatcagcacttgtgctcatgaaggagtggttactcctgatgttggcttgagatataaaaagggctctgtatttgcaccagagctatgagatttgttagcacagagatcttcaggaatgataaaagacacatgcaagaccttttgaaaatttaaatgacttctagataatgaatcctcaaaatttttttgaaagtcacacaattttatagtgattaaagcctgttttgctgctaaaaatagtaagtgtaacagcccagagacacttaaaaacacaactacattttagctctgatgattcaatattgtaagaggtttcataaaagtattataaatatattaaataagtcagtacagagtacttaatactaaaatcagtccctttttccttttcttttttttttttttccccaagacggagtctcactctgccgcccaggagtgagtgcagtggtgcgatctctactcactgcaacctctgcctcccgggttcaagcaattctcctgcctcagcctcccgagtagctgggatgcccggctaatttttgtatttttagtaaagatgaggtttcaccatgttggccaggctggtcttgaattcctgacctcgtgatccgcctgccttggcctcccaaagtgctgggattacaggcatgagccaccacgcccagcccttttcttttgaaaacatgattgtacctgagcagaagctgtgtgataccccactgcactcctctaagaagagtcaaacatcatagagcacagtgtttgagtgatcctgttaatgactgtcaatatttaaatattattttccccttctagttagtatgcttgttttataagaaaagacatttctataaaggccttttgaatcacttcaagtcattgtcacaagggacaatgggtaagacgattgctcaagcctaggagttcaagtccagcctgggcaacagagaggcttgaatagcaatacgttgtctctaaaaattaaaaacaaaaataacaatgatggtttactgatgttaaaattagaacagtacaaggacagagttttgaaaaccaaattatttcaagaggattagcattgaacagatgctaggggtaacccagagatcttctaaataagaaacccagagaggactgatagccttaagttttcaaaaacagtcatatcccttctaaattcaatagaggaatttggtacagaaattattccatttcaaataattcaatcttatcctctctttataatatcaaatgccagaagcattcttcatgttatttaagtttcatgtactttccctataacctgctccttggtcacacttaccattggagcagaacggcccatcataggctgagaaggcacagtcacaggtgacccccctgcgtttctctctgcatctccctccattgcgacacaagtgtccataggtgctgcagtgtcctgcacaccctggctccactcctggcgtcactgtggctctttcttccagatccagggccaccccgttcaactgcagagaccgaatgcatcctagaaagcctctctgtctggtggccgttccacctacaacggaaacactgcaaatagaaatgtgttccttggtattttattcaggattttatgtccatgtcaaactcaggccttatggagagtggcaataatcacaatgtgtcaaaaaattttgtgaacatacacaattttgaaaatgtaactgttatgagacatgaagctttaaatgacattgaataaaacacttatttacataactttcaaacatggtgagtctggcaaatagtcctaaaacatttccttaacttcaggtaagaaagaatttcactttagttccttcacaaagaacaaaatacataatataaaccacatcaaacactattctactttgtttaggaataagaatgtgtattcatcaaacattattttaatttctttatgaataagaatgtgcattataatggttaggtatgaacttccaaatttttcacaataataaaaatatatatggataatttcttacttggatggactctaaaaataaagtgtgaaaggaaatggagaggcaaaggaggggaagttggaaggggtgacaccgtaccccaggatctcctcctctcagagggtacagtgctaaacagtaattgaatactgcatgcatgcacattttgtcatgtcaaacttgaatgctgaagaaaccatttagagaggtttacaacacctgtgtagtgacaaacaccattatgaaggcgacaattctcaatgttaggagcatggaaattacctagagtttctggaaaatgcagtttttagcctcctcccagagattccaattcggtgggcctaaggtgggggccccaaatctgaactatcaatcagctttgtgggtgattctgaagccagtgattcatccaccgcaatgaatgctgattctaggtgaattttacgctaattgtgtttctaggcattcccttaaataatctccaagattacaagtgagaaaatcaagttcttggtttgacccctccgtgtagtcctcctttccagtagtttgatggtttcatgtcctttgaaaaagcctcactgcaccttaatagaagagctaaccacgcctgaagctaggttttaggaagtcatggtataacaccccatccacatccacatacatacgtgggttcacgtgtagcatttagtacctggaagttgtatctacccttccctgtaaattaggttggatgataatttgtgatttagtccagttttaattagattgcatccttattcactttaaaacacttaagaaatgaacaagtgagagctttaatctgtgtagctcctaagttagaatagtttcaaaagcaatatggaaaaataaacaacagtgataaaacagtaagtaagcaaactaaaggaaagacttccagagctatcacctttaaataaatggagtgcaagaacagatgagccagaccaggttataaacaaggagcctgtgatgagagagccccagaagtgagaacagcagcgaggaaaaccgggagtgggctcctggaagcctggccgcgggggaggtgcgcagtgctgcttccaatcagcgggtatcctgcgatctggttttgagtggaccctggaggacttctgtcccaattacaagctctctaactccaccgagaagtgaaactgaaggaatggataaaaatgtctaatgatctcactaatagtgttgataaaatatagctgtcacatatgccaatcctctgcaatgtgaatggttcaagtttgggggtcggctatcctgggatccctctcattagctggttactccacttctctgaggcttggctatctcatctgtaaacagatgacaatacctaaacattgatacctaaacactgagatactgcagggcccggtggctcgcgcctgtaatcccagcactttgagaggctgaggtgggtggatcatcaggtcaagagatcacgaccatcctggccaacatggtaaaaccgtgtctctatgaaaaatacaaaaattagccaggcgtggtggcacctgcgcctgtaatcccagctactcaggaggctgaggcaggagaatcgcttgaacccggcaggtggaggtttcagtgggctgagattgcaccactgcactccagcctgggcgacacagtgagactctgtctgaaaacaaaaacaaaaacaaaaacaaacaaacaaaaaaagaaatgtcaaataagaagcacacagcaagctcctggaacctaccaggttatcagcaaatagtaccaataagcagtagttgttgttggcaactgttgctctcagtacatcacagttcttattttcttttggtccctctctggactcacactaaattcagttataaaccaccagcactcaccaatgaagagctggctgttgagctgtaaacgaacgtgcccatcagcaggggcaggctgcatcttctgaggaagctgatcaacttgaagagacgctcctttaacatttctctctgccctcacgtggtgccactgattgtcattaaagggagtgggtgactgcaccgtgacctcacaaggtccattccccacatcgaaggaaaaggtcacttctgtgggagctagaaatattagatatgaatattgctcaagcaaattcacagaaaattgagtcttgtgcagacacaggaaaacatgaaggcacgctcaggatggaaggagataatgacggcgatgcagaaaaacgggactgtgagttggggtgggggcagaataaatctgtatcctggaggaaaacagaacggattttaacatatttatcctcagagttcacaattcaaccttgttaagtcctaaatagtagagatatgtacccatagctggactacccatagctatgtacctatagctagaataccaaatagtatttgtttttgaggtttcagtaattttatttacaaacggctcaaagtctcatctaattctataaacactgaatgtaaattttgacagtcataaattaagctttgggtacataaaaaacaatatgtctggtcaaatatttttggaattcagtaaacaatgtgatgagtttggtttaaagctctggctctgctgttctgtactctagggaaggcatgacattttaatggattattacgtgcttcatgcttcattgttttattttctcttaaaaatgattactggctgggtgtggcagttcacacctgtaatcccagcactttgggaacccgaggcaggcagatcacttgaggccaggagttgaagaccagcctggtcaacatgggaaaaccccacctctaccaaaaatacaaaaattagctgggcacggtggtgcctgcctatagtcccagctactcaggagactgaggcaggagaattgcttgaacccaggaggctgaggttgcagtgagccaagataatgccactgcactccagcatgagtgacacagcaaaatcctctctccctctctcaaaaaaaaaaaaattacctaaaatcatagaagtttagtattttataatgaaatagaatcacaaaataagaatgaaatactaacattttgttgagttaaagcttttattgctaaataatgggtaccctgtgacttgtccagagtggcgagcttaccacgcagctcaatcctgatgaaatctgtgatccccaggttctccataaacaccccggaggaaactgtggtcttaaaaaagaagcacacgtcagcagtgagttctccgtggaaagcagggaaatgaaggtatgaagtctcagtgttgaaggaagctgaattccagaatgactctgtttacaatagagaaaacgacaaaaggaaaaaaagtcatgaaacaaaaataacagctacatttgatacttacaggattatgactgctaaatacattaatagaatctatatgagctttcactgggggttctgagcatccatgtcatatactgatgacatcaagagctaaatggtgattatggtgaggattagaattctgtgttcagagaaggccaaacaaaagcgaagcaaaagcaatgagaccagtcaggggatcgcgcagcaacacagtagggacagggtcaagttcagaatcacctcaaaggtacgaccaacagaacttactgaagaactcggtaagatgtgagaagaagggtggagtctgaggtgactttggggtttttggtctaactgggaggggaaataattctaaagaggcaggttcgagcagcagctcagtttgggacatgtttcatttgagatatctattaggcatccaagtggagatttgaaggaggtagttggataaatgactccagaagccagaacacagactcttgctttccttcctgcacatacacatacacacacacacacacacacacacacacacacacacacacacactgtcttaattcctttcatggcaagaacaatcaagaacaagaagaagcttatttgttcccttctgtccaaaacccatcacaggactgcacatcacatgtattcctcaggcctctttagtgtccttcattctggtacagtgtgtgagtcttttcttatcttttgtgtacttttgactttttggtatttttcagttgacttgcagaatgttcctcaacttggatttgtctgacatactcatgattggattcatgttgtgcatttttgtcaaaaataccacagaagggctgctgtgttctcctcagtgtgtcgcagcagcaggcagcaatgctgatcagcccatcactggtcctgttagtttcaactgctttgtaaagtggcatttgtccactttctccaacatgaagttattatttttctctttgtaattcatgtatttttgacactttaaggttacagaaacacaactttacccagttaaaaatttcttcatccaatggttttacaatatattgatggctcctgattgaatttttattctgatggctgccagtggtgatcttctaagctctgtcattccttccacattaattggttgacatgcctccgtcagaaatagcttttctcggctaggtgcagtggctcacgcctgtaaccccagcactttgggaggccaaggcgggcggatcatgaagtcaggagatccagaccatcctggctaacatggtgaaaccccgtctctactaaaaatacaaaaaattagccaggcatggtggtgggtgcctgtagtcccagctactcgggaggctgaggcaggagaatggagtgaacccgggaggcggagcttgcagtgaggtgagatcatgccactgcactccagcctgggtgacagagcaactctccatctcaaaaacaaacaaacaaacaaacaaaccaagaaatagcttttctcttgatcttttactaatttatttgtgtatttatccattggtttattcacatcactcttgaatttgtattctattcaatggtttatactctataacttattttgatgcttaagttgtctcaaatgtggcagctcctttaagctgacacccatgcctttttcagctttttctttcccctttgtcataacaaaatgatccaggctcatcttacattttctctgccacatttctggaatcagccatttcttcaaggagtcgtggtttcttttttagcagagaatgatagaaaatggtgtttagaagccgagatctgcaggctatttactagggtgtcattgcttctagccctctcagtagtcagctaggaaatatgtgtatttgtatctctctctctctctctcacacacacagtctctctcttctatgtgtattctacagttatctattatgtatattaaaatccatgagttcatgtggatacctccgtttttaacccagcaccacagggttcattacagtcttcctccttcccacatgtataactctttcctcagtgagaaggtcactcctactctcctcactgtatttacatatttgctcattccccagtgtggaaccaagcttctaacccagtggtcattccttgaccctatccctgcagatcccctagtcccagctgccccaaaagaagggaaaagaatcaataagtgttatgttaaagaaaacagagatgaagataaggaaaggaaaagagaaaggaagaggaatctacaagttttacagaagagaatattttatttttctttctttcttcattaatcaatttatttatttattttagagatgaggtctcactttgtcacccaggctggagtgcagtggcatgatcatagttcactgccacctcacattcctgggctcaagagatcatctcacctaagccttcctagttgctaggactacaggccaccatgcccagctaatttttagtttttttgtaagagacggggtcttaccatcttgtccgggcttgtgttgaactcctaggctcaagccatcctcccatctcagtctcccaaaaagagaagggaatatttcaaatatcacactttctcttctccatactttcagaagtcttgctgaaagtaggatataaactgaaggtgaatgacatatcctgaagagtctcacaaatacagccacgtttggagagaaatgaagggctgaggtaaatttccagagagaaaataatctagaaaatgtttttgagaagtacagagtacctagaaaccagtgtttgatgtcagagtatcaataggcaggggaaaaagctacaaatttccaggggttattactgaactgtgggaggcatctgaagcctgcagatataccctccatgcttcagtgtgatgcctggcacaggacatttaataattcttgaagataaaacggcacagagaatggccagtaaatcagatacaattcaacagatccctcccttgagctcttagattatgggaaaaaaaattgataggatgaccaactctagtcctgctattgcagttcagaagggacaagaagtatgtgtctgattgtgaagagatgaatgtcgagaagaattcaactccattccatataaatgaattaaatgtctggacagacctgccagacagacctgtggtgtagacttacactacaagtataaacaatgtttcaaaaagcgctgaaacagtgcaaacatactgagaaagaaaaagaaaaaaagaagacaggaaagaaagaaagaaaaagaaagaaagaaaagaaagagagagaaagaaagaagagagggagggagggagtggggaaggaaggaaggaaggaaggagtataaaagccagactgaatgggagggaggaagggagggagagaaagagggagggagggagggaggaaggaaggaaggagccatctgaatgggatggaggaaggaaattaagagagaacacaaggaaagaaaaatttcataagagttttacactatgggaataatataaaaaccaattcagtaaaataagagctaaaatatgagataaacagaaaagatgatttttaaggaaaaaaaatcaaagacccaaacaaaatcacagaggtaacagataaatcggaaatatctggaaatggagaacacagctgataacaaattactgacattgggagaagcttagaataatcatattgaatgcataggagaaggacaaagagattaaagccattggaagaaacagaaaaaatgtatggggggcaaaggaaacaagtcaacagtcccagatgcagagaatccaacaaatgaaacaaagtattcaaagcataataaaaaccattttttcttaaaagagaacagaatatttcggtcaaaataagcatatttcattttagaaaaaattaacagaataattaatgccaaggcatattctggataagtttttgaaattgaaggataacatatctgtcaagagctgtgaggagtctgagatttcaccctacttgcaagctaacaatttagcttgccacagattaatggatgctgatagaaaacacaaaatttccgggtcagagttaaagaactttactgctcacagcacagcatgcagcatgagtgtcagaatatttgcattggttccccctatctccaaatttcacagggcaacacaatccatcagcccaggtggatgctacacacacagtgggtaggtctgcatctcagatgaggagcccccagacaagggtccgggactccttcatcaagcaggagacaagccggtcccccccctctctggggagtgagtacgcatcgatagtgatgttgtgttctctttgaactacttagctgcctacacgactggctacagaaactgcttggtattaggggatggagacgccacgccatctggcacactcggcaagaatgtacagagaggctcaggctccttggtgaaccacctctctcagaagtagcctccacacattgaggtagagcaggaaataaaaatacatttagtctcagacttctccacggcaatgtatgatgctagtgggtaagaaacactattaaaatttttctcagggaaagaagatttttactagcttagttgtggttcccgtgctacgcagtaggtagatcctctaagaaccctgggcttatagtgccactgaggtggaggagcgaggacttgaccatgaaagccacccatgaacgaaaatgctgcaggaaagagattaatacacattcggtgccatgtaatgtaaaacagaatgtacagaggtcagaaaatagagagtgtccaataatttcctaccactatagttgtctgaagagtataagggcaatgaataaatatcccttagaattcagaaaatagttcatctcatgattgttctggaaaaaatacaatcaattgataataaatccagccaagcaagtaataagttaaaacaaagatgattcattttctataaactaatgcttcagtaaggaaacacagatcttcagtactgactgtgcctttatggtatgtgtgttttcctgatattcgccccagtcctagtactgccactattctctttctggcaagaacaagggcatttgtctactcttttataaccaaaaaaagttattatgaaaataaagctttttcttgacactacttacgatctccgcggcagagcagtggccccagtgtataagctgcttcggaatgtggtcggcctgcgtctgtcatcacaatctgagtgactggcaggtgctccttttgggaaaggactattgtgtcactagtcctaaagaacaacaaccgaaaccattaaaattattctgattaacatacgggcaaaattaactctgatctcttatctcaatttgaaaccaacatcatagagcttaacagaatacttaacattttcaatattttgagagcacagagactaccatgaatctaaatcagggatgggcaaacattttgtgtaaaggaccatacagcaagctatcttagctcagcaggccatgcagcttctcacagcaactactcaactctgccaccaaagtgtgaaagcagccacagacacaggcatggctgggttgcaataaaaatttatggatatgaaatctgaatttcatacaagttttataagacatgaaatattctttttatttttcaaccttttaaaaatgtaaagaaaacattcttagctcactgccatgcaaaaatagactagtggtctggatttcacccaaagcaagaggttatcaactcctgacccgtttgccaattcctgatctaaatgattacagagaaggggaaaaatcaagaaggtaacttcccttctaaaattgtcttagaataatatctaagtgattattcattacaaataaaaatagtaacactggatttagatattcattttgcagaatattaatttatcattattttttaaagtccttttatgattactgggtatttctttccttgttaactttgtaaatgcaaaatgaatcccacagattcaaaaccaaatacatactacacccttataagtaatacatagactaatgagtgtgaaagtggtctgtgaaacactgctcccagtagttcaggcaacaaacacaggccgggcacagtggctcatgcctgtaatcccaacactttaggagactggggtgggcagattgcttgagctctggagttcgaaaccagcctgggcaacatagtgaggccccgtctctacaaaaaatacaaaaattagctgggtgtgatggtgcacacctgtagtcccagctacatgggaggctgaggtgggaggatcccttgagcctgggaggtagaggctgtagtgagccatgtgtgcgccactgcactccagcctgggtggcaaagtgagaccttgtctcaaaaaatacaaaaaacaaacaaaaaaccccacacactcagcgctcaccttttgtcaaacagacattgtcctgggaattgaggacacagagtaaaaaatatattttagtctctgccttctgaaagcacacagcctattgaataccatgagtattaattatgtgactgggaaaataaatgcacacgtctgggtccaatacaaagagacctggaggatcccctaggggaacctggggtcctggtcttagctatgccactaattttgtctctggccaaaataaaggcatttgtctactctgctgcaaaagtattttattatatatgtgtatgtaactgtatatgtaataaatatttggccaataataaatattgcatatatgcatatataacaaaatgcttatatttatatacttttggttatattttatcacatatatgtctcaactgcatgtacattctgatttacagacaaaacactcttagtccagttatggttagaaactccacagtatctagtaaatactgtattttttaaattgcccagttctcaaaccttcttttgtatgcatttgtggcaaaagatcacaataattgatatttcatcattgcaacacttttgtattttcaaaataaggctttctgaattaaaaaaaattaaattggcatgtcagagttgtacatatactgggggcacatgtgctattttgatactagaatacaatgcataatgatcaaatcaggataactgggatatccatcactttgagcagttatcctctgtggtgggaacattacaattctcttctggctattttgaaatatccaataaattactgttaactataatttctctagttctatcaaatactagaatttcttttacttaactcgacttttgtacccattaatcaacttcttttataaaagactttaggtatcaaactttcaaattggaaaatataaaactaaaataaagtggctatattatttaagattattccctgaaaaaatacacttaatggtaaagaaagcttatttctaaaattcagactaaaaccctgttgctttacctagttaagattctgttattcatttttatgcaaagaacagaatatggattatctaaaggcatcaccattcagctttagagtggattgatggtagacaagctagaaatatgtctcctgctgaatgaggtaggtctaggaaattttttattaatgtggtggtagccattaaaaattaccatttcaacttctgtgatcatcattttagcaagatagtctagtagagaaaatgcaatttaattatttatggaggatgcttgtattttaaaagatctatttcacgggagctccaagtttcattccattttcaatactgactgtgcaaaatattgagaatgtgtaaatgaaatccacatttcagtttaattagggcagatactataataaagtcttgttttttcagttgttttggaaagtctggtgttttcattctgagcataaagatagccagtgtttttcaccagtttcttattgttacaggcagattcccaacctttggagatcaaaatagaatactcaggatttgtcatagttatcagacttcctcaaaacttcctaattaatagggacatctcatttttcttttctattattttctaaagcttatactatagtctacacttggaaatagtgctttcataggtaccataatctcttgcagcagtattaaaaattcagtaagagaactttcaaagactttttgcttttattttatattttattaaaatttttatttattagaaattcctacggttctggaaattgtactttcctaggaagtgtgaaaacttctaaaagctactacttattatttgccagggaactttatttaaggcaaagtagggccataagtttgggaggttgcaaagaaagctaaaagggagaaatgttaagtcaactttttaactttttttttttctttgagacagagtctcactcttgtcgcccaggttggagtgcaatggtgtgatctctgctcactgcaacctccacccccaggattcaagcaattctcctgcctcagcctccagagtagctgggattacaggcgtgcgccactatgctcagctaatttttgtatttttagtatagacggggtttcaccatgttggtcaggctggtctcgaactcctgacttcatgatccgcccgccttggcctcccaaagtgctgggataacaggtgtgagccaccgcgcccagcccaactgttaatgattattttgggggagtaggtcagcaataataaaatcattatgatccacatctaacacacttaaaaaatttctagattctcagtttctgtttaattgcctatcttctggccaattcaacctgcattaattactacagcaatacagtatgtcttgacagctaacagaactagtttcttcactttatttttcatcttaaaaattatcttgcttatcctttcatccttaatttccatatgaattttaaaaccaggttgctgcaatccacacaagtaaaaccacttggcatttttttgaattttgttaaaattacagactaatttgatgagaatgtcaactttaaaagagggtatctcaacagcagcgttactgatattttgggctaatttttttttgttatgggggggctgtcctgtgcactgtaggatgcttagcagcaccctgatttctaattaatagacactaatataaacaaccttcctctctgtgtgatgacaaaaatgtcttcagacaatgccaaatgtcccaagagtcgaaatcacccccgattgagaactactgctttaagatactgagtcatactatccacgacagtagtgagtcaatccatttatttggctgtccttaattctcttgaataagttttgtaattttgtaattttttccataaaagtactgcagttattccacagaactttacatttttgttaatattgcaaataaaatttttctaggtgtgtaatggtaattattttaagattttatagaaattcaagtaattcctcaatactgactgaccataaattcagcaaacttactgaactctcatttttcctgatatttctttatattattttggattttctatgtaggcaatcatattatctacaatatctgccaggtttgtttcttttccaaactttttatcacttacatctattttatttcctcttgtgtctttaactgacacacgcatgaacttttaaaaattatatattcattattgattacagttaagaatatagtttccatcatgacaattccataaaatttgttaagattccatccatttacaaaattttttatacttattcaacaataatgtataatacattctataaagaaataatttttccttactaaacgatatatggctgctatatcaagtttgttaattataatattaaaatattcttacctgcttcacttactcattcccaaaaatgttatgttaattattccactgttttgggtgtcaatttgcctttgcatatttgttaattctctctctctctatatatacacacacacatatatatacacacacacatatatatacacacatatatatacacacatatatacacacacacacacacacacatatatatatatacacacacacatactttttttttttttttttttgagacagagtcttggtctgtcgcccaggctggagtgcagtggtgtgatcttggctcactgtaagctctgccttccagcttcacgccattctcctgcctcagcctcccgagtagctgggactacaggcgcccaccaccatgcctggctaatattttttgtatttttagtagagacggggtttcacctgtgttagccaggatggtctcgatcttctgacctcgtgatctgcccgcctcagcctcccaaagtgctgggattacaggcgtgagccatggcgccctgccacttctttatatattttaaacaatctgatgatacacacaagtgtagtgagatctttctagtgagtttatctcagcattagatagagttcaagtttatccctaacaatgcttttcatctttgtctgacataatacagctgtatctgctttcttttgatttgtatttactcggtaaatattttctattcttttagtttcaacttcactgagtgcttatattttatcttttgtaaataagctatagcttctttaaaaatccaatatgataaaatctaatgtctggtttttaaatgaacagagtttactcatatttattatgattatttgtacacttgtatgcatttaaaccatcttattttatgcttttttttgtggttacttttaaagactctaagataatcacacaaaagtcctatttaaattcttaagtaaaataatattacagttacatgtgtcatcattatattagcaaaacaacttgtggatttttgcagacagctgaattatatgttatatgtatattttagagaatatattggtctatttgaacatagtccactatacatttatacacatatattgacttgcagcatagttcaatattttaaatcattatagtgccttttaaatatatttgtttttataataaatctttggcatgttatagttatttgatagaatattcttactgtgcctgaggaactgtctgatcataaacttttttttaagtaatatgctttagacgagttgctgattacagggacaacttacggaaaaatggcgatggtttatattaacaatactgcctgccccattaacggacatatgcctgaagagacttaaaatagctttcactttactttcattcccaaatactatttttattataaactttccaccaggaaaaccttactaggcacacctcagtaatagaaaataagtaataaagactaagatttatgttcttatgtctacaccttaatctaaattattacaattataaatcttttcatttcatgagactggtaaattccatttttataaactgaaaaatcaattttatttgaaaaattaaaatagaaattgtaatttcccacccccccacccccatacacacccccacatttacaaaacaatctacaaaagttgggataggatttcagaatgcttgtggtcttactgttggatagacctgtctactggaagctgcaaagtaaataaaataaggttaaaaagcaaatgactccacaatgctcccttctgaatgtaggaggggagttaatttttaaaacctgcttctctcctaaatttttttccaaatgaaagcccagggcttctgtcacaccagtgcagtccttgacggtgctgaagtgacatggctaagggtatcagaggacctgcacccacctcagttcctcccattcccctcctcaaactcagttcatgggagggtcactcaatacaggtggctccaagtgatacgttcctctggttactgccctaagcatacgtgaagtctacaataaagtatgcacttaatactaacagaaggttctgtaacaaaaaaacagttgaccagcctggccaatagtgaaacccagtctctactaaaaatacaaaaattagccgggtgtggcactcggctgtaatcccagttactcgggaggctgaggcaggagaatcgcttgaatccgggaggcgcaggttgcagtgagctgagatcgcaccactgcattccagcctgggcgacagagagagactctgtctcaaaacaaaaacaaaacaaaacggttaacattcttcgaactaagttataaagccactagcatatatgccattctggctttcttgtaataacctgccaatgctctcctctctgacctgtagagaatgggggtggggacagaccaatgagctggaggtcttctgaacagccaggagctggagggctggagccctcacaggcaggagccccttgtggaatggaggaaatgaaaacctctaggattgttaaagatgtccgtcaaaagatttgaaggtcgctgtttgtctcattagagcccaaagctaacacacatcatcacattatcataccagacactttaaaatgtacatcatacaaaatattgtacaaaaccattttaactcatgggaaattacttcagacctgaaacttactggtggtcagatttgaaactatggatcagatctgttcctgttactcactgcactaaaactgcattcatttttaagtaagagaaagttgtattaagattgcatatcaaaatattcaaaaagagtgtctcataaatctgtatgatcatttagtaattttgaacttgaggaagattaaaaataatatccatgtaaatgtatagtatgtattctatagaaagctccagtagattcaagtgagttttcccaacttcacaatattttttaaagtgatgcaaagtagactttttatgccagataaataagtggactaccatgcaggccaaacaactccatttttaggaatcaaattactgcttagattagctattttatgtccaaatcaattatactgacacctggattgaccattacattttttatttattaattattattattattattattttgaggtggagtcttgctctgtcgcccaggctggagtgcagtggcgcgatctcggctcactgcaacctctacctcctgggttaagcaattctcctgtctcaccctcctgagcagctgggactacaggcacacacagccacacccggctaatttttgtattttcagtggatacggggttttgccacattggccaggctggtctcaaccttctgacctcaggtgatccacctgccttggcctcccaaagtgctgtgattacaggcgtgagccacagtgcctggcctaagtttttttttaaagcacgtactctacatgatctagttgttttatgacaatgctttttaagttgctgacatgaacccaaaggttgaaaacatttacatattacaaataaaaaaaagaaaaccaatatgcatttcaagagtaacctcaaaaagaacttctgaaaaaaaggcattgcaatctacatgagaaaattgtttctgctcaaaggaaagcttacaaaataattttcaaattccagaaagtctatgttagttgtttcaaagtatggtctacagaacagttggtgcttgaagctttgctattgcactgaagatttcaatgagtgtgggaaattgttgcttctacaaaataaacacagtccttttatgcaggacctctcagagtttcttgtgttaatgttaatttctaaaagaaagatagaatatgcagcattatatcccaaatcaatttaagacaaagatttggaggaatttgctttttgaattgccacatgaatactacgttaattaattaactaaacttcgcagagaatgatatttgatttccagtgagtggaaaacttaacagctgtttctcttttacgaaaaataaaaaacacattatatagtattcacaacgaactagtaaatctttggtcataaaatttaatccttagattaactgatcatatttcatcaaaacttgtatttcagcttgcttgaacatactttagttaccttattgtaccagcttgtctgacatttaattaactatgcataattaaagaataaaaaccacatttttgtgcagggaaatcatgtggaaatcaccattcattccggccagcatcacagttgcagtaatactgagaatcaatgcagttcccctctaatccacaagtacacttttgagcatcaggcagagaacctccccaggaagtgtgtgtttcattggttcttccaacccaccagctcagtggggttccatctgaaagacaagtataagaaacatgacatctactttgtccctcactaccaccctccccatatagctccctttactcccaggtgtaaagtgtatgtgtgagagacagagagagagaaaatgaaactatacttaaatacttgtattttacctctgaaacgtttatttaagcctaaccaatgtttttcccccaatatttcaatatctaggcttaaatgattccatctatttttcttctattagaaatcagtcagttgcatgtgatacatactttctatagaaataacattcaaaaaaattcaccattaaaataaataccagagtaatttgcacactaaagataaaatctatttgaaattatgaaatgttcattgagaaagtttaatattatacaaagacattgatttatctcatcccatctttttgctaactacctgtatattacacatttggaaagatatggtactctctgtcagtacttactaatttttggaggtatttgtttttattgcattggatgtcctgactctttatttggaggttaaggaatgacattgataggcttttctcatctctgaggttagagatttctcatgcgaagaaacaaagtgccctgggtcaactacagctctgacgagtgcacctccttctcagcactgacaatgattaaatgatagagtcagacactaactcagatctatagaactgcatattaggacaagggatgctgccaggggttgggagtgaagattggggtgatggactgactgcacatcacagtaaagttaggataatttaaaaagcaggtgtcaggccacctatcttaaaaaaggaagggggtcaggggccacaagttgcagtcatcacagatgaggccatgaggaaaatgaaattggattaactcaaccagttttttaaagatgcttgatcatgtggtgctgtttttcaaatttcaataggttgttaccattggaatatgaattgagatctggaacttagcttctaccttactgcttattacaactcaattataactcatccatagataagatctctgcattcattaccaccaccactatccatcacctgcccctctgccaaaaaaaaaaaaaaaaaggcaatctgggaaaatttaaagaggaattagtaccaggaatcttttaaaaatgtgctaaaaccttgtcactacaacgtaaaagatatttttaaaaattaatacactcttctcggaatgccactttaaaagttaccgacttcaccattaaactgtcgcagattaaagagcaaaacactcactatatcctaatgtacaagtgtaaatttacacctaaatctcccatattccccataaagtagtaaaaatgtattttttttagaaacagtagcaaaaagatgtaagtgggtgaacttctacactgataaaagatcttgtagacttgtctatccctgctatttccaccaagtataatgatagattctggaaataatacagaagacaaccgaagagaattctgaaaggtagaaagaggaagcttaggaccccaggactggaagatacaataacataactttttaaaaaactctgaatgggctcaagaatagagtgaaaagacagaggacagaatcactgaacttgaggacccatcaataggctttatctaacctgaccaaaaaagagaaaacagactgaatataaaaagaactgagccatagggtcctatcagacaatatcatccgaatctcaaaaagagagaagaaagtgtgctgaaagagtactgaaaaaatactggctgtaaacttcccacatgtggtgaaagacacaaacccagagatttaggaagtaaagtttaagtccaaaaaaggataaacccaaaaatatcgacaccaagatccatcataattgaactttttggaaacaaaacaaaacagaaatcttgaaagcagcctgagagaataacacattacctgcctgtaaaagaaccctaatttgaatgatagtagattactcatctgaaattacagaaccagaaggaatggcatatttttttcagggctgatagaaaagaattgtcaactataaattatatatccagagaaactatccttcaagaataaaatggaaataaaacctttttaggccgggtgcggtggctcacgcctgtaatcccagcactttcggaggccgaggtgggcggatcacgaggtcagatcgaaaccatcctggctaacacggtgaaaccccgtctctactaaaaatacaaaaaatagacgagcgtagtggcgggagcctgtagtcccagctactcaggaggctgaggcaggagaatggcgtgaacccgggaggcggagcttgcagtgagccgagattgtgccactgcactccaacctgggcgacagagtgagattccatctccaaaacaataacaacaacaaaaaacctttttaacacaaaagaaaactaaaataatttgtcgctagcagacattccctaaagaatggctaaaggaggtttttcaaaaagaaaggaaaatataacaaaggattcttggaacatcaggaaaaaaatgaaaagagaagaaatatggataaatgtaatagactatccttatcaatttttgaaatgacatatgataattgacacaaaaattgtaataccatatgatactcaagacaatgatatttagaagtggggaagataaaggacccaaatagacataaggattacatatttcattatgagagtgaagatatttaagttgactgtggtaagtcacatatgtaaactataataccaagcaacgagtaagaaaattataaaaattaccttaaatgtaaatggttaaaatataacaaaagttagacgttggcagaatcaactgaaaaaaaataacacaacgagaaatttataagaaactcacttcaaaataaacataggcaggttaaaagtaaaaggatggaaaaaatacactctgcaaaaattaaatttgaaagaaagcagaatggctatctcataaaatagacttcagaacaaaaatactagaacagggacattacataatgatttaaaaaaaatcaccaggaagacataaatgtatatgcaagaaacaatacacccttaaaaaaatgaggcaaaaattgagacttctggtttccaatctgatatgacgttaagagtctggaagtcatcgctcccattctcacaacaagaaaaaagctgcactaactaaaaataaacagttcttcttacacagttaaagtcatagggcaaacattactcctaaagctgcagagacaagtgaaaacagcatcacagctaatggagccaaagcagatggtggagtctggtaaaagcacttagaatgtaactgactaattgatggatactgagcaaggacaagctacagagattgaaaactcctagagtgggggataggccttagagggtcaacacaccttcaagagttttatctccaggaagagccccatcaagttctcagaataaagataggaaaaaaaatgctcttatgtctccagtcctggggtcctaagacataaggggagggaaggagaaaacatttttgaaataagcgcagaacattatgttctctccttaacaacattctaatcccccaaaaagctagtttactagagcctaaaccacctaggggaatggaaatacccagcaccagccccctctacccttcttttcttacccaagggaaggggaaggaagctgagaagcactctgaaggtcacagtccaggaagacaggttctctaaaagactgacctaatcctaagagtacaggatgcttctggccgggcgcggtggctcacgcctgtaatcccagcactttgggaggccgaggcgggcagatcatgaggtcaggagatcgagaccatcctggctaacatggtgaaaccccgtatctactaaaaatagaaaaaaattagccgggcgtggtggcgggcgcctgtagtcccagctactcgggaggctgaggcgggagaatgacgtgaacccaggaggcggagcttgcagtgagctgagatggcgccactgcactccagcctgggctacagagcgagactctctcaaaaaaattaaaataaaataaaaacattaaaaaaaaatgagtatacgatgcttctcctcttcccgcaccttatcatcaatcacatcagtacattacctgtatagtaacaggagattaaaaatgaaagagctgtcaattttagaccctatttaagacagagtctctgggaaaactcaaaacggaagaaagaaaaataaaataaccttagaggaaattttggcctctgacaccacagttatgcaaagagcaaattcagcctaactactaactagataaacataaaaccttacattaaaggcttccttacctcagttcctttgccaatacaacatgtctggctttcaacagaaaattgcaaggtatgctaaagccaaacaatacagtcttatgagacaaatcaagcaaacatgcagatatgacagatttggaaatatcagataaagaatttgaaataataatcagtatgctaagggctctatgttgaaaaagtgggcaacatgcaagaagagataggtactataaacaaagatatgaaatttcaaagaatcagaaggaaatacagagattaaaagtaaaaattgtagagtgtctttgatggcctcatcaaagtctgggaagactgggaagtgctgaggaaagaatcagtgagtttgaagatacgtcaataaaatttttccattaaacacaaagagaaaaagaatgaaaaatgaaacataatatccaaactgttggacaataatttttttttttttttttttttgagatggagtctctctctgtcgcccaggctggagtgcagtggtgcaatctcggctcactgcaagctccgcctcctgggttcatgccattctcctgcctcagcctcccgagtagctgggactacaggcgcccgccaccacgcccggctaattttttgtatttttagtagagacgtggtttccccgtggtagccaggatggtctggatctcctgaacttgtgatccgcccgcctcggcctcccaaagtgctgggattacaggcaagtgagtcaccgcgcccgaccctgttggacaatttcaaacggtgtaacctatgtaacccataatcggaataccagaagtagaaggaagagagtgagaaccagaagaaatatttaaaataatgacagttgagaatgtttcaaaattaatgacagacatgaaaccataggttcaggaatctcagcaaacaccaagcaggttaaatacaaaaaaatccacacctaggcatctcatattcaaattgcaaaaaattgaagactttcttaaaattaaaataaaatcttttaaaaataaaatctcgaaataaaccagagtaaaataaaacaccttacctacataggagcaagaatgagaattatgccagatttcccttaaggaaccatgcaagcaagaagaaagtgaagtgaaatatttaaactgttgagagaaaacacacactaatataaaattctatatccagtaaaattatcctaaatagtaaagtagaaataaagacttagataaacagaattgaggaaatctttctccagtagacctaccttgcaagccatgttaatagaagttcctcagagaaaagaaaaacaatataggtcaaaaacacagaaatacataaagaaaggtaggagcattagagaagaaaaaatttaaaataaaatctagtgtcttcttcttaattgatgtaataggtaacagctctaaataatactaacaatgtattgggtgattatggcttatgaataagtaaaatgaatgataataatgtaatacaaaataagacagaaggattggaaatgctgtgttataaagtaccagcaccattaatgaagtggaatagtgttgtttgaaagtagattgttatagtgtatatttcatactcaaaggctaccactaaaacaatgaccaagaaatgtaattaatattctaggagaagtgaggatatggaatcatataaaatgctcaattaaaacaaaaaatgtgacaggggaattcaggaaaaaaagaagaaacaagggcaacaaataaaaaagagttacaatatggcaaatattaatccaagtatcaataatcactttaaatgtaaacagtctaaatataccaattaagaaagcaatggcaacaaaagccaaaattgacaaatgggatctaattaaactaaagaggttctgcacagcaaaagaaactaccatcagagtgaacaggcaacctatagaatgggagaaaatttttgaaatctacccatctgacaaagggctaatatccagaatctacacagaacttaaacaaatttacaagaaaaaatcaacctcatcaaaaagtgggcgaagtatatgaacagacacttctcaaaagaagacatttatgcagccaacagacacatgaaaaaatgctcatcatcactggccatcagagaaatgcaaatcaaaactacaatgagataccatttcacaccagttagaatgatgatcattaaaaagtcaggaaacaacaggtgcaggagaggatgtggagaaataggaacacttttacactgttggtgggactgtaaactagttcaaccattgtggaagacagtgttgcgattcctcatggatctagaactagaaataccatttgacccagccatcccattactaggtatatacccaaaggattataaatcatgctgctataaagacacatgcacacatatgtttactgaggcagtattcacaatagcaaagacttggaaccaacccaaatgtccatcaatgacagactggattaagaaaatgtggcacatatataccatggaatactatgcagccatgaaaaaggatgagttcatgtcctttgtagggccatggatgaagctggaaaccatcattctcagcaaactaccgcaaggacaaaaaaacaaacactgcatgttctcactcataggtgggaattgaacaatgagaacacttggacacaggaaggggaacatcacacactggggcctgtcatggggtggggggagaggggaggaatagcattaggagatatagctaatgtaaatgatgagttaatgggtgcagcacaccaacatggcacatggatacatatgtaacaaacctgcatgttgtgcacatgtaccctagaaattaaggtatgataataataaaataaaagactgagactgtcagagtaaacaacaacaacaaaacccatgatccacctacatgttgtctactgaaatcctctttaaatataaaatagcaggtagatttgaagagctagagaaagatataccatggtaacactaaccaaaaagaaagccagagtatctaaattaattttagacaaagccaactgcagagcaaggaaaattatcagagatgaaaaagggtattacacaataataaaggggtcaatataacaagaagatataataatgcttaatgtgtatatacctagcaacagaagagtcaaaatatattagggggaaactgatagaactgcaaggacagagagacacatccattattaccactggagacttcaacacccctctatgagtaagtgacagactcagcaggaagaaaatcattaaggatagatttgaactgaacagcaccatcaatcaactggatctaactgaatactttagaattcaattagcgttgtagaatattttatctagacactgcagaatacacattcttctcaaatacaaatgcacaattcattaagttaaaccacattctaggccacagaacactttaccaaatttaaaagaatagaaatcacaaaaggcatgttcttgaattagaatggaattaaactaataatagcagaaagagagctgaaatatcctcaaataccaaaaaatttaaaaacacatttctaaataataaaacatggtgaaagagaaagtctcgagagaaacaaaattttttaactaagccagtaattaataaccttcccaaacagaaggtaccaagcccagatgattcactggtgagttctatcaacactggagaaataaatgataccaattttccacaatctgttgcagaaaatagaagcagagtgactatttcttaactcattccatgggccagcattaccctaatacccaaaccagcaaaaccttacaaaaaagtaaactgcaaacaaatatctctcttgaacatggatgaagcaatccttaaaaaatattagcaaattgaaccaaacaatttttaaaaatgaacaccacaaccaagtgggatttactctagatatgcctttaacatttgaaaattaattaatatagtccatcagatcaacaagctaaagaataaaaatcatatgcttccagtactttctgctcaatttctatgtaaacttaaaattgctaaaaaatataaagcctattaatataagaaaactgatggagcagaatggaaaaataaacagatccacaattatagtacagatttcaaaatgtctctcttagcaactgacagaactactggacaagaagtcagcaaggatatacaagatctgaacaacataatcaaacaacaggatctcactgaaatacatacagaatactccacttaagaatagcagaatatacatttttttttcaaatgccgatgaaacatttacaagacagaccatatcccggcgagccaaacaaacctcaacatatttaaaagaactaaaatcatacaaagtatattctctaagcataatggaatcaaactggaaatcaataccagaaagagaaaaagaaaatctctaaacacttagaaatttttaaaaatacacttctaaataagctacaggtcaaagaatatgcttcaaagaaatttattaaaatacttaaatgaaaatgaaactacatgaaaaactaagtgaaaatgagaatacaacatatcaaaatatgtgaaatgtaggtaaaactgtgttgatagggaaaacgtagcactaaatgcctacattaggaaagaagaaagccctaaagccaataatgtaagttcttacctctagaaactagaaaacaaaattaactcatacaagctgaaggaaggagataacaaagagaagagcagatttcaatagaatttgaaacaaaaataatagagaaaatcatgaatcgaaaatctagttctaaaaaacagtaagattgaaaaacttctatcaagactgacagagacaaaaacagatgagacaaactatgaatatgagaaatttaagtggatatcactacagatgctggagacatcaaacaaataataagaaaatactataaataattctacacaaatcaacttgacaattcagattaatggacaaatttctcaaaaagtacaaactaccacaattcacctaacattaaataggtaatttaagtaattgtaactattaagaaaattgaattcataatttaaaattactgaaaaaaaaatctcttggcccagatggttttactggagaattctttttgttttgttttgtttttggtttttatttttgagatgaaatctcgttctgttgcccaggctggagtgcagtggtgtgatcttggctcactgcaacctctgcctcccaagttcaagcgattctcctgcctcagcctcctgagtagctgggattataggtgtgcgccaccacgcccaactaatttttgtatttttagtggagacggggtttcaccatgttggccaggcaggtctcgaactcctgacctcaaatgatccatctgcctcagcctcccacagtgctgggatcacaggcgtgagccaccctgccgggccttactggagaattctaccaaatgtttaaataaaaattaaagtcaattttacataatctcttccagaaaacaggagactagagaatgttaccaaattcattttatgtaggcagtattgtcctgatactgaaaccagataaagacaatatgaaaaaagaaaactacatatcaatatctcttatgaatttgaatgcaaaaatattcaataaaatattaataaatgaaacacattagaaatgtattttttaaattatacattatggcaaaatgggagttgctctagttatgcaaagctgattcaacatatcaacagacaaaagaagaaatataatattttaataccaattgacacagaaaagacatttgacaaaaatccaatgtcctttcaaaataaaaactgtcagccaaccaggaataaaagggaactacctccacataacataggaaacaagaatgaatgcttttcccctaagacaggaaacaaggcaaggatgtctgccctcaccactctagttcaacctaggattgaaagtctagctactgcaataaagcaagaaaaataaattaactccctacagattgacgaggcagaaataaagctgactctacttgcagatgacatgattttccatatagaaaatcccaaggaaactaaaaaaaaattaagttcaaaaaagagcttataagattagtatgaaacaatcatatttcatattctaacaagaaacatgtaaacaaaaatgtaaagcacaacagcacttataatcaatcaagaaactaactaaatgcctaagcatacttataaaacatataatctctggatgctaagaattacaaaatgctgaggcaagaaatcaaagatccaaataaatggaaagatatctcatgttcatggattggaagactcaaaacagtgaaacaccaattttcccttcattgagctattatgtttaatgtcattcccataaaaattctagcaagatgtttgtagacataaacaaatttattacaaaatttatacagaatgaggcaagctacagacttacttaaacaatcttgaaaaagaagaataaagcaggaggaataactcaaccctgctatacagctaccatgttcaagacagtgtgatattggtggaggcatataaattaatgaaacagataaagaatgcagaaacagacccaccacacaagtaagttcaaccaatttttaacaatatttaaaatgcaattcaatgcaggaaggatagccttttcaacaaatggttctggagcaactgaacattcatagtcagagagagtgagagagaatcaactctcacatcttatataaaatgtgtcccaaaatagggcatggaattaaaagtaaaaggtaaaactagaaaacttttaggaaaaaaattcaaaaatctttggaattggaatttagggttaggtaaagaatttttagaattgacacgatgtgtacaacccataaaaggaaaatatgataaactgaatctcatcaaaattaaaacttttgctctaaaaaattccagttaagagtcgatgaataggcaagcaacagagtgggaaaaaatatttgcaaatcacatatccagcaaagggctagtatctagaatgtataaagaactgaaaattcaacagtaacaaaacaaatccaaacaatccaattagaaaatgaacaacaacaaaaacacattcacagacatctatctcactgaaaacgatatacagatggcaaataagcatataaaacatgctcaatattattagacatcagggagacacaaattaaaaccacaataaagatattactacacagttatcagaatagcttaaataaaaaatagtcacaacaccaaatgctgatgagcatgtggaggaaatgaaatcatacactgttggtgggaatggtacaaccattctagaaaacaatttggcagctttttataaaactaagtatgcaattaccatatatgacccaccaattgcactttggggcattaattccagagaaatgaaaactgatgttcacacaaaacctgtacacaatgttcataaaagctttattcataattgccccaaactgtaaacaaacaacccagatgcccttcaatgagtgaataaactctggtatatccatgccaccgattgctaatcagcaatgaaaaggaacaaattactgatatacacaattatgcaaatgaatctagagaggattacacagagtgaaaaaaactcaaccacaaagagtacatactatataatttcatttacataacattcttgaaatttaaaaaaacccatagaaatggagaacatactagtggttattaacgagcaataggaggaattcttttttttttttttttttttttgagatggaacggagtcttgctctgtcgcccaggctggagtgcagtggcgccatctcggctcactgcaagctccacctcctgggttcacgccattctcctgcctcagcctcccaagtagctgggactacaggcacctgccaccaagcctggctacttttttgtatttttagtagagacggtgtttcatcatgttagccaggatggtctgatttcctgacctcgtgatccgcccgcctcggcctcccgaagtgttgggattacaggcatgagccaccgtgcccggccaataggaggaattcttgtgctgatggaaatactgtgtatcttgactgtatggatgtcaagattccggctgtgatattgcactatacttctacaagatgtcaccttggggtgggggaactgcttaacggctactcgggttctctctgttacttctcacaagtgtatgtaaatctacaattatctcaaatttttttttaaattatcttttcaaaagaggagaaatagggaaattctcactgatgggagtagaatattccatttcttgtgttattttagcccctagcccagtagtttccaaaagatcacctggggattttttttttaaacaattccaaagccaaggctacacttcattcaacagcaatgaactaacaaataattaagttttgtaatgccaactttaaaaaactggagaactgggaaggagagtttcttacttactgaacttatgtaagctatctcatttataaaagaaaccccatgagatcaatactacagggtccatttcatcaaagaggaaacaaagtctgagaaagattaaggaatggcctaaatttccacagctgctaagtgacagacttaccacttgaacttcaaactttgaatgcaaccagacctttgctctttctactagaccaaattggctggcaggcatccaggggagagagggatcaccctgggaagggacccagatgccgactgcacaggtctagcacagtgggtaagatttaagagtgtgagggccgggcgcggtggctcacgcctgtaatcccaacactttgggaggctgaggcgggcggatcacctgaggtcaggagttcaagaacagcctgaccaacacggtgaaaccccgtctctactaaaaatacaaaaattagccgggcatggcggcacccgcctgtattctcagctattcgggaggctgaggcaggagaatcgcttgaatccgggaggggagggggttgcagtgagcaaagatcgtgccactgcactccagcctgggtgacagagaggccaatccaggcagaggaaatggtctggcatattccaggggctgattggccagacagattagggaaggcaatgcaggtatgggttagcggatcagcgcaaaccaccttcagatgacagtcatacaccactttccaacttaaagattttgtattgaaaattaaagagtgaaatttaatttaagtggctttattatgctaccgacatatactgtttttgtttttttaagacaaggtgttgctctgctgcccaagctggaggcagtgaagcaatcacagctcactgcagcctggacttcctgggctccagtgatcctcccgcctatatactatttgggattgctaaaactaaaaaaagaaaggcaaatttcagtatttaactataattagcaataaagtgctttcaagaaactatatggaaactgttggagagcagcagtgagtcctgcaggggacttgtggggattccggaaaggagggggaagttggtctttaacttaggagaagatggttttgatgcaggcagagtttccaaaacattacttccatatatgaagattaaggtatacatttctcaagatataatttcaaaaaaatgagacacccactgacaaaaggttttaataaccctagtcattatttcatcctagaccacagtgaaagtggcggggctgaggaagggcatattcagttaatctaaagggaggaaacaaacgttccaggtagatttagaggaagactttgaccagagtaaggtggttaccggttcccactggtcttcatgaagaattgttagacccagcctgccctacagccattatctcctcagtgtgaacggaaagctaaggcataagttatcagcaaaatttcccttgattaagaaaggacaagtcactagtcctgcatatgaacgcgctgaacgtctctcaacggtcaggaaggcgctcttgaatgctctttggtccaaccaagagcgggaagagaaggagagagtggtcagggctttgaactaagagccacgggagggaccctggccttttctccctcaaacgcatctcgcagcccgagggccgcgccccggccccgtgaacccctgtagcctccaggagtggcgcttacctcgtgagtccgggcgccgcgccgtcccgcagcgcagagccagccgctgctcgcagcgctccgccaggttcaccgcggaccgcagctgccccgcgcccgctgcgtacgcgaaggacacagccgagcgcgggtgcccgctgggggcacctcggagggtcaccgcgtcggggccaccgtgctgcaccaccgtccacgcggcgtctgctgagcagaaacgggcaaaggagaggcatcactggacggcagaggccagcagcaagaggcaaagcagacctgtcttttatgtgaattaacgtttaattgaaatttacattactgcatgtttgccgcgatttgaggagttggacctgtgtaacaatgtactgagccagaactcagcctctaagagaaagcatattggaagaactgatgaccaaacttttgtgacgtcacgcctaaaagtgtatcatgtaagcaatgactttttagttgttaaaaccatttttttatatcaacacaagcatggggccaaactgttactacctggacctttatctttttaaactcatctgcattttcctcatctgtatgtgcctctatttctttcattatcgaataaatttataaaagatacatattgggacgatgtgacgcacatactcacaggtatgataggaagcagctctattaaaataaagtggtttaattatgtcagcttatccatcagtgaccaagcccagaggaatcagaggccttgagcttctaacagcactttccaggcggtgaccctgagcatctgactgcctgctgacatcatttctgatgtatctctgtcacttgattacttatattgttttgatgaaataaaaacaaaatgactccacaatctcaaaagggaagaagtgcatcttgagttctttagtgttcccaaaaatggacctcccaccagacttgaagtcactttaattctactatgctggtgctgtctggtcctttaacctctaataagatgtatttagaataatggacattttacataaaaattttccgaactggagaaatgaagaaacattcgtatggggattttttaagaactacgaaacaaaacaatgtgatacattttaccttgagaaatcaccctgccagcccttcacatctcaggatttctaatggcttggctgctaactgtgcgtaagacaaatttcacagccttactgttacttacacacgcctaacaacagagatcagaggaaagaaggaaaagaaaaccagccatgctactgaaatatctctttagtcacagaacccatggagaggaaaggtgtgatatccacaaatgagccacaagtacagaaaaaaatctgcaaatttaaataatgaatgcaattttaaattaaattatcactccactcactgtactcaccaaaggaggctctaagtgtgcctatggtaatttcaattccatgggttcttcctttaatattgctctattttttttattttagattttttatttaatttatttatttttgagataagagtctcgctctgttgcccaggctggagtgcagtggcgctatctcagctcactgcagcctctgcctcctgggttcaagcagttctcctgtctcagcctcccaagtagctgggactacaggcacacaccaccacacctggctaatttttgtatttttttagtagagacgggggtttcaccatgttggccaggctggtcttgaactcccaacctcaggtgatccacccaccttggcctcccaaagtgctgggattacaggtgtgagccaccacgcctggcctcattttagaatttttacaacctggtgttactctgtgcacatcacctactctcaccttcagagttttcctatcaactgaatcaaatatagaaaaacctatggaacactaagttgggcattgaagatgatcaaccacatgccatttttggccatgtgttcatgatttgttgtacaatgggagagaaatgatggtccagagtagttcacataggccggtgggcagtatgatagatttgcagtcacccatggttaagatgtgatcacagaaatgccctcagtactgagaagggaactgttcagaatacatctgtaaaacttgtttttctgaagagtagaatagtaaccagggacattataggctatgcatttgtgtttataaaattccacttgactcacttctccttataatatcagtagtaaaacacccaaagaaggacatagaccattgtggtttccttaattgctcataatttatttcaattgattataagcatattggaactggaaaggatcttaaagagcatctaatataacccttatatttttctttttcttttttattagagatagggtctccctctgttgcccagcttggagtgcagtggcaccttcatagtttactgcagcctcgacctcctgggctcaagtgaattggacctgagtagattaattataacagtggctaaatgtggaaaggggatcagaggtgtggctgagtctgaacacactggaggctgtctcactagcccagaaggagggtaactgtaacacgttgatccctgttccactcctgttgctcaaataaatatccgactttgaaaattaagctaatttaacttcatgattttgattggaattaacagtacagatgttcctcaatttatgatgaagttgcatccagatgaacttattataaattaaaaatgcactttaatacatgtgacctactgaacctagctcaacccagcctaacttaaatgtgctcagaacacttaaatcagcctacagttgggcaaaatcatctaacacaatgcctattttataataaagtgttgaatatctcatgtcatttattaactactgtactgagagtaaaaaagaaaataataataatggttgtggccaggcatggtggctcacgcctgtaatcccagcactttgggaggccgaggcaggcagattacgaggtcaggagatcgagaccatcctggctaacatggtaaaaccctatctctactaaaaatacaaaaaattagccgggcgtggtggcacgtgcctgtagtcccagctaccggggaggccgaggcagaagaatcgcttgaacctgggaggtggaggttgcagtgagccgagatcgtgccactgtactccagcctgggtgacagagcaagcctctgtctcaaaataataataataataataataataataataataaaaataatagttgtatgggtacttgaaatagggatgcatatggtttcacatagtgaagtcgcaatattgtaagtagaaccattgtaaacggggattgtctgcacttaaaatttacttagtatatcatatgaaatccccagcatctggtatacccattcctatatgtcccagaagaagaaagaaaataagatccactgttctgttgtcaggagcatacatattaaggttatctcttttagagaactgaccctttcatttgtctgagaaaatctttatttcttcacttttcaaggagaaggttttgttttgttttgttttctctctttcacactttaagtatctcactccattcttgctggcatgatttctgaagagaagtcgctgtaatacttatctcctatgtaggtaaggtgctttcttcctctgattatttttaagaatttacttttacctggcctgggcacggtggctcatgcctgtaatcccagcactttgggaggctgaggtgggtggatcaccttagttcgggagttcaagaccagctttaccaacatggagaaaccctgtctgtactaaaaatacaaaaattagccaggcatggtgtcacatgcccataatcccagctactcaggaggctgaggcaggagaatcacctgaacccagtaggcggagttgtggtgagccaagatcgtaccattgcactccagcctgggcaatgagagtaaaactccatctcaaaaaaaggagtttacttttatctttgaattctatagtttgaaaatataagcctggtagagttttgggggcatttctccttctttggtgttctctaaacttcctggatttgtggtttggtgtctgatactaatttgtgggaattctcagtcattatttcttcaaatatgcttctgttcctttctttctttcttctcctagaattctctttacacgtatgttacaccttttgtagttgtgccactgtactcagatattatgttctgggttttctttttgcggggggttgggttcagtctttttttctctttgcttttcagttttgcaagtttctattgaggtatctctaagcttagggattctttccaaagctgtgcctggtctactaataagcccatcaaaggcattcttcatttctgttatgctgtttttgatctctagcactcctttttgcttcttagaatttccatcttgctgtttacattgttcatctggtcttgcatgctatctattttatccattacagctttttccatattaattatagttgtttaaagtcctggtctgataattccaatgtccctgccatatctgactctggtttttgtttgttttgttttttggtttttttgagacaaagtcttgctctgtcacccaggctggagttcagtggcatgatctcagctcactgcatgctccgcctcccggattcatgccattcttctgcctcagcctcccgagtagctgggactacaggcacccgccactatgcccagctaattttttttgtatttttagtagagacagggtttcaccgtgttagccaggatggtctcgatctcctgacctcgtgatccacctgcctcagcctcccacagtgctgggattacaggcgtgagccaccgtctgtttttaatgcttgctctgtctcttcaaagtgtgttttttgccttgaaattttttctttttctttttttggagacaaggtctttctctgttgcccaggctagagtgcagtggtgtgaccatggctcactgcagtctccaactcccaggctcaagcgatcctcccacctcagcctcccaagtagctgggactacagatacatgtcaccatgctgttttttgttgttgttgttgtcacaatgctgttttttgttgttgttgttgttgtagaggtgggggtctcactgtgttgcccagactggtcttaaaactggtctcaggctatcttccctcctcagcttctcaaaaagtaataggattataggtccagctgaaattttttcttgataaccagatgtgatgtaccaggtaaaagtaactgtaactgctgtaaagaggcctgcagtactataagtaacatgtgtgggaaggggaaaggttctatagccctgtgattaggtctgagtcctttagggagccttagcctctgggctgtgaccttcacaagagcttctcagccctccctcccatcaccacccttacttggggacaggatggccagaggtgggtaatttccttcctccaggcaggttaggctctgaaaacaaaaaacaaaacaaaacaaaacaaaacaagaaaacaaaacaccagtagcttaggtgaaatatttgcccttgaggaaagaccttgttaagaagaacagaaagctctggtgtacttcaagatggttccttttcaccttccctttctggaagcatgaggagatttttctccaacattcactgtgagaacctggtcaagctaggtgtcaaactcacagaagtgtggggacccttctctgtctgggtcttcctggagtttttaactctcagatgtgtccacatcgaacatccaacaattcgtcaattaagtttaggttttcctaccttgacaacggtttccccaaaggttagtgcttgtggaagaaaattgtcattctgtatataagcctgcctgtctctccaattttgaggggcagtggtttgttctgtgacctcacttctctgctggatctaaaaaaattggttgatttttcagtttgcctggctttttacttgttcttaagacagagtgctgacttccaagctctgaagcaactgctttttgaaggttattaccatatatacatttcaagctattagagtagtttgaaattgcacattttataatcattattgcttgatttgtacaactagagaatttattactggctatagcgcaatggggcatctaaagagaaggtgacattttctagggcagaaaagagaccagagtttagtgattcccctatcattagctagattttgtcagtagatacttccctaaccaacttttctgagccttggtttcctcatcttaaaatgatgacaaccaaggtccttcctggttgtgactttggttgagtcttttgatatccaccaagaccatttttatgggatttctcactttgctttcattgtttgagtcaggggattttggaggtaattggtatcttatggcagaacgcctgtgtttctttatcttcagcacattgctgtgcaggtggctctgaatcttctgaacgtcccctgtaaagttttactactttttggcaatctttgctaaggcactttaaatgcccatgtaatttcagttatttgtttctttttccttgatgcttgctgacccatttggttattgtccaaatttatgaaacttttgaaaccttttgtcagcacaataaatgagaacagtttattccagatttccactttgcagagagttggaagagctaggtgacaacaaatttctgtaaaaatgtaactatttaaaaggcattctagtgcaatcttctataatcaagctgtgttcatttctttttttcctttttttttttttttgagatgcagtcttgctctgtcgtcaggctggagtgcaatggcgcaaccttggctcactgcaacctctgcctccctggttcaagggattctcctgcctcagcctcccaagtagctgggactacaggcgcgggtgccaccatgcccagctaatttttgtatttttagtagagatggggtttcaccacgttggccaggatggtctcaatctctggatctcgtgatctgcccgccttggcctcccaaagtgctgagattacaggcgtgagccaccatgcccagcccaagcagtgttcatttctaatatctaaagcacgagaaataatcaagtttctttggttatgaaaaaattatatgccataaaaatcactaaattatttaagatgcacatagaacattaacatatctatgttatttcttagcacttttaaagacctctgttttttctaaatacagaaagcatgtaaattaccgaatcagaggtttgtatttttcatgatgcacatgaacagatgtattacgaagagtgtaggagctagagagatgccttggcagagcactgaatctttcctataatccaacccaggcaaacaagaaatacaagaaaattttgttgacaacaaaattaataaatatatatttaatgcttctacttagcaagtacacactatcaaactgcatgttttaataatgctgccaactaggtaaatttctccttggtctattctgatatatgcatataacgattatcaacatacctgtcatattgcagtacacaagaaatggtcccagggggccacttccatctgcatcaatatagtaaagcccagacgggttccctcggtgcttgtgggcttcacaagactgctcgtagagagctgtaggagaacaccagccataagaaccagaaaaaatatctccagatgttgagtcagtgtccaaaggtttgcatttctgaattacagacatgtgatacatatgacccaacatcattttgatagtgtatgacagtatatttgatgagatgcaaaaaaatgacatttaaaaaattaaatctatttttattaacaaaggagaaaaaaattacctagtcaaaatacattcaaatgttggatgttgttagatgctgaataaatatttggtcacagtgtatttctattttgaggaagaaggaaagattgtgttggtgttcaaacatgaagatgtgcttacagtgggaatgcgatactatcttcaatagacaatcttttggcaatgtctagagactgtagtttctctacataaatgttttcttttgcttttaggcaagaaagcatgcaaactctgaagcacagtgtaaaacacttgaagagatatgagaggaaaactttgtgaatctgaattctgcgtgctattgaaacatggttcttttcaaactcatggcaactatacctcagaattaaactctataattaaggaagaaaccctcattcaccctgtaataactgaatacctgagcacattaaactgcctaaataatctggtattttcccataagcattctgtaaagtttttcttaagctatgcggcagttataccctttgcttcctttaaaacaatatgaatgagcattttaaagagataaatagaatttataagctatcaacatctcatcattaaaaaataattaaagctgatttaaaaaagaaacttccctaagtattttgcaagtgacaattcaagacagctgaaattcaaaacaggagagaaacttttttgaaagatatccctatataatgtaaatttactctagcataattgaatattttcatttgtgcaagcaaatgttttaccaagtacaaggtatggaattaatatctgcaggagatggacattgctaatctttatttttttgccacttatggcatattgatttaaatagatacatatatttgtatatgtctggtaggattcactcaaattaataacaatacttaaatatagggcacagactaggtttggaatggagacaaatattgaggaaagtgactagaatttgtgctttatgtgaattttttggctttttaaatgataatgtacacatgtattaatgtatagtatatatcaattgaatacaattaatgagttatatacaattaataattatatacaattaattagttgcacataattgatacatgttatacaattagaaatacaaaataacctattcaactaggtgtggcagtctagtctcacagtgaatgactgtggacttggcaaatttctacctatagccgtcaactattagatgagactgacacttgaaatactttttcaatctcctgatattttccctcagaagtttttggagttatattttgattgcagtgaataaccatggactaatataactcattgattaattgcaacattaaatgcaatcagatgatgctgagtgtggtggtggatataaatttgccaggtaacacacaagattaggcttctgcttttaggtaagatactatgcctggaggatgaaagatacacagaagtaaaagatgtactccctgcaccaactctatgaccttatcaagacattcaacctctggtgtgagaggccactcaactcctagaaaatgtgtcacagcggctgggcatggtggctcatgcctgtaatcccagcactttggaagtccaaggcaggtggatcacaaggtcaggagatcgagaccatcccggctaacatggcaaaaccccgtctctactaaaaatacaaaaaattagccaggtgtggtggtgggctcctgtagtcccagctactcgggaggctgaggcaggagaatggcgtgaacccgggaggcagaacttgcagtgagctgagatcatgccactgggctccagcctgggcgacagagcaagactccgtctcaaaaaaaaaaaaaaaagaaaatgtgtcacggctttataaacagggacccttctagtacaaaaatcatacttcatgcttcaatctgtgagagtcactcctggactgtctcctcttttgcccagatcctttacagaacctcaggactgggagcgcagaattctcattccatgtatgaactgtggttttaacactccacagcctgcctttctcctgtggcttttgtgaaaatcaaatgtctcacggaagagttcttaaaagtttcaattaggaactcaggatgagcaagtggaactgaggactttgcatctctgtttccttgaagacccagggatgggcgaaatattcctgaggagaagttgctcagaaacgtcagtagagatatacagaaagaaaactttaaaagttaaaaacaaataggaaaaaaaaggcttttcagattctgtgatgttctaattataacaggttagaggtcaataaaatggcatggcctttgaaattcagagggtgattcttcagtaaagacagatgatttttaatatggcagaggcagttgagaagtgttagaatatgccatcccttagacattgttcttacacttaaatgtctaccagaagcatgaggaaggttggttacaagagactcggggccccatctccagcgattctgatttagtaagtttgggtaaggcctgagagtctttacttgcaacaggctcccaggggctgtgggtgctgctggtgcatggaccaccaatcaggcatcctggagccaaggctgtggagccaacctccttagctcaactcctcatcttcccacaaactagctgggggccaagttacttaacctctttctgtcctcaactctgcaatgaagataataagagtactttcttcctggagcttctttagggttaaatgagttaatatatgcaaagcaatagcagagggctgacataagtactcaatacattaatacttttacacttattcactttacaatcatcatcaccaccaccaaagaaaatcacagtcattgtaagagatcttaaaggtcctctagtttctagctgatatcccattacctcttcaaaaatcttaccatgtacaatcccatgattgcatcatcccagtgattgttaaaaaatctttaaataccttaaatgtagcattgacagcctggcaaggggttgtttttccacctttctttgactgagaagattctcagaattaaaagtatggtccaactcaagtaatggaacaagctgttacatcatgcatttttaatttaatttagtttctaccttttactatatctgattctcctagacttatttccccattgcttgccagtttctttttttcaatcctatgcgtaccacgtatttctgtgcactgtctcaacaccttgtattaaataaggtggattaaaagtaaactagaaattgagtgctgaaatatctcttctgatgtgtttgcatgattgcaaatatgcagatacatataaacaactaatcaaaatgaaatgacaaagagatgctgacagaaacgagagggaggcgtgaggcttacaggaatggcaggtctcgcccgtatagcctgtgcctagacagtcacaggagaaggtgtcccacgactgggaacactcgcccccatgctcacagtagctgggcaagcacctaaaagaaaacagatacaactgctgtttccctttttcaatcatcaaaaaataagtgtcttaccaaaaacaggttaaccaaaaacaggttaatgtgaaagagcagcatatgcaagataaccccacatgacgtgattactgggtctgccatcaaggttctctaattatattgacaaactttagataaatatatccattagcatgcagctgattattaggtttctgagacagctgaattttcaacacatttctttttttctttgtcccaagtgacacaataacttgacatgtggctagcaaaaccaattacatacataaaactatgaaatatggcatgctccgttactatattgtggtcatttttaaaagaaagaaggggaaacagggaggaagatacagaggggagaagaaagaaacaggaacagcttcagtcacatagtgacagaggttcagaaattttgaagaacatttaatttaggtcatcttgtcaccttttagatttgcaataagcagtcggttattgctttttaagcaatcttaacactggtaatatgtcaatatgacccaaagcaatccacaaattcaatacaattcttattaaaatcccaatgcctttttttgcagaaaacaaaaatccatcctaaaattcatagggaacctcaagggaccctgaactagccaaaacaatcttgaaaaagaacagttggaggtctcacactttcagaattcttggaatctgctgccgcccactataatattgggggcctagcatgcctgcctctcaggattgttaggggaacagggagcagggtacactatggaaactgaccagcacctgacacagagtgtcaccaagaggtagtgtgaccttctggaggcctggcctgaataccatgacccacctctgccttgagcagggttggatctcagcctctggccgctgtctcccactgctgagtacacagctaaggacctggtaaagagtgaagattctaaaggacactgaccttccaggccgtgagggacatcatagtccatgctggagcggcagaggcggggagcacccaagtgcccctcaccatgggacccagagaagtaacagaagaggggccgggaggttgtgacaggcctcctggctgtggtggaaggacgaccagcagagaactggggtatgaagttgacagaaagccccaggggcctgtatttggcctcgggagaggtcctttgaggggaacctgaggggctgggaagaatccgcagcattccctaccctccccatgcccccagccccctatcctggctctccagcactgcaccaccagctcagggccaagacttccataattacatggtgttaatgagcatttagtctgcattcagagaagagttaggggccatgagaatcacaacttttcaagtatttcaaaggccaaggcatggaaaagcctgtgtgaactgatcagaagaggggcagttggagtgacaggcaaggttggctggggtgggggcccaccctcataccatttttaaaagagcagctgttcctcttcccccacatccttctccctctcctccccttccttcttaatataatggagcatcttaagatcatacctgacttgaagattccacaaattttaaaaaacattaaaaaccactgctgtttgatatcaacagggagagaataactttagttcaaaatatttggaaataagaactatttaagtgatctagagactaccaacaagtatacactatttttcttcaactaaacacaacatgaattgtgaaaaatttacacgtagtacaaataatagaggaagtagctagcatgcagaagaccaacagaggggaagatggcagagggagggcaggagtggggtcagcagcctggtcagcacagccaggtgaggaggtgacggaggcctccctgctcagggagccccagttggaatgcagcacaggactccattggaagctctgccatgtggtatacagggcaaaccttaaaagagtacagcagtctgatgtaagaggtgattaagaagttaaaacctatcctggccgggtgtggtggctcacgcctgtaatcccagcactttgggaagctgacgcgggtggatgacgaggtcaggagatcgagaccatcctggctaacacggtgaaaccccgtctttactaaaaatacaaaaaattagccaggtgtggtggcgggcgcctgtagttccagctactcgggaggctgaggcacgagaatggcatgaacccaggaggcggagcttgcagtgagccgagatcgtgccactgcactccagcctgggcgacagagcgagactccgtctcaaaaaaacaaacaagcaaacaaacaaacacctatccaaacataaacatccattatttgtgactctgtcatccaaagtgcccattgctattttttgtgtagcttaaaattttgactaaaaaagataacttcataccccttatctgtccctaagtaggatttttaggtctggtatttgagtaacatatgtttctactttgtgaattagtgatacggtttggctgtgtccccacccaaatctcatcttgaattgtagttctcataattcccaccgtgtcatgggagggaacctgtgggaggtaactgaatcatgtgggcagatctttctcatgctgttctcatgatagtgaataagtctcacgagagctgatggttttataaaggggagtttccctgcacaggttctcttgcatgctgccatgtaagacgtgtcttgattctccttcaccttctgctatcattgtgaggcctccccagccatgtggaactgtgaatccattaagccttttttctttataaattacccagtcttgggtatatctttattagcagcatgagaacagactaatacaattagatttttgtttgtttgttaacaacaacaaagaaaggctgacatgcttacaggcctgttttcaggatacttaaaagtgaattttcagtattttcaggttttcaaaacttaatgtaaagggaacagcaaaggtatttaattttaactctgtagaatgtcattttgtgtccccaaagttttctaattttattgctttataaaattcaggttttcaaaataatctcagaggagctagtcttctacgttactgactttgggaatgaaatagtaaatagcctttatttgtagccctatttgaaaataatttaaaagtgctttcttaaaacccttatctgcaatgattattgtacacatcatgactgaagtttaagtgtggctcacacatacatgcttagttgagcatgtttacaagtaactttggggtacaatttggaggcctttttaaaatgtgggatcttagagaccaagttaggcaccaatgtaactcttgggactttaaggttaaaacaaaacagcctataacagtaaaaacaatagttttgtactttaggagctacatgcacaaagcaggcaacatggatcatctctgaaaagaggcagcctcacgatatatatctcataacagaaacactgcaaatggatcatattttgtgagtaattaacaaggtatcaaaataatgtcatacaagtgaagaaaatcacacttgcatcacagttgagctgacagctcttgtcactcacagtgtgggcccatgggacattaccccttaactcagagagagctgagctccctggctagttagctgagcaacttgggattatattaagtgagcaaatggccagaaaccttcccaactacccttcccacgactacagagtggggttctggagctggtgttgagatataaatgcagtcccagctgtgtgccaagaattcaaatctcaaggtcaagaatgagaggtacttgacaaattcttgcacttcatatactcctcatctttgaattaattcatttttcctacaaatcaacagaatgttcacagggggaaattattccatgctgaataaatacagtccatatgaatgaacttttcatttagtagtaattacgtttttttagtatgtcactaactatgagttataaattaaaacctgtttagccagagaggataattttacagttaatgtttaaaacagaattgactaactgaatttactccatgaagaaggcaggttttgaaagttctaccagatgcagatataactttttttttttttttttttgagaagagtctggctctgtcacccaggctggagtgcagtggcacgatctcattcactgcaagctccgcctccacggttcacgccattctcctgcctcagcctgccgagtagctggaactacaggcgcccgccaccatgcctggctaattttttgcatttttagtagagacggggtttcaccatgttagccaggatggtctcgatctcctgacctcatgatccgctctcctcggcctcccaaagagctgggattacaggcgtgagccacggcgccgggccagattatcactttttaatttttaaatctgtagcatttatttattcactgaaagtaaataccaaatgtactagggcaaactgtatgtagaaatattatttttccaggtgtgaccctatgattcttctcagccaaaatctttgtaaaattatggcacagctagcataactgtggttgtaatacttatttgaattaaatgtttttcttgtctaacctccatatttcattatgtccttctgcacacatcttcatccatctttatgattcaaacttttctagcagaaattactttttattttctctgcagaacatgtggggttgggtggctgatgaatagtaacctggcaaattcctctgcctggaaaaacatcatccaactgatgggtgtggggttgcaaaagcgagcttgataactattagctgagcaacttgggatcatattaaggtaaaattcataaggtgtatgtcttctaataaaatactatcatttaaaaaatgctatttattccattagagatgcagtttttgtttttgtttttttttttgagacgcagtctcgctctgtcgcccaggctggagtgcagtggcgcgatctctgctcactgcaagctccacctcccgggttcacgccattctcctgcctcagcctccccagtagctgggactacaggtggccgccaccacgcctggctaatttttttttttttgtatttttagtagagacggggtttcaccatgttagccaggatgaagttgatctcctgatctcgtgatccgccagcctcagccgcattacaggtgtgagccaccgcgcccggccaagatgaagttttctaatcctcatagtaattatgactatttcattccctctcgaaagataacaacaacaaaaaagagaacggaatgcctttttccagctgtctacatttgctttcttcaactttgaaaacaggcaagctaaagtgacctaggatggcccttacctgtctgtgatgccgcaggagtctatctggaggtccctgaaactccccagcgccccctgctgtactaagatgggatccaccgctttgtcaccaatggtgatgagccttaggcagccctgaaaccctcccagggggcttttacatccagagccagagctgttgtccaggcagcctaaatatgaagacaaaaataggacaaaagcaacaactatgacaaaactattccacagtatttactatatgaagactgctgctcccgcttgtttatggacatcggtatgatgcgatgagcttcaccattcattagagaggtgagaaggggcaaggttagaactgatcaaatttaagataatacctggaattcagaataagaaattatgggggaaaattcagatctaaaattcctataacaggaattatttcccaaccaagtgaaaagaggtttggcttcttttgtgaaatctcatctaagaaataatcatgcattttagcattatgtagtgtaagtgaaaaaaattaaagtggaggttaaattaaaataaatgaaatcataggccaaattttatttaggatatgctgtgaaatgtgaaaaatgctacctgaaaatataattgtgtactaccatttatctaaaatatgttaaatatctaccctataggtgtttttgtgtgttgcgatgtatgtatatttgggagtatttaaaaacgtatttttttatactgactgggtggaaatacctagatttgcttttctagtaacactttctttggtattaggtactttagtcaaatatataactaaagattaaattctaatgttaacaacaacacaaaaagtaacaggacctaacacactgttagggtacataaggataaaaatttgcagtccagaatgttctatgaatagaaagagataaaatagacatttgattatttccaatattagaagttaaatattaaaagtttcactacaaccgtcagctaatttcacctaaattacaaatggcaatgcttatgacatcacttccctttactatgtgggcttgttttgtgaaacaagaacagtacttataagaagcagtggtgagtgcctgactttgacgtaagcagtattactccacaccagtccaagcatataggaaagtagtgtcttgaacttactcccaccctctgagttacaatatataacctaataatggaactgtaagtttgaaaagtaaggaaaaggatgaaagtacacactctagttaaagaaaacacaataactgtaaaatctttttatttaaagacaactgtttgtagaaagagtcatattaattcagaataaaatcataaggcatttgtctaagtcaggagtctgcaaaggttttctgtaaaacgcagatagtaaacacttttggttttgtgggtcacacctggtttctgttgcatgtccttcttgttataaccctttaaaaatacaaagcagggctgggcgcggtggctcatgcctgtaaacccagcactttgggaggccaaggcgggcggatcatgacgtcaggagatcgagaccatcctggctaattcggtgaaaccccgtctctactaaaaatacaaaaaaaaattagctgggcgtggtggtgggtgcctgtagtcccagttactcgggaaactgaggcaggagaatggcgtgaacccagcaggcggagcttgcagtgagccgagatggcgccactgcactccagcctgggcaacagagcgagacttcttctcaaataaaaaaaaataaataaataaaaatacaaagcaattattcatttcggcttatataatatgccatagaccgtgatttgtctacctctgatctaaatgaatacttaattttaacatacaaatatgaaagaggcacctcatttcataatggtgtaatgccaatgacaagagaaattgaataactaaattgtatattatgaaattatatagcttttaaaaattttatcctttgccttattttaaaaaagaagcctgcttatattgattctgtaagtattgtctctttcaaacttgtgagatataatttcttactttcttttcccaatcattcaaatattaggtattaaacctaatattggcatgacactttgagtccacgcaaatacccttttctccaaagattatagtaaatatacatcaatatttatcactagaggattgagttttctttacagtgttcactaaaatgaaaaaaatgaagtatagaatttgtacttatgtgtttttcattgacctctctttgaccttatactgttaatcactagcacaatttcaaaaaatagtcaatgaagattcctcttactggaataaatgaagcacccctcaatgcctgtactcttatttcctccctgaaagttccataaaaattaaatgttgtgtttagatttctattttaataactgaagctttatctctttaactttaatattttctgctttagatttctaaagtaaaagcctccctcatatttaaggcttctttttagcttatcgaaactatacataacctcacagacacttggaagtttaacatttaacaccatatttgtttaaaagtttgaagactaaaatcttttatatttttatatttacaaaagaaatataagtttaaatggtacagcagaaccttctgaagaatgggatagagagtgaactttgtataattctgcatctcactaatcattaagaaataaacacattaagttaagaattaagaggattattaattcaataaatattttccagtaatgaattataggaatatcaacagttctgctaatctttctttcaccatgtggtgtttcctgacacataacttaggttatcttttttttttgagacctgagtctcgtgctgtcgcctaggctgcagtgcagtggtgtgatctctgctcactgcaagctccaccacccaggttcacagcattctcctgcctcagcctcccgagtggctgggactacaggcacgcgccaccacaccctgctaatttttttttttttgtattttttttcagtagagacggggtttcaccatattagccaggatggtcttgatctcctgacctcgtgatccacctgcctcggcctcccaaagtgctgggattacaggtgtaagccacagcgcccagccaggttattcttaaaagaaaatgaattcaataactctgttagaaaaaaaaaactaaaatccaggtgtcccacaaaaagttatgaaactttcaggacaaattctaatcataaagtactgcatggatatgaaatcaaacaaataaagatattaagacccatgaaaattttagcccggttattttaacttgtgtaagcatatgaggttggcaagaaaattgtcactgtgtgttattgcagtgacagacttcaatgcaatgttgccacaagttctcagtctagcagcttcctacaagaaggatgtgaggactggcgacacaacagtcaattttgtattctcaatatcatggaaggaggcatggcattgaatagcagaaagattccataaaggtaagtttaaaagaatttgaccttcagtcaatctctatttcaggcatgaatgcaaaaaaatgcaggctatatgcacaacctgcaaccgtacagagtgctgcttgaaaaacacttcaaaaagatgaaatcacagaccagaaaaaaaagaatggacaaatgacagtacagaaggtaagtctgcatctgcgaattagactttctctttctttctctctctctctctttcttgacagagtctcactctgttgccaggctggagtgcagtggcaccatctcggttcactgcaacctttgccttccaggttcaagcaattctcctgcctcagcctacccagtagctgggactacaggctcccgccaccatgcccagctaatctttgtatttttagtagagacaaggttgcaccatgttggccaggctggtcttgaattactaacctcagatgatccacccgcctcagcctctcaaagtgctgggattacaggtgagagccaccgcgtctggcctaaactttctattaaaataaatctagtgagatccagaaatccacatccaccagtgattgttccaagtctctcaaggtttctttggtgcaaataacattttccatttatctggcatcaggaaattggtgggtttttcttcttcttcatttcttcatattaacctggctacccatgggtagagtcagcagggcaacattaaatagaaaaaaaaaaaagatgcccccatacgatggcctgagagtggagaccagtgactcaaaagcagaaggctggttccaaaacatcaaacttctgcagtctcagcttcaggtgaggaaggcagctctcactcagggaaagagccaaagttagaaacagtgcagctcttgccagtcattgacctaaggccaggcggctcctcagatgacctgcaaattggggacacaccacggcatgcagcagctgggctgaaggatcctgctcccagtggatttttgcaggggacgttctgattcccttagctgacgaatatgatcctatgttcccttatgattatgagaaagtagtgaagtgccagagagaggaacgacagacacagcaggagctagaaatatgaaaggaaatagaagaaagggaaaagaggcctgaagacaggcaagaagttaggggagttctgatcaaggcgaccaaatccagattctgatgaaggggaagattaggagggagagaggaggaaaagtagtagggtggagctgccattgcccttcccacttctctggtagagaaagaccaagagtcaccccgagattttccttatgaagaggattcaagacctcagtcatggtcttccaaagcagccattcctcccccagtgaaggaggaacaggacagactgagatctccaaaccggcctagcagctccttcctcgctaacgtggtgggaacggtggcgcacaacatcatgcagaagcgcggcttccgggaaggccggggcctcggggagcacctgcaggggctgcgagatgcctttccggtggggaagactagcagatcaggcggcaagatcatcgtgggcgacgccgcagagaaagatgcattgaaggatcaggtacaaatccactgactgaaatacttgagtcctactaaggtggtcctactaaggaacatggttggtgaaggggaggtggaagaagacttggaagttgaaaccagagaagaatgtgtgatgacatatttttcagttgatatggtttcctatgagacatagcatcattaaggataaaataagtgaaactgaaaagagtatagttaatctagttttcataatgagttcattctgttatgtttctttttcttttccattgtcaatttatattggctcagagaaaacaggcttgatggataaagtccatggtatttcccaattttgccatgaaaaatatggcaaagttggaaaacgtgtgatatgtgaaattcttggtgtccctgatgatgaagcagtacagacctttttagaatttgagagttgagtcagcaattaaagctgttgttcacttgaatagaaggtattttggtggacaggtggcaagaggatgtttttacatttgtacaaattcagcatcttggatttggtggaacaagtttgattttaagaactagagcatgagtcatctctggtgacccttaaatgaccagcaggctgagaaaagaaggaaaaaggtcacagcctccatggctgttagatactgagactcttggaaggacctccaaggtatacgttgattgatcccttttcattttgtggtttttaaatattgtataaaaatccaaatcctttttaataaataaataaaatgtgcagctgactagtttcaatcattggtagatattatactgtaggaatgaagttagtgtctgcagctgtacatattcaggccattctaaatatataagctagttaggaagaaaatactgtggattttatccatcaagcctgttttcttcaggccagtataaaacaaatggaaaggaaaaagaaacataatgaaacgaactcattattaaaactggattacaggattaattttaatgttttcagtttcacttatttgactcttagtgatgctatgtgtcataggaaaccatatgaacagaaatatcccaagaagtaaatttgcttagaaaacagaaaagggcttattagtctctttcagtgcactgcacagcattcaagaagaatttgggtcatgtggtctttaaattactaaaacgagtaatgaatactagcggaaccaaaggctgtttctatgtgaagaaatgatctattttgggtttacatacatcagtaaaatttaacaaccagcttatgctgttaaacatggtggttagagctggtgtttcccgaagtttactatacagatgggtaaataaagttacaaaagcacacacaaggaatgcaaaattcactggaaaaactaggtatgttaagaatattttaaaaactaaattttaggctgggcatggtggctcatgcctgtaatcctggcactttgggaggctgaggtgggtggatcacctcagaccaacctgaacaacatggcaaaactctgtctctacaaaatacgaagaaaaacaacaacaacaaaaattagctgggtgtggtggtgcaggcctgcagtcccagctactccagaggctgaggtggaagaagtgcttgagcttggagaggcagaagctgcagtgagctgtgattgcttcattgcactccagcctgggcaacagagtgactccctgtctaaaaaaaagcaaaacaacgaaacaccacccccctaaattttataaagcaaatctaaaagcaaaaatgaaaattgcctaacaatagcaaaatgggacagtagaactgataaaatgtggtatattcatgtaacaatatatacattcttttgaaaaattagcaatatttttaactgtacatatatgatctatttcacagtaaaaatgaataaaattatgatatgcataaaaataacacaaaaacatttctcacattagcatgtatatatttatggaaatgggctcttgaataacaggacgttataaaatctcacctgtagaatttaaaccctaaaggtgatactatatttatactttgacaaatcattttctgtaatcaactttatttagtatcacttaaaaaaatgaatagtactttcattcttatcccttttagtgcttcctaaatattttacttttgaaatgataggtcttggatatattggcttgttttttgttataaaatctgtcatctatagcaaatgttttaatacaatttgaggcacatatgcacacctcggaatatgaggaaagaaaacaatcagaaactttgcagattgacattgtctgttttcacagttgctctgtggaaagtttgctctgaaggactgttagagtttagaaaatgagttttataatttccatgctgacagccaattttagggatgaattttacttttttttttgagacggagtctcactttgtcacccaggctggagtgcagtggcgcagtctcagctcactgtataagctctgcctcccaggttcatgccattctcttgcctcagcctcctgagaagctgggactacaggcgcccaccaccatgcccagctaatttttttttttttgtatttttagtagagacggggtttcaccatgttagccacgatggtctcaatctcttgaccttgtgatccacccgcctaggcctcccaaagtgctgggattacaggcgtgagccactgtgcctggccgaattttactttcatattgtgctgtctccaacataattttaaaaggattctggaaaaaaaaatagtaaaatgcaaaactatactaatactctcaagaagcacctcaagcattgattagcaaatgtatcttattatttacagagttaaatgacatttctaatgaccaaggactttctgagtaaacatccctggggagaagatttattgcacccttctgtgacctccccactctgactgccctctcttaggctgcagtgtctcttggctgtactcaatcattgactgagctggcaaatattctgtttattattgtctaggaaaggctgatgcgctccctgacttggtaaaatgtttcactgcatcattactgggcaataaaaataagttgaaataaccgactgagtaaaactattaggcactttgggcaaagcatggcctttcttcatgccgcagtgggaaatcaataagatgctccagaggagccgagtctctggggatacctgtatggtgcaataaaaccagcacataaagcagtggaaaaggtaacggcactcatttcgcactgttaaaattccgttgggcagaatgatgaagggaagctccataaagggtggtctatttaaaatcggttcctgagtgtgatcttttatttaggcctatctggaagacatgcatttcagtccttaatctgtagtcttttttcaacaaccccatgaaacaaaagggatccagcatggtgatactgtttcatggtgatacaaccccatgaaacaaaagggatccagcatgatgatccagcatggtgatacataatgatactgtgttatttacctggaatttggtaagagagcagatttgtaatgacttcactcccctctgccatcaacatggtaactatgtgtgatgtgatggatgtgttaatcaacttgactgtggtaatcagaacgcagtgaatacctatatcaaatcgtcacatagtataccttaaatatacagaatttttatttgtcaaataaatattttaatttttttaaaaaagggatttatggcagtgtagcagcagtgggtggtaaggtctgggtcaggttcagccccaggtgggaggtggcgtcagggaggaacccagtaaacagctctggccttgcaggtgtaacactttaggcctctgtcttcctgaggcgttgttcctgcatgttgtcccagcgtcttccctctctgtgtgtctctgcacctccatttccatttttcataaggacactggtcatattggattggagctcaccttaatgacctcattttaacttgattacctctgcaaagatcttatctccaaacaaggtcacattctggagttcatatgaatttgagggaaaacaattcaatccataatatcatctctgaaataaggacaactttacttatgcatatacaatttgggttgtggttgctgcgtatctgtttcaaatgggttatgggctcttctcacactttcaggtcaaaggggactttggaatccatagtgtacctatgtatgcatgtatgatcatggatcagccttcccatttctgtcgctgtgtccctatatggttcatgatcatgtatgttacttcactcgaaggccatacacaatccaaacaaaataaaacacagaaactgtgttggctattttgactttctgttgaaactattctctttggtcatatatatatattttaaaaatattatatatatatatatttttaaaaaacattttatatatatatatatttttttttccagtgattatcctgcctcagcctcccaagtagctgggattacaggcacctgccatcatgcccggctaaattttttttgtgtgtgtatttttgtagatacagggtttcaccatgttagccaggctcgtcttcaactcctgatctcaggtgatccgccggcctcagcctcccagagtgctgggattacaggcgtgggccaccacgcctggagatagatagatagatagatagatagatagatagatagatagatatatgtaatctttttcagtatattctcagggtgtgtttgaggaaagctttttttttttttggccattgtccaagggtttagaactgaatgggaatgtctgtaaatggatctgatggaggttggaatgtgtatcagcttttaatcatcactgtaacaaatcactaaaatattctctttattatctctcactttagaagtgtgggagggctggactgatgactctgcttatagtcctacaaggacaaaatcaaggtgctcttgggctccttatgaaggccctagggcagaatgtgtgtccaagcacatacaggttagagcagaattcaacttcttgtagttgtaggagtgaggtcccaattcatcactggctggtagttggggcctctcagcaatgtcaggctgcctgcattgctcttcatagtgcccagttcattttctaaaccagcaatggtgcagagagacattctcctgcttctagtttctctggcttcccctcacccacacctctcttctgtgtctcttctgcctccaaccagagttaaatctcttaagtgctcatgtgattacatggagcccactgcatgaatcacgatcgtctcctaaggtctgcaaccttaattacatctgcaaaatcccttatgtgatgtaacatattcagtttccagggcatcttggagagtcattctcattcttgctgccacaaaatattcctcattccttcatgaaatgttgtttgctttcatatatttgtctctagagaagcatcaggtattttctcaacatcccttcatgttaaaaaccctcaacaaatgaggcattggaggacatacttcaacatagtaagagccacctatgacaaacccacagccagcatcatactgaatgggcaaaagatgtgaagcattccccttgaaaactgggacaagacagggataccctctctcattattcctacccaacatagtactggatgtcctcgcccgagcaatcaggcaagagagagaaataaaaggcatctaaataggagaaaaagaggtcaaactgtctctgtttgcagatgatatgattctgtacctacaaaaccccatcgtctctgcccaaaagcttctcgatctgataatctcagcaaagtttcaggatacaaaattaatgtacaaaaattagtagcattcctatataccaacaacatgcaggctgagagccaaatcaagaatgcaatcctattcgcaatgaccacaaaaagaataaactacctaggaatacagctaaccagggaggtgaatgatctctacaagaagaattacaaaacactgctcaaagaaatcatagatgacatacaaatggaaaaacattccataatcacggataggaataataaatatggtttttaaccatattggaccatactgcccaaagcaatttatagattcaatgctattcctatcaaatcaccaatggcattcttcaaagaaccagtaaaaactattttaaaattaatatagaaccaaaaaagagcctgaatagccaagggaatccaaggcaaaaagaacaaatctggaggcatttcgttagccaacttcaacctctactacaaggctatagtaaccaaaatagcatagtactggtacaaaaacagacacacagaccaatggaacagaatagagcgcccagaaataatgtcacacacttaaaaccatttgatcttcaacaaagtcgacaaaaacatgcagtagggaaaggactccctattcaataaatggtgctgggataactggctaaccataagcagttcctagaccccttccttacaccatatacaaaaatcaactcaagatggattaaagaataaaatgtaaaacgtgtcaggtgcagtggctcacgcctataatcccaacactttgggagggtgaggtgggaggatagcttgagccttggagtttgagacaagcctgggcaacatagcgagacctcgtctctacaaacaataataataataataataataataataataataataataaattagctggatgtggtggcacgtgcctgtagtccaggctaatcaggaggctgaggtgggggaacctcttaaagcctgggaggttgaggctgtatcgtgtcattgcactccagcctgggcaacaggtgagactgactctaaagtctcaaaaaaaaaaaaaaaaaagtaaagcctataactacaaaaatcctggaagataacctaggaaatataggaaatgccattttggacacaggacatggcaaaaatttcatgacaacgacaccgaaaacattgcaacaaaaacaaaagttgacaaatgggacctaattaaactaaaggtttctgcacagcaaaagaaactatccacagagtaaacagacaacctactggaagaaaatattcacaaattatgcatctgacaaaggtctaatgtctggaatctataaggaacttaacaagaaagaaaaaaaacgtaccccattaaaaaacgggcaaaggacatgaacagacacttttcaaaagaagacatacatgtggccaacaagcatatgaaaaactcctcggcatcactagtcatgagataaatgcaaatcgaaaccacaatgagataccatctcacgccagtcagaattgctattatttaaaaggcgaaaaataacaggtgctggtaaagctgtggagaaaagggagtgcttatacactgctgggggaattatacattagttcagccattgcagcaagcagtttcgtgatttctcaaagaacttaaagcagagctgccactcaacccagcaaccccattgagtacacacccaaaggaataataatccttctaccataaagacacacagacgtgcatgttcattcacaatagcaatgacatagaatcaacctaaatacccatcaacagtagcgtaaagaaaatgtacatatataccatggaatactatgtagtcataaaaaaagatgagataatgtcatttctagcaacatggatggagctggaggccattatccaaagtgaactaacacaggaacagaaaaccaaataccatgtattctgacttaggagtgggagcttagtattgagtacccatgacacaaagaagggaacaatagacaccacagcctacttgagggtggagggtaggaggagggtgaagatcgaaaaactacctactaggtactatgctcattacctgggtgatggaataatctgtaccccaagcccccattacatgcaatttacctatataacaaacctgcacatgtatacctctgaacctaaaataagtttaaaaaaaaaagagaagcaacacgtattttctgaaggaaatgggaattatatatgaatatacattgtcaaagactataatgtttgagattttctattgcttatttcattagtttctttctggacctattccatctgggctagcagctctgaaaacaaagtagtgtggatcaaactctgtcatctgtttctgtcacacagattacagccctcatcctgaaggagggacagatttcagtcccatcctaataaaaaaaaaatctctgttctgtttactgtttttttctacttggtttggaaaaattttgttagaggcaattgtcgataccacatatggctgacagcaggtataggaggtatcctggtactcatacttggaaacccttaatttggcatcatcctcagcacatgaaatttctcagatcactaacaatcttggaccgatgatgattccttaagccaacttcgctcttctgaaaaggttggcaggcatgtctgcatttttctgaggactcctatgttatcatccactcaagatacacgaaggcattaactaattttaaaaatcttggcctggcacagtggctcatgtctgtaatcccagaactttgggaggccgaggcagtcaaatcacaaggtcaggagatcgagaccatcctggcaaacatggtgaaaaccccgtctctactaaaaatacaaaaaattagctagatgtgatggtgggtgcctgtagtcccagctactcaggaggctgaggcaggagaatggcgtgaaccgggggggcagagcttgcagtgagccgagatcgcgccactgcactccaggctgggggacacagcgagactccgcctcaaaaaataaaaataaataaataaataaaaatcttaagctcttcagttttactttgtgtctgcttagaggaaaaaagcatccaactacagatataaatgtatccattaataaaaggtaaatggaggcacaaaagtttatttgagctaacagtgattcatgaatcactgttgaagcagcttcaaatgggaactggttcagggaccctttcaagggaacaaaaagggacagcttctgtaaggtaaatatagtagcaaatttttcactggttgtacttatacaattgccttatttggttgatcctgctggaaagtctctagttatataagttaattggcttctgattggttagccttaagtttgactttttttatttttaaagacatttacaagaaatagctcaagttttgcttatattggtaaatcaagcaaagttaacgccacttaaaaggctttgtctggtcagagatacctcaggccattttaattttctttaacaatttaaatacacctgtgtgccagaggacagctcagtgaagtctttgaatgtctgtggctgtatatttggaaaagtatatattctttgcgaaataccacaaatactgatgaggtaaaatgcaatgtacaggactgcatgtatataacaagtctctattactagatctatacttctgtttacatacaatttttattactaagaaaggctgaatatatttacctttccagtaagaattacaagtaattaagttacctcagtaacacttcagtgtttaggtacagtgcaagtggctctctgtatctgtgtccagcatggaatttcatacgtagttgaaaactttcttactcgagagtgagttttcttatcatatatgtggtgatatgggatgataacagaatgttgtaatgtacaggcatccatgcccccaagtgataagttttctcacatgattgtttctcttaactgtggtttccagatataaaagcttaatctttggattcacaggagcattctagaatacatagcagggttttgctgttattcctagtggttcttttaatttaaaaaaatccaaacttcctttataatcaaaagatccacttgtttccatttctttagctgtatgagttctcatagtcagtttgggctgctattaacagaatcccatgaacagagtggcttacacaacaaacagttatttctctcagtctggatgctggaaagtctaagtctgagtttgaggcaaagcagatgcagtgtctgcttcacagaccacagtgttcgccttataacttcacatggcaggaaaggcaagggagttctcttgggcctcttttataagggcactaattccattcattagggctccaccctcctgacttaattaccctccaaagcctcctgacaccatgactttggggtcaggatttcaacatatgaatctggggtggggaagcaaacattcaatactttgcaccagtgtaacaccaattatactggattcatttaatatgtttgtctcctattaattaatatttgtttacattgtcaatgttttgaaagtacttcataatcagtatatttcctattacgccttctccatgtaaaaaatatttatccatctatctataaactgagctgtgtactaataatgattcaatagtatagatttagatgtagacttaaatatataagtaatattttatgtaagccaatgacttcagacagtacgatttgttttgtttttatgagctaactgttagaagtataaatggatttatctgttgtagagatatgactatgatattgtttgaaagtttccacttatttactacatgtagctcaaatatatttttcttttaatgttaaatgaaaatatgaagttatttaaacagcaagtaaactttctgcagatacttatttttgtattgggaagaaaaactgattaaatgtttcatgttttttataaactcaaaaggtattaatttcatggctagagataaattatttcttagtatcaacttggtttaaatttgactagagactcaaaatgcaaagcaataaagataaaaagtggttccactgccagtgtcattcagttgccttctcttacctccaaaataataggtgtcacctgaatcaatgagcacagccaccaggggctgaacagctgtgtcatcgtccaccaccacattcatatggctccacttggcagagaaggacacagagtgccactgcccatcgtttaatccagcacctggaggaaatacaatcagtcagagacaactctaaattatgagctctgtaaacacttgaaaacaatttgattcagatcactgaataagtcagagaagagtggtatttacatgttcatgtatcactgaaaaaaaaattaaccacctatctttaatttaaaaatttcatttattacgaaaataacacatgaataaaaatattactctttctgaagaatcactgtaacaaattctggtaatttgcttaaagtaactagaatttaattatcaaatatatacagtaggagcctttacaatgggataaaaacaacacagtttggtttaatcttcaaatgcaaaacttacttgctttactgaatctaacaaaaacattttacaagaatcaagaaagtgagttgataaaaaatacgtcaagaatgattgtgaaaagttttttttagaaaaagttgacacataattgcacatacttatggggtgtgacaggatttgaaatggaagatcactggatgtctggcttactgcacctattaattaaggtaaaccctgctttcactgtctgagctattttacagccctgtaaattgtagaaaactgatagtaatgcaaaatgacttgtacccatagaaatacaaatgactagtgcctggcgaggtgcagttgcttactgaaccatttcatatctgtctgtaattcattttggcatttcttatctgcctgtatgtgtagtactttgaattatcctccgaactgattgtaacatcttactggtttcttcatagattagttaaaatctttaacatatattcgtgtgtttctgaattaacaaattatgattatagatataattatactgtcttttaaaagttattattcgctgggcatggtggctcatgcctgtaatcccagcagtttgggatgctgaggcgggcagatcacctgaggtcgggagttcaagaccagcctggctaacatggtgaaaccacatttctactaaaaaacaaaaaattagctgggcatggtggcactagcctatagtcccagtcacttcggaggctgaggcacaagaatcacttgaacctgggaggtggaggttgcagtgtgctgagatcacaccactgtactccagtgtgggtgacagagtgagacactgtctcaaaaagataaaataaaataaaataaagctattatttaatatttgataaaaaatgcttaggaaagaactggagttgtactttatatatgtgcaatatttttatatatttacactcacatccacattattttatgattcttagtagtaattatgaaattaatcctgtcaaataatttggtaacaaaatgaattgtctttgatggtaaagttaaatgttaaggtatttaaaatcactagaggtattctgtgctttcttttacctgataatatgtcaaagatacatgccaataaatgggctaaaaataagattagcttcatgaggcctattaaattaactttgcactgaagtttaaaattaggccaagattgaaactatttcagaagttacatatatcataataaactttagactaatagaaattttcctataaagttaacattttacttgatagtcctgggaaacctgtaaattattaaaatgactctatgcttcatttatttttcttcctaacatgcatttatgtgaagttagtatattattaccatttcaaatgtagtacttcttaaaaattaaacattaacattaatattttagctttcccttttaaccttcagtgatgtatgaaacagaaacagaagtagtaataaagtgtaaggaaataaattattctttaaaatcaaccaagattctggatgtcttcaatgtaaaactaggcattgtctaaacacaatctggaggattatatgattctgcaggtttctgtgccttttaccttgagtttttttttgtttttgttttttttttttgagatggagtctcgctctgtcacccaggctggagtgcagtggtgccatctcggttcactgcaagctccgccttccgggttcaagccattctcctgcctcagcctcctgagtagctaggactacaggcacccgccaccacgcctggctaatttttttgtatttttagtagagatggggtttcaccgtgttagccaggatggtctcaatctcctgacctcgtgatctgcatgccttggcctcccaaactgctgggattacaggcgtgagccaccacacctggccccttctttgaattcttttaccaccctgtgaattgtagaaaattgaaagcaggcaaatgattattgtccatagacatgcaaatgaattttgtctggcaggaatacaattgaacttcttcctggttcctctaccccatcccatggaataagccagttttacattatacacaaaatcattgcagcagtaacatcttactgattctctcataaactaatgagttaaacaaaatctttgacatgttctttttataactgcaaaaagtgccctctttaagaatatcttttgacaaataaaagcagatctttgtataactgttttcatgtctatcatccacatttgttttatttttgttttctattaggttgtatttggcctttggccatagtttatgcacaagaaaatcagatacagtagaatctataaatatttcaatgagaagttactaaattaattgcccacaacatagatgttattttaaacacatttgatatgaagatgatctcttgttaacaactacaacattttaactgcagaggcaaaatatcacactcacaaagccatgagctaaagcaaaatcctgatgagatttaagaactttaattatatttaattctagttattgtgcaacccagaactggatgaagtgcttgttcagcacttcattgaatccagaatatatgcaactcatcagcagtaaaactgaaccaactactataggaaaaaaattgagggcagtctttgcaatgggcaaaggagattactgggtatcttttcaatggaaagattagctgatattacgggattgtaaaccatcatcttggactaggttactttacagctgtgtagtgacagaagttaacttgcagaacattgataataatgcaaataatgcttgtccatagagatgcaaagtgtgtacagggaagggatttgcctttccctttggatattgacaagtttagctagtcggcatctcttttctgactataaatgtgtggtacttctttaaacaggccttactggtgtaagggtaaacacaaaccaaaacaaacaaaagctttcttagtgctaaaagggatacacactttcattcactttttttccttagagcatttctttcagaaaacttgtaattgtacatctttaaaatcttaaaacaaaatcttatttagcctctttcttgtttccaggagtgtttttcttgaggaccttggagacatttctttgaaatgtaaacaccaagaaaggcagtgctcctatctccttgtctccgtgggagtttaacgtaggtgcctggctccaagttgcaactacccacttgtcaaagagacatggagtttagttttcctttgcataaaggagtgtgcctccccaatcaccaggtgaatgtaagatgggctgtgtagcaaacggcgctgtcaagtcctcttacttgaggacaagctgtcctttatctttagaacatgtatgtaatgggttgtatctgcctggctatataaatggatgaaatttctttatctttgcaatcacattagcgattgcctgaaatgtacatcacagtctggcttaatacttattccataataagattatttcatttctaccttgtgaaactgattcactatgttggtgggccattttatctttacttatttccctaacactggttctctcatcaatgagttaaagaaaatctctgacatgtgttcattctgtatctgtgtgtaggtcacgattttaacctttcttggaaaaaatcttattcgtgaggaaatggaaactaggtttgcatttctaaaagataaaaaatatacgtcccctctgaatatctgttttatctcccctgaaacacctgtgtgaggtggacatagattctaacacccaggacttgcctgattgttccagaagtactgagataaggccccgccctctgaatttcttcacgggtcttgaaatcgtgcttttataccacaacatttaatagcagtatagtcacgtgtgcctcttacagccaaaaggaatctttttttgagtatgattaccccctggtctcaagcagaagtcagcctcttcgtctgtgcctttttctttttcagattacgctttttttttttttttaaagcccccatttagttccgatgccaatttaggcacaatgtcaatttaggacccagtgctcctcccatctgcaaatccaaaatcatcaaaatccagcagctctgtagttaacaaacttgcccacatctgactgcatgtgagattagttcccatctattgtaactcagtctggcttcatgggatttgagcccctaacctagcatttgcccaacaaaaacaggccctgatggggagtggggatgtgagggcctgtgtgtggggtgggcattgtgctaataaaatcagacttcctattgttctccctgcaaaggagatctgaggtttaccacttcacaagtgaaaacagctgaggcttaggaggcttcgtgatttacatttcagaagggcagtaagtggaggagctgagattcttccagggtgcccagctatcccagaaaacgaatcagccatcaacgaaagaataagaactcttggtatttgccgggcatctttccctgtaaagtgatagttatcaattgcctactgtgtatagaatatttgtgcacagaccctgagcggcggggcggagaagggaaaggaggaggaggacaggagaggaatgtgcctctaggtattgtctgttccatgaggtcctgaccctagttctttgggatggaggctggtatatgtttgtcaggaaatggagctcaaggatattccttgtatatgggaaggtatgtctgcagaaatatgcatttcatatttctcatacatagtcattttggtcaaaagaacactttagtggcagcggggtgtaccacacagaacagtctaaaaggaaacagcaatctgttcctctagtgggggcatggagcatctcactgcctcactcactcactaattaccaaatgatttccgtgtggatatgtcaggtttatgggaatacaactgttacctgctgtgacattccttggtgactgtcccggctggaagagactcagtttgagcttgccatccttaagaaagaggacgaaactccctgaaccacgtcgaagttcgccgaaaagcaaatgtcctgctctgttccacgttcgaaattgaaaagtgacagacactttgtcctccccagagttgcctggcagagccagataactcctggagctcagaaaagtcacagggacagtctgtggctgtggacatgagaaggacacatttccctataaataaaacaaaagagcacattgagcagccttacaggtggtgcttctatctaattaaagccagattttacgaagacgtacaaggctttttatcaatccaggattagtctgcctgctaaagctgaaatctataacatttatcttctctttcaacataagtattattataattgggcacacatccatgtggctttctgtgtgtgtgtgagaaattctccacttctctacttctcagcattagtaaaggagtctcaatataattttagttcaacaggagtttaatctatgccagctattttccaggccctgtgctagccctgaggatacagcaaataacaggacattttcatactcagtctttctcctgagcaacatttggtcttctctacacaatcctcaaaatctcttttgaaccagcttactattttactggttccctcattaatgaattgactaaatctttgacacatgcttatttgatatttgtatgggtcatatttttagctgttggaaagttatatttgacagcctttcaaatggttttcagatctaatagttatatgcaatgtttgcatatagtatttttagcatgaaaacattgatgtttttatatagtcaattatgtctatattgtattttacagcttctgagtttccaatctttgttaagaaagtttcatactaccctaggtcctacatacaatctcatagattttctttaagattgttgtttgtttctcatcctctttaatttacatattcttagtgtgtataagatagtgatcatgcttattttctgccttatggacacttgtttgttccggcagaatttcagaaataattcatccctgttccactgaattgagccacattccttgttactaacaactttgcacataaactgggatctttctgagatcttgactgttctactgacttctctgttcctatccactaccatactgattctagtatagaagcttttagtatgctttaatatctggtaagtcaacatcttactaggtttttaaatggtttttgtttgtttgtttgttttgctttgtttggctggtgaaaggaataagcaattcttgggcattattcacacataggaatttcagttccagagaaaaaccccagtaattctgattttacttggaatttccatggatttatttctaatatactataaatgattttagaaaaagaatgttactggagcaggacagataatctagggtagtggctctcaaacctagctaaacagtcgaatcaccagaagggctcttaaaatccagatacagaccaattaaaatcccgatctctggaggtagagccaggtaatggtatcttttgaatctcctctggtgactccaagataaagccaagtttaagaaccacactgatccagtggtaaaacaattttcaaaacagaatcacatttttaaaaaattctgtcccaacatactttagaaatggatataattcagttatcattttataataatctttaatacacattctaactgtatacatcaatcagaacatttcttcttgactgtttttgtaattctgccaaatgggaaacagttttcatgacaagaaaacatttgcagaagaaaatttaaaaaagaaaacatttgctgtaacaaactaaataccaaaagcttacaagtaattggcactgatccatagtacacatgtaatcactggactattacatattttttatctttttatcagctgtatatttcttgacctcatcatttaggtgggtagctgcctgctacaacagagaggcagggcttcttgccacagaggagtgcttgttagttgactgaatgaattctggcaactgattttcccaacaaaatacatttttaaatgttttccttttatatattggaacaactattttcctgtttttatacagaacacatagaattgtagtaattcttaaaatggaattcccataattaacattatatatccatatgcacaatttggaatgaattgtctttttgtttttgtgtgaaacttacacattttaataacctcattcaatgtaattagtaaatagttttcttgaggatgatatccagaacccagagataccagcttaattgtggttctccttattggctatactcaataattccatcagtgaacccatcagtaattcagaataacatggaatgtatatgaaaacctgtgtctgttgtcctcaaatagtcttgtctctttgtgtcataaggcccaactcactcttcctcacttcaatgacagtgtctttgtaaatagccccatagaagttagggtgaggaggagggattcttctgaacaccaaggactggcagataaaaggtagcttaatattcagaacgtgttaggtcaggcttcttgacacggatgcccattggccaaacccatctttgtatctgtatctgagtaacgcatctccaacaaagccaacttcaataaccaggtcttttttctttttcctgttgagcagcacttaaatgtcagtttctccatggacagaaactttaggtagagggctgttccatttatctccttcctcttttcatttctttttcatcttgtcaaaggaaactgcactctgtggagccttgttatcactcttccctttggtgtttcctttttcatgtatcttgatggtatttttcatttttatgatctcagcagggtgctgttcatagtaaaacttagacttcaaacccatctttttttttttttttctcctttaccttcttggaaagttcatgggcttcacagctgtttttccctttttctcatgctaacctaagtgatgtattcattgtgtggtctggtgacacacagtcagagatattttcaggttttggtcctgcaacccatgagccaactcctccagcacataacaggaaagaaaacatgttcccaacaatacaaataaatattcccatgatgtgctgctgagatacactgacaactaaacatgagctttccctttaaccccaacttggatatttcaaactttaaacattgaaagaagtttattaactgatttggaagtatttccagttgattagggaatagatcattagggattgccattgcaaaatgattggtctcctgtggataacaacaccaaaaacacgtgagacatatgaattctgatttccatgtaaaaatagaaagttattttatttcatataaaaatgaaacaacgatgtcccatgaggcatatttactttataactttttatgcataataaaaattactatattaggctgggtcaaggtggctcgtgcctgtaatcctagcattttgggaggccgaggcaagtgtatcgtctgaggtcaggagtttgagaccagcctggccaatgtggcaaaaccctgtctgtactaaaaaaaattagccgggtgtggtggcacacacctgtagtcccagctactcggaaggctgaggcaggagaatggcttgaacccaggaggcggaggttgcagtgagccaagactgtaccgctgcactccagcctgggcaacagagcaagactgcatctcaaaacaaaaacaaaaacaaaaacaaaaaaagtgcgcctgtggtcctagcactttgggaggccgaggtgggcagatcacgaggttgggagatcgagaccatcctggctaacatggtgaaaccccgtctctaccaaaaatataaaaaattagccgggcatggtggtgggaacctgtagtcccaggtactcgggaggctgaggcgggagaatggcgtgaacccaggaggcagagcttcactgcactccagtctgggcgacagagtgagactccgtctcaaaaaaaaaaaaaaaaaaattggcccaggcccagtggctcacacctgtaatcccagcactttgggaggccgaggcaggcagatcacctgaggtcaggaattcgagactagcctggccaacatggcgaaaccccgtctctactaaaagtacaaaaattagctgggcatggtggcgggcgcctgtaatcccagctactcaggaggctgaggcaggagaattgcttgaacctgggaggcgtaagctgcagtgagctgagattgcgccgctgcactccaacctgggagacaagagggagactctgtcttaaaaataaataaataaataaaactaaattactatattacatgggcagctgttaaagtaagaactgattcttaaaatattagatgaaatggagacttcacatgaataatttttaaatgcaaaaaataaaatgtccttttttctttccttcccattaggcttccttaccatcatgaggatctgtggtttgtgtttcttggctaattcggtaacatccactccattataataaagattttctaaacacccatgaaagcttttacgtctgaatgcccgcgatcttccgggtgtcggaattcccccaaagctgatcttagaaagaaaaatgacataaataacattgtttagtgattttctgatggtacgtgtttaaagcatttataattaataggtctagtactaactgtcacaaatccattcccattatcttatatttgcatgcttgcttattccaaatgaagtgttctatcataatgacagctgttaatacctttatttctggcaccacacagttttgaacaaacttaaaaggaagaagtcaacacacattttctgccacattgaaattttcagccatgtagtaaatttaccctttgtgggtcatatgatctcttttgcagcactcaactctgacacgaagtaccaatgtggccacggacaatacataaagaaagagaacatgttccaataaaaccttctcttttgaacaaaaacaggctttgtatttttttaattaaaaaatgtccaaacttggcctgatgcccatagtttgccaacctctgcattagatattatcttttgctattacatggttaaattaaagtaataaaactgaataatccggtataggactaggatcttcagtttaatattatatgccaaagccacttacgccagtaaatatcacagtttttctggtttgttatgatccttcatacactttaaggtgtcctgtaaaggactgaaagaatagatgctatttaacagtgtagcttagatacatatgggcaatgggttgcaaaaagcattaatgacttaaaaaatatcaggatattatttatatgtgagcatctgacttttcttgttatttaataaatctattggtgtatatcttgttaacttctcaaagtgatcctaaataatgctatgttggttaggattgcaccaagacaagaaaaaaaatcccccaggaatctgcatagtcaaacaacaagtgtaatataccagatgaaatttcaaatgaaatatattcaaatgagtacatttaataacaatgcttgctactttggtatttctgcatttgtggatttcctaaacctaacactgactgtttacttctttccaaggtggaaaagatgatctattataataaactgacctattagaaggcataaacagtttcatagtaccgggacagacataccatacctattactattagtcaacttagttatgaattactataaaatggcatttctctatgcagctaccttatttttcaggttatatttaatttaaactatatatctataataacctcaaaattaagatccaagtaactggaatctccctttgcttggaaatgatgagtgtgtttgtccacggtgaagttgacctgcgtgtcgaggagctcgatgaggacggaatgccagtgctggtcgtccagcaggctgcccagggtgagggtcacaggagcaatagtggaaggcagcttagcattgccttaaaggagaaggaaaaaaacagttatttctgttcaaaatcacagcttcccttttttagttgagcatcacagtttgcatccaactttccatcttacagagttgttttctcactttctccctatcttgaacacaataaccttaccctgtttttattttttttaagttcaattctacactttgttgaaatttttcttagtattttttctattactcatgacatttggatttacaatgcaaatattttctttcttagaacctcattatcagcattatctcataattttataatgatgtattgtctttatgatatggataatcatatattacatatatattatacacacatatggtgatcttgcacagtttgtcaaaatatatgctgtttacagaaatcatacttaggatatgtatgtattgcatgcatctggtagtaatgctcttaaattttcatttacatttgttcattgcagttctactttgcacttactgtcccagagtaactatcacttgtgtattttttatttcttaaaggtgttctggtttagatgatgaattatatggtcattttatctaactgtgaaaagactgagtaccaacaaatgtaaacagattttttttaactactggtataaaagttcaagtatttttttacctgaattaagaaaaaagacaagctttcctttaattaattccagagtaatgtgatttccatgttgtccttctctgtgaagtagaattccattgctctgcatggctttaaatttcaaagaaataacgtctcttattggttttaaaggttttttatcaagtctatacagcagagcactttgtccatcaaaataaaccacctcagattctaggaaagaagatattagaaagcaattctaaatataaatatgtcatacagtagcacattgaaaatgtgtgcatcaatatgccacaccacacacacatagacacacattgtatttctaagccattcattgaaggaaacaactgacaataatatattttctggtggcatcatgagttgatatatgtaatacccaccgttagaattttctaacattttctcaaacttcatcatctagaaatgcttttattaatctactcccaatggctcttatctttagagcagcccatttcttctcattctgtttgattaaaaacaatcaggaaagaagctgtatttcactacataaattatttattttaaggtcattcttatattaaatatcagtgtcactcaatttaaatacctttgttcattcccagtagctttggcttctcttgattcttacacatgtacctactttactaaagattttgtctgtaaagatacagaaacacatatcatacttattaaatactgctttagacatgtaataaatgtattttaaatgagctgacatgtaatatttttctcaaccctcggctaatggtactgctaatgggcactgcaatgtgtcaacttggctaggccatggtaaacagcttttggtcaaacactagtcttgatgttgcagtgcaggtattttttagaggtaatcaatattaaatcagtaaacattgagtaaagcaggttaaactctataacgtgggtgagcctcatccaatcagttgaaggctgtaagagaaagaaagaaaactgaagttctctaggaaagaaggaattttgcctccagacaacctctggactccagctgcaatatcacctcttacctaggacttgccagtccttacaatcaggtaagccaattccttaaaactctctctctctctacacacacacacacacacacacacacacacacacacacacacacacacacacacaggcacacagacatcctattggttctgtttctctggagagccctgtctgacaaaggcacagaggttttgttttcttggatgctttgttgagagagcatggccttaacacctctgttttggttcttcctgctgtagcttgtcagaactccaatgctgccacactctctcagcactctgtcagggtcttataaattcactataaatgtcacatatgttcagctcatcaaaaaacaagttgtttcattttatcagtaatataaaataatatttgataatatttgtcaaaatcacatgaagaaattaatattacccagaaaatctcttctttttaaaagtaaaaagaaaaataagcaattgtcctttgaaaaatatatttatttaataaatgaagatgcatgaaaacctagtgaaatatgaaactatttgaagctgactagctgatgtcattcaagccaataagatggcattgtttaattatatttaatttcacaaaaatattactagtactttttgcatggctatccatttcattcacattatctgaaatacatataataaactgcacttcaaaagttctccattttatgtatcattttaaaatttagaagtttgattttctcacattgggttaatgtacttacaaggaattaatgtatcaagtgcatgatgaataaacacattctgagtaaaatatgtgtaaattaaacaattattccttgttacataacttattatatgttcatgataaaaacaaaactctctgtcaaatgtaaatgaagacatctaagattattattacctggccatgaactaagggaaacctgaaaaagattgactacagactttcacatttttagcactgccctaatacttataatcatgtctttatttgttgcttaaagaaaatgctaatatttgagctattttttttttttagttgactaacaaaaaaagttttcttcccgaaaaggttttttctggattattgcaacctatacatttctttttctcattctatgtttactattactctccaacagcagtattgatcttctaaggcatgtgaagtacagttcctggaatgtttccctcaggcaaatagaatagtaaaacacttatcaagtaaaagagacataaagcaatgaccttgaaactcttttgttctttagctaataccttgattttttctttactgtaatcgctagtgcttgtatctagaaatttaagaatatacttatagctcattatgcatattttaaaataaaagcagattaatgaattgcaaatccaaactttctaaaaatcataaaacattctatgatttatgaagtcaatacataaaaatatgaaacaaaaaatgatgtttgggatggaaagcattgagttcaataagtcaacagtaacgagcccaccaagatcagcactggagagggacaactcccatgtagtccctcttgaataagatcctcccactggagaagcaaaatttcaagtcttggtccttagaagtaatgctaaaaggtaaactctcttcccacttgtccacaaaagtcatacttttagcattttaaaacacttgcaagagcaaagaaaagttctcccagctggtcaggtgcagtggctcatgcttgtaatcccagcccttagggaggctgatgcgggcagatcacttgggcccaagagttcgagaccaggctgggcagcatggcaagactggtcgcacttgcttatattcccagctacttggaagggggaggtgggaggatcgcttgagcttgggagatggaggctgcagtgagcagtgcttgtgtcactgcaccccagcctgggcaacacagcaagaccccatttcaagaaaaaaacagttctacctagccataatcaatgcaaatattcccctacaatatatatttgaataatacactaaaataaaataattccagtaacacatttaatataatcttttctcagaaacctgttggaaaaaatcctttgtatgaaattcaattatataaataggaaatgtagtgggatactggaaaattaatgtcacttattatgtttacgataaaatccaacgttcctcaaagttttcagaatgaaagccttgctatccaaaatgaataaagaaaacttagcttgtggtttaaagcaggaagtgcttttctaattttacatgaatttagtttataattattagctttattaattaagattatagttttgattgctgaatctcaatcagtattagcaatgtggacccctgacacgttagtctgtcaccattagatcaggagctacattttctagtacactagagtatatactgcgtgggcttgaatcctggctccatcctggataagttacatagcctctctctgcctcagtctactcataagtgaagtgagaatacatacactcctctctcacaaggtcgttgcgagggttaaatgagttagtatttgtacttttacaacagtgctgggcacatggggtaccttcagtgaacgacggcttcattattattgtcagggcactgggcagaaaaagaggtggaaatgagtttaaaatagcacataggggatatataggaaagtagacagcttaaaatgatagcggatttaatttttgaaggacctaggaaatcttcagtttccaccaggaaaaagagatttacaaccattcatccacacttacacagctccttctctgccagccagcttgttcctgggctgactcacttcaatcactggtaacctaaatcttactcagaagtattaatatatctatctcattttcttgtgttagaggaccactagagtttttaaatgatacttgaagattattggtgcaattataatgtttttgtcacacttcctcaaagaatatcggaaaagctaaggacagatgtgttcacaaagttcccaaatacgaattcttgtagataaagaactttgtcatacaaggaagaactgtgtcagaagtaattttgctaaaatgtgttatgtcctcattcatacagctaatattcactgaaagccttccatatgctaggtgaaagataaaaatgcagaagacaatgaattacttttaaggatcccacagtatggaaaaaaggtcatataatcctgaaatacgattgtttctgccacattcacagtgatgcttctgtaaacaggcatctggtccagaatgacttctaagaaaggataaggaaggagtctacctgctttagactcctgcaaagtatgacgtctctgaaaagctaagacataagtaattttgagttgctatttcctttatttccttaagccatattttaccttcacattttacttttattagaaacagagactcactccgttgcccatgctgtagtgcagtggtatcttcacagctcactgcagccttgaactcctgggctagagtgatcctccagcctcagcctcccaagtagctgggattataggcatgcactacaatgcctggctaattttttactttttttctagagatggggggtctcactatgatgccaaggctggtcttgaattcctgggctcaagcaatctgcccgcctcagcttcacaaagtgctgagattacaggcataagccaccccgcctggcctactttcacatttttcacacccagaatgtactcttaactctggcttctcattactacttttctgcttctcactgtcattctaagcacaggcatgtctcatccccatcctaccttgtactgccttttcagaggaaacatcaacattgcttgaaaacagcaagattccatagggtgcaaacactgatgtcttacagaagaaaaaaaaaaacacgattccacagaaattttcttaaagtgttctatcaaccaccttcactcagattgactaggagtgatcacttggagactttagaacgtgagcctcaaccagaccaggaatcaggatttctgtggttgagacccaggggtttgcatatttaataagctaactaggtagctgtgatgacacgaaggcttcaggatgatttatcagggataatgggcagattacagaggtttactctctaaataaattgaatgttaattccaatatggggtgaggcacaggggctcacactgtaatcctagcactttaggaggcaaaggcaggtggatcatttgaggtcaggagttcaagaccagcctgggcaacatggtaaaatttctactaaaaataccaaaaaatcagctgggtgtagtggtgcatgcctgtgatctcagctactcaggaggctgaggtgggagaatagcttgaacccaggaggcagaggttgcagtgagccaggattgctccactgcactccagcctgggcaacagagagagactctctctcaaaaaaacaacaacaaaacccacaattccaatatggaaacatgaatatcattttcatagagttataatttatattcaataaatttaaggttatagttcaatgagttttaataaatatatatacctaccttattgccaaaaaatcaaggtgtaggcaatttcatatcaactcactaattgccatttgcatcaaacccccaacactgtcacccagacccagacccaggaaaccaatgatctacattccgtaactacagattagttttgtcagttccaaaatttcataaaattgtatcgtgtatgtgttcttttgtgtctgcgttccttcttaagtgtaacgtttttgaaatacacgcatgctgttgcatatatcaacagtctgttctttcttattgcttggggtattcaactgtttgacaacttgtttatccatttacctgctgatagacatttgaactgtttccaggtttaaactattataaataaagctgctaggcacattcacacatacatctttatgttgacatatgcattcatttctgctgggtaaatacatgggagtggaattgctgagctatatattaagtgtatatttagcttagaagaatgccaaattgttttccaaagtgatagtatcattttcacatttcccaccagcaatgtataagaattccatatctttgccaaacacttggtgtttccaccctttttaattttagcctttctgctaggtgtatagtggtttctcattgtgattttatttctctaaagactagtgatgattcattttaatataataataagttagaatagatgtattgggattctgtagatcaattcggggaggatgataagaatattgaatcctgcaatcgatgaatacacaaagctttcctaggaaatatttgcctttattcactcacatattttctttccttctgggcataataagaggaacttagggaaaacaggccttggttctgcattctcagtaaaggccttgatctctctctttaattttcatgcatgatctttcctctctatttcttttctttcctctctcttttctccttctcccatttcctggtaaagatagttgattgcacagagtctggaatcctctgtgagtaggttcacattccaattcttcaacttacttatttctgatggacagggatttactttttcatcttattttgagtttctatttattttacttttttatgacaaattttttttttttttgagacagggtctcactctgccacgcaggctggagtgcagtggcatgatcttggctcactgcagccttgacctcactgggatcaagcaatcctcacacctcagcccactgagtagctgggaccacaggcacacaccaccatgtccagataatttttgtattttttgtagagatggagttttgctgtgttgcccaggctgggcaatcaagtaatctgcctgccttggcctcctaaagtcctgggattacaggcatgagccactgtgaccagctttatttatttttaaaaaaatttgttgaaatttaattagcacttcagtgttttacagaaaaataattttccaaaatattaagtagattgtattataaacacattattatatgaaaaaattatatacactttgttttcttcaacacatttcccatggcattaaaagaaatgcagttagttatattttcagttatgacaagcaaacattcagaagactacacttcctaccaaggacaagtagaaaatgtgtaccaagtaaagtttaaataatcttcttgaaagttttaaagatctactacgactgccaggactcaagaatgtaaagatcttagaagacaagctcagaacactctttctgcttctacccttgaagcactggtcaactcccaaggagcaatgggcaagagacaaggtggccaagcagaaagtgacaggacagctatgaggctgggtcacgaagcaggggtctctgtagactcatcataattaggagtcagatggcagaattcagagattttcaaaaaaatgttttggcaaaggccttcaaatctcagttgggactagtgaagcattgtactccagatataagatatcaactaggcctcatggggactgagacgctgcactgagtcagttaaatgcttatttgaattaacatctgtgcctaatctagaagcctaacagaggctgtggtggggattcgctgggggatcactttgtcttctctagcctctacaaatttctgtccaacatgtccagaattcagccaaaattatcagacatcaaaacggaaacaaaaaccagacaatggaaaagatcaagagataatccagatattgaagttaacgaaaaatctttaaaataactgtaattaatatttccaggaaaataggcagcaagataaggagtttcactaggatacatgaacagaaattcccaaactgaaaatcacagtaactaaaattaatagctcactggcatattcaacaacagattggtcacagcagaagatctgattagtagtatagaagataaagcagtacacaatgtctagactgcagcataaatagaaagaaaagatgaaagaggagagggagagagagaagcaggaggagggagaaagagagagacaaagaaagaaaataagatacaaacatctcagacagatgtaattggagtctcagaaaggaggaaaggaaatgcgagacagaagcaatattttgaagaagtaacagtgaagaattacccaatctaataatcactgcatagaaaaaagaaatttagtgaaatccaaagaggacaaattcaatgaaaactaaaatagccacatcaaggcaaaactgctgaaaatcaaagacaaataataaattctcaaaagtaaccagaagaaaaatacacatttcccttataggataaaaatcaattacctattgatttcttaataaacatcatgaaaacaatagaatgccatctttaaaaggccgaaagaaaataactacagaccgtattctccagcaagctgaaacagccttcagaagttcatataaaataaagacaattttcaggcaaacaaaagctatatgacaatttattaccagtagaactgggctaagacaaatattaaaaggagtctttctagctgaaagaatttgattcagaaagagcatgaaaatgcagagaaagtaaatatgtgagtaaattcaagtgaatactgattgcaaaaaaaattatattaaattttgtgattaaaatatatgtacacatatacacatgtatgtatgaaactaaaatgtgtcaacatagcacacatggtgggaggagtttaactaaactaacataagttgtacttaaatcctagtattgtttggaaagtgataaaagtagtagctcaagtacctaggagaacaaaattagaacagcaaacaatagtggaaaaactggaaaaattaaacttgattaacccaaaagaagaggagagaaaaaggagtataaaacaagtgaaccaaatataaaacagagagtaacatgtcagctacaatttcacatatgtcagtaattacatttaatataagtggactaaatataccaactaaaactcaatgatttccagatttggtttaaataataaagaaagagtccttacatatgaagacaaaaagtttgaaagtaaagaatggaaaaagttattccatgaaaacactaaccagaagaaatctggcatagctatacagtactatcatcagagaatgcagacttacaggcaggaggcattattagaaataaacaaggatatttcataattacaaaaaatcaactttaaggaagataaaacaattcccaatctatatgcatttaatgaaacagcttcaaaatatgtaaagcatgtatctcttttcattttactggaattcatatttcaggcatgcttattaatggtagacacaaaggaggacagtaggtacactgtagagttgactctgcctaccattagccaaaggaagtcactggctggctcaaaaatcagggggcagggaagcatacaccactcacaggcactggcaaggaacaggtgcagaattggtgccagtgatgcaaactagcacagcgtgtatatataaaagtgataaaacaattaaaggaactttacagaggtaggtagttctaacttcattagaacaccaatgaagaaatacaaacttggaccatctcaggagttatgaaaatttcccatgtctcaaattctaatcaaggacaggtaaaattttggaagggagaaaataaaatttgcttttgtccagtcactatttgttctatttgttttgttttaccggaaacctccacttgccgtctgttgttcctacggaaaacagtacagcactcagttaatccagatgaagctgctaatattcaactgtatttgatctacaaaactggcaaatatatggttcaaccaattataagtgaagctagaatgatgaataagaaaaggactgattggtaatagcatagctatgtaagacagagtctgaatgacatataaaactatttgaagactaagttataagaaaatgtaacagaaaatgcatgaataaagaattacctgtgagtaataaaaaatgattttcacttgggacattataaaagaaatcttcgtgaaaagaacattttagaattctgttaattatctgggctgtgctccaagtattaaaattttaaagaagaatccaccactcccagaccccctcccccaccaaattttccaccattaagggaccaaaaaagtggcgaaccaagctcttcttggttatttatgaagtcaaccttgaatactaaccattttctttttccttcatgaattattgcccgtgacttacaaaggaatagaagcccaatctcagtttaacagaaacatgaaccagacaaaagccatgtttgagtgttatctaatgaaaatactaaaacactagcatggagtggaatgtaagcccttaaaatctgcactagcggactgggaattaaagagatggaaaggatactaaccacttgagaaaacaacaagaagaggactgttctattttttgcattaatatcaaagaaagtggagtgatttaaagaactctgaaattgaggataattaaagctggcatgataaaaaggaggaaggcacagaatcaaaaactaaatgtttatatacaatacaatgcagcttgatgctgtctctctgaaagtagaaaagaagctgccgccatcaatcaatatagcaatatatcaaaacaagtatcaatataatgatcctttatgaaacctcggcagttattatccatcaagaacatggaattggtagtcagaggactggagtcctctccctgtctctggtgactatttgtagctcctgcactgccggcccttggtgtggcttctcagattgcgtacttggaacatctgggtgttaataactgcctttctactacataaagatgcatcaagtatcagatggaagaatggaaacataactgtaaaatcttatatttgctatttttactagagttattacaatttttaatactatactttataacaatataatctccaagatacctgccttacctggatggctagtataagagagaaataatctgaaatttagattcattattcagattttattatcatctgtcagactttttttctgaattgcttcattcattcattcactcaatgcaaagctatggtgcacttagtatgttcctggctctgtattaggtgctgatgttacagcaatgaatgtaccttaccctagtgtagcctgaagtctaatgaggaaaaaggaaactaggcctctaataagacagatacagatacactataaaaagtgactatagcacatgaagtcatactataggcttcctgggaacttataatgaggaaacaaatgtagagtgagggcctaggaagcatcatttaaactgagatcgaaaagaggaagagtaaatagccagttgagaacatggggaaggagcatttcaagcaggggagaccgcaggcgtaaaggctttgagtcagtaaaaagccggacacaattgacagtggacaggtagcaggtgacggcagcaagaggtggcactggagagttattcagggacaagctccttcaggccttgctgggagtctggatgttattttaggaacaatggaaagccactgatggtattaaacagggacgtaattgtatcagttctgcatttttaaaaggtaacttgagttgcagtgtggagaatataatgtagtcagctatgaacagagacagaatgacctaaacttggaaggcaatttccataatttgtgggacaccaagtttagattaagtcggtagtagagctaaagagagctgaaatcatgcaaggtgtaatttggagggaagaatacagaatttcgtgactcactggacatggagggcaagagagatagatgcgtcaaggacccatagggttctggcctaagattctgggagttcccctttgttcttgagagatgccctcgaaggcctggacaggcagtagagcatagggaatttatttttctgtctaaggcctctgggaaacaatcctagtgtcttgggcgtagctttaagcatgtctcaacaatcgagtttgaacaatcgaatgtgcatgtttttccaggaatcatcctgattattgtgtggactaaaaactggaaagatcaagaccagagacaaatagctgatttaggaggctggtgctcatttaggctaaactggagggagagaaagaaattcaaaacatttaggagatagaatcaggtttcagtcaataggtggctgttggtatcgttttataagatggaaaacaaaggaaaatgagcagatagacaactgagttttaagtgctcacagggccagtgaagagaggttggtaccagaggttggaactcctcagagtaggttgcggatacgtatttggaagttatcagccacagtgtgtaaatgctactgaaaactcatggaagtggataaaaggctcagagagagcttgggagcaggataaaagacctagaaccaatctgtggataatgctagcctttaaggagtggcaagaagagtagcatgcaaaggtgcatggaaaaccaggagaatacagctgtcaagaagggcccgaggccatctgtgctcatggctttattctgcagttgagcagcaactctgggagaacctacaacctatccccaggctagaagtggaaatagaaataaatagagtaagccaggagtctgtgaaaacacacacagtttaaaggaataatgaatctattactgtaaatgaagtgtagaaaagctagtaacactagggctgggcagtcccagctactcaggaggctgaggtagaggatcgatggagcccaggggtgcactatgatgatcaggtgtctgaacaaattttagcatcaaatggtgatctctccgagcggaggaccatcaggttgcttaaggaagagtgaactagccctgctcccaaatgaagcaggtcaagactcccgtgctgatcagcagtgggattgtgcctgtagccactgcactccagcctgggcaacataatgagaacttgcctcttaaaataaaaaaagataaattgataaatacataaataaataaatgggaagagatgctgcgtggcagggatattataagtcattataagcaacgttctagaaaacaagcagggcagtggaaatacaaaggaaaatactgaaactaccattattaacataagtcataaaggattgtattactgtcaacaacaaaaataaaatcaccatacttgaacaattattcttctaaggaaaaaaagacaatgtagatgtccacttgttctaaagaattacttttagctagttagcagtggtcacatattatctgtctgcatgtttgggtttttttactagtagtcccttacagccaacagcatgtgtttacagaagttaacggtgccagcagattgcatggcagctgcaccgctcaccggcccttcctggaatcaggcacggggctttgatcttcctggtaccaacctccagcccaaggaactggagtaatatctcttcatgaaggaacatcaagctaatggcaaatcgccatcaaagagcatgttccactttgaagtcagtaaacctgaagttgtttcagagtaatgagaggagaaggtaacttcacagcatcaaagagagattccaaatatcagacatcttagccattgaaacagagagcacagttataggtcccagaaaacacagggatggaaggagatgaacaataacaggaagaaaaaagactgttggtaaagcaacatcattatatttagccctgtagaaatgtaaacactaaaaaacaagcagagttaggaaatgaactgggttgtacaggagttaagtaataaaatggaaataatagtatctgagatattaaatgctgtatgaatgacagacgttgttatcatgctttagaaaattaatattctgcagggctaaagctgtgagtaggcagagaatgggagtgactgtgtgtaaatagtgtgatatgaacatccggccggacccaaattgaagctgcttaagacatttccatccaggctgctctttgacctgttctccagttttatacaggagtatttttcaattttattccattttgacaataatttaaaacatttttatgataatgtaaagaaagaatacaagtatgttctagatcatcaagtggcaactgtgtcactgagtaccaccaaataatttcacggccggctttttgtttgtgttatattcatgtcggccccatcctttccacttttataacaaagaataggtgagaaaagaggctgactaaacacaggttcccaccaagtgaagatcaagtgaagcgacagcacagtgtgcaaaagaggacgttagcagagaaaaacacagagaaccaagagattgcgagaaatcacaccctgcccccagtaccgctcctgttttcccagacagcgtatcatctcagcttcaaaaaaacagcatcatctgttgttagtttgaattgtattcgtttcatcagatgcctaccatattgcaagtactttgctaaactctgggaatctaaagacaggtaagtttcagttcaggtccaccactaaattcaactataaaagacagtaactaaagtccatattgtcatggggagacactagagtgtttccataaaaaccagttctgcttgcccagctatataaaaagacagaaaaagtcaagttcaacatttcatgccgacattggcttttacagtttggctttgacagaatctcatgctgaccttgatttcacacagggaataaaggccacttactatatgcacatccgtacacttcgatccgcatcccaatcctgcccctagggttccaggctaaagggagaaagcgcaggaacctggcttcaaagggaggctggagtctgtagtgcaccacactgtctgcgtttgtgtttcctggaaaaccctaggagaaaacagagaaagggatcaatgtatctgcaggacacaccatcttcatgtcgtcacctctcatggcaatgagcaatgtatgctcgctttgctaatatgcaaaaagctgctgttttaaaggaaacactgctaatggttaacaaggatgtgacaacctctccagtccctgaattcgtcaccattgtctaagttttctttatttacaaggtagtttaaatttcatccacatcattaaaatgactataaacatggcaacctctatgaagttcacttttctaaaatgctatcccacagattcctccctaatcaagtggtaaagatgctcacaaaaagccacatcacatggcagggcaatcaagcaccacggtaacaggcaaaggatctgcagtgagaatcctggaatctgcaattagagagttggaagggacctagacatgattccagccccacacccttaatttataaatgaaaaactacagtctaggaagaagaaaggacactctggaggtaggacagctatcatagagtgtgggcaggattacatctggctttgatttcaatggcatcattgattccatgttatcaggctgaatccacttcacagtgaacacagctccatgcacctgtggcctgtttcctgggggtgtcaagaggagcacactgccactatctgctccaaggcaaaggggctttcactcttcactccatcttgctatctgaacattgggaaggatcagagtgcaaagcaaacaaagttgttttagatatttttttcattgttctcagatttttaagaatatggcatgtgtgagaacaaggaaagggttaatgctattttgcactagaagtgctatcacctaacatgactggggcacatagttaatatctatgtatggaacaggccagcagttagttcaaccaagaatgaagaatgtttcctgcctaattattttgctttactaaagaatgtaccaggcttagggccagcgcgttggctcacgcctgtaatcccagcactttgggaggccaagttggacagatcacgaggtcaggagatcgagatcatcctggctaacacggtgaaaccccgtctctactaaaaatacaaaaaaattagccgggcatggtggtgggcccctgtagtcccagctactcaggaggctgaggcaggagaatggtgtaaacccgggaggtggagcttgcagtgagccaagatcgtgccactgcactccagcctgggcgacagaggtagactccatcacaaaaaaaaaaaaaaaaaaaaaagaatgtaccaggcttaacaacaaaacaaagagaataaagatcagcctgcctcatacccaaccaccaatgggtgtccctgggtataaacacatggaaataaaaatataggaaatgccttagtgaatgtggtcaattttaaatgctagtgttgatgctcagacttggtaacagttcgtctattgttaattcgtgccaattccaagataatcatttcacctttttttttttttttttttttttttttctgagacagggtctcactttgtcttccaggccggaatgcagtggtgcgatctagactcactacaacctctgcctcccagatttaagcaattctcctgcctcagcctgcccagtagctggcattccagaagcatgccaccacacctggctaatttttgtatttttagtagagacggggttttgccatgttggccaggctggtttcgaactcccagcctcaagtaatttgcccacctgggcctcccaaaatgctaggattacagtcattaagccaccatgcccagccagagataatcatttcactcttgttccaactaaagggtcatgtacatcgacattttttgagttaacaatcgctataccaacttcaggtaaatatttgcacaacctctgcactcacaaccttctgtctggacagcccaggctgacctatataaaagaagccatatcccagctccaccacctcaaaccctgctactctctgctgcaagctgcagtttctccatctgtgaaactgatcttgaagggccagagtactaattgagataacacctggaaatcaatcagcccaccacctgcgtggaggtggctgctgtgattgtgacccaggttggtcattgttggcatggttggtagagatggttgatccatccttttattttggttctaatttgggtttaatatctaagacatacagccaagctaatacaagaacatcagatcctatgagcattttgactccaatgttaaaattcagttgcagaattaaaatcatatttttctgtagctgaataaactttgtaaacctcagcaaaaacaatacaataaaaacctttcaaaggaaccctaccaaaacagaattttttcacctttatctgccaaatgttacttctttctcaatttgtttcaaagtgtaaactctggaaaatatacttctgagtgatgtgataataggatcatgtagcaaaataaaacttaatgtcaatttttgcttaattaaatagattaacatttaagaaactttaaatagacattacctaatagtttgtgaataaggcagatgagaaacatactctttgcaacttcagagatatcaataaaaaatcaaacatttattacatatgactaaaatatatttaaaagtttatatatataatcacattaattcatttgaaatttcagaaatcacattattgtcttatatagaattataaccagcttcatgggataccaaccaaatgaaccattgttctttaaagatatagaaattaaagagaatacattttgggcaggaaagatttatactagcatttcactgtcataacattcagggcttattattgaaataaccttatctataacagtaaaataatgtgtgtcttaaaaatatgcagtgtagtttcttatttattatattcaaagtttgcttcgagagcttgcagagcagacatgagttcatacgtgagcacatgaccactacggacagaaagaatggcgaacacaaagacctattcctgctttgttttattaaggtggaaaaacgaaccttctagaaggataagccagcttttatagaaatatgcagccttcaacaattctgcagaggcttacgtcttcattttagacataaatagcaaaagttacagctctgtggagagtgagggtatacagaatagttttcggaagccatagtccttcaaattcttttctgtcttagcaggcatgtgaccttgggagaaatcatcatctttctttgtaaagtagaaaaattgtatctatctggcaatcttggtaagaattaaactagttaatatatataatgtatttgtaagattataaatcatttattttttacagcattcctctgcaatttgtgtgtgtggtgtgttcatgtataaaagctccatcttattgaaagacagtcacttaagtttgatgtggattctctgtctttgagggcattctagctaagtattatattaagtaatcaaaaatgagtattttcagataaaatgatcagtttccataacatgttccttaggtatacatgaaagtgagtgaaatctgcggcttggagtccactcacatgctggaaatatgtttcataaataatttaggaattaatgacattactgaaaaatttccaacactctactttgatttttagcggtcacattagttaaatctaacagtcacagtcagtgatggtgctcatgtgatatcctggtctgcaaaatgttaagcgcatggatagttgtggttgagtatgaaatacccagattgacagccataagcagaaaaaaatctgtcaaggtaagactcatcaacaactatttttaagaagactgttagaaatttgttatttttccaaatttgtcattttgtcatttctgttttagtgggtttttatcatcaaatctttattttaaattacgagatactgaaatgagtctctgaattttaaaataaacattaaatctctactatgcatagggccaccactgtcctatgcaatttcacacatcaattcagttagtcctcacaaagatgttagaaaagcctgtctaaaagaaacagattcttcagcagcttcagtttattattagtttcccaaacacttaaatgtactacgagagattcttattttaatatgctgttattattttaagctgtctgtgtgtggggtaagaaagtgcccgtgagtccctgagttctaattctgtttccttaattgccagactatgctgatattggatacaaattttagtgcttgtaatctcagcttctttatgagtaacatgggaataatactaactgctctgcccaattatagcttgttggaagatgtttctgtaggtgacttcaaaattctaaggaactatacaaatgaaagatattgctaagctgctccctgtaatgcctgttaacaagattatttgattaagacactttgttaattataagtgttatatgaagaaattgtattaattctaagtatatagcattaataatataattaccatgacatataccttgatgattttatgaagcaattaaaatgtttctatagattattaaaaattagcatattatctttatcaccttagtatgactagtacaattatatttatgcagagttaatcagtaaaaagcaaaatgaaagatataaaacaatattatatgtaagtgtaaatatgtgtgaacaaaagaattatgatttttaaaagagtatgtacaaataaaatgtattggactggggaaatatgaatcatgtacaaaaaaatatgattaatgaatgaatgaacaccaaggcaagagtagggtcttatgcagaccagaccgatcattccttcatgattactcactaaggaaggtgactcatggaaaccttggcatctgatgtctaaacatagtaaataaacaaaaaagggctccagcatgtggacccagtgcctgctgaagagctgttaaccctctgctgctgccccctcaacctcctctgttctcaggatgctcatgggtgaagaagggactcctggcaagtgggacctggggctgccacagagccctcccaaggacatagacaggactgtgaggccacggctccagcaggatgctggctcctgcaactgtcaaagacttcagctcagttttggagtttcctgtaagtgatatatcatatgatgaacacaggctgcgaagctggagagacctgggtctgaggccaagtcccaacatatactggttctgtgactgtgggcaagacactcaaccacgcagagccttctcctctgaacactggggagaatgatgatccggactcacaagactctcacgtatctctaaagctcttaacataggactagcatacggtaaataatcaattagtaggaaacactgcttattattatctgttaatactaagtgatatttcctcttactcattctcacaatgctactctttgaaagcaaggatgaatctatggaccttttcctttgattctcagccggaatcaacttaatcacttaggtctgcatcccctcactagcagatgacattaggcaaggatgatactgcttttgtccctgttattttcagaagattacagataatggtgtaacatgcaaaactgtttcttatttaaattagtatcgataactgcctatgtgaacagttgtacttaattattttaaagtgctcatgaatgcattattttttactaaccattagaatacaatgtttatcaacacaaaatgagaaaagtgtgactttgccttattctagcattattaaatgaactgaagtaggaattaagaaatgtgggtgatggttccagctttttcattaattagctgtgagagccatggtatgtcacctgaggcttcagtttagctggaaagcatgctacaaagtactatggggccaggcacggtggctcatgcctgtaatctcagcactttgggaggctgaggcaggtggatcacctgaggtcaggaatttgagaccagcctgaccaatatggtgaaaccccatctctatttcaaaaaaaaaaaaaaccaaaaattagcctagcatggtggtgtgcccctgtagtcctggctactcaggaggctgaggcaggagaatcacttgaacctgggaggtggaggttgcagtgagccgagattgcaccactgcactccagccttggtgacagagtgagactctatctcaaaaaaaaaaaaaaaagtagtatggaatctaaagttttctctagcactaaaagagcatggcctgaaatagttagtttatattcgggtcaagaaagaaagaaatgttagaaaataaatgaataatcaatgacagcaagagtaccttattggaaaaaatgtatgtatatatgcacttatgcatatctttaattaattaaatatacataatcattgaaaaatgaaacactgcaaatacatttgtatgtttgatacttgagcatcctatcatttttttaaataaaaatgaattaatttaccatatttgaataagtcaaaaagagaaaaacaaagtgtagtgcatgtttaaaaaagacaaataaatgtttgtgtttgctcactactgataactttgaggaaatgatcattcagaaacataaagcaatccaaaatacgaatcaagattaacgtaaatgtaatttttaaaataattcagataatgaagagagcagaactagccacttagctctctgtatatagtgcatataactaaatatatcacaacttaacaggcgttctttctgagatattgctattgactttaaatgatcacgttagttaaatgttaaaatacctttttagaaagcaggcaattcatctaacttgtcatttgacttggatctgggacaaatttcctgtgtgagattgatcagcatgtcttcttgctctcagatttccttattataattataaatctttgtgccttataaaagttcagggtattatgctggtgccatctctggtttctcagagactttcaacaaccagcctcgttctgggacatgataggcattgctgcaaaatcaggaattcttcaaggagaataaatgtctgctgtgttgaattttatgctaggttccccaagatctgcacctttaaccctcccagtatttaccagtgtttaacacacagttggtcccaggcaaatgctggtgcactgacttgattgttagagataatcttcctaatgctatattctatccagtctctctaaacccagctccttgttctgctgtgaggagcagcacctgtcttcctttgcctgggtgactcagagatgcccactccatcttcatctctggactcaccacaagtaattacttagtacttcccaccaactgcagagcaatttacttaattggaatgttttcacactttttcatccctgataatcaacctgcacagatgaaaaaattagctagggaatcactattattaaatcagtgatctaagtgcttttgttattctaactgaaaattgtaatcatttgtttgtttgacatatttactatctgaccatcagacagattcacttattttgtccattttaactatgaccaaatatatattttttcacataagaatctgtgagcattaaactgggtgatccatattaccttatccctgaatattagatattggatatgcacatacaaatggttatgattgttatgattagtgtgctatcatggaaaatagttcatagtcttgatagtctgagaattgctatgataatagtttcaaaaacatttaggatacttgttccctatttttaattttagtttttagcaacaaaaatcatttgaaaagcaaacaaaattatttcaccatatttttacacttgtaatcatgtataatacgttctaagaaaaagccatctctacctataaaatactgcataagatgcaattgtatattcctgtgtgtctctcacacagatccatcaatgaacaatattgccagcattgggaataagaatactgaatgaatcaggcctaggttgagtattttctgtgactatgaggcagtcacatcctcctatttggttaggatctacagagtaactagactcaaaaggtgccacctgcctagaataatattagtatgagataataagacttgctcatagcttatccggcagtgtgctagaaattttctgtctatgaatttgtaaaacagcagcaacaacatgaggcacatggaagttcaatgtcctatggtcaaagctgagctctggaaaccgccttcgcacaaattctaacagtgaaattgaaaccgcctttgcacaaattctaacagtgacaaaattatggcaatggggagacctgatctagttaaccccattcttgcccttgaccttcaagttgcccttaatcattcctgagcttgggcaagccaaccgtgagagacatctagtttatagtttaaatgataatagcccttccccaaaactaaagctaatgagagaccaccaggctaggagaatagaggagcctaaattctgctaagatacagacataaatgattgctagccatttgttcagaggtcacgagatatgcaacttcctcatgaattccagcagataacatcagtattgtagaatctaagattagccttttgagatatccaggttttttgcatgtttgactacccatggctccactggacctgccaacagctcccgtagctccacccataagtaactcagcatgcagaagaatcatttcccacacccctatgattacacccccaaccaatcagcggcaagcacccatttcctagccactcccagcccttcccctaaactacctttgaaaaatccctaatctatgagccttcgatgagactgacttgaacaataacttcatctctaatgtggtgtggccgaccttgagttaatttaaactctttacagcaaataccatgttttttgttttgttttgttttgtttgcagatgacatgattgtatatttagaaaaccccattgtctcagcccaaaatctccttaagctgataaacaacttcagcaaagtctcaggatacaaaatcaatgtacaaaaatcacaagcattcttatacaccaataacagacaaacagagagccaaatcatgagtgaactcccattcacaattgcttcaaagagtataaaatacctaggaatccaacttacaagggatgtgaaggacctcttcaaggagaactacaaaccactgctcaaccaaataaaagaggacacaaacaaatggaagaacattccatgctcatggataagaagaatcaatatcgtgaaaatggccatactgcccaaggtaatttatagattcaatggcatccccatccagctaccaatgactttcttcacagaattggaaaaaactactttaaagttcatctggaaccaaaaaagagccctcattgataagacaatactaagccaaaagaacaaagctggaggcatcacgctacctgacttcaaactatactacaaggctacagtaaccaaaacagcatggtactggtaccaaaacagagatatagaccaatggaacagaacagagccctcagaaataatgccacatatctacaaccatctgatctttgacatacctgacaaaaacaagaaatggggaaaggattccctatttaataaatggtgctgggaaaactggctagccatatgtagaaagctgaaactggatcccttccttacatcttatataaaaattaatgcaagatagattaaagacttaaatgttagacctaaaaccataaaaaccttagaagaaaacctaggcaataccactcaggacataggcgtgggcaagaacttcatgtctaaaacaccaaaagcaatggcaactaaagccaaaattgacaaatgggatctaattaaactaaagagcttctgcatagtaaaagaaactaccatcagagtgaacaggcaacctacagaatgggagaaaatttttgcaatctacccatctgacaaagggctaatatccagaatctacaaagaatttaaacaaatttacaagaaagaatcaaacaaccccatcagaaagtgggcaaaggatatgaacagacacttctcaaaagaagacatttatgcagccaacagacacatgaaaaaatgcccatcatcactggccatcagagaaatgcaaatcaaaaccacaatgagataacatctcacgccagttagaatggtgatcattaaaaagtcaggaaacaacaggtgctggagaggatgtggagaaataggaccacttttacactgttggtgggactgtaaactagttcaaccattgtggaagacagtgtggcgattcctcaaggatctagaaccagaaataccatttgacccagtcatcccattactgggtatatacccagaggattataaatcatgcttctataaagacacatgcacgtgtgtttattgcgacactattcgcaatagcaaagacttggaaccaacccaaatgtccatcaatgacagaatggattaagaaaatgtggcacatatacaccatggaatacaatgcagccataaaaaatgatgagttcatgtcctttgtagggacatggatgaagctggaaaccatcattctgggcaaactatcgcaaggacagaaaaccaaccaccacatgttctcactcataggtgggaactgaacaatgagaacacttggacacaggatggggaacatcacacactggggcctgtcgtggggtggtgggaggagggataggattaggagatatacctgatgtaaatgaggagttaatgggtgcagcacaccaacatggcacatgtatacatatgtaacaaacctgcacgttgtacacatgtaccctagaacttaaagtatataaaaaaaaaagatctgcatagttttggatggtatatatttaacatgatcttcctgttctagatagataaacctctagatattagagagttgtcaattttcactcttataaacaatgctgcaaccctgtaaatatgagtaagatttacgcttacttatctctatttcagaataactttctagggatatagtacactcagcagccctccatatccatgggttctgcactcatgaatccaactgtgattaagaatagtagggaaaaaatggatggctgtgactttgttgaacatgcacaaccatttttttcttgccattattctttaaacaatatagtataacgactatttttacagcatttgcatcgtattattagtaatctggagatgatttaagtatacaggaggctgtacaaaggttacatacaaaactacaccattttatataagggacttgggcatccatgaatgttggtatctttgggggtggggggctcctggaatgaatctcccgcagatatccagggatgactgtatttctagtccacaaggttgctcatcattgagtaacttctttttacctgcacatggaggtgtattttaagtgtccattcaaatcagtgattgatgagaatacacagtgtatttttcctctaggccacagaaactaatttctgaaatgaaatttttttaactaattgactttttgctagtttttgaatagcccaaagaaaatgggattatattctcaaattcaaatcatcatcatcatcatcatcatcatcatcatcatcatagcttatgtttttgagcacttcccacatacttccttaagccctttgctcagagatggtcagtatttcattgtcataataaccataatcaccttcacccaaatttgtctgaaatgcacaactgattcccaagtttatatagaaatattgatattttctttttttcttttttttttttttttgagacagtctcgctctttgcccaggttggagtgcagtggtgggatctcagctcactgcaacctccgcctcctgggttcaagagattctcctgccttagcctctcgagtagctgggattatagatgcctgccaccacgcccagctaatttttgtatttttagtagagactgggtttcaccatgttggccaggctggtctggaactactaagttcagatgatccacctgccttggcctcccaaagtgctgcgattacaggcatgagccactgcacctgaccctgattttcattacttttctttcagattagtttatagatttttagatttgaggcttagaagaaaattccttagtttagtatagtagaactattttcctgtattttatttaaagcttaataatacaaattttagaagtgcaaatatattttattatattctttatctctttatcttttttatttgtaagataaaagtaaagatttatctcacaaataaatgtttataaaaaatgagatagcaaaagcaattattttagcctgcctaggagatttaaaaattggttccacagatctgtaagaataaacacaaacaattttctatagacaaattttaaagtataatttgaagtacatcagaaatacagtcgtctccccttatctgcagttttgctcgctttccatagtttcaattacccatggttaatcacagcctgaaaatattaaatagaaaatttcagaaataagcagttcataagttttaaattgctcactatcctgagtaatgtgatgaaaacgcatgtcaccctgctctgtcctgcatgggacgtgaatcatccctttgtccagcatatccatgccctataagctacccacctattagtcacttaagtagccctctgggttatcaggtgggttgtcatggtatcacagtgcttgtgttcaaatcactcttatttcaatcaacaacggctccaaagtgcacaagtagtgatgctggcatattgctacaattttctattttattagtggttcttgttgttaatctctgtgcctcatttataaaagcaacttcatcacaggtgtgtatgtataagaaaaaaacatagtacatatagggttcagcactgtttgcagtttctggcatccaccagggatttggggactactgcagtcactttctcccaaagtatcacctccatttctcacatctgagttgtcaccatcaaaatactcattgttttgggcctacaagccttttaaagttcattattaaagtttaaatagccttttatggggattcttatcagttagtgcctttttcattcatttgtccaggatgtttattaaaccagaacaccggcactccctggactaggaaacaaggagcgcgcaggctggggcccagagactttacacgactcctgaggacaaccgactcagacggggtccgaagaaattcagatcggtgaacgggtgaaccacacagagaactagaaaaggctacgtcggcccacttcaccattttgccctgagatggttctgtggacttaacaagaaaaggaaaaggataaagcctgtgccagaagaagtggttcaggaggtaagggtttctaagattgtgtatggctttacaatgtatagctccctcctccaagtacatttcagagacaaatcctgagcaataaaaaaccttgagcaagctgaaagcaataaaaatgtactggagtgtgataaaaaggacattttgccaatttataattacactcgtaacatataagctgtttcatactttacaagttgcgcttgctaggagtcaggtctgtgggtgtatgtaatctttcctctctatacttctgcataagcctatttttcttcaaaattttatagctgtttgtgtagtgactccaaataaaaacagtgaaaatacactgattatttttcaactctaaatacccattttaagtatagctgaagaatgaaaggatataatcctcctattggtcccttgttgctaagaagcatttccgttgcagattttgagtattacattcattgaaaaagtcttatgcatattttatggcataattatttttattgtggtaagaaacttaacatgaaatctatcatcttaaacaatacagtaccattaactataggcacagttttgtacagcagatcgctagaacttgtttaactgaaatttatgccgaaagagatagcaagtgttggcaaggatgtgaaaaaaaggaaccccttttgcaccattggtgggaatgtaaatggtgcagctgcaatggaaaacattatggcaaatcctcaaaagattaaaaatagaactatcatatgatccagcaatcttactttcgggtatatacacccccccaatataaaatgaagatgttaaagaaatattggctctcctatgttcactgcagcattatccacaacagccaagatgtggaaataacccaaatgtccactgatgagtggaatggataaacaaaatatggtataatttttaaaatcacaaactgagttggtctaatgtcttaaattggcatgtcattttcagcttgacattcacaccttgaagattcagttaaacacagaatagcaatctgcatctttaatatcatctcggtggggctcagactttcctgtcactgaactttctgtaggtcctcagtgctgtgaggagcttagaggcccaatagcaacctgtcctctgggattccgtcttccaagttggagcaactgggagaacaacaggggccactggaactgtccaacagagtcctgcagctgcaggacagccatggggtagatggaggacagtcagaattctctgctgctttcatttcccacagagctgttgtccccgtcttcctccccacagtcagtgctgtgggctcactttgcaaaccacacaaggaccggcctgtgagaaacttccagtagaaaatgctgccaccctgagaaaccaggactttccagaatctttctgtccacatgtcacctacttataaactgagggaggcagtgctggattctgtggtgaggcagggttggggggaagggtttttaacttggaagatctaaataaaccagagttcaagacctgtcacaattccaagtatgatgtaaatcactcatcccccttgaatttcccatcttccttttgcaaaatagaggtaatggtgattactcctaggatcttatctgagggaagatgtatagatatcagtaaacataatgcactgtggaaaattcaaatgatttccacttcaagtacactttgggatgaagcaaggttgaaagaaaataaggaagacaaggttttgtttttgtttcttgggtcttgctctaataaattcacaaaggagtttgaaaggtgatagcggctgggtgtttcatagccaacaggcctacacataccacagaaaccacacagcaaaatgtaaattttaaaatatgttcccttctttttaactttcagcaagcttaacagatttcaaaattacactaaaactctcccagagttaaatgttgtttttccactctggaaaagggaaattagattgaaaaatagaatattaaaaaataggtaataatggaagaaaatgcattgggtgggggcctctaactacatacactttggaaaaggaagatgttttcctactctgtctttctcgaagagttgcgtctggtcctactcaagtctgcagagggtcagtttcctgttcacttgctcacagcagcttgcagtccttctcagtcccaacttctaattttattcattttcaccccaatgtagaatttgtttctcacagtactcatcaacgtaagccacggttcagtcttcctgatattttattgtgcaatgtatattaaatactgtattacattttaaaatacgagttatgagatgttagtcacattcattaatctgcatgtgaaagtacaactaaaatgtgggcacggtgagtccctggggccgcagttctcagggtttatcgagcacatgatttctttcaaggtgaatgtgatttaacttaaaaaattttgctgtttttataaaggacaatcagacttctctgtattatttggcatcgctgcagggttcagactttgaatgaaggcagaaaattagccttcagcatacaaagtaaagtgtcaataataagaagtaagtggtcactaaagctaaaatcaggaggaaaaaagcagaaagcaaaaccaaagcaaattcaatcccaaagcaagtttaaatgggaaaataaattaaaaattaaattttaaaatgacatagcaaattataaatagaaagaaatgagtctagtcgagttctgcagcctccagcctggagaagggtggggtgagatgaaaacattcagacttccttccttcccttccttccctccctccctccctccctcccccactcccctctcccactcctcccttctccctcccccttcccccctccccccttctgccccttcctcccttccttccttccttccttccttctggtgtgaactgcaccagcaccctgcccctcgcccctctcacctgcatctccttttcatcctttctccctctctcagttggttctctgtttgtgatagtgttttaggaccaaccacttgggttcagatttcttcagaggacaaaatgccagagggactagaaaggaggagggggttcctatgactcagagggaaaagaacttgggcctggaactaagtctcctgccccttctgcatgaaagtgccctggagtcctcagctgagcaaatccatattcctttaaaaggcaggaaatgcattttgcccagcactaaactcgtcctcactgataaattccaaacctgagggggaacagctgtgcctgatcatcgccctcactcccaccagggagacagaatccatagaatccacagcgtgccaaacagtttgggattaatgtttctgtgtggaaccctgaagagagacacgttctgggctgggatggcagcaaaaccacatcactccagaattccaatcagagacccgagagcagccattcccccaggcctctcatccctgtcatccccggacatgtcctcaaatcgtatgccgttgatcctcaggtcaatctgtccttttccgggctctctacactcccatccgcccatgcactccccactactcttcttccttccccacagttttttttctgtgcactctttgaccctcataaagaagggaagggaaaaggaggggaggggaagggaagggagggaagggaaaaagaaagaagagagggaagggggatgaggttgaggggaggaaagaaggaagaaaaaagactactttaatcttatctgagaatattctggtgtagcctagaaattgagactggctccccaggtgggcagcccaaggtttctggtacaggctctgcttgtgtgacatgagctcattactgagcctctctaaagttgtatttcttcatcccaagttaatgatgaaaaagtaaataatagaatgcagctaaaattctaaaaatctcacctggtacacaataaatactcagttatattgggtgtcagacactgatctacaccttgattaaaactcaggtctttcttttggacacccctgcccttgtaacactcaggaatgcagtttcctcatttcccctcatcttatttgtggtggggtctggacacattttcaccgatctcctttgatttcataacattgcacttcctcacaaaagtaactgaacacacacaacgagaaagttatctcttctcttaaatgccatttgactatagctccctctacccttcctggccattgtaattcattttctaaactctgagtcattcccttacacttatcaccatcttctctatcccaaagccacaatatgaacatccttgaggaataccaataagatcctttgacttcaagttccctgatgcaaatgagctccagctgcttcacttcagcctcattcccacggccaacctcatcaccacctgggatgggggcaccatctttgaaatcttatttaaactctgtgttgactgtacacctctagatagtcccagatctctcactcccacactatagcttctttgacatgctgactctttctgattttcgttatcagcctctcttgatctaactgtcctctccacattgcccaaacagcatggtacctttttttccagactcttttgccaatttgttagcatttatgtagccaaatcctcaatgtcagcatgtcagcatacctgcagatgctaattctaggtcagtcttctcagttgccttctcaggttctgcaaacagctgactattgctggggaaaaccccccagctgtgcgggtggggtccctattcatggtctccatcctggggtctgtatgctacgaggacaatggtccttagccttgaatgaatatgggaatcatcaggtggattctttaacatactgcttagttcctactctcttgaggtttggatttaagtggtctgggcagtggtctgggcaggtgtttccagtgtagaaatgtactattactagggactcttgttgttccctgtcaaaatctttttccattccacatcctctactacacacacataaacatttcctaccttaattccacttttcccttatcatttttttgtttgtttgtttgtttttgagacaggctcttgctttgtcacccaggctggagtgcactggctcgatcacagctcattgcagcctcgatcttccagactcaagcaatcttccttagttttccgagtagttgggactacaggcacacaccactacaactaggtaatttttgtatttttttgtagagacaggggtctcactgtgttgcccaggctggtctcagactcctgcactcaagggatctgcctgcctcagcctaccaaagtgttgggattacaggtatgagccacagcaccggatccttcatcactcatatcacagagcttgaatcttctgaacatcaagtagataagaacagccataaactccctttcagaaatttaaaataaagcatatataattagctattttcctcctgtttcagaaaacatcattgtttttcagtgtcttctgtgttctggatccttttccctgccatccctctgggacgttgcccctcagctactctgtgagtttcttctgtctccaagctgttgatgggcatgggagttccaccagcatccctggcagtgaccaggctctagtcgctctagcttccacttcacactgtcccctgcccgtgtatgtccctcttgctactgctgtcccactctctttttctaagcatcccgacttctacagaaagtattcatcatttgctctctccttttcattaactcatttcctctcctcagtcttctgcaatcaggcatctactcttatccattcatcaatttactgatgaactcagatctatcactaatttatacagattattttgttttcattttcacaataatcctataacgtatgttctataataacacctattatatagatgaagaaacaaggtacaaagtggttaatcagctaatccaagttcatacagctagcaaacagtgaacccagtatttgaacccaactgatttgactcaaactctgcattcttacctacgtcctgctttgtcttccaattcacctgacatttgcttgctctgatgacaaaactctgccctacctgatttgacattcctagcattcaagtcagtcttgggttaaatagctgaagtgggactattatttccagactccactgttaaaatgcacaaagaagccagaacagagggagtgtgctgatggttttcactaattattttcctctaccacattagcttgggtaccagatccagccacgtttttggtgccacaacccaaggagctggagggtaaggatccacagaggggaagggatagaggagatgagaggaaggagaggaaaggagaggagagaagagaagagaagagaagagaagagaagagagaaagggtgaggatgaccagctcagtacccagtgttctgcagctctggaaggtaggcctgccttgatctaagatgtgatcctacaggacctctggcaaccagaagctccaaacaatgcccaaagcaggtaacatgaaaaaagatttgggaaggataagaaatgcatattcctgaacctgaactcagaggtagctacagcttactctgcccggtcacagcacacaaatgcagtttcctttcagaaataattttcgcaaaagattttgtgtcatagcttaaggaatttagctcagatgaagaaaaaaaatcttagtattaagattctaaatagaacaataaaagaaacccatagtacaaattaatgagatgtgatagggctaatttctctgtttagagatgttttaactgtgacttgacaatactgacatgcaagctcttcaggagaacctagttttcatttgagcttgcttaattaattaccgaagtaatgaatttattctgattcaagggtagacaactgattgttaatgtaaatttattggccgtttaactttttttattattttggagaagcaagggtggaaaaaataccaccagagtaaatttacattgtgttcttgggatatttttcagtaatttttgcaaacttccttacaataaatagaagccattcctaaacctgaatttatttttcctttcagtcagaagtttagctaataaaacttttgccagagtgtagcacaatagctcccctgggaactctttcaactgtgtaattttttctctctcttgtaaaaagaatgacatggtgtctttaaaatgttcaaggctctgaaagaaagacaagccatttgatatgaatgattaataaggacattaaggaatacaaaataagaggagtttaaatataaaaaaaattctcattttcagaatgcagatcaaatctgacttctcttctattttttctgtttcacagacaaaatcctgactgaggttaagtgctaatgtttttaatgcccatcttttattctcatgcttgacaccaatcggctacttcagaactagtgtcttgacacttgaatcttttccacagcaccaaaggttattccacaaggacatctgcgaaaggaagaatatatttctaacgcaataaacaaaggattttatgcaaagcctatttagacaggaaatggaaacccggatggcagagaagccatgttgttcaggtcctgctatttatgagggtgagttttccttgagaaacgcatgtctctttataagcagaaacctctgtaaggtaatccagcagtgacggaatgagatataatattacgttttaatcaaaaagagagtcattaagaatatggcattattatttatatttattcttatccatattattttttaaagtattaggaaaatattcattgtggagatgatttaagaatctatccatatgaggaaataaggtattacctgaaaggggtcccgatccagatcccaaaaaagggttcttggaccttgtgcaagaaacaaattgggacaagtccagaaagtgaaagcaagtttattaagaaagtaaaggaatgaaagaatggctactccagaggcagagcagcagcatgggctgctcaaataaatatagttatttctttattatatgctaaacaaggggtggattattcatgagtgttccaagaaaggggcaggcaattcccagaactgagggttcctccccactttagaccacatggcataacttctggacgttgccatggcatttgtaaactgtcatggcgcttgtaaactgtcatggcgctggtggaagtgtcttttagcatgctaatgaattataattaacttatactgagcaataaggatgaccagaggtcactctcatagccttcttggttttggtgggatttggccagcttctttaccgtatcctgttttatcagcaaggtatttgtgacctgtatcttacgccgacctcttgtctcatcctgtgactaagaataccttaacctcctaggaatggagcccaacaggtctcagcctcagtattcccagcccctatgcaagatggttcaaatgcttctgataaagggactcatatattaggaattcacaatctgaaatgagcaataatattctgaatgtaaagatagcctaaatgacatgttttagccagtggcatataaaattagatttgtcatgaattgatgtcatacgtataatttgggggaaaggccagcatagaataattgtaagatagaatggaaaataactgagtttcaaatactggcaggcaaagagtaggcaagccattgtagctcatggtaattcagaaaggcatctggaaatggagccatctcagaagtcgtttacatgacagaagagaaattagtaaatatttctgaggtggagaccagtcggcaaacacatggctttactcttggtcaaaggacctaattcagaggtgatgagatgacaaacgtttgggggtgatacctgacaccaaaggaaagcaagaactggagaaatggtcatgagagtaaagatgcaaaactctagtgactgactagtagcagcaacttagaaaccgagtcagcagctgaaatgcaaaaggaagccatcctagaagaaagccgggttaaagtcgcagacagagtgggctgctccaacagcaaagccatatattttgagacagcgatgcgctgcctttcttcacaaggtttacccagcacacccacccaaaccatggcagacttgtattgatgcattttccccttccaaatggatcccctgtgagaactctgggagtctatcaacacaaaggttgatgagaaagtagaggactgagcaaagccaacttactttgaacttcaatactactttagagcacaataaaatattaagatttacatcatcctgcttccttattgtagattacccattgttcagtctactttgggatttcttcattgtagcttgttgcagcacttctgtgcgtgtgtgtgtgtgtgtgtgtttgcatgagaaatagttacaccatgtgaatttaaaaatgaggagaacttagataggaacttgttagtctcaactgcagctgcccctgtggaaaactggtgttgccctccctttacagttttgctgcagaaatgggtgattttaaacctgaaagtcaaagtatatttattagcttgatcatatgaaattgctgtttttgtaggtcaagatacttagatatcagcacattcacaaggttcagccttatagtgcgtgactggattccacatccaccctgcattttgtaatcgaaggggaggaagctcacaggtgttgagcaccttgtgcttggccaggtgtttgttaggggctattttagaaacagcactcagttagttactcttagccaggtgctgtctgcaccacatcacgtgatggtcaaggactgatgacccaggccatgaataagtatcattcattcaacattaaacacgagaaaaaaagattcattaatttaaaaaacaccactaaaataaatattacaattagaatttgaaggctcctatttctttccattgggttatatccactaataaatgttacaaagttaggatgacacttaacttgagatacagttttgtagccgttgtttttttttaatctaataagctccttctgtgctataccaaatgacctccctagctgggactcctcctgacatccaggctgttccttcgcatttgaaagcccacgaaagtctttcttcttaccagtacactgatacccacacatcccagccactgcccttcactctcacatcaagataaggtcttgatgttcactttcaggttttatatcagtatactgagcattagcgattggctttcatcctggagaaatttcaatgggaaaaagaattgcattaaaatcactacttattattattttttacgtttatttcaatttgtttttaattgaaaagccatacgattcacatagttcaaaccacatctgcatccattttatatttttatcccattcccattacccagaggggaaaaatgctatgatttttcttatttttcttatgtgtccttctagaaatatttcatatttacatgagtatatatatatatatatatatatatatatatatatatatatattcattgtgggaatttcaaatgggagaatatcttaccttattctttgattttagaaaaatatcttggaagttcattcacagtaagtatgtttacctcattatttctcaaggctgcatgctattccagagtataaatgtaccatgaccactgaaagagaactgtactaacatatttaccattatattcataaaatgttaatctcttcatgcacatatgcatatattacactatgactgtgggataaattcctagaagtagcattgctgcttaatgtaaactatacattgagagaaactgaaagcatcactctttttgcattacctccattcactacactgcaagttgatcattttttggaactttaattttatagatagtgccaaatggttcttcaagaaatcatattcataaaaaggcaccagttcctgaaattgaatcatctgagttttaccttttcatgtgcacacatgaaacagacctaaaacattcccagatgtggtgaggggttgtgagtaaagattctgcagccaggccacttgggttcaaattattgtgctaccactaactagctctataattggggcaaataaataaagcctgtctttttgctttccttgttttcatctgggaagaatattagtatctagctcatagagttctgcgaggattttaatatatacaaagcacaaagaatcatgtttggtgcacagtaagcactcaagatacataatgtcttcatacttaaatttattcttaaaactgattatttttaacctgagccttatgctgagcaatgatatccataatattgcatgtttgcatactatttagattttaagagactttaaatttaatgcattaactatgaaagtacagttgaaagtaatgtcctaagcaacacagcctcagtaaatgttttagttgttctaatcaattgagtagtacctcactgctgttttaatttgcatttctttaacttataaacaaggttgaatattatctcatgaatttattattattattattattattattattattattatttgagacggagtcttgctctgtcgcccaggctggagtgcagtgacgcaatctcggctcactgcaagctccacctcccgggttcacagcattctcctgcctcagcctcctgagtagctgggactacaggcacccgccaccacacctggctaattttttgtatttttagtagagatggggtttcaccgggttagccaggatggtctcgatctcctaacctcgtgatatgcccacctcggccttccaaagtgctggaattacggatgtgagccaccgtgccaagcattatctcataaatttataaactattttttcttcatgtggaatgcttatcaatccttctcaattttacattgcttttttttaatctttatccattgatgtataagagcactttataaaaaaactatcatgtatattaaaatattatttcccattcataaattgatatcttctggtaagtttcaaataatttcatttattagtccctttactgtggtcttggttttacatcttgcatagaaatacatgcccgctcccacattatatatgcaaacctctcccacaatcttctagaactgtttctgtggctactttaaaatctttaattcacctacaatctactttgatgcaaggaatagggtaatagtccagttttattaattttttcctgagggatacctagtttccccagtaccatttattaatttttttcttactaatttaaaatgccacatcttttatcagcatatatatttgaatttgttagtgaatactattttttccactgctattaatatcaagcatactaaaatatagaatcaacctttattatgtactttttttttttttgagacagactctcactcactctgtcactcagcctagagtgcagtggcgcaatcttgtctcactgcaaactccacctccagggttcaagagattctcctgcctcagcataccaagtagctggaattacaggagcacgccaccacacccagctaatttctgtatttttagtagagacagggtttcaccacgtcagctaggctgctctcgaactcctgtcctcaggtgatctgcccaactcagcctctcaaagtgctggaattacaggcgtgagccaccgcgtccagcctctaggtatttttctaattggtaagactaactcctttttcaatttcttgttgccaattgtactgcttatccttttatgaaaattaatttttttaaatgtgacgaataaaatatgtatgcattatgtacaacttgatgttttgaaacatgcatacataattgaatgagtacatcaagctaattaaatatgcattacctcacatacttatttttgtggtgagaaaactaaaaatctattctcagcaattttcaagaacacagtactttgttattaactatagtcaccattttgtgcaatagatatcttgaacttattcctcctacataactgaaattttgtatcctttgaccaacatctccccaactcccaaactcgctagtccctggtaacaactattccaccttctgcttctatgggctcaacatttttagactccacatataagctggatcctgtagtattggtctttctgtgcctgacttattacaccgaacataatgtcctccaggttcatctatgttctcacaaataaataggatttcttttattttatggccaaatagcattccattgtgtatgtacaccacattttccttatccattcatccacagatggacacttcagttgattccaaatcttggctattatgaataatactgcaatgaacatggttgtacagatatctaaaagacatacggatttaatttcctttggatacatacacaatagtgggattgctgaatcatttggtaattctatttttgattttttgaggaacctccctactgctttccataatggatatacaaatttacattgccaccaacagtatacagggatcctcttttcttcatatcttcatcgacacttgttatcttttgtctttttgataataaccattctaacaagtacgaggtgatatctcattgtggttctaacttgcatttccccgatgatttgtgatattgagtattttttcatatacctgttggccacgcatatatctttcttgagaaatgtcttttcaggtcttttgcccatttttaaaaagcacagttatttgttttcttgctattgagatgtttgagttgcctatgtattttaaatattaaccccttatcagatgtattgtttgaaaatatttcctccgatcccataggttgtctttttactctgctgattgtttcctatgtggtgcagaaaattagtttgaaataacctaatctgtctaattttgcttttattgccaatgcttttggggttgtatccagaaaatgatttcctagaccaatatcatggagcttttcccctgtgttttctcttagtagtttcacagttatgggtcataagtttaactctttaacccattttgtgttgatttttgcatatagtgtgagataagggtctaatttcattctgttaagcatgtatatcccatttacccaataccatttactgaagaaactaaactttcttcattgtgtattcttagcacctctgtcaaaaatcaacagacaataaatgcctggatttagttctgggctctctattgtgttccactggtctatgtatgtgtctgtttttatgtcagtaccatgctattttgattgctacagctttgtagtacattttgatgtcagatagtgtgatacctccagctttgttctttacgctcaagattgctttggttattggaggtcctttgtggttacacacaaattttaggatcattttctctatttatgtggaaaatgtcattagaattttcataggtaatgcactgaatctgtagatcaccttaggtattatgaatattttaatattaattcttccaatccatgaacatggggatatctttcgattcctgtcatctttaagttctttcatcaatattttatagtctactataaaattctgtaaacctcagtgtacaactctttcaccaccttggttaaatttattcataagtatcttattggattattttcttgatttcagacacttcattattagtatatagaccacataactgatttttctgttgatgttgtactataactttattgaatttatttattagttatttggggttattttcttttgagagtcttgctctgtcatccaggctggagtgcagtggcactatcacagctcactgccgcctgaacctcctgggctcaagtgatcctcccacctcagcctcctgagtatctgggaccacaggcacatgccaccatgcccagctcgttgtttatttttttgtagaaatgggggtcttgccatgttgtccaggtctcaaaccactggagtcaagtgatcttcctactttggcctcccaaagtgctgagattacaagcataagccatcatgcctggcctgaaatttattcattagttctaataattttttgttgaagtctttagggctttctatgtataagatcatgtcatctgcaaagagggacaatttaaattctgttttcttcaaatttggatgttttttccttctttttcttgtctaattgctctggatagaactttcagtactgtgttgaaagaagtggtgagagtgggcatccttgtcttgtttggatctcagaggaagagttttcaacttttcaccgctgaataagatgttagctgagggtttgtcatatgtgacctttattttgtcgagctatattgtcctctttacacccaatatgttgagagattttagaataaaaggttgttagagattttgtcaaatgcttctgctgtgtccattgagataatcacatgttttttgtcctttgttctattaacatgatatgttacatttatagatttgcctatattggaccatcaattcatcccacagataaatctcacttgattatcatgaatgatctttctaatatgctgttgaatttggtttgctaaaatttcatagagtttttgcatttatgctcatgaggatattggcctataattgtctttttttgtagtgtactttctgagtttggtatcaggataatgctggttttataaaatgagtttgaaagtattcccttctcttccattttttggaagtgtttgagaataattagtattagttctttaaatgcctcgtaaaattcagcagtgaagccatcagggcctaggtctttatttaattagagctttttactactgattcaattttattgcttattattggtttgctcagattttcttttttttatggttcagttttggcaggttgtatatgtccagaaatttatccacttctaggttgtccaatttgttgatgtatacttattcatagtagtctgttaagatcctttgtatttctgtaatattggttgtaatgttgcctctttcatttctgattttgagacttcttttttcttaaagatttgtctattttgtttatatgttatatttttatatatatttatatatttttaaaaacctgacttttagttttatggattttttaattgtttttctagtctgtattttatttgtttctgctctgatctttattatttctttccttctttaactttgagcttagtttgttcttgttattctagttccttggggtgtaatgtttggttgtttatttgatatctttcttccttgctgatgtaggccattattgctataaacttagaattgcttttgctgtatcccatgtgtcttgatatggcatgggtcaatttttgtttgtctaaagacattttaaaatttccctttaaatttcttctttgacccactggttgttcaggagcatgttgtttcatttccatgtatttctgaattttttttcttttttttttttttttttgagacagtctcgctctgtcaccaggctgcagtgcagtggcatgagcttggctcactgcaatctctacctcctgggctcaagcaattcccctacctcagcctcccaagtagctgggactgcaggcgtgcaccacgcccagctgatttttgtattttagaagagatggggtttcatcatgttgtccagaatggtctcgatctcctgatctcgtgatctgcccaccttggcctcccaaagtgctgggattacaggcgtgagccaccacgcccagccaaattttccgaaattccttcagttactgatttctagaatcataccattgtggtcagaaagtataactgatacgatttcaatctccttaaatttattaagacttgttttgtggcctaacatatgatctatcctggagaatgttctctgtgtgcttttgaaaaaggtgtcttctgctgctgttggatgcaatgttcagtttatgtctggtaggtccatttggtctaacacatagtttaagtctaatttttccttactgattttctgtctggatgagctgtctattgctgaaaataggatatagaatttccctcctattaagtccccctcccttcagatctgttagtatttgccttatatattcagatattccatcatttggtgcacacatatttacaagtgttacattctctgggttaacttatcccgttatccttcttcttttttttttttttttttttttttttgagacggagtcttgctctgtggcccaggctggagtgcagtggtgcaatctcagctcactgcaacctccacctcctgggttcaagtgattctcttgacccagcctcctgagtagctgggattacaggtgtgtgccaccatgcccgactaattgttttgtatttttttagtagagatggggtttcaccacgttggtcaggctggtcttgaactcctgacctcatgatccacccacctcggcctctcaaagtgctgggattacaggtgtgagccactgcgcccagccccctttagcattacatactgactttgtctcttgtggcagttttggacttaaaatctattttatctggtataagtacagctacttctgctctttattggtttcctttgcatggagtatcttttttccatccctttgctttcagtctgtgtgtgtccttataagtgaagtgagttccctgtgtgtagcacagagctgggtctggtttttataatccattaagtcacactatgtcttctgattgaatagtttaatttatttacatttaaggtaattgttgccaggtaaaaattgactacagtcatttagttcattcttctctggctttgtttcctgactatagccctttagttcattctttctagctttgttttcctttgttccttccttctctttccgtcttcctttgtgattaggcaattttctatagtggcatgctttaattccttactttgtattttctgtatatctagtacaggtttttgctttgtggttaccaggaggctgacataaaatatcttagggttgcagcaagtttttttaacttgaatacaacttaaccatgatcacacacaaaaattcaacatttttacccacccacactttgtttttgatgctttttatattgtgtaacccttaatgaattattgcagctttaactatttttaatagtttgttttaaccactgtaataaatgttacttaaacactaccaccacagttttaaaatttgacttacttttgtacttacttttgacttaaactttttgtacttacttttactagtgagtttcaaactttcttatatttttgtgttactaattaacatccttttctttcagcctgaagaacttcctttagcatttcttgtaagacacttctgagagtaatgaactcttgactttgtgtgtgtgtgtctctgcaaaagtccttttctcttttccttctgtagaagagctttgctgtgtattcttggttgacagtttttgttatgttttgtttttttcctttcagcactggaatacatcatcccgctctcccctggcctgtaaggtttctgctgtgatgtctgcttctagtattaatggaattcccttatatgtgacatgcttcttttgtcttgatgctcttttgctgcagaatactctttttgtccttgaattttcaaagtttgataataatatgtcttggtgtagtcttgcttggattgaatctgattagacacctttgaccttcctgtgtatgaaaatgtaaattttcccccagattgataaaacattttctgcctgccttcctgactgccttttttccttccttcctgtcttactttcttctttgctccctccctccttccttgtttctgctactgtttcctctctctctctatccctctatctctttctttacaataaaaacttgctctattagccaggctggagtgcaatagcatgatcatagctcactgcaacctcaaactcctgggctcaagcgactctcccacctcggcctcccaaagcgctgacattataggtatgagccacgacacccagcctattgtttctttaactaaactttctagaactttgtccctctattctcctttttcagtgtccatacttttaagttttgttcttttgatgctttcctgtaagttccataagcattcttcattactttatattcttttttctccaattgtataatttcactaaactgtctttgagttcagagcctttcttctgcttcattgattctgctgttgacattctctattgcaattttcatttcattcatgcatttctcagctccagaatttgttagtttttttgtataatttcaatctttaattttctcattttattcatttaatgacttactaatttttgaattatttttccttttttagataaacagaaatttacttgtaacagttctggagactgggatgctgaagatcaaggtggtggcatctgtgaaggccttcttgctgtatcataacaaggcagaaggcatcacatgggtgagagagagacaaaagtagggtccttttataagaaacccactccctcataacataaattttgagggacacattcaaaccagagcagtcccagttccagatctctagttttttccaacatttattttagattcaggaggtacatacgcaggtttgttacctaggtatattgtgtaatgctgaggtttggggtatgaatgatcccttcacccaggtactaactaaacagttagtttttcaaccactgtcccactccctccttttcccctccagtagtctctagtgtctattgttgccatccttatatccatgagttatcaatgtttggcttctacgtacaagtgcaaacatgcagtatttgattttctgttcctgtgttaattcacttgggataatggcctccaactgcgtccatggtgctacaaaggacatgatttcattactttttatggctgcatagtattccatggtgtgtatgtatatgtgtgtatatatatataccatattttctttattcaatccactactgataagcaccaaggttgattccatgtctttgctattgtgaatactgccatgatgaacacacaagtgcatgtgtctttttggtagaatgattagatttcttttggatatctacccagtaatgggattgctaggttgaatggtagttctcttttaagttctttgagaaatctccaaatttttttccacagttgctgaactaatttacattcccaccaacagtatgtaagtgttcccttttctccacagcctcaccagcatttgttgttttttgactttttagtaatagccattctgactggtatgagatggtatcttactgtggttttaatttgcatttctctgatgataagtgatgtggaacactttttcatatgtttattggccatgtttatgccttcttttgagaaatgtttgttcatatattttgtacatttttaagtggggttgtttgctttttgcttgcctaattgcttaagttcctcataaattttgaatattaaacctttgttggatgcatagtttgcaaatattttctccctttctgtacgttgtctgtttactttgttgatagtttcttttgctgtgcagaagctctttagtctaactggatcccacttgtcaatttttgtttttgttgcaattgcttttaggacttataaatcctttcccaaggccaatgtccagaatggtgttccataggttttcttctaggattcttacagtttgaggtcttacatttaaatatttgatccaccttgagttcagtttcatatatggtaaaatgtagggttctagcttcattcttctgcatatggctcaccagtgatcttaacactatttattgaatagatagtcctttccccattgcttatgtttgttgactttgtcaaagattagatggctgtaggtatgcagctttatttctgggttctctattctgttccattgttctatgtgcctgttttaataccagtaccagactgttgaggttactgtaaccttttagtttgaagttgggtaatgtgatacctctggctttgttctttttgctttggattgctttggctattttgaattatttttctattttctttaagttcacttagctcttttggtggtattttcagatgtcaacagtggttcaaattgatgattctgcagacgaatgtcctatttcaccatcttgctggcatctgtacacttgccttgtttattcttgaatgaacattcttcaaagtaaaattttgaattacatcattttattatgggttaaattagagaggattaatatctttacattactgagtcttcatatccataaatgagaatttacgcagatctctttatatacctcatagtaatgttttaaccttttcttttcccatgtagcttgtacatttcttacccctctcctgcctgccagtggtattttatgccttctaaatctattataaacagtatttgcttcttttcattttaactgataacttatacaaagggaggtatttctgattattaaattaatttccaaaaaaaagtattaaaaactgtgagccgttgaatcttttttttttttttttgagacagagtttcactcttgttgcccaggctagagagcagtggcatgatctcggctcaccacaacctctgcctcccgggttcaagtgattctcctgactcagccttccgagtagctgggattacaggcgcccgccaccacgtctggctaatttttttgtatttttagtagagatggggtttcagcatgttggccaggctggtctcgaactcctgacatcaaggtgatcaacctcccaaagtgctgggattacaggcatgaggcaccacgccggcctaggtgattttcttatgtgcgttttcaaggatcaaataataataatttttacttggttcctattttttatgcctcttgtttagtctcttctctaattgaaatactctttgtatcataggaaaataaggatagaccctagtgagaagggcctaaaattctttttcagggttacaggaatgaaggaataaataaatctttattgccacaaaataaaggaaactctaaactcagcctctctgagaccaaattataaaaaaagtcatacatagaatttgagaatatgatagcaccattaagagggaaagaggaaaagagattatgaggtgttgcattgataatatactgtgacgtataagtattaaaacatttttgtatctctgaatagaaattttagtcaggcctctctccttgaactcctaagacggagtcaaacaaaattttctatttgctttccctactagttatttttattttgccttctagaaactcatcaatttgaagaaatatagtcaatatgagtcattttataggcatccttatatatgtataaatttaaattttacagtgtttgatacacatattcatgttctattacatgtatctatatagatacagtcttgtttatgaaaattgacatagtatgctataagtgaacaaaactatatgaaagaataacagaccatactgcttgatagaaaaagttttaaataatagaaaagtgctgcaacagagataagaagaaaaaatataacaacaaaggtcttatgggagcttattatctgccaagcacagagttaagctcattaagtggataatcttatttttcctcacacaattatgctcattttataaatgagaaagctagaactttgagaagttaaatcacccaactttacatagtttataactgattcttgttctcaaaggcaactctgcgtgactgtgaagccccagcacaggctcccataaaaagggcatttccatttactgtaatatttaaaaatccacaaaaactgatttttcaaaagcctacagttaaaagaaagttgctcaaatattacctaaaatagaataatccgttaaaaaaattgatcacaatgaaagaggaaaaaaaagcagctcacaggaattttctacagaggcatacaaagatacactctctaaacaagaaaaccattatctagtgaatgttcatcagaaactagaatattcacttttgtttaagtaaaactttcactaattatatagagggttatacttcctattgagataatttatcactatagccaaagtttcagtgtagaaaaacacccctgctcatcagtgtctgggatagaagtaaaacagaggatactgcttgaaacaaaactgcttagaccagcacacttctctgatttgtcaatgtcactgatttaaaaatgaaagttaataccttttaagatatctgtacaattctagggcagctgtttcagaaggtcaaatgactcacagccaatggggaactagagagatatctgaggatttggctggtaaaccagactttcactgacagggtcccctttggggctgtggtagaggttctcttaaaagacagagcagcttaaagaaatcactgaggattttcactattacaacaacaaaatgatactgaagtgctatattgattttaaatttgacaaaacgacagaatccctgacaaaacagaaccattactgtggaataaatcagttagattctggatcagccccattattattcatatcatcacaagtgctttctaagatgttgtcaccagattagggcacaaagtggggaagagagctggaagggcttctccttaaagagtatggttattgtacttcacttccatgcttaatcatttgataacactcacccacagttgctattttggatactctataaaattcccaggcagttacccatttaatctaacataaatatgtgttaaaatcttttctgctatttctcaaggtcacgtgtttgcccatggaacttagagtactggcatctcactcagtcaccgcaacaatggcttaaatccttcttgacaggtggtacctctgtgttcctagtggcatcataccacagaaggcttctccctcacactaatgggactgaatcaataacatcagactaaaaacattaaccttaggagtcttattattctgaaaaatataataaaaccttcagaataaaggttttattattaaaactcagacccaattaaaattttacaaatgagaaagctagaactttgagaagttagattacccaactttacatagtttataactgattcttgttctcaaaggcaactctgtgtgactgtgaagccccagcacaggctcccataaaaagggcgtttccatttactacaatatttaagaatccacaaaaaatggtttttttcaaaaccctacagttagaagcaagttgctcaaatattaccaaatattaccaatattaccaataatcagacccaattaaaatcagagagaaaaaaagtaacacaaggctgtgtagctcatgcactactaatatagcccattgactatttaactcataggatgccttttaaaatagtttttattgtggtaaaatatatatcccataaaatctaccattttaaccattttaagtgtacagttcagtggcattaaatatattcacattgttgttcaaccaccacctgcatccagcccctgaactcatttcatcctacagctgaaactcaaatcttctgaataatttgtgaagttggcaacacaccatgctgacccttaatttgtgaagaaggcccacaagtattagaaagatccatttgtagaggtgtcacttgatgtgacattccttgctagcacagatccatctcaaacaaacttctaaagcttgggctactctgctcaactctaaatccacatgaagaaatgtctcctattcaattggcaccacatcctagcaggattttgtgttcttttttctctacactttgcttttcagatggattttatatctatacatctttatctatattatgtgtatacatatatacatatattttgctttgcaggaggatcatttatgtgtgtgtatgtgtgtatatatatatatatataagtgggaatgtttcataaggacaaatacaccactaagtctctcattcctttgctattgtagaaatggagttaggaaacaaggtgaaaaagagccctttcacagccagagactgtttctttaccttcttggaaactgtaacccttacaggaattgtgcaagaattaaatgtgggagtgctggaaacccagagcacacagccttatgcacaaagagctcttcataaatggtagatggcattagcttcaagtttagaaacaatgttttctttttgcttcctagccaggaaaagcccttttgcttcaagcgactaaagaatgttctctaacttcctgagtgttgtgtgtgtgtacttgcctctgctaatgtttagtttgccttacaaggacaatctgcctgacttcgtgttggataaagggaagctgtacatgaagatggagagatacagaaggaaacaagccatgatttcagtaacccagtggccatgacagccagaggcagaatgaaggccgactgaaactagatatccgctgaccacctctggacccacaggtgcagctgtttggaatgacaccacacctggcagcagggctgacgtgtcctgcagacctgctcttcctctgactcactgtgtcgctgcccaccactggctcacggcttggtagctacccagccacaccctcagcctcccttttccctactgtcgaccaactgtgtgtctggcatgtaacacacactcagactgagaatgtttctgtctctgtgctaactgcagtgtctgccatcctttcctgctctctcatagcaggtaccgagtcagtccagacagctgctgcctctgggctcagtgctgatgggcagatctccaacctctgaccttccttctgcctcctccgttagttccactcacatttgctccagtcaggcccggaaaataaagataacaattaggaacaaatacacacaggccatgggagatctactaatgcactttgtccactgccccaaaaacgtcccatgacagctggtggacacttttttagatttcccagttagagcggttctacattttggatctcaaaaattctcaacactgataaagaccagtgaaacaagaattcagttatagcaaattgtatgttctttgtcagaaagttttaaaaaacaaagtccaataatattattcagagaacattttctttctttgcataaaatcttcctagtgaatagagacagacagggaaaaaacaaaattccatacatgggaacaagaaataacgacttccataaggaaacacaaaaccagggaagacacaggctggaggcgggtggggtggggagggcagtgggagctgtgtgcgtgcgtgtctgcgtgtgtgtgttctgtgcacattaggggttaggttatctagaagaattctatcaggaagagataatttacccaagaaacgaattgaggaagctatctatgctataggggaaaatttcagagatactgaatagctagtacaaagatggatcttgcttgacatttttaaagagcagctagaagaacaacatagcacaaaatatttgaagccacagataagcagagaatacggtcgaagttgcttatttctttttatctaaataaggtcagttctttattgaaaatgactacattcatatggtgcataaaatatgtggcaatttacagaaagaattaaagaaaataaaattctatagatttaaattggaagccagttgcaaaggcagaagcaagatgggatgtgaagctgtggcaatggtccaggtaagagatggtgggcaactgggctgtcatggtaataacagaggtgagggaaagttgtcagactccacatatactctgaagctgtgactgacatgatctgtctaacgactgagttgacaggatatgcctatggattgatcgtggagtgtgaaggaatggaagtcattggtaactccacgcatattggctcaagccaacaactggtaaatgctgtgatatttactgagaggtggaagcccaggggcaatagggtttggtgatgggaaggatatggagataataaacttagttttggacgtgactatttgacatccgaaaggaaatggagtctggtgctcagaggggaacttgaaacctatgtcagggatggataatatcctgaatatatctaatcccaaccagaagaaaatttcacaatgaattaaaaagttctatatttccttgcagatttaattctttattctttcagaaataagtgaaaaatagacatgagggaaaatggcttgtcagtgattgctaatctgggactatggttaatagaatgttatggtataatctctcagcatgattccaggacatggttaggtggatttctaaatatcttttctctctttctgattcagaacatttgttcttattaggccacgtggctttttaaggccattcctattactactactatatatatgtatatatatatatacacacacacatgattatcccagaaaattatcttttatcttccctcttctgttgtttattcttttgaccttgtttgagtaatggcaccttttaaaatgatgtagcagatgaggagattattcacctcaagtgagtctgtgtcctgaaacacattttgttaactgaaagtataatacataatgaagcttgttctgttactcagaaaagattcatgtattcctgttgtaagtaacagggattctctcttttcaacggagcttttactactctgaagattccataaatctggcagttacatctagttttcttgggtatttctcaacacaaactcagtctagcccttgaagcgtcaatgtgaagcatgtaattagtaagaatgtggattgatatattaatccattcagataatcaaatgtcagtgattgatatgacagctgtacaatctcttatctaaagccttggtatcagatttgctttagattcagattcatttcatatattagaaaggtcatactgtgtatacaccaaatatgagtgactaggtggtaatcacatatgttactatttttgcaataaaacatatgaatattcacattaagcagagaaagtaaaaaatgcaaatagccgcaaagtcagtacattcagattttgctgctaaataaatttgggtctgcttagggttcaccattttaagaattttgcttttagaattaaaaattgcagataagcaactgtggatctttaataatagaaaacattagcataggtaatgggtaaaaccagaccaaaaaaaacaaagccataaaaagacagagggagagcatacaagaaatatataagactggagaatgcatttttaacgtgtccttaacataaaagtagaggcagcaggatccctaggagagagctggaaatgcattctgttctcctggtacaggaaggttaatacgatgaccctgagggcaggggatgtagctgtggtcaggaaaagataataataataaagataataatgtgctgggaaagataataagcctataaaaacataattttcattaatcaagagtgttaatattttaggtatcaaaaataaatcttaagttattttaatatcatccattcatttctaaaattaatgccttggtaaagggcagaaactctaataagagatgtaatttattgttaaggcagcaatgataagactggaggacagtcaatatcagcccatctttttaagaaaatgataaataggagacagtcagtgaaatttatttctacagaagtagctttgataggaaaaatactagacacaagggacatgcctagtgaagaatatgataactatgactcagctcacatttcccaagagtatattactaacctctaccataattatttgcttatttactaaaagaatggattaatgaataaacaaatggagaatatgtccctgagatgttgatgtagcagttcaagaaacacgaatcatgatggttaccagtggcagggaaggggcgtggggggctggggaggagatggggatagttattgggcacaaaaaaatagtaagaatgaataagacctaggatttgatagcacaacaaggtgactatagtcaataataatttaattgtacattttaaagtaactaaaagtgtataattggattgtctgtaacacaaaggataaatacttgggatggatatcccattttatatgatgtgattattatgcactgcatgcctgtatcaaagtatctcatgaatcccataaatgtgtacacctgctatgcactcacaaaaagtaaaagtttttttaaaaaaaagaaactcaaatatctacataggtattttataatccaaacttgacagcctctctctttgcaattttacaactttcagcaaattccccatattctctccatctcagtctgaacagccatttcacatcttacagctcactgttttttgtgtatctcatccattatccatggttttgtttgcattacttttgctttctgaaatatcctcctgaattgttttccaacaacccatgaggtaacgctttctccaaggcctgccattctcaagtctcttcgggtctgtgtcttataactgaacactcacaagaaccatctctggtttgttttgtgggttctctcttcagtagcattaacatttttttcaccatgcaaattctgtatagttggtcatagagtaggaaatgaagctattaaatggttacaatttgccagtcacagtgatggaggatgaaggagatgcaaagataaagccctatccccaaaaaccttttagctcaaaacgatggaaggctgagtcctgaaccctcatagcactacatttcattgttttagtccaaaacaagtcctagagatctgcagagccaggaaggaccattttcattgtggttgttcaaaaaaggcatcctgggagaggatgaatttccctcattcattcaggaaacatttcctcatgtcctagtcctgttaggcacagttaggctttagaggctgagttagttttccagaactgctgtaacaaagtgccacaaactaggtagctaaagtgatggaggccatacgtccaagatcaaggtgtctgccggccatgctgcctccggaggctctagggagggatctgttccatgcccatctcctagctgctggtgcctccggtgttctgtggcttgtccatgcattatcccaatcctccctcctcacagggctgcttccctatgtgtccttgcactgtgttccctgtgtgtataactgtctctgggtccaaaggtccttcttgatgaggacaccagtcatattagattagggtcaaccctcctgactacactttaacttgattacctctgtaaaaaccttatatccaattaaggtcacattctgaggtactgggagttaggattccaacatatgtttttgggaaaccacaagtcaacccagaatagagatgcagggatgaaaggcaggcacagtgactttgaaaggaagctcacactgtgagcgggcaccaggaaagtaaatcacttgttccagtgaagctcaacacgttcctacacgaggtaagatcatgagagttgacatctgtcattttaagtgttctggattagtaagaaccttaacctttacgctctttccccgcaggctagtaacctttcagagtaagcaaaattggcaaatggcattgccttggctatggtttccctctgaactgcttaacttgataacaaaaatgctgacggtacctctgtcattgatgtatttttttttaggaggaagaaagagccaaattacaaatacgatgcagactctatatgagtcttctcttacagcatctcttttatagggaaactgtccacaacattttaaacattattaatcaatgcagagcaagattttaaacagatacaggttactttcaaacactatgtaataaatacttattattattattattattattattattgagacagagtttctctcttttttgcccaggctggagtgcaatggtgcgatctccgctcactgcaatctctgcctcccgggttcaagtgattctcctacctcagcctcccaagtagctgcaaaagtcaaacaaaaagtgattaccctggcaaagaggcactgacatataatcagaaacagaaataatgtcactgttatgaggatatttacagattcagagaatgtcacagagatctgtagtctatgaaaaactaaatctggccaggcgcggtggctcactcctgtaatcccagcactttgggaggccaagatgggtggatgacctgaggtgaggagttcgagaccagcctggccaaaatggcaaaaccctgtctctactaaaaatacaaaaaaaaaaaaaaaaaaaaaaaaattagccaagtgtggtggcacacgcctgtagtcccagctactaaggaggctgacgcagaagaattgcttgaacctgggaggcagaggctgcagtgagccaagattgtgccactgcactctagcctgggtgataacagcgaaactctgtctcttaaaataaaaaaaaaacaaaaaacaaaaaaaaaaaaaacaagaaaaactaaatctggctgcttaataaaggacacacaattcttcaagttcaaagtctgtgttcctgtacttgtcatacacacagaaactgctcatttattacattttgaaatttcagtgtctttcaaaaacatcagatcaaatcagagaaaataaatgaattcaatctaccactctaaaataatgcagaggcaatgttaaattactttattaagcaaaccaagaaaaaataaattatatatgatttgtattattttttaacttccacactatttaatggtataatataagattgtctttcaatgctttcaatgaaataggtatcttactttcacttagaacatttttttctaagtaattcttaaaattctgtttttctaataggtttgcagcaataggtagcaattattattattagaaacatacccagatgctttcttctcggcgatactgcttccagtttctcccaccatcactgaacatcaggaggtagctggtcacccagtcagagctcccatatcctccttgggtggcgacagcagtgacctccattctctctccaaggtcaatttgcagccattggtatttatttgacacaagtggagtccagccaccagctcctttattgaaacagaaaaagtataaaaatggtagaggaggaagttatttaaacatagctgttactagattagaaaactataaaattatgaatatatattaagaaaatcatcgatttacaatagaaaaaatagaagaattacatgtgactggatgaaccctaaattgtgttcacatttagctagatgacccctgacattctagaaggcaggtgtcctactgactgcagaaaatgtttgtttaatgcaggtggccactagagcattcctgtcaacttttggaactagtgttatttcatagcccttgtgcaagatttgccctttgccaacctaagagactaaattccagtagtaggaagtacagcattaagcactgataaaacaaagacggttaatatattgaccttgcactcaaagtgcttacagtctcataggagaaatggatgtaaaagaagagttaaaacatagagtgctttgtgaggcaatcccacttacatgtggaattttaaaaagctgaattcacagaagtacagaggagagtgatggttacgaggaactggggtgtggaggagatattggtaaaaaaatacaaaaaggtatggagtagcaaatggtcaaggtgagtcctaagcaggttctggtgcactctgctctctctggcagtactgcagggaaactggggcaagtctcacacagtgctcatccaccttggacaaggaaaaggagactgtcgggtattgaagaagatgcgtgcagagcagaaaatttgctttttgctctgaccaatgccaaatctgaaacaaaaacataggcatgtccgctgatgttttattgatgtttgttatttttctagtctaatagaattaggggacactcgaaaaccacagcttctttaataatcaatgtctagaaaaagagagtactctataaacaattcccaagccgaggagtcagaacacttttattattccctggtgctgccacttacctgaaggctctgatagaaagtctgaagttctagacagttcattattattcattgacttatactgtgtattttattattaggggtttatcattatgtcctcatttgtaaagtctttagtacttcactacatgtccaaaaaagtttgatattattagaatatagctaggtgtaaaaacgaataagtgaggacattatactttaatataagttattatggggaagtgttgagaaatataaatatttatatttaaataataacaattcatacttaaataataaatataaatattaggcacctatttgaattgatgaccacacttaactactgtttccttatgattcccaagtttacagattcttagaagtcagattctaagatatttttgtagtgaatctttgttcaaaaatatttttcctctgaatgtacaataagcacctctaaagtttatattatatatatagtatgtacacagacatatatataatttttgtttgttttgctttttattgttccatgttttgaattgaagagtcaggaatttgatctagtagacaagatggaaaattattggtaaccaacactgtgcatctgattgacactaaaatactccatttattttcttaatccagacagctaggaggtggacacagctcttgttcaaagttaaatgttctgctacagaccaggggcatcctccactcatgcaacatggtttcctagatcgggcaatatttattcttggatgatttacagcaatatttatgtgagcccctgccagagacagtgcacagatttctttagccctcagtaggaactacttccacagtttcttctctctgctcattcctccttccaacttaacttttcaggatgtaacagaattccacctacccacttccataatcactcaatttaacaatgaacacttatcgagcatttgagaactctaggtcaggcaaagagttccctttaaataaattttgcatttaattcctaacatacctttaaaagacaaggcctcattactaccctccatatatggtgggcagctcacctatgtttacgcatctagcaaggggcccatgagctttggatccagaacctgtgcaattaaatatttctattatattattttgatgataatcatgggatgtggtgtttctcaaataaatgtaacaaagatgtaaagacgtttgggagtgagcaggtctggctacctaaggcagcagcccccatacagcagggcaacctctcctactcctggtcaggcaaggtctgggtttcggaaagctgagggtgcagtgccaatggggttttctctactggcccttcctgttgactccaccagatctactcttctctcctaagcctatgtaaactttaattggtgggagatccttttggggttggtctaactagcaaccaatagtcctaggtacaacactaatgaaactgtgtatccttttctgtttttcttattactattttatgggggttttttttgttgttgttttttttgtttgtttgttttgagatggagtctcactctgtcaccagcctggagtgcagtggcgagatctctgctcactgcaacctccaactccaactggttcaagcaattctcctgcctcagccacccaagtagccgggattacaggtacgtgccaccacgcccagctaatttttgtatttttagtagagaggggtttcaccatgttggccaggatggtctcggtctcctgacctagtgatttgcccatctcggcctcccaaagtgctgggattacaggcacgagccactgggcccagcctattttatggctgttttaaaagagttgggagaaggtgagggagatgctaacagccaacccatcatcttaggctggatgttgtacattgggaattttatacacagagctgaaacttctgaggaactattcaatatttttggttcttcccctcatcttagttaagggcatcctcttcagcttgtatttcataacctttctttggtgttttcactccctctcattccaggtttagaaaagtaattactatgagaacacatgtggagaagcacaaggaggaaaatgagttggcacggttctggtgtgctaccctggggtggtgtgttttcatcagatgaagagggagccgctggccatccctcttctcggcatccctcacagtttgttagtttgttggtgttcatggttgcactcctggtaacagatgacacatttcagtgacttcattttacctttgatgaagtagtactcaaatgcaaataagctatattttcagccattactgataaagtaatgaaattctggcattaccaaagaatttcatcaggatgttgtagcctcaggaaatctgcaatcccagatgcgttttaagggtaagctgctgtgcacacaatttaattaaacgctgagtggaaatggtgggaaacacagcgtgactgacctgtgcactgctggatagcactagtctgtgtgcctttgttaaaggcagctttgatggttggtatagaaggccactatgggtaacagaaagagaaaggaggttggctgactccacccccaactagagtgtagtaattgtccagtcactcagcctctctgagacaaaaatgttgtcctttgtttaaaaaagaaaagcataaagttgggagtggggggattaacagtcatataaatcacgtcacaagactgtaaggaagacaatgggataactgaaactacagcactttgtaactaaattattattcaaatgtgatgttatactcaatttttgttgtctttaaattaaaacaaatgaaagtcttctatttgttaagtcaagattatacatgtgctgactacttttcaacctggaagtgtcttttcatagtcccttctagtctatggtcaacaaaactttgtacacaaaacaggggaagcagttatgtcctctaagctcagcctctcccccataacaaatgtttcttctccacttcaccctcctccccctgcctctgacaagacattgcacctgagttaaataaagtgtcacaattctaccccacagatcctatgaattatgaaaactcatcccctccattcataatatatgttctgacacacatgttccattactggaatgagattaaaatatgctgagcaactgaaactttctcttacactttatatggcttgagggacagcagatgttattttttaaagggtaattcgtttttataaaggttgatattggtaccacagtgaagatgctgagctgcgctaactgttttgtccctaaatgttcacacaacataggatttatcttatgaaccgttttatccacttttaagttttcaagttctgaggaaattattaaagttttgccacttattttgtaatggaaaacaagggaaaagggggaagtgagaaactctgaagcatatattgtatgctgagaattcgaccagatattttcaagcatattatcattttttatttctaaaagcattcagtgggttgtctttatcgtatctaccttacagatgagaaaataaaatcactaattaaaacacatggaaagatattatttttaaaatcagcttatgtttcatttttatccctgtccatgaatatattcacatgatttgtcaatcacttagtactttttggttatgaataatctggcatgattatgtctctattttgtacagttatatctgtttgttataattctgcacttacatcaggtcaaagttacatttcactatctggggcagggggctctgtgaaagaaaagtagaaaccctacagctggagccttaattatttctgactaacaacaataaaacttcccatgactatagtatctagtcataagtgacagcactgtcacagagtatgtattgactttgtttacaggggaaataatgcacaggtaaatcatcatcatcatcattacaattatcatcatatcaccataatcttataccttccttaactaaatttgatgttgaaggcacaaaatataagtaaacaaagtaaatgttcaaagccagccactattagggacttctgtataccaagcaaacacacagttaagtcaaccttgtccccacgagacacttcccactaagataacaaattgtttcaaatgtgattttatccagatatatttgtttctttcctcatctaattgcattttaattcacattaaaaatttcaggtattacctggggtgagcaggaggtgggaagtgagatgtgaggtagggactgtcacagctcctacactccagtgtgattatatgtaatttatagggaagaggagtgaagctggctttaaatcaactccctcattccacttctgagatttataggctttaaacagccatgctttttgtcagtaggtctgcctttttgctgagggtaatttaaacatttacctgagatctaatttcatttagaaaaaaaagggctaactacacagatatagaatcaggtactacagtctttttcaactatgctgttttaaagtaaaaaatacagaaaccctccctcagaatctgtctttgtgtacatgttctatttcagcagtatttccttcaatcttagcaggttgaagcagaaagaatattcagcctactaaaaatgtgttcataaaaaaagtactgcaattatggttaaaatctcagagtgtatataacaatttataaaatgtattctcttacaaaatgcatctacactccctagtagctttgaaaatggacaaagaataaacaaaaaacaaatagtagatgttagacttaaaattaatcatataatcatattaaaggcaagtagtacaaacactcctattaaatggcaatgatggtcagattagatgagaaagcaagatccaactatatgttgcctacaagaaacacactttaaataaaaaaggctcaaatagcctaagtgtaaacacatggaaaaatatatattatgccaataatagtttttaaaaaagctggattggctatattaaagtagatttcagtgcaaaaattattataaaaggtaaagaaaattatttcgtaatgattaagatgttctttcatcataggacataatcctaaacatgcaaacacttaataacagagcttcaaaatacatgaaatgaaacctagtaaaactgaatgaaatagataaatccacaatgacagtaggagattctagcaccccgtctcggtaactgattgcacaagaagacagaaaatagggattcagaagtattaattatcactatcaacctatatgattcattgatatttatggaatgtttcacctaacagaagaacatgtattctttttcaagttcatttggaacttttaccaaaatagaccattaaacgagtcattaaacaagtttcaacaaagttaaaatcatttaagtcatgtaaagtatatctttgtgatatacaatagattaaaataagaaatcaacaatagcaacttctctgaaaaatccaggaatattaggaaactaataacacatacttcataatcaatgaatcaaagaagaaactaaaagggaaattagcaagtatttcaagctgaatgaaaatgaaaatacaacttatcaaaatctatgggctggaacttctggcttctgccccaggaagtagaaagctataaggagcctcatttccactcttacaaccaacttcaagttcatgatcttttacaaatgcattggagagttgagcttgcagaaccaccacctagcctaaaatctaaagagatatgaacctcacagggagagatgtgagcaggatctcaccttacatagatgaaaccagaggtcagtaagaaaagttcagctggaatagttaacaaaatggtgaaacctactgtgcaggctggtgggacagtgagaaatcctttatcaccccagaagttgggggagtgttccctcttgcaggcacttgctccactggccattggcagaaactcacatgcactccactgagaactctacttggccctcacagaaaatatcagaaagagccctaaaggttaaatgactcagcctataacctccgttatctccaccacatcttgatttttgggtaggtgtagttccattcatcttggtaactaactgcataattcaataaaaccatcattgtgcattttttcatacatccaataaattatctgatgagacatataatctcaaattatcacttgagcaggcaaagaagccattatcttcacttggtgagtagaaacaattaggcaaaagtgatgggtgatgtgcaaacggggcatatgaggagagggctggaatggagtcagggcaccctgaggctgactgcacgcctctcattgtgttccatttcccacagatagtgtgtttaccttcttcagggagtgattaaacacgtgtatttgtctttcttattaaatgacaattgatatcatgcaaggaaacacgagagtgaaatgctgagaagtgaatattttagtgaataccaaattatccatctgtatgtgattgattgctcagtcaaccaaaatcccctagcccaccccctaaaaaaaaaagagatggtaatatttacatttttcctaaggatattatgtagttaaactaattatagtttatgaaattgctgtgaaagcctcgtatgaaaagagacatgcatttgttattgcatgtaataggacactatcaaaatatgatgcaaaaggaatgtcctctaaacattacaataatgtttattttaagttgctattaacagagaaatttttttagaggcaagcacacatcgggtacaatgtggggcatcagaattctgctaaagtttgtcccactgaattctttggaaaaaatatgacaacctaaaaaaatccagttggcaaaaattaatgtgaaagaaaataggtgaatctgcaccatgtcctacagaagttctggaatgcctccgttaacactgactttaataactaatgtaggagagttggttataggaccaactgttgtaatttaccattttcatcattggtcatagtccttttgaatccgttttgaagcacaaattaaactgccagtcagaaattaaatgttatttaagaaaaaaattattttgaaatatagcttcacatcaattggcaaagatagtacagagaagtgatgtgtactcttcacctagtttctaccaatggttacatcttataaaattacagtacaatatcaaaaccaggaaacgatgtgtctatgtagttgtatgacacgtttagggtccgtaacccccaccacaatcaagaaagagaacgacttcactaccacaacaatcctcctcattggtaccctttacagttatacatagcaaccactaatttgttttctatctcaatttcctcaattcctcaggttcctagatggtctgtcttccctacattttttcattcttatgtttattttatatataaagtgccttttaaaatgtacttatcaggaagaatatattaaagacatgtacttcatctctccggagcagaagctggcaatatgatggtgaatacagtgtccctttattcttgagtgattccagttgcctctggtaaataggaagtttcctattcaacctcacctttcttgccaagaactgcatgacagttgagctgtcacatgttatcactggatttttttgaacaggaaaaaagtgaaacgacaacatttttagaaggaagaatgcaaactgtaagagagcgatgcgaaaatcctagagaggagtgggacggcattcttcattaagagtaattggtaacattaaggaacaattaagtacataaagaaatcatggcctatcggtagctttaattttattactaaatagcaaccagttcaatgaatatgccacattgtggttatccattcagtggctgatggacatttgagttgtttccagtttttgtctactgtattagtccattttcacactgctgatgaagacatatctgagactgggtaattcataaagaaaaaaggtttaatggattcacatttccatgtggctgaggaggcctcacaatcatggcagaaggcgaaaagcatattttacgtggcagcaaacaagacagaatgactatcaagcaaaaggggttcccccttataaaaccatcagaccttgtgagattgattctcaaccacgagaacagtatgggggaaccgcccccatgattcagttatctcccactgggtccctcccacaacacctaggaattacgagagctacaattcaagatgagatctgagtggggacacagccaaaccatatcatctactatgaataatgttgctatgaatatatatatatatatataaatttttttttacattttttacatttttgcatttacttttttttttttacatttttttttacattttacaacaggcagagtctcgctctgttgcccaggccaagattcaatgcaatctcagctcactgcaacctccacctcccaggttcaagcgattctcctgcctgagctacccgagtagctgggattcctggcgtgcaccaccacgtccagctaatttttgtatttttagtggacacggggtttcgccatgttggccaggctggtctcgaactcctgacctcaaataatccacccacctcgccctctcaaactggcggcattacaggtgtgagccactgtgcccagccgctaggaacatttaagtcttagagtggacatatattttttggagtggaattgctggtttatatggtaagtacatgcttttactttttaagaaactgccaaactattctccaaggtggtggcaccatttacattcccaccaacaaagtatgacaattaggattattacaattaggacaattccagtttcttccaatctataaacatagtgtgtctctcaatttatttgagtcttctttattttctaatagctatgttttatagtgttccatgaacaggtcctgcacacctttcgtaagatctacatttaagtattttattttttaatgctattgtgaatgaaattcttttcttaatttgataatcagatcgttactactacataaaaaagaattgatttttgtatattaaccttgtatcctgttaacttgctaaaattcacttattagttggtgtcttttagatttctagatttcttagaagatctccatataggatcatgttatccatacacaataatgtatggagagacagtccactttaagcagcttgcactcctacatgttttgttgggtctgctaagactacaaaggcctaaaaactcttttatggacccttttttcatggttgtttatgcagctggttaaccttgagaggtgaggttacattttcttccacacaaagagctttctcacttactacttgctataactgcagtagattccccaagctcattatttctcagctgcaatacaagtctgctatgagtgtaatattcatacgtgccctattgcattgcccctgtgggcctcaggggcaaaggagacagatacaaatatgctgaaactcatgttgttgtttgtggtgccatgagtaatatagctcacaggtgttgtcattctttaattttagccatcctagagaacatattatctctctatgatattaacttatatttctccaatggttaatgattttaataccaaatgttgaccaggataagaagcaactggaattgacacacattgccaatgagagtataacatgttcaagggcttttgaaaatagtttgacagtttctttagagtttcacatactgaaattccactcccaaaagtgatgtaaaagaatgtttgtagaaatttattcataatagatccatactggaaacaagccacaagtgtccattttaaaaagaatggataaacaaacagcacaattgaaatctactcagcaatagaaggaaatgtgccacaaatccacgcaacaacgtggatggatctcagaaaccttatgctcactaaagggagctggatacaaaagcttctgtatgattttggtactgtatgactttttgtaagttcaaaagcacaagccaacctaaataatatgacagaaagtagaacagtgataggtaggaggtgcctagataatcaataaaaagtattaacaaatggtaagggggtgatgaaatgatctgtaacttgatctgggctctggtaatacaggcatatacatctgtaaatattaaccaaatggcacactttatgcatttaattgtattttaagttatgcctcgatttcaaaaattttaaaaataatttttaaagtgacccaagagaatcagaccagccaaatatttgttctcatgtctaatctatattaacatccttatgaatattttgtttgtttgaatgccacttcctgtcatagtactaacaacctattttagatgaattttaattaaagttacatatgctgctgaagcatactctttgcgtaagtaaataagattaatttctttaaaatctacatatttcttcaaccgaaacacattttgctatagataacttgatgctattttgtttggcctgtagtcagctaaatcattcaacatttgtaacatattcacattgtcatatgctacaaatctgaggaaaaaaagcataaaaatagaatgccattggacttactagttctaagaactattaaaaggcacagataaaaaatttagtaaacaatatcctcaggcaaaatattttctgttgtattaatgttctacttttcaggtcctttgttgtatatgtaaattggcacatctaacacctaggcacattgggaagcttagtgtagcttctgacctataagctaaggaggggaatacgcaagaattttgattttatgaaaaatgaggaccaggcgtggtggctcacacctgtaatcccagcactttggaaggccaaggcgggcgaatcccctgaggccaggagttggagaccagcctggtaaacgtggtgaaaccccatttgtaccagaagatataaaaatcagccgggcctggtggtgggtgcttgtaatctcagctacttgggacaagggtaatcccagctattcagggaaagggaaagggaaaaagggtgaaagggggaaaggagaaagaaggggaaagaaggggaaaagggaggggaggggaggggagaagaaaaatgtaggggaatttaattcttattagattagttatcttaaatatttgctacatttacattattctatcagagattgatactctttatatttttaaattattgcatacatttttatcaatttctttcctctagattcctcatacaaaacaacgaaatctcacatcctattctgttttgggatattgcactgtgcagaatagtggaaattccaagtagttaaagatcgcatactataacaaaccatttgtgggtcatttccccaatgtaagaattttgcttttatttattaatatgattttaaactatggtgctaagttttcattaggagttatactttctaatgtgggaaataaatatcttgatattgaaaagcccttacaaatatcctgagctattcattttgtattaaaaatattcagtaattattttctctgcctcttaatcactgaacctagtcagtgtgccaagaaagcatgatcacatggaaggacatctgaatagtggagaaattcgaggagtggagggaaaagatccagtatgtttccatttgctctgtgtttgcagtttagcacacaggtttctaaattatccttgtctgcgaaattcattcccatacaccaacgttaatttccattcaaacccacgggcttgctccctgattgtactctgcacgtgagagttcatggttttcaatatataaagcccgtttgaatcattaacgcttctggctgagaatgagagttaacgcaagcactttctaaaaacagaaaaagagggcaaaatacatatacgcttttgcctagccagtttcaatttgcttctagcaaaattatccatttcatccctactcctgcacttctatttcacattaacgaaggagaatatgtacttattaaaatggaaagttgtctcacataaaatgctactgagccaatccaatgaatgttcgcaattaaaggtataataatcataaaaagaagaaaacttgataagcaaaagaataatcaagtactagcatgagttactaagtgttttatttcttaagcttttgtctaaataactttggatcacatagttttcttaaggagacacttaagaagaatgacaaatggagctctactttttctttatttgccttttcttgtatcaaatgccccatcatattttagaaatcttggttttgcagaaaaatttagcaatgtgcaattccaggaaatatcaatgtaaacttaatgacaacaaagtcaggtttaatagtcaaatccaaatttcaagaatttcatattttatataatggcaccaattttcctgcagctgaatatacacaatctgactatacctatatgtcagtatacatacatatatatactgaaatatatatgtatgtatatactgacacatatagtcagtatatgactatgactatagtcagtatatatgactatgactatatatagtcagtatacagtcagtatatactaacatatatgtatatgtgtatatgtactgacatatatgtgtgcttatatgcacacacactgaccatgtatgtactgacatatgtgtgtgtgtgtatatatatatatacacacactcacactgaccgtatatatgtatatattcctgcaactgaatatacacacacacacacacacacacacacacacacacacatacattcagcttcaggaaaactggtgccattatataaaatataaagttcttgaaatttggatttgactattaagtacacactgactctctctaaatatatatatatatatatatatacacacacacacacacatatagtatatatttagtacacagtacatacacacacacagatatatacatatgtgttgtgtatttatgtacatttattgaacacattaaaatctattaatttgcaaaattatatatacaaaattaatcatacacttgtgatgaaccttttcattctttcatgtttctttgcataaagaagtaagagagttgtttggatattagagtggaagagtatacatacataatcagaaatttccagaggaaacatgaagagatgtcaactatttctccattttttactgataatgctttccagaatcatgacttttgatttttgctgtgctataattactcgctctttacaatgtccacttacttccttgagggatatgacaggaagattgagaaaaactgtggctggaaggccggcagtgctgtagagaccctgggacctgggcccttcttctttggctccaggtcatcctgtggtctccccaccttcctcctgcttccctgggccctcctcacaacacttcacagacttctgtcctcgtcttgttgcaatatcttttctaaaatgtattttacaataatttctctacatttcctaagcatctgaaacgtagtgtgacaatttcatatatattaatactttatacaattcctcattctgttttaggaaaaattacaaatcagtttaaaactattttggcaagcaatctaaattaactaaagaatatcttcttattgctttcctgtaataggaaagaggtggtgatgagatggtacacaggtaattctttatgaaagctatggaattcagggcattgctaattcttactaaaatatgtggaaacttagcaactttgagcatcataaaaaataaataggaaggtacatggaagaaaaaccatgttctctaaaaccccataaagctaagttttctaaatataatgaaatgtaaaattttttaaaaatctgacttttttctggtttattttcctttttaatttttaatttttgtgggtatgtagtagttgtatgtatttatagggtacatgagatattttgatacaggcatgtaatacataataatcacatcatagagactggggtatctgacttaagcagcttttgtactggaccacacttaaaatagcttaaagctaaaataatggtatacaaagaattatcagcatcattttccgttttttcaatctgaaccaaagggagattgttatatctactgacaaatacaaaaatcaaatgggattatgagaatggtcctgtgtcagctagttataaaatagaaaatacacatatatatcctattggaaggaaaatacacatatacacacatcacccaaatggtgatgttttacaacacgttatgtataaaattaggcataaaattgaactttagttttcagtgaagtatgaataaaatagtgaagagctctccaggttgacaattatgggaacaattctaaaactactcatcagctgattgcgactccttataaaattaatttaaacgcaccaaaagccatattgcatttatactatagaaggtaaaactggtacagccatttcataaaaagatttttgatattttcctgtttttttaaattgaataattgtgacacagagaatgagaaatgcattaatcttattcttagaggtttctctgtcgagtttaagttgccaatgtcatatgcctggcagtgcggtggccaatttaaatggaaccataggggattcagtccatgtaaactacttaaacatcacctgacggtcccctcccctgcaccgtgggctgccataacctaatttaacaagctctttcagagtttggacatttctttggtaacaactgacattacctggcattatttcatgttttattcttaattattctactacagaagcttaagtttaattccacctatacatattatttaatgtttgctttgtcatggctctgagctagatgttgtgaaacaatgtgcttaactgccacttttactcccactgttgatactactaattgccgggcgcggtggctcaggcctgtaatcccagcactttgggaggccgaggcggatcatgaggtcaggagttgagcctggccaacatggtgaaacctcgactctactaaaaatacaaaaaattagccaggcgtggtggcgcgcacctgtaatcccagttactcagaaggctgaggcaggagaatcacttgaacccaggaagcggaggttgcagtcagctgagatcatgtcactgcactccagcctgggtgacagggtgaggctccatctcaaaaaccaaaacaaaacaaaacaaataaaaaaaatctactaattataatttttgcttcagcagcactcagtagattttagctactttggatcagatcatatactaattttttaattatggtaatacacatcacatgaaatttaccatttgaactgttttatatgtaaagttcagtagcattaagtacattcacgttgtgcaaccatcactaccatccatctctagagctctttcaccttcccaaatgaaaacgctgaacccactaacaataacctccattaccagcccctggcaacaactattctatttcttgtctctatgaatttgactactctaggtacctcatataaatgagtaacgtagtagttgtccttttgtgtctagcttattttccttagcataatgtcttgaaagttcatctgtgttacagtacgggccagaattttcttcctacactgcactaggcttctccgtttgtccatcaatggaaatttgggttgtttctcttttggctcttgcggatacatctgctctgaacattggcgtaacataacctaattattttatgtgtattaattcatttaatcttcacaacctattttactcaagttaactatttcatgataggtactttactaatcccattttataactgaggaaacaaaaactcagggagataaaggaatttgtccaaagtcacgcagctagtaaggggtagagcctggatgattccaagcttatccctaatcactaaggataagatagcacacttccttcaaggaagttagaattgcacaaaccgtaagaaaagtatacaaatacctagtaagcacactggcatgtgataaatgctgagagctttttaagggaaagtgccagacatatttagcatgcaggcttagtaaaaatctagattagatctggcagccaaaatctagattatgacctgctttacacagccagagaactaagaatggttttacatttgtaaagcgttgcgtttaaaaaaaaaaaaaaaagagggcgggggctgggtatggtggctcaggcccgtaatcccaacattttgggatgctgaggtggctggactgcttgagcccaggaattcaagaccagcctgagcaacataatgagatcccatctttacaaaaaatataaatgttcgctgggtgttatgacatgtgactgtggtcccagctactcgggaggctgaggtgggaggatcacctgagcccacagaggttgaggctacactaagctgtgatcttgccactgtactccaaacctgggcaacagagcaagactgtgtttcaaaaagagaaagagaaagagagaagaggggaaaagaaaaaaagaggaaaggaaaaaagcaaggaaggaaggaaggaggaggagaaggaagggagggagggagggaaggaagacagagaaagaaaaaagaaaaaaaagaaatgtaacagagaccttacatggtccacaataccaaaatcattttccatctgtctctttacagcagaagtttgctaactcccatgtttaaattttatttttaattgatgaataataattgtacatttttaagaggtgcaatgtgatgtttggatacatgcatacactgtaaaatgatcgaatcaggctaatcagcatatcagtcacctcaaatatgtatcattcttttagcggtgagaatagttaaaatcctctcatatatttcaaaacagacaacacttattaactacattcactatgctgtgcaaaagaacaacagaaattattattcctatctacccaaaactatgtacctactgaccaacatctcccccttccctatccaccctctcctctagcctctggtaaccaccatgctactctctactcctgtgagcactgtctttaaattccacatgtaagtgagactatatggtatttgtctctctgtgcctggtttatttcacttaacataatgtcctccaggttcatccatgttatcacaagtgtcagagttccctgcatcacgggttttaatccacacctttgatgtacttggctctagtaagtacaagcgtggggaaaatgtaaaactcttttggtgcaagcattctgcatcatgtttcagactttcaaagaaaattttaagtcatcctcaacaacatcacattaatttgaggctagagaagatacggactataaccctgacaaaagccacttgagcaaatccgtcagaatcattctgcaggtataaatttttaaatcacaaactcatgagggaaaatgtaacttcatttctccataacccagaaagctttctagtaggagctggaattctggctgatacacagactggaagtagtcacagcaggtgtctctgtccagttaagggataagcctgtcagttcgtgtctgtattggtcgcagacccttgaaaattccttcaggggttcttttacttccccttcatccccagagttaactctggtctcttctggctttgctaattgccttggtaaagcggggaggggagtgtgttcaagccccaagtagaggtcagcactgcactgtcctcagggatggcgacctgctgccgatggagccaagtcctcccatcccaggctgggacagtgctctccacaacgttttggtgaccctttctcctccctctgccagacctcaggcaggaacatggtcttgctcacctgcctttggtacctcagggtgtccttggataactggggctgtcctcaccggccaccagagctgcagcagggcgtccagtcctgtcactgaatgtgccgcagcacaacgaggatgccgtgcaggctgctcttggagactggcgtcctcctttccactacacacatgagagtgcccactcagatccctgagcttcagtgaagacttccattaagccaccaccggcaaggctctgcttgagagcagagcttcagggcagtccccacctctctatgcatcctatcatgcagtcctgctgagggttcctagtctgcgagatagcagaaaaattaaaacacctttagcctgctcaattccctttcaaactttttctacctcagaccaaaagatgcttttggacttcagaagtgaagattaatgccttggttcacagtctctgcaatgatccccttttctctctacagaagactcaagacaatctgagttaggagcaaagacggaggtctgagggcactggcgaaaaaattcagtgagcttggaagcagggtcatttatgttaattgtacatgtcatcccacacagaaatggcctttataggaattatcagtgtcgtgaagaaagttttgatttccatttttaaacctcatatcccctcatcaaaagctcccatcatgagtttctggctgacttacgccaggactcacagaatgattcatccctacatgaaaaagtattttcaccagcctcaaaggttttcaggaattactagatcaaagaattgttaaagaaactttccaaaagctcattctacttgcccctccaagcaaaatactaactttgtgatggattttagacattcctagtccgtaacagcggcatgaaactttttttctttttttaatagagacagggttttgatgttgcccaggctggtctccaactcctgggctcaaggtgatccaaccgcctcagcctcccaaagtgctgggattacaggcgtgaaccaccgtgcccggtcctgcacagaagtttttgatgttaggtgtaccaccttcaatgatggctgtgtggatccaatatctgcttctctttcattcataaaattcaccaagttcacattggaaaacattattctatggttattccagaaaatattagattatccccattttgtttgaaaactgactgaaaatatgacatcatgttcccatctggcaggagtgcacagcaggcatggaaaatggggatgagtgcgtccaagttagttccaattttcaaacattcatcccgcaccgcctgttcagttgcctgggtaaaattgccccacgcagagaagcttttaccccaggttaataaagatgctttttatattagtatttgagttgtggtcactagtaatgttttctagttcagattgtgaaatttgtatttgttactatctttgtttttatacctcaaagaaccatttagagtcactgattcatgtccataaagcaggaactttccgaaatttagtaagaatagctaagtacaaatctaaaaaaaaaattacatacttcagaaactaaaaatgcattcactgagatgccttatatcctaattaaatattagctgaattgtaattgatcttacattttgattttgtgaaatatatattgcctttactccaaaatttactagaccaccttcttacgtatggcagtgggcattaggtggcttgtgaatttgagaactgctctatggggttagtgtctgagattcatcaactgagcatggaacaagaagagaatagcactttaaagaacattaactgaggactttgctaagcatttatttaattagggaaagcttcaaaagttgaagttcgatcatgggactttcaaaataatccaagtgagacatgaagagactaagctgagggggagatccatggaaatgatgtattagaatcataagcatgaactgtttcaacagacaatacacagaatttggaaaaaggagggagtgataactctaagatttttttccacaaatcaacattcatacatattattttgtattcatatactgtgatcttcatggagtaaggtgttaatgtaaaaaaattgattattggagtttataaaagcaacttttgaccattttctctgtgtgtgtgtctacatagcaaacttacttcctcagagaagcagaaactctttgtcttactgacactggaatctatcctctgtagttttattccatcaaaaagataactaggctgggcgtggtggctcatgcctgtaatcccagcactctgggaggccgagaaaggtggatcacgagatcaggagattgagaccatcctggctaacatggtgaaaccccgtctctactaaaaatacaaaaaaaaaaaaagttagccaggcgtggtggtgggtgcctgtagtcccagcttcttgggaggctgaggcaggagaatggcgtgaacctgggaggtggcgcttgcagtgagcagagatcgcgccactgcactccagcctgggtgacagagcgagactctgtctccaaaaaaaaaaaaaaaaaaaaaaaaaaaacccaacagcaaaaaaaacagataactaagactttggccctacaatatttacactctgcatggaaaacaacccaccaaatatgttttctgtacttactgaaaaaccaccaactatggttttatattcactgaatacaagtaaattaatgaaacattttcaggacaatcaggcacagattgctattttttctattgagttgagataattatttgggctaataatagaaagaaagtgtgtatccactcctggaaggctgtgtgctgtgctataagagaagctgatgcctctgcttccccatctttgttctgtggagccacacaggcagcctgatacctgggcaaatgcttacctgcccagatccgaagggctggtgcacccagattcgtggctaggttgtgtgcagcacaaattcccgcctctagtttccctgctttcctcttttcctaagaaatcagtacctgagctttttcaaaataactggagaagaaatgaggcagaaagtatctttttaaacacaatcctcattcactcagaaaattgagaaaaaagttctaagtgataattgatgacaacctgtaaaatttttcagcagcttgagtgtctattttctctacaatattgtcatcaactcataaccaaatatcacaaataggcagcataatggcctcattagggcagtttccacagtgacccacaccatcaacaatggcatgcatctgtcatgcatcttcccagaaagtcctaaaattctacaggaaaaacctcttggaaagaaagtttcaaacgttgatgaggtccacccatatagttaatctcttcaggtgagaagctataaacataagacgcttcttcggtttcatccattttgtaaactcatttgctgaaatgttcttcacagtaatatctgtgttcactgcattgtttccaagtatttaaaatccctgaagaagtaagtaatccatgtgttttacgccatttcaacagaaatgtcttaggcaatgtttatctttgctgcttacagatccccaaatgagacagcttgcttcattagtgaaggccccttgaaaaaattctcaaactctccttcggtctaacgcatggttagttattgtacattcattttgcgactttaaaaaggagcaattgcagaggtgtcaagccacaaataacaatgctgtctaacttcgttagaccatgaaaacacatggggttatccttgcaaaaaagcatatgtattgtttaatttattgcagtagcatcttgaatcacatctatcatgagagaatataaaatctttttcatgtttttcacacactgtcataacttattattgttttccattatcttaatattctgctgtctaagagatgtagcccctgggtgacctgaaagtctggtgaagctagtatgatcagggatataataagacagtgaccatctatggaccttggacacaatactagagagcatgatagatgcatgtgggccataatgatgttgatattaatacgctattaattcctctctgactccagtaaatcatctccaccttgtctaggttttgcatttccaaatgcttgccctttctctcttaataattctccttaatatcccacattcctttaacctgaggtggaaaactcataagtggggagggaaatcctaaaactcactaggtgacacaatacactaaagcattccagcttgggtcagcagacatgttacagctgcagactcttatgttttctctctttagaccaaagagtttatctcacactcatcatgtgttggtctgtgagtggccaagacaacattcaatgagcaaccagcaaaccctcccttatgctagaatgcttacttatggggatactaaaaaacactaggtctgttatagttctacttggaaacttcagatgccttttcttctaactctgaaattttaataagatggaagaagcactttctgcataattgtttatttaaaactaaatgcaattccaacccagaagaggcctcttttggataagactagccaagttacagatgaagacaacagggtcttagctgtcagtgagatagccctctttgatcttgggaaattctgaaggaatttctcatttcaaaataagaataaatacttttgggtaaagggaggagagaaaattcttcaggtcaccttccattttttccttataaacaaattacaatcagttgacctcagcctagcattttgattaaaaataactcaagataggactgaaagaaaacaccaagaagagagttttatcctaatcttagaaaggcatattcatatgacaaccagcataagaagcaaggaatctgaattacagaaaaataaactttaaactgaaactgctaatataataaatgcagaggagacacagggcagcaaatgcataaataaatgtatgtctttagccagtatgtgaatgatacccaaaacggctggttttccatctcaaacagtcatggaataacaacttcacagtgtttattaattgttgaaattgtctaaaataagagattatattttcacaaattcatttgacacagacacagctataagcacatgagaagacaggcctaaggaaaaaggtaaaattaattcacctatgtctgtatttgtcaactaaacaaagcatcgatccatttattataaagtataataaaactaaggacaaccattgcataattaaattgcctctgaaagccaattattgattatggagaaaaccaagttttacaactgtatgtgtgtatcatataaagatttcatttcctaatacagatcattcattattcattttgaaatgttaagaatttactatgtgccagtgtatcgtttgaagtctcatattttaaacattttaaactataggttaattttctgaaattttcgattagtgtcagaagaagttacagaaaaaggaataacaaacatgtttaaataattaaatggtttcaatggcatctcggaatttctttgatattattatcaaaatgttttcttcaattctactcaaaaccttatttttttgccctaagtctttgtcagcttatttcagtcttatttttacatgtaatataccacagagttcttcttagcttcaagtgatgcaatgtgaaaggtgtagaaatgcacactgacccttagcctcttaaatttacaacaggtcggccaggcgcggtggctcacgcctttcggaggccgaggcgggcagaccacgaggtcaggagattgagaccatctgggccagcatggtgaaacccctcctctactaaaaatacaaaaattagcctggtgtggtggcgggcacctgcagtcccagctactcgggaggctgaggcaggtgaatcacttgagcccaggaggtggagcttgcagtgagccgagattgcaccactgcactccagcctggcaacacagcaagactccatctcgataaataaataaataaataaataaataaataaataaatttacaacaggtcactttatcctcaaattagccaataccatgttagaggttatactgaaattctaactatgaagatgtagaaagcaaaaacatatttaattagttataatccaatctgtgcaatattcatgataatacatttttacaagttgaaagtaattctggattatgcttcataacttatgaaacctttggtggaaaaactgagtcttccccattaaagggaattaaataagttgcttataaaagtgcattaacttgtttggcccatgggttcatcatttagtggcatggaagaactagtttacttgtggtatccaagaggcatgaagaaagacacctccaaaaagtccattttgattctttacactgggacagacgggatgcatagctaccttgttcccctctcacccctcaggctaaggcttgagtaactatcgcagctgtttccatggcgtcttcccatcacatgggtacaaggcactgggctgcacaacagggaaactacttgttttctgcctgttaatttttagctctgagatctttacactccactggagaaaggctttaatgtctgagacagggggtcattatttgttagtttaattatttatgatcagaacatttgttcagtcactcttccatagaccattctgaatctaataaaggataataaaacactagagataatctatagccttcaataaatcactcccaatttggaactcctttgatgaatactccaggctaccatgagggagaagaaaaaagtcaaaaccaattaaaaaaagcaacaacaatgaatttgtaataaactcagttgatagctaactaaagtaagcctgtttttctaacttcattaacatgaaaataaattttattaagattgatatcatgcttttttgcacgaggagttacaggaacatgaactaagaataaaaatgatccctatgataaagaatcctcataatcatgtactttagtacaaaatatgatttgacatcaagaagagctatggcttgagattgctcttgttttcctttaccccctgtgcccaggcttagtcactgtttcagtgataatgaccatccactgaggctctgcagcaatagaatctaaagtaacaaaacagagcccatatctctgcaacaaatgaaatcacagacttaagaaacataaacagaaaaacaaaaagttaagttgttcatgtttcatagccatactgcctataacaaatgccagaacatatttatttggtccaatgtgcaatgcattaaatgtgctcaaatacagaaaacaccaagaaatgcaacagggagttaaaaaaaaaaaaaaggctgggcgcggttacaggctcacgcctataatcctatcacttcaggaggccgaggtggatggatcaggaggtgaggagatccagaccaccttggctaacatggtgaaaccccgtatctactaaaaaaaaaaaaaaatacaaaaaattagtcgggcctggtggcgggtgcctgtagtcccagctacttgggaggctgaggcaggagaatggcgtgaacccaggaggcagagcttgcggtgagctgagattgcaccaccgcactccagcctgggtgacagattttgtccgtatctgcagaggaaatgggaaaagccaaaaggaggggcgacaactgatgctatggggaggagctttacattcaaatgaggacacctcctggcatctccggatggagctccgaattcattacagtattacttaaaggattttattaaaagaccaaaccacactgcacttgtggttgaatgcctttatcagagatgaatcttacatgtgttaggacaggctgacagtggctcccaaagatatgtctatgccccaatcccgggaccctgtgaaggttacttcagaaggtaaggttctccagatgtgatcaaagaccctgagacgaggaaattatcttgaattatctggctgggtcttaaataccatcagaactgcccttgtaagagagataaaggtgaggatgaacagagccccacacaaaagaatagtcacagtggagcatgaataaaccattttacatggttatttctctacagtggatgctaaggagagaatcaagtccgccataataagaaataaactaagagttgtagttaaaacataataaaaatctttttagacgcttctttactttgccaattttctcatccaaatagggataattaaataatctgggacaacaaaatgtatactgtggcagaacaaaagaatccaaggtaaaaaaaaggacatgacagaatctaaggtcttcgataaataatactcagatattgcaaggggtatacaaagagttcaaacactgtcaaagtcaggtgtgacatgttcaaggcacacaaagatcgtaccaagggaaacccagcaggaccagaaagccgaagtgatcaacttattcctgtcaaatacattcttggagtttcaaatgtgaacaaatatgcttattctgaattttacttccttctgcaaagtaataatcaattataattataattataattattttgttaaatgaattataattattttgttaaatgaaaatccaatgagagtcaccaaggagcaatacaaggaaaaaggcagactcaccatctcttcgattaagccttgaaaaccccgggccgtggctgctggacagctctgaggagctgctgaaggatgacctaggcaaggcagaggccagtggggcatcacagtcagctgccgggaaaaataccgtgatatggttaacactcagattgcagcttgggagaaataatagtccaaaaatatatatgaatatattctaggatgtatggcaatcatcactccttttttaattttttacaatttttaaaatttacattgcagtataatttacagagagtaaaattccagagaatttatttgatgtttttaaagtgtacagctctattcattttgacaaatgcattcagccttgtaacctccaccataatgaagacataaaacaggtccattagccctcaaagttccctaatgtcccacattttctcaattctgcaagatgtctgggtacatcacccatccaacactactttaaactcaatttgatgcttaggttctttaggtacacacacacagaggtagtgtgaattgtgtgcccaaacctcaatagcggctagaaattctcacagtgccccagcacagaacctgtgggggatgggaaaagtgaaatgcaccaggtgttcaggtcagagttacctgcgtgaagccaggacccatgaaaggcaacacctgtagtgatgaactggaaaaagcccactctgtagacccctccagagggaatcactgcgggctacttgcctacaggagatggaggctcctcctttttgcctgataacttgagcattgcaggaacttgctctgcctttccaaatcacgctagaccagagggtttctggcttgctgcacttccctaggcttgttgatttagtctcggcgattagctctgcctaggttcctctctccccactctatggtcttgatttgtcccctgacccctgcctggcatcactcttagcttcccacttctccttgacaagtattcccagcatgctttgtgattcccagcatggtgcctatgaagggtttgggacagaaaccatttcttagtattatgttcatgaaagacagcagaagattaaaattagcctaagggcttcctgtatacaaatcaacattgcattcacagatgtgctagtttacgacaatttttaccacatgaatatgaaatgattaaaaaatcaatttgaggaattgcccttacctaagacagagatgatatacttttcaaaacagcatttcatttgagtatgttaattcttgcacttatttaataaaagtgtattgagcacctaccatgtgcaaagcattatggggcataaagagagacatggttctaggttcaagaagtccagaatctaacatgggagggagatgtgtaaatatctgttataggaaataaacagaagagcaaaatatttagatactactatttattccaaaacacagggaagcatcttaattgcttaggaacaaaaccagcctctgaaagagcaaacactactagggagagatgcgtataaaagtgcttctggaaaagataaacataaaccatgcattttcaaacagcaattcattattctgggatctgataataagaatgaaaaaaaaaagaatgcatgtataatacatggacagattttgtccgtatctgcagaggaaatgggaaaagccaaaaggaggggtgacaactgatgctatggggaggagctttacattcaaatgaggacacctcctggcatctccggatggagctccgaattcattacagtattacttaaaggattttattaaaagaccaaaccacactgcacttgtggttgaatgcctttatcagagatgaatcttacatgtgttaggacaggctgacagtggctcccaaagatatgtctatgccccaatcccgggaccctgtgaaggttacttcagaaggtaaggttctccagatgtgatcaaagaccctgagacgaggaaattatcttgaattatctggctgggtcttaaataccatcagaactgcccttgtaagagagataaaggtgaggatgaacagagccccacacaaaagagaagagggtgtgaaaatggagtgaggcacccacaaggtgaggcacacgggcaaccacaggaagccggaagaaacgaagaatggatgtccccctagagcctccgtagggagtgtggcccatcttgattttggactagggatactgatgcggaacttctggtctccagactatgacagaataaattcttttgctttaagtcagccagtttatggtcaattctcacaagggccataggaaatgaacacactgtttatatggaattacatattggatattttaggggaaatgcaggagagttccaacgaaaatacgattaacatccctttgaatcacacagatactcaattccttctcagaagggcttcgtgatgctaagccactctgccaggctgtggctctccccatgcttgtggctgcacttgctcctcactgtgaaaggagctaaccactgtgttggcggaacctaaggatggaaggagaggggaaggggccaccgaactgctaatatgaggggacggcaccttaaccaccttcgaattatcagaaaaacacaaagcctactattaaagagttcaacagatggttactgtgttatcacagatgtatagaaaacctctttgttctaaaaaaaaaaaaaaaagaaaaaaaaagattcctgtcctttctcagactgtctcgattaggtcaaattcactaactccacagcaggcttctctctggttccacatattgagtcagtagggagcacggcctcgggaatcgaatcacaaacagggaagggggtgcccataccttcttcaggccacgtctggatgttcatctggatacggcgctattccattcttcccatttcatcacctgtcttttcagttcttaatgtaccttaacattatcttaatgagaggttaaataaagcttttatttagaaggtaccaaaagttcatcttgttatgaatctgaattgatctgtgcattgctatctagagggaatgcttcggaaaaagcacattttactcacagtgaacataagcagtaatggtcaatgtaaaaatctacttttttccatataaaaacttctgttttacatggtcttgatctccattcgattatcttcagtcactgtcttccctacatctcactccatggggtctgaagggggctcaccctaccacctggggccagcacagggacacgcctcaggcctggcaactgaatgccatgcctgtcctactggaaaggactggttccaggatggtcaggaagcccatgctgaatgaatgggaacagaacctgggactttcgaatgaataacagcagaacctgggactttcggcttgaactcttgggagaaatacccattcattcattcaacaaatatttgttgaaaatctatactgtgccaggtgtgcccctatgttctggggatataaccataaacaacagaaaaagtctctgctcctgtgaagcttatcctactgagtagaataaacaaataaaggcataatatctgtagaactcaacattgctaagaacagaaataaaggaaaacagtcacgcttctaagctggtaaacggtatgcctgaagctatggcatagacagagctgcccaagaatgaggccagttgtagacgaaaataaaactgcaagaaggaaagaggcagactgctgatgaaagaatctgattgcctaaattcagcctggcttcaatcaagacactttggttccctttattgttcaagtctatttgatcttagattctggtcacctgaaactgaaaaatgctcaataagtacactgtcctgagcccccacccttatcttccctctacagccaataaattgccaaggattatgtactttttgtgtgtatatggcagcttttccattatcatgatcatcatctcactgtaggtcctcatgttaacgacctaactaatccttacagccaatgcttccttattgactgtccccagccacacacacaccttacgtatcaccagagcagaaacggttttaaactattgctgagtgcaagtcacacaaacagccatatcaaccagctccaatggatccccactgcacctgtcctgaaattcaaatttcaggtcctggcattcaattccttccatcgcctgtttcctgtcactctctgcactacagccaaatcccctacacatttctcagatgtgcttcctcctttaatcggagtggtcttctcactgtttcctgaatgtgggatgcatgcaccaacgctccttgaccgctcacccgatgacattgcagcccctcctgtctgcgagttcccatcacttattatcttcagggctcaactcaagttttgtctctgctctgaaggcttctcacatgtgtgaaggccccagtaaggcttactcttctgaaatactgaggtctgtctcatggaaaatgaattacacctctggagaaggagcagcacctcactcacggggagccacacagcagccacgtgtggcggcagatggggatgagagggaacaggagaacctcactcccgagaaaggagccttgcctgctgactgatgattctggggtgaggaagagaggctggcatgaccagctgatgagtgtctggttcccgggacatgacagacaattcctacagtctacctgtgggaacagatgaggcctggaagaagacacatagaaacaggtttaaattctataaattagaatttacagggggtaggagataggggttacacgttgtctctccttccagatgatattttgacttgttaaagaaaacctagcataggaacattgaatacctcctgacattggtgttttcaagtgacttacagcactacaaatataaagttataacaacagcataccaattttaacataccaggaccaaggactttattctatgagaactacaaaagacacaacacaaatgaagacctagaggaaagtttacatagttttttttttttttttttttttgagacggagccttgccctgttgcccaggctaatttttttttgtatttttagtagacacggggtttcaccatgttagccaggatggtatcgatctcctgacctcgtgacccgcctgcctcagcctcccaaagtgctgggattacaggcgtgagccaccatgcccgctcaagtttacataaatttaagcatcttaatttgatgatctactctacagtcattacaacaataaatataagaactatttaaacatgtggagagatgaaggagatgggatgggaaaatctgcatatgagaagataatggacaaagagatctgctggattgagatgagataatgggtgttaaatccaacaaacacagctctggaaacacagaagggattaaacatagatcagctccttttccctgaggaagctgaatagatgatcttgttctctttccttttatttctaaatttcttgctatgtagttaaattatacttctgtgataaattcaatacctatttttaaactatagatttttggctaaagtatataatatgagaataagatgaacctatttttttgagacttactgctaagtagaaagagaggaaaccaaataacaaaattaagtcctgcagaaagacatcagacacgacacagaaaaaaatacaacaacacaggtgcatataatttaaaaagaaaatcatgtggagatgtcatcactaataattgttattacgaatgtatccacagctgtgggaatataagtgataaagatgagctgctaataaagggcaataaatgatctttccacgggtacaaaaaaatagaaaaaatgaataacacccagtatttgataacacaagaggtgactatagtcaataattacttaattgtacatttttaaataacttaaagagtgtaattggattgtttgcaactcaaaggataattgcgtgaggggatggatactccatttttcttgatgcacttatttcacattgcatgcctgtatcaaaacatctcatgtagcccatcgatatatacacctactatgtaaccacaaaattaaaagctaaaaaaattaaaaataataataattctttctatgcacctctgagagttgacagaactagcgtctgaatgagaatgtaaggtatgagaaggatatggcttcttcccaagacatgttacagagggatggaaagaagactgtgttcaacttataacatcttaaagggacgtcatgacctcacaggccagagcaggctacggagcatctgggagctgaagaaagagaacttcagtgatacttaagtaagggttaagagatgcactccaattgcattctgaagacagatcccaacaagaccaatgacatcagctagatttttttcagcccaaagtaatatacctgcaaattatcagaacttgttcactactccgtacttggctctaatatgattagtaagggggcagtgtcagaatccttgagaaaataataaccagaacatcttagaatttattgtgcccaaggaaggagccctgtcaatagacaaatgtttatttgagatgtcaaaaagataattttaaaactttaggaaaacagcaggcattatcccatggcaatatgttttatgtccaaatttcaactctattatttcaagctatgtgtgtgactttagaggcagctttgacttcaattttttaacttaaaaagataagagtatttagaacacaatgggaaatgttacataatactaccttgtagacctccgagcaaccactatacaaagagacactgttgttatgattgaggacaacatcgttcatcaaatgtgaaaagctacccaaatgaaatccagaaaaaacatgttccactgaagaagagagaaatgggcaaagtaaccaaggaaagaatatttacagtgaggctgggcacagtggccaagatgggcggatcacaaggtcaggagtttgagacgagcctggccaacatggtgaaacttcatctctagtaaaaatacaaaaattagctgggcatggtagcgggaacttgcaatcccagctactcgggaggctgaggcaggagaatcactggaacccaggaggcggaggttgcagtgagccaagattgtgccactgctctccagcctaggtgacagagcaagactccataccggaaaaaaaaaaaggaatacttacaatgaaaaggaacattaaaaggaggcaatataaagcaaagtaagttaaagcccagaacaaattaagactttcaaacattgctaaatgcaatcaaagagatatttgtatactcataagaaaaaccagaagaagctgcactctcttgacaaagctcataaggctaagaaaatagacaggtctggatccaagatggtcgaataggaacagctccagtctacagctcccagcatggatgatgcagaagacaggtgatttctgaatttccgactgagctttggtgacagtagtggttctcccagcatggagtttgagatctgagaatggaaagactgcctccttaagtgggtccctgacccctgagtagcctaactgggagacacctcccagtaggggctgactgacaccgcatacagccaggtgcccctctgagacgaagcttccagaggaagaatcagacagtaacatttgccattctgcaatatttgctgttctgcagcctccgctggtgatgcccaggcaaacagggtctggactggacctccagcaaactccaacagacctacagctgagggtcctgactcttagaaggaaaactaacaaacagaaaggacaaccacacaaaaccccatctgtacgtcaccaccatcaaagaccaaaggtacataaaaccacaaagatggggagaaaccagagcagaaaagctgaaaattctaaaaatcagagcacctcttctcctccaaaggaacgcaactcctcgccagcaacggaacaaagctggatggagaatgactttgacgagttgagagaagaaggtttcagatgatcggtaataacaaacttctccgagctaaaggaggatgttcgaacccatcgcaaagaagctaaaaaccttgaaaaaggattagacgaatggctaactagaataaacagcgtagagaagaccttaaatgacctgatggagctgaaaaccacgagaactacatgacacatgcacaagcttcagtagccaattcgatcaactggaagaaagggtatcagtgattgaagatcaaatgaatgaaatgaagcgagaaaagaagtttagggaaaaaagagtaaaaagaaacgaacaaagcctccaagaaatatgtgactgtgaaaagaccaaatctacgtctgattggtgtaactgaaagtgacagggagaaaggaaccaagttggaaaacactctgcaggatattatccaggagaacttccccaacctagcaaggcaggccaacattcaaattcaggaaatacagagaatgccacaaagatactcctcgagaagaccaactccaagacacataattgtcagattccccaaagttgaaatgaaggaaaaaatgttaagggcagccagagagaaaggtcgggttactcacaaagggaagcccatcagactaacagtggatctctcggcagaaactctacaagccagaagagagtgggggccaatattcaacattctgaaagaaaagaattttcaacccagaatttcacatccagccaaactaagcttcataactgaaggagaaataaaatcctttacagacaagcaaatgctgagagattttgtcaccaccaggcctgccttacaagagctcctgaaggaagcactaaacatggaaaggaacaaccagtaccagccaccgcaaaaacatgccaaattgtaaagactatcaaggctaggaagaaactgcatcaactaatgagcaaaataaccagctaacatcataatgacaggatcaaattcacacataacaatattaaccttaaatgtaaataggctaaatcctccaattaaaagacacagagtggcaaattggataaaaagtcaagacccatcagtgtgctgtactcagcagaccctgctcacgtgcagagacacacataggctcaaaataaaggtatggaggaaggtctgccaagcaaagggaaaacaaaaaaaaagcaggggctggaatcctagtctctgataaaacagactttaaaccaacaaagatcaaaagagacaaagaaggccattacataatggtaaagggatcaattcaacaagaagagttaaatatcctaaatatatacgcacccagtacaggagcacccagactcataaagcaagtccttagagacgtacaaacagacttagacttccacacaataataatgggagactttaacacaccactgtcaacaacagacagatcaacgagacagaaagttaaaaaggatatccaggaattgaactcagctctgcaccaagcagacctaatagacatctacagaactctccaccccaaatcaacagaatatatattcttcttagcaccacatcacacttactccaaaattgaccacatagttggaagtaaagcactcctcggcaaatgtaaaagaacagaaattataacaaactgtctctcagaccacagtgcaatcaaactagaactcaggattaagaaactcactcaaaaccgctcgactacatggaaactgaacaacctgctcctgaatgactactgggtacattgagaaatgaaggcagaaataaagatgttctttgaaaccaacgagaacaaacacacaacataccagaatctctgggacacatttaaagcagtgtgtagagggaaatttatagcactaaatgcccacaagagaaagcaggaaagatctaaaattgacaccctaacatcacaattaaaagaaccagagaagcaagagcaaacgcattcaaaagctagcagaaggcaagaaataactaagatcagagcagaactgaaggaaatagagacacaaaaaaacccttcaaaaaatcaatgaatccaagagctggtttttttgaaaagatcatcaaaattgatagaccgctagcaagactaataaagaagaaaagagagaagaatcaaatagacataataaaaaatgacaaaggggatatcaccaccaatcccacagaaatacaaactaccatcagagaatactataaacacctctacgcaaataaactagaaaatctagaagaaatggataaattcctcaacacatacatcctcccaagactaaaccaggaagaagatgaatctctgaatagaccaataacaggctctgaaattgaggtaataagtaatagcttaccaaccaaaaaaagtccaggaccagatggattcacaagcccaattctaccagaggtacaaggaggaactggtaccattccttctgaaactattccaatcaacagaaaaagagggaatcctccctaactcattttatgaggccagcatcatcctgataccaaagcctggcagagacaaaaccaaaaaagagaattttagaccaatatccttgatgaacattgatgcaaaaatcctcaataaaatactggcaaaccgaatgcagcaacacatcaaaaagcttatccaccatgatcaagtgggcttcagccctgggacgcaaggctggttcaacatacgaaaatcaataaacgtaatccagcatatacacagaaccaaagacaaaaacctcatgattatctcaatagatgcagaaaaggcctttgacaaaattcaaagacgcttcatgctaaaaactctcaacaaattaggtattgatggcacctatctcaaaataataagagctatctatgacaaacccacagccaatatcatactgaatggacaaaaactggaagcattccctttgaaaactggcacaagacaggatgccctctctcatcactcctattcaacatagtgttggaagtcctggccagggcaatcaggcaggagaaggaaataaagggcattcaattaggaaaagaggaagtcaaattgtccctgtttgcagatgacatgattgtatatctagaaaaccccatcgtctcagcccaaaatctccttaacctgataagcaacttcagcaaaatctcaaattcaagattttgtatcttgatttgatacaaaatcaatgtgcaaaaatcacaagcattcttatacaccaatagcagacaaacagagagccaaatcatgagtgaactcccattcacaattgcttcaaagaggataaaatacctaggaatccaacttacaagggatgtgaaggacctcttcaaggagaactacaaaccactgctcaaggaaataaaagaggatacaaacaaacgaaagaacattccatgctcatgggtaggaagaatcagtatcatgaaaatggccatactgcccaaggtaatttatagattcaatgccatccccatcaagctaccaatgactttattcacagaattggaaaaaactactttaaagttcatttggaaccaaaaaagagcccgcattgccaagtcaatcctaagccaaaagaacaaacctggaggcatcacactacctgacttcaaactatactacaaggctacagtaaccaaaacagcatggtactggtaccaaaacagagatatagaacagaacagaacagagccctcagaaataatgccgcatatctacaactatctgatctttgagaaacctgacaaaaataagcattggggaaaggattccctatttaataaacggtgctgggaaaactggctagccataagtagaaagctgaaactggatcccttccttacaccttatacaaaaattaattcaagatggattaaagacttaaatgttagacctaaaaccataaaaaccctagaagaaaacctaggcaataccattcaggacacagtcatgggcaaggacttcatgtctaaaacaccaaaagcaatggcaactaaagccaaaattgacaaatgggatctaattaaactaaagagcttctacagagcaaaagaaactacaatcagagtgaacaggcaacctacagaatgggaggaaatttttgcaacctactcatctgacaaagggctaatatccagaatctacaatgaactcaaacaaatttacaagaaaaaaaccaacaatcccatcaaaaagtgggcaaaggatatgaacagacacttctcaaaagaagacatccatgcagccaaaaaacacatgaaaaaatgctcatcaccactggcaatcaaatgcaaatcaaaaaccacaatgagataccatctcacaccagttagaatgacaatcattaaaaagtcaggaaacaacaggtgctggagaggatgtggagaaataggaacacttttacactgttggtgggactgtaaactagtacaaccattgtggaagtcggtgtggcaattcctcagggatctagaactagaaataccatttgacccagccatcccattactgggtatatacccaaaggattataaatcatgctgctataaagacacatgcacacgtatgtttattgcagcactattcacaataacaagacttggaaccaacccaaatgtcaatcaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccacatgttctcactcataggtgggaactgaacaatgagaacacatggacacaggaaggggaacattacacaacggggactgtcgtggggtgggggtacgggggagggatagcattaggagatatacctaatgctaaatgactagttaatgggtgcagcacaccaacatggcacatgtatacatatgtaacaaacctgcacgttgtgcacatgtaccctataacttaaagtataataataataaaataataaaaaattaaaaagttcagtgttcgagttctctgtctcttggcctctgtgatgcctgcagaaacccagtcgcaacccattcattcatattcctctccttagagccaggagttagcgccccaagggcagtgctgaatccctggacaggacttgggataaatgcattccccctgctgtctctcagaggcacagctgtgaaacacattctaccggcttcctgagagcttcccagggagttcatgccccagttgctcacagaagtgaccagctcaatgacacccccttttggtggatttttcttctctattccattcttccctcttttatgagctcactttctaaaagaggctacctgcacaaacgcccatcacaggctcagctgtctaagaaaactctggctgggagagtggactttccagaatggaatgtgggcagtattctaaaatactaaataaaatgcaacaggaaaatcaaagggatgaacgtcacatggcataaagaaggaggtagaggacatctgcctagccttccaagaacaaaacaaattgacaatcaaccctggccacccaggagatgagctttgtcacagcaattcttcctcatatcccagaaaagagaagaagaaatgaggacagtagaatcaactgtgacatccaaaaaaggctgcccaatctcttctctagaatgtgtcaactgtgatttatgaaataacatatgctatttttatattgcaatgtttgcttatctataggtaagagctcactatttcttatatcatgttataattatattcatgaagaagatgaccattgcacagacaagtacactgtgaagaaccgtgaggagagattttaccctacttgcaagctaacaaatgagtctgccagtttgtttcatcgttgcggcagaagactcctgggtcaaagcaaaggactgtattacttacagcatagcaaacaatatgagcatcagcatatttgcatcaatttccttgcctccaagtcctctgggggaatatggatgggcacagatggatgtgtgcacacgcagtgggttacatgacaagtgaggagccctgagcttagggaattcaaagttttctacgggcagcaggcattgcttgccctttggcaacactgctgaaataaatctcttatggttcaagatgtattgataagcatgttaagcttatttttatacatgaagaacaacaaattgttattttctatggttattcacagtatctcaaaatctatgtgatattttactagcttagttttattataattttaaaagaccatttgggttcctttgttagtggacaagaataaaaagagataaattagttactttcttaaagctaagcaacatcattttctattgaggaacccaaaactttcctaacttttacaaatgtttgtaaattgtaggttctgtgacagcctgtgctataaaatttcataagcttataagagctttcttaacacagctgtggacttttctcctggtgttgtacagcagttcaaattagctcaagaatcataaaccctatatttgaacagctatataatattatatatttattttcccatttgatgttgcattactttttctaccaatcttcttacaataaattcataaatatcttaattatagcaaatgtgaagttcttaaagatgagaatcatcaaacatatttctattacagagatatattcttcaaaaagtcatctaaaatagaaacccaactgggagacaccttaaaaggttatctgccacaacagaagctttgcttaaaatactgttctctttgtatttgtgttaataattgatttgtctttgaaattaaattaggaatctactatatctagtggtcttgaaatcaaagccccctccccattccttatcttcactgctgtgttcaaaaagactagactccagggacgtgtccaaagctgggttaaatataggatgcctgagagacacccttctttcatagttcgagggtaagcatgtagctgtatgtgtgtggaggggcgggtggaggaggttagctgtatcagggtaggcataatactatattttaaatccctccttctgttataaatgtaagctgaaaatagtctctgctcccagcggcagcaatcgtaaactcgcttagttctgcctgtaatttaatttaatttaacatgtgacattgagacaatgtttcttttaattcacatataacttcttcctcacccacattccagccaaataaacacatacttatagaaaaatgtgactgttttcctgggcatcccaacaattcaactgtccctaaaacaccaggttcaatttaaactctattagcttgtctgagggctaagatatctaaaaatccaagacaaattatcatttgcgtatatggaggcagctctgattgaacagatatctaaaacggttaggtaatattttagatcaaatcactccatcaagtcaaagactaattcaactgtttgttcagtttccaaaggaatccttccattttggtctagtgttccataaacattgactttacatgaaaaggacagtgaagagatctcttgaaccggccagaaagttgaagctcaaggttgtagaagatttgagctaccaagtccaagccttctaaaagattcccaatatgtatatatatcattttcctaactctacatttgcctgagaaacaatgacattcaataaacttttttccatgggatttagttacaaaataagtcaaggaactacaagttatatatttcctggaaaaatatactattatatatatatattatatattcaaaactccgtaaagcatataaagtataagcatatactgagttataaggcataactcaacatgttattttaacctaaaattttcttagggcctcaattgcaaatgctttaattgccaatggttcataaacacatctgtgaattagaagcaagtaatatcctctgtttttatactctcaaaaaatgtgattatacttaatcaaaagtaattcaaaccacagcccaggcaatacatactagaccatgtcttcttggtaatttaattcttagcaataattttaattgctgccttattaagtaggtatgctacttaaattacaatcctgtagttataaggttaaaactattttaaaatctcaaatgtttttagatttcaatcactcttcgtattattacaacaaaaatgttcattaactggaacacatgcagtatcattttttagcccccactttatgatattttttaatttttattaccagagtagtcatttcattataaaattttaaccaagctaagcatatactccattttttagaaaactagatttactgtagtcctgttaaggctatcatagtaagcaatgaatttcacacttgtcttttatacagtacaacacatcaagcagatatatgaaatccttgacaaaagacatttaaaacaaacaattccatgctttatatgtcaagtgaaaaggaatattttttctacagtgacagagcagacttgacatgtgcacaatcatgtacaaccaagcgtttgcaaatgctcttacaacgtggagcaaccgggcctagggacaagcaacctttcagctaagagtctcgtcaaaggtgcggaagcccattacagaagaccagataacagtcagtctgacgggttcattcagatattcaagctttaaaaagtactttgaagactgatacagatgtcctaggcaataaacttcccgaaaagaatggggaacaatcccagtgccaatcacatctttgtcattcagaaatccaggctaatttgatttagagacatacataaatgaactgttatttctcataactgtttttttttcagcctctttatttttaatctacatctcttaggtaaaatgcatcaatttaactacatttacttattctgagtttttctattggtccatgtttcctttaaacacaattttgaatggttttttaaagtaaccatttgattttgaaaccaatttacagaaaacatggaagaactacgctaatatgctgtatcacccctgaatacttcaatgtacatttcctacaacaaagatgttctcctatataaccataatatgatcatcccagtcatcatggataaagttccaatatttaatccccaatcttgttcaagttgcaccaattcccaatcatgtcctttataacataagcatttaatgcagagtagtatttagttgccttgttttcttagcctccgtcaatctggaatgcctccttcctcactccactcaacctctgacaacttgctataggtcaccaccagtgctgtctcctgtctctccaggtccccacccttgctacactgtggatgctttccttaccctgctggtttctgaatgctctgccacggtcctgggcctccccactacccagcatggatgcctaagctgaactgaatgaccttggactgaattgttcaaaaagagaaggggagaggaagaggaagaagaacgccaagtaatttgatttttcttttttcatgatcaaaccaatgtcttggaattgattatcacttccatgggctacttatgctccgtactgtttgtatagagtttggtgaaaatgaataaaggcaactgaactacattttttggttttttttttgagacagagtctcactctgtcacccaggctggagtgcagtggcacgatctcagctcactgcctcctcacaggcacctgccaccatgccctgaaattttttcatatttttagtagagacggggtttcaccgtgttgtccagcctggtttcgaactcccgacctcaactgatccacccacctcagcctcccaaagtgctgggattacaggtgtgagccaccgcgcctggcctgaactccattttttatagagtaccatttgacactaaaattaagagtctgttactcatctgcagaatctctctttaaatggtattactaaaaggtccaaaatgaaacatctgtaaaaataattattcctacactctgtgagatctctttcctgacacatttcacatctaagtgagtttcctaactaacccacacacactctatagtaggcttacccttctttccccaggctggctggcgaacttgcaaaacataaccatttaggggaaaaaattgaggcaattaaaattaaaagtgttttaggctaagtaatgaataaattaacccactgaaaagttacatcaaaggctattactcagcattttaccagttacaggaatttctgcaaaatctgcccagccatttgtttgtgtatccctgggatcagtgcccagcgttcaatctttctcttgatgcttcctgctgttttcagggactcaatgagagcagtaagtgacctttcactcactgcaagtctatgggcactgaagttaggaaaatatttcccttcatgcagaatcttcctaacaaagctttcccatgtatttgtcgggtcaaataacattcagataaactgcacataatccccaaaatgccaaatgtttagaaagctttttttttttgagacagagttttgtgttttcctcttgttgcccaggctggagtgctatggtgggatctcggctcactgcaacctccatctcccaggttcaagcgattctcctgcctcagcctcccgagaagctgggattacagatgcctgccaccacgcccggctaatttttgtatttttagtagagacagggtttcaccatggtggccaagctggtctccaactcctgacctcaggtgatccacccacctcggcctcccaaagtgctgggattacagacgcgagccactgtgcccggcctatagagctcttcccatgaagagccatttcatgccatcatcaacaggttgccttcgtgggtggccaatgtgcttctcgaaaaccagctgtgaataacgtgagcaactcatggtgtctacatgagaaggaaacttttagatgtccttattgactttcttcttggtattgaaggtggtataattattacagttacatagttttatctggaagaattacttgatctaaaaggtaatttaaaattagtaaaatttattagatatgaggatactaagtttcatcaacgaaagaagactgaaaacacccacagtagtagtattgaaatttcacgtgtcactcagcaactcgcgagagtcccgtctggtgctgagtccatttggaatatctgtccctgccctcccctcctccaaaaagaatgttcactataaacgagaagagcttaatttctatgggctttgtaatccttccactggattccaagcaaaataactaccaatacaactaatcctgagaataaaaagtaatcacaactatgcaacaaaaacaggaaaggtggtggcagggtctcactcagatttcattgctttgcttttctccaggaaggtctttttgaagccctgtttattcaatagtaagagtgacctctagtgactttttttgttgttgtattttgccagttgattggtcaattactctagcatgcctttctataagtagctcatttatatgtttgtttaagccaaacggcagtttccattacaagacccaaggattttgatttaagtaacaacgttttattcacaaagccttctcacaaaagcagattaaagttgaatctgaaacacggtacagcatctgaccaaaggaatccggagcttgttttttggaagggcacaccaagtgtaggattaactgaggcgcaactgaatcatgatgcacagtgagttcatgaacccatgtgcgtgccctgtgtgtgaagaaccaacccacccttgagcccgcgggcagaacagcactgagctacggcaaacttttcatgacagcttaggagaactgctgaaagctacccttggttatcctgcaataatctaaatttccaaacatggccactggcgtttattggaacttatttcgaaagagattttggtaggagagggctgaggctgacagcggggagatgccactgaaagaaaaataaaagtgatttgagaaggaagaggaagacattttaaaaattctaatctcatggtttgattaatcaagaaagaaagacaactctctgctagagatttactccaagccaaaaaaaaaatgtgcaatgttgtgtaaacatttttatgtgtgataaaatatgggtacattatgttttgctcatctgtctggaatatcatcattacattagaatcatagcccattctagaaataaaggcttcctaggtgtttaccaaattaaggaaaataaaaaacagggaacctgatggcaaattaaataatgtaaaatattagcatccagagaggaatcattttcaagatcacctaaatgactggctgagttttgtctttaagcaagaactttctactatgagaaacgaagcccctgacaggggtgttcaagtgttattcccttagtagttaggacaggttattaatttagtttcacctacaggcgctctgtccctatactgcatggaagttaattagcattttaactctgaagctgccaaggtcggcaaaactgtaagctgctaacatctaagttgatgcagtatgatgtaatgtctgccagttttttccctgttagacttaattcctacaaaatattacaatcctaaaaaggaataaatgacagcatttgcacgctaatctcttattaagatgcttttcaggttttacagaaacgtccactttctcaatgaatattcaagtacatcgattaaaaagtcaaaacatgcatggtatatcttagactcccccacaagaggaaagtctattgtaaacaaaatcgtctttttcgggttgcaattccaaattttttttaaggttcttcatgttcaggagcatgttctgcaattccacttccaaatattaccgataataaaaaaaaaaaaacaaagttttccagacagcctagcgcaagttttaaaccatttgctgtacttacgtggatttcctgctcccacggggctccaagtctgagtggggagaagcagcagcaccttgaggacggcccaggccactgaagccatgctcacttcagccaggcgccctgagacccgggcacggcgacggccgctctgcgtcgctcctgctctcactcccgtcccctgcgcggctctgacgctgctctgcctcccctgtccagtctctagctctcttcctcacgcaccagcagcctccctcggcgctgcagaccctcccgccaagccgcgcccggccccagctgcgtctccgaggtcggccccgcggactcgcgccgcagctttct
